United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 25

SEQ ID NO: 101897 - DNA, 423 bp, Glycine max
  Peptide Sequence Number=SeqID_218675
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcacatctgttaa

SEQ ID NO: 101898 - DNA, 1296 bp, Glycine max
  Peptide Sequence Number=SeqID_218676
atgtggacccatccgcaggaccgctcggtggagttcaattcgctggcgtactggctggatttagcgcgtctgctggagcgcggcctgttcgacggactgttcattgccgatattctcggcgtttacgatgtgtatcagcagggtatcggcctgacggcgcgcgagtccattcagctgccggtgaacgatccgctgatgctgatttccggcatggcaagtgtgacgcagcatctgggctttggcgtgaccgccaatctcagctacgaagccccttatccttttgcccgccgccagtcgacgctcgaccatctgaccaatggccgcatcggctggaacatcgtgaccggctatctcgacagcgcggcgcgcgccatggggcagcagcaactgctggcgcacgatcggcgctacgaccaggccgatgaatttcttgatgtcacttatcagctgtgggaaggcagctggcaggacgatgcgttgctggccgacaaacagcgccggctgtatgccgacgcgcagaagattcacgcgatcaatcatcagggcgaattttatcaggtgcagggctatcacctgagcagcccttcgccgcagcgcacgccgctgctgttccaggcaggctcatccgcgcgcggcgtggcgtttgctgcgcggcacgccgagtgcagtttcgtgaatgccagctcgccggcggcgctgcgcgagcaggcgcagcgtctgcgccacgcggcggtggcggcgggtcgccaggcggacgacttacgcatctttatgggcgtcagcgtgatcgttgccgccagcgaacgcgaagcgcaggagaagcaccgcagctatctggaattcgccagtgccgaagccggcattgcgcacttctccagctcaattggcgtcgatctcgccgcgtttggcctcgatgaaccgattcacagcggcgacacgcgcgccattgaatcggtgagcaaagcctataacggctggacgcgtcgccagctgctggagcagcatgcgctcggcagccgctatccggtgattgtcggcaacccatctcacgtctccgaccagttgatccgctggattgatgaaggtgacatcgacggcttcaatctgacgcgcatcctgaatccgcaaagctaccgcgattttattgagctggtggtgccggaacttcagcagcgcggccgcttcaaaaccgcctatcagccgggatcgctccggcaaaaaatttttcagcagcaggatcgtctgcccgcgcgccacccggccgcgcgctggcggcctgcggctgacgttcgttaa

SEQ ID NO: 101899 - DNA, 959 bp, Glycine max
  Peptide Sequence Number=SeqID_218677
caggcgggcagcagcgcgctggctgttgtgctggccgcctcggtagtgctggcgtttgccggctggctgtatggcatggcgcagcagcgccgctttgccggaaaagggcacaaagcgctgttcagcgtcacggcgatattgctgattgcggtgatcgcgccgctgccggggctgatcaagccaggcgcggcgctgcaaggcgatatgcagacgcaggtcagcaaacagacgtggacgccgcaggcggtggccgctcaacgcgggcatggcaaagcgatctttgtcgattttaccgcatcatggcggtgaaaaccgcactggcgaaaaccggtacgctgtacatggtggcagactcgactaaatttaacccggacgttgatgacgtgatgagtgagtttggtcagggcggtttaccaatgtacctggtgtatccggctgatggcggaccaccgaaagtactgccgcagcgtatgcacacaggcgatagcgcacgtgaaaactggcccggactgatggaacgcgcgcaggccggggatcagtgtgcctatacccggctgctgcgggcgctggtgccggtgatacgcgcgcaggtgcggcgcaggctgagcgatgaagccttaacggaagatgtgattcaggatgtgctgctcacgctgcatcgcgtgcgccatacctacgatcccgcttacccttttctgccctggctgacggcgatagtctcggcgcgcgcgattgatgccctgcgccgccgcggccgccagcagcactgtgcgcttgacgacgcccaggccgccgatcccgccagcacagcagaacagcagcagctggacacccggcaggagctggcgggctatctcagccagctgccgctgcgtcagcgtgaaatcgttgagcatgttcatttgcatgaaatgagcctgaacgaggcggcggcacaccataatctgagcgtgtcggcg

SEQ ID NO: 101900 - DNA, 246 bp, Glycine max
  Peptide Sequence Number=SeqID_218678
atgtatcaatctcacacagtgcgtggcgagaaagtcgctagcgcacaggattttgtcggcaatcaaagggagaggcctactttaggtcgtggtttcctttttcttgtttacttggtttatggtaagttgggattttggctcaaggcttgtagaacggctggtcatgatacatgtcagggtttggccagcggtttggggataaaggggatgtcccacattattcccatgatacacatgcaacaatga

SEQ ID NO: 101901 - DNA, 1488 bp, Glycine max
  Peptide Sequence Number=SeqID_218679
atggtgattatagcaaatataacaagaaatcctgacataaaaaaaattcaagggcaaattgctgagatgttgggaatgagattggaagaggaaactgagattgtaagagcaaaccgcattcgaaagaggataaagaaagaaaaggagaacacccttataatcctagatgatctctgggatggattggacttgaatagattggggattccatccagtgatgatgatgatgatgatgatagaagccaaacggttgtcaaggatatatctgactttggttacaataagatggaaaaccaagagttattttctgtcaatttcaaaatgatgaaaaaagatatgttatttgctgatttcaataagatgaaaaaagaaaagttatctggtgatcacaagggatgcaaaattcttctaacatctagaagtaaagaagtaatatgtaatcaaatggatgtgtcggagacgtcaactttcttggtaggagtcattgatgagaaggaggcagagactttgcttaagaaagtggctggaatacacgttacaaattccatgtttgatgcgaatgctattgaaattgccaaaatgtgtgctggattgcccatagcattagtttccattggaagggctctaaagaataagagttactttgtatgggaggatgtttgtcgacaaattaaaagacaaagttttatagaagcccaagaatctattgagttctctataaaattaagctatgatcatctaaaaaacgaggagctcaagcgtatttttttacaatgtgctagaatgggaagtgatgctttgattatggacttggtgaagttctgtattggtttgggtttgcttcaaggagtccacacaattagagatgccagatatagagtaaatgtgttgatagaagagttgaaagagtcaagtttgttggtggaaaatgagtggcctcatgaagatgaatatgaaaggtacactgctatctttttacactattgtgacatcaatgatgagcttcatgagagtatatattgtcctagacttgaagtcttacacattgacagtaaaaatgaatttttggaaataccagatgatttttttaaagatatgattcgactcagagtattggtattgactggtgttaatctatcattcttaccttcttcaattaaatgcctaaaaaaactaagaatgctttgtttggagagatgcactctaggaaagaacctatcattcattggagagttaaagaaattacgaattcttagtctttcagaatctaatattgaaagtttgcctcttgaatttgggcaattggataagctgcaacttttcgacttaagcaattgctcaaaactaagagtaataccttcgaatatcatatcaagaatgaacattttggaagagttttatatgagagacagcttggttctatgggattctgaacagaaaatccaaagcggaaatgcttgtctttctgagttgaagcatttgaattag

SEQ ID NO: 101902 - DNA, 324 bp, Glycine max
  Peptide Sequence Number=SeqID_218680
atgagccaagtcaggttcatgctgaacttcatccctgaccttgggaaagtgcatcaagcaaggacttatggtaatgacatgaaaccccgacacaaggtgttggagatgcttggggctacgatgatcaatgaataccatgaaacatcaggccaagagataatgacgccaatgctaaaaagacaaagcaatggccataatttccttctcatagacggatttggacaaggtgtaacgagagagggccttgttgcaataattaagcaattggctggcaatcttgctccaacaccactccaatgccatgacctgaagcatcacacttaa

SEQ ID NO: 101903 - DNA, 241 bp, Glycine max
  Peptide Sequence Number=SeqID_218681
atgggatcatcagtggagaatggatgcagttccacgcgcttgaagaacaagaggttgtcgtccacgacagagaaactgggagttggagtaggtgttgaattgatggagggtgtaaaccgcaacctattcttgcgccactctgtgcacatggaaactgtggttttgggtaaagtccgtgatgctgggagcatggacgcaattgtctctacagctaccgaaaatgcacttcaaattggaggag

SEQ ID NO: 101904 - DNA, 672 bp, Glycine max
  Peptide Sequence Number=SeqID_218682
atggagtacattcttcgtttcgatggttgtcaatgcaaaaagtatcaagctatgttccctgttgggttactccaacctctcccaatttcagagctcgtttgggacaatatatccattgattttatcaccgggttgcccctttcacaagggtatgatgtgattctcgttgtggtcaatcatctttctaaatatgctcatttcatttcccttaaacatccctatcttgcacgtacaatggctgaatctttcatccgggatgtagcaaaattacatcgtttacccaagttcattatcagtgatcgagatcccttattccttagcaaattatggagtgaacttttttttttttgcaaggcactgtgttgcgcacgagcactacttaccatccttaaaccgacagtcaaatggagctataagttacaacttccaaactcagctaacatgcattcggcttttcccgtttctcaactcaaatgcttggtgaatagcggttttgtcgtggcttctttaccaccaaggttgacaattaatgaaccagtaactcctaccctggagggcatccttgttactagggtcagaaaacaccaggggaaacatgtggaggaatacctcattctttggcaatctcggcaaatagaggaggcaacttgggaagtggcagcttcatcttag

SEQ ID NO: 101905 - DNA, 258 bp, Glycine max
  Peptide Sequence Number=SeqID_218683
atggttaattttaagaaattttccttcggcttatcctccattgattaccaggggcacatcatatcctccctgggcatagaaatggacccttccaaagtcaaggttgtgctagagtggcctaccccccttaatgctaaggatgtattccctaaccctgcttcccaagaaggaaggttttccttggggtcaggatcaaaagtgtgcatttatcatactcaaacaatgtttggctactttcctagtattggcccttcctag

SEQ ID NO: 101906 - DNA, 477 bp, Glycine max
  Peptide Sequence Number=SeqID_218684
atgcttcagaaacaactggatagcatcatcgtagggggcctgaagctatatgtgaacctcccacgttacgaaagactgaggggtggacaactgaaaccaggagggagaagacaggaacaatggcacgggaagcgcccaataaaccttaacctcatgcacagaggggacacgacaaagaaattgtcgtatgcagaagcggtgactggaagaagcaatatggatggatcaacagcgatccacatcaagccaacagaaagaactctgaaatggttgaaggatgcgtgggttggcaggttatcgaacccaactatgttcgataaggcggaagacgagttgaggtgggactatggactggatacttcaatcacgtatctgggggacgacatgataataataattggaatgaatgatgaaagagctgatcaattgatgaaggaactaaaccaaagaaagccccctttgttgtattccctgtag

SEQ ID NO: 101907 - DNA, 129 bp, Glycine max
  Peptide Sequence Number=SeqID_218685
atgggggatgtactggagtttgacgacgaagtggaggaacgaagaaggatggacagggctagggtgcttctcaaaacaccatggaagccatttattcaccatactgtcaaagtgcatgtaggctccgaa

SEQ ID NO: 101908 - DNA, 201 bp, Glycine max
  Peptide Sequence Number=SeqID_218686
atggagggtgaagggcaaaaccaagaaaaagataagggcacggatctaggtgatcgcatgcaacacgcaatgagagcattggtcgttgacaagatcgccacgacactagaacaggttgtagacggcgtcggaggagacgggaacgatgaagttgttgtggttggcgaagacgacgaagttgctgagggaggcaagtattag

SEQ ID NO: 101909 - DNA, 3184 bp, Glycine max
  Peptide Sequence Number=SeqID_218687
gggttttgctgttggaatgaatgctgcaattcacataaatccttactatggcaaaacctcattggatgttttggttgctcactacaatagtgttctttccataggccccatcatcatcccgtctattcgcagggaagtgcaggtattacagccaacctcattggctcaggcagtttcgtatgtgcgactacaggaagaaaagatcctcgacgctcaccggctttcgtcatatcacacaccaacacctactgcgggagccaccaccacacgttcttcatcatccaagcctacaccacctcttttaccaacaccagtacatgcatcaacatctattcccttcaaacgattgacaccggaagagttggcaattcgccgggaaaagggactatgcttccactgtgccgagaaattttctcgaggtcacaaatgtgcgtcctccttgtttttattggtcatggaggaagatgaatccgcgatggaaactgaacaacggcgaactccttcaccaactccagagttgttacaggaatctccatcggctattttgatagatgggggtagtacgcataatttcctccataatcttgtagtattaaacttggggttgaagccaactgaaacaacaccgcttcgcgtcacggtggggaatggcgatgagattcgctaccatcagttatgcacggccgttaaggtccacattcaacaacactccttcaccattgatttccacgtattgcctttgtgtggtgccaacatggtgttaggggtacagtggcttaaaaccctcgggccagttttaacggactatggcgcgttaacgatgaagttcattgctaatggcaaattaattgagtttacttttttccacattcgtgttgaatcaacatccaataatactcctcaaccagctcattcctcacctgaaatcactaccttaatcgccaaatacgcttccttattccaacctcttgggaaccttccaccttcacgatcgacagaccataccatcaacctcttaccaaatgcagctccagtgaacgtcaaaccttacaggtacccctattttcaaaagcaagaaataaaagaccaggctcttaatgccataatggtgtgcgatcgttttcccattcccacggtggatgaattgctagacgaacttggaggtgcacagtggttctctaaactggatttgatgcagggatatcatcagatattgatgaacacaactgatatcagtaaaacagcatttcgcactcaccaagggcactacgagacctttcaagatcatcttcttcatttggaaacaactttccaagttctgttggcgggtcaattctctcttaagctctccaaatgcacattcgcacaacaacaattagaatatctagggcatgtggtctctggtaacagcgtcgaaccagtgccggaaaaagtgcaggctatacagggatacgcaactttggcagcaccactcacgaaaattttgtgccatgcacagttcagctggaccaacaaggctgatgatgcattccaaaatctcaagaatgcagtcacgacagcactagtccatgagctacctgatttcaatgctccatttgtgattgaaatggacacatctggtacgggtatgggagcggtattgatgcagagaggccatccccttacttacttcagtaagcaattctgccctaaattactgaactcttccacgtacgttcgtgagttagcagcaatcatggcaaccgtcaagaagtccaacatggtggctaatgcattatctcgggccatggaaggacaatctgcttcgctttacctcttgtccatgcatcggtttgtcttccttgatgaccttcgtaaggaactagactctctatcgacattcatagaccttagttataggattcaagaggattctgcagcatacctagattacacacttacagaggggctcatcttgcatagagggcgtatttggctcccctccaactcttcattcattaagcttttactcgaagagttccaccaatctcctacaggtggtcacataggaatacaaaagaccttacatcgactacaggacaacttcacatgggcttcgatcagggaagatacccgaaactttattgcaagctgcgtgacatgccaacacaccaaatatgataatcgaaaaccggtagggctgctctatccgcttccaattccagtgcgaccgtgggaggatctgtcaatggatttcataactggtctaccagcttatcgcgggttgcacttaggtatgctgcccactcaacacactgcacacactgtagctcttctctttataaacatggtgggacgactccatggcatgcccaagagcattgtttcagaccgggatctgttgtttatcaacaagttttggagagagctttttgctttgagtggcacgaagctccgtttaagttcttcctaccatctgcagtctgacggacaaaccaaagtggcaaaccgcatcgttgaacaatacttacgggccttcgtgcatgagaaaccatcgacttgggggcgttatttgctttgggtcgagtggtcctataacacatcgtgccactctaccacgggcatgacaccattcgaggttacttttggccataaacctctcatcttccctcagtacattaccgacacttctaacatagaagcagaattcaaggtgggggatttggttatggtcaaacttaagcctcatagacaagtatcaacgactggagccacttattcgaagctgggtaagcgatactatggcctttttcaaatcactgcgtgcatgggtaaggttgcctacaaactgcaactacctgaacactcgcgcatccatccagtttttcacgtttcccttcttaagccttatatcgcatccgacaccgccccagtcaccgttgaccttccccctctaactttcaacaatcaccctattgtcacacctctagccattgtggcgtctaaactcattccgtttgaggcaggccctaaacacatggacaaggcgttgcttgatgggcacgggagtgttacgaagggaactgaggggttgcaattaacaagggaggtgcaggaagaaactagagcaaggcccaataggaagaagaccatgccagcatatttggaggattatgaaagaagccatgcagaatggggcgcgtag

SEQ ID NO: 101910 - DNA, 243 bp, Glycine max
  Peptide Sequence Number=SeqID_218688
atgtgcatcagcagtgccatagccattagaaagtcgtcatcggtgatccttatggcaccatctacatcgtcggcaccactttcccaattgagaggatccacacaagtgttgcctgcggtgaagagcaagatggagagaacaagagagggtacgtcatgcaaaaaattggatacattaagtaacttctataagactactgggacacaggcccagttttaccgtccaaagaagggtaatgggtaa

SEQ ID NO: 101911 - DNA, 546 bp, Glycine max
  Peptide Sequence Number=SeqID_218689
atggctattcaaggactaattatcataaagatgtcaaatggtgacatgttccagaacaaccatgacgagatatactttgagtttttggggaacattagaggcaaagaccggaggattcagaccaatgtttatggcaatggaagcaccagcattggtagagaggaaagatatggcttatggtttgatcttgttgaggatttccatcagtacaatattctttggacaaattctaagatcatttattaccacactcttaatcacacggggagaatctccaaaatattggacacttggctaatgcaaccacagttattgtgtctatcaatttggaccgcttcagagttgagtttaccaataggagaaggagtaaactctcagcaatacttcgacattggcggagaaaaatacacttacctggctgacaatggccaagcgcgacaccagggacacacacgaacgggacgccaaactggggcacgagctgtaggaccgaggacacgaacaacagaaaaagtggggcacaagctctcaacacagggtgtttga

SEQ ID NO: 101912 - DNA, 1032 bp, Glycine max
  Peptide Sequence Number=SeqID_218690
atggcttatggtcaaactggaacgggcaaaacttttactcttggacaattgggggaggaagatacctctgatcgtggtatcatggttcgttctatggaggatatcttagctgacatatctccaggaactgattctgtcaccgtctcatatctgcagctttacatggagactctccaggacttgcttaatccagcaaatgataatattcctatcgtggaagatccagaaactggtgatgtgtctttgtctggagctactctagtggaaatcaaggatcagccaagtttcttggagttgctaagagtaggggaaactcatcgaattgctgccaatacaaagttgaataccgaatcttctcgtagtcacgctatactgacggtacacgttaagaggtctgttgtggacagtgaagatgttgtttctactgaaaataatgatgcctctcacttgactaaaccttcaaaaccacttgttcgaaagagcaagttggttgtggtagatttggcaggatcagagcgtatccataagtcaggaagtgaagggtacatgctagaggaagctaaatctatcaatctttcactaagtgcactgggaaaatgtattaatgctctagcagaaaacaattctcatgttccatttcgtgattcaaaacttactagattgctcagagattcatttggaggaacagcaaggacttcattgattgttactattggcccatctccacgttatcgaggagagacttctagtaccatattgtttgggcaaagggctatgaaggttgagaacatgctgaaaataaaggaggagtttgattataaaagtttgtctcggaggcttgaggtacaattagataaccttattgcagaaaatgaaaggcagcaaaagacttttgaagaagaagtcggaagattaaatttggaggcacaatgtcgtatatctgaggttgagaggaaatttgctgatgcattagaggtttgctatattttctatagaaaagtagcactattttgcgcaaaccactgtttttaa

SEQ ID NO: 101913 - DNA, 3402 bp, Glycine max
  Peptide Sequence Number=SeqID_218691
atgaatcctgtaataccatgctctattggcaatgtttcaattattcctgtattcatctattcaacaaggaagaataacactttaacaagattcaacttgtcaaggagcactgtaaaacctggatcatcatcttggagatttctattaccttcatttgttgccagtggagcgtttccacaaaacaaaggaatacgctcttttcataagaaatctagcacctccatatcagccacagaaacagatgtaacagtggaggaaccaagtcctgttgctgatgaagattctggtgaaattacttcaaatgaagttggaattagtgaagattcatcttctaagtctgatgccaaccctgatccagctaaaggtagacgttcaagacctgcaaggaaaagtgagatgcctcctgtaaagaatgaggatttgatacctggggcaacttttactgggaaagtgaaatctgtccagccatttggtgccttcgttgatattggtgctttcacagatgggcttgttcatatttcgatgttgagtgatagctatgttaaggatgttacaagtgttgtttctgtaggtcaagaagtgaaggtgaagctgattgaagtgaatactgaaactcagcgtatttctctctctatgcgtgaaaatgctgacactggtaagcagcgtaaagatgcacctgtcaagacagagaaagctggacctgggaagaggaacagttcaaaacccagttcaaagaaagataatgtgacgaaaagcaccaaatttgccatagggcagcaactggttggttcagtgaagaatttggctaggagtggtgcttttatatctcttcctgaaggggaggaaggatttctacctgtatctgaggaacctgatgatggatttgataatgttatggggaacactacgctggaagtcggtcaagaagttaatgtacgagttttgcgtatcacaagaggacaagtaacattgactatgaagaaggaggaagatactgcaggattggactcaacatttaaccatggggttgtccatgttgcaacaaacccttttgtgttggcttttcgtaagaataaggatattgcttcttttttggatgagagggagaaaactcagaatgaggttcaaaaaccaacgactgcaagtacttcggaagaaattaagggaactgtcaatcaaggggaaactgtattggatgttcctgacgttcagggtgaaccagaaagcagcaagttgacagatgatgatgttccttctgctgaagatgatatttctgaaaatgtgggaaccagtgcaacaaatggctcctcaacagctattgtggatgatgaaagtaacctagtcagcaatgtttctagcccaacgacaggtatagatagtgccattgagaaggaagaagaggttgcttctggaagtttgattcctgaagaggatctatctactgtaaatccaataattgaagaagttactcagacagatgtcacaaacgatttgaaaactgacacacctgttgaaatagctaatgaaaatgtaatagaaactggagttgatcaaattgttacggaagatgagaaacaatcacaaactcctgatgcaattgaagagtttgcagctgcagtactaacagacagtgatgtggttgaacctagccctgataaaaatgatacaataacagaatcagatattacatcgagtgcaccagctctccaagaaagtgcagatgatgatgttggagctattactgaaaacattgacagcgatactagtttgggtggacaaagtgacgagttgtctcctgtgggaagcttgactacagatgcaacagaagaaactgatcaggttccttctcctgaaagttctgccactgaagtagtaaaaccctccgttgatgatcctgaagaagaagcacaaaaactaactcctgccacagagaatgaaaattcttttacctcacaagttgaagacaaagaggttgcaattgcatgtgaggaaaataacagtttatctaattctgatggacaaactggcgctacttcaggagaaggcttgagtaaagcaactatatcaccagcacttgtgaagcaacttcgggaagaaacaggagctggaatgatggattgcaaaaaagcactatcagagaccggtggggacattattaaagcacaagagtaccttagaaaaaaaggcttatcaagtgcagacaagaaagcaagcagggtcactgctgaaggaaggataggttcttacatccatgacagcaggataggtgttttggtagaagtaaactgtgagacagattttgtctcacgaggtgaaatttttaaagagcttgtcgatgatatagccatgcaagtggctgcatgccctcaagtagagtatcttgttactgaagatgttcccgaggaaattgtgaacaaagaaaaagaaatagaaatgcagaaagaagatcttttgtcaaaaccagagcagataagatcaaagattgttgaagggcggataagaaaaagacttgaggagctggcattgctcgagcagtcctacattaaggatgataaggtagcagtaaaggacttcatcaagcaaactattgcaactattggagaaaatattaaagttaagaggtttgtgcggttcaaccttggagagggtttagagaagaaaagccaggattttgctgctgaagtagcagcacaaactgcagcaaaaccagcacctatgccagcgaaagagcaacctgctgttccagaagccaaggagaccgagccaaagcaatcaacagtagcagtctcagcctcattggttaagcaactgagggaagaaactggagcagggatgatggactgtaagaaagctctagctgaaactggaggggaccttgaaaaggctcaagagtacctcagaaaaaagggtctctcaaccgctgacaaaaaatccagcaggctagcagctgaaggcagaattggttcatacattcacgattcacgcatcggcgttctaattgaagtgaactgtgaaactgactttgttggtagaggtgagaaattcaaggagttggtcgatgatcttgcaatgcaagttgtggcctgcccacaggtgcagtttgtatccattgaagatattccagagactattgtgaacaaagaaaaggaacttgaaatgcagagagaggacctgctttcaaaaccagagaacattagagaaaaaattgtcgagggcaggatcttaaagaggctcggggagcttgctcttctagagcagccttttattaaggatgacagtgttttagtgaaagacttggttaagcaaactgtagctgcacttggagagaacattaaagtgcgccgttttgttcggtttacgcttggggagacatctgaaaaagaaacaacagtaccagcataa

SEQ ID NO: 101914 - DNA, 549 bp, Glycine max
  Peptide Sequence Number=SeqID_218692
atgaagcttaagcagttggaaggtctcctcggtggtcttcaacagttccctcaacccaaggtcgagcttgaacagtacccaacaggaccccatatagcttctcgaatgcttttcactgtgttccctctttccctttatttaccatggattagggaaagatggggaggttatgtttcctttgctgttcatgagaatcaggcagagaattcttttgaggatgtgagcgacaaagtagtggctgactttggatgcggttgtgcattgatcagacatgttcttggcattgacattgatccagaatctcttgaaatagcttccaataatgctgaggaacttgaggttgacatcgattttattcagtctaatgtcatggacttgggatggagaggtcgaattgttgatacagttataatgaatcctccatttggtactcggaaaaaaggtgcagatttggattttctctccgttgctttgaaggttgcttctcaagctgtttattccttgcataagacttcaacaagagataagatatatctggccattagttaa

SEQ ID NO: 101915 - DNA, 210 bp, Glycine max
  Peptide Sequence Number=SeqID_218693
atgtatgataaaaggcttgatgttcacatcaaggctgcaattaacagtgcaatgaagaaaatattcactactctggaagacaaggcggaaggccctgcacctcaatggaatgaaccaaagagtcatgttcaacccggagcctatgagtgtggatactatgtgatgcattggatgtggtgtatagtcagcagcggttcgaagaatgaatag

SEQ ID NO: 101916 - DNA, 180 bp, Glycine max
  Peptide Sequence Number=SeqID_218694
atgatggttggtgttaatggtgaagggaagactacatctttgggaaagctggcctatagattgaagaatgaaggggctaagatattgatggcagctggtgatacatttagagcagctactagtgatcagttggaaatatggggcgaaaggactgtgtgtgagattgttgtggctgaataa

SEQ ID NO: 101917 - DNA, 477 bp, Glycine max
  Peptide Sequence Number=SeqID_218695
atggaaagtcacttcattgctctgaaagttggactagcgcttgtcgtggacgagggcttggtcgaggcgacagtcactgttgaggacatcgatgatggtgtagttcacgtggttctcaagtttgaggatgaggttgaagttgcaaaagccgatggcagccatcgagaagcccaggcgatggggggtttggactttttgggggttagggtttttacggttccagtggaggagaggagaatggggacagaggaggaatgtggagttgggggtggtggtggcgtcggggagaaggtggagagagggaaaagggaagaggagagaagaagaaagagaaaactgagcaaatacagcgttgtagaaaagagtttttttagtagtgttgccatcgcccttgcccatgaccaggttcttatgcgcaacaacaggggattcctctgcatgaacaagctcgatatcaaccctgttgttctcgcatga

SEQ ID NO: 101918 - DNA, 1326 bp, Glycine max
  Peptide Sequence Number=SeqID_218696
atgccaacggattgcaagactcattttatcgaacatggagtaaatccctcttgtgaagttggtttaatattgtacaacttcaattcacccttaggtttggactacgtccaatgtttcaattggacaaaagatgttgatcaatttttaggctttctggcatatttacctttcaacggagataatttaaatcaacataccattgtaaaaggtttggcagaagctttagtgatgttcccgaaagatgattactttaagtgtgaaagacattgtattcttgtggcaacgggtgaacctgttactaggagcatgctagtgtctttacctgtggttaaggaaggaaaatttatttcaggacaattcataactttagatgccacctttttgagggtggctaaaatgtttggtccggggaattatctaaaggaagacactcccatcaccaactatggaaatggtcagatcactgttttattgtcaagaaattttaaggaggcacactatgccgtacttatcccacaggaaacagcattagaagaggaccgtttaacacggcttttagaacaagaccatcaaatttatttagacgaaattcttgaagaaatgctgaggtcatccacttccacgactggagaagggtcattacctcaaaacaattcagattcagggcggcttgaggaattaaatgcgtggtattctccaggagtcggtgcttcttcatttgttcctactgcacgtgttgatgttggtgctagttctggtggtattgctggtcctagtgctagtactgatgctggtgttgttgccggtgccattgctagttctagtctttattatggtagtcatcatcaacaatttccaaagcaccatcactttgaaatgactgagatcaatcctactgcaatgggagcaaacacttgggcttctccagcgctagtgatgcatgaatataatcaggcaattttatggcctaaaccaccaacagattttatagactacgtacaggcatgggagggatgtttggttggaaaaattcactctggtacatcccttaatcaagcaaaggcctttaggagactaacatcatctgtcattctttcacatcagtggtcaaacagactgaatatcgccctcttcttttccaaaacggctgtcacatataccatgacgattaatggtggacctattgattatttgttctttcaagtaactcaattcgataatcttgagctgtacgaacatctcatgagtaacgatttgctatttcactgtcacaggatatggtatttgttcaacgtcccaattagtgaaagcaagtgcaagtcatga

SEQ ID NO: 101919 - DNA, 300 bp, Glycine max
  Peptide Sequence Number=SeqID_218697
atgaggtggaacaagcagccacatatcactcataagcatgggctatatggtagaagaaacatggaagaaaatcccggttttggaacaagcagccaaatgtcattttgcaccttactcattgaggcaacattatgcaagatatatgtaacttatattgataaggatggtgaggagaagcatatcaaagtccctgttggaatgccgatgttagaagatgctcatgaaaatgacattgaagtagaagacaagagctttggctttagaattctattatttcatctcaagattttagtcttctga

SEQ ID NO: 101920 - DNA, 273 bp, Glycine max
  Peptide Sequence Number=SeqID_218698
atggacgacttgccattgtcggcgctctttgagcaagcccgcaagatccacaccacaaccaccgattctagcaccgaccaggaggttgtaaagaaggggtgcgaggctctgcatagatgcgaggacatggtcaataatctaggtttgttctctcccaacgagaccaaagaagatatcaacaccaccaatctcaagtacatcctgcaatactaccatgctcatatgctattcatcttcttgaaagattttgtggtggatttactaatggaatga

SEQ ID NO: 101921 - DNA, 144 bp, Glycine max
  Peptide Sequence Number=SeqID_218699
atggcaactaggaaattgttgaacattgttgtagatggaaactcggccttgggtccttattggcccaaaattgtttcagattatctggaaaagatagtcagcattattcatcatacgcatgaccttaactatacatgtcattga

SEQ ID NO: 101922 - DNA, 273 bp, Glycine max
  Peptide Sequence Number=SeqID_218700
atgtcgcggaacttcacagattgcttaacgatgggtgtcaagttcctcgaagcggtcaagcgaaggttgcatgccatcaaacaatggtccccggacgaaattagagcaatcaattcgtggggcttcggactcaatggtggaggatgcatgaacagcgctaggcaattaattcatggggctccgaataagatgatggaggatgcacgaacaatgctaggcaatcaattcgtggggctccgcactcaatggtggaggatgcatgaacagcgctag

SEQ ID NO: 101923 - DNA, 192 bp, Glycine max
  Peptide Sequence Number=SeqID_218701
atgttgcggaacttcacggattgcttaacgatgggtgtcaagttcctcgaagcggtcaagcgaaggttgcatgccatcaaacaatggtccctggacgaaattagggaggttacttcaagaaaggaccaagagcagtactggtttccatgggacaaaccatatcgatatgtcaacagtattggttcttcctag

SEQ ID NO: 101924 - DNA, 624 bp, Glycine max
  Peptide Sequence Number=SeqID_218702
atggttatcgcaaattatgggttcctagaacacccactttgtgtccctcaggactcattagaatgtttgggaatgatgaattgggaaggcatggattcaattgattccatgttttctaccccttgggagagtgaaaaggaaagattggaacaacctgaaaaggataaaacggagaggaaatcattcactgatgtgtcaaataaccaagctaatcatatgtctctattaacgcggctagacgacgagtcaaatttagctgctgagaagtctcaaactaagatcttgaaaacaaaaaacatagcggctcgatcattgtccaagtgcaaaattgattttctgaattcgacacagagtgggagggatgctaagatctgggagaaaagatgtggtcacaaggatgctaggatctgggagagaagatgtagtcattgtgacgccataaaaactcctcaatggagaaccggtccttttgggcgaaatactctgtgcaatgcttgtggtatacgattcaaggcagggaagttatatccagagtatagacctgcagatagtccaacgtttgatgtaagcaagcattcaaatgttcataaagagataatgaaaatgagaaaccaccttagttaa

SEQ ID NO: 101925 - DNA, 519 bp, Glycine max
  Peptide Sequence Number=SeqID_218703
atggatgaaagacccaatgaccaaaatgtcttgtttttggtcactcacacaaataggaaaggttgttgggttgatgattgtgctcgcgatacatatgaaaaataccatgagggtttgcggtcgactcaaacacagatggttgaagcaactgcaagattagttgaagcaaatcaaaggtatccactaatggaggagcaaatgcggttgatgcaacaacaattacaaatggttttggacaatcgaactggaggcaactcgacgggtactagtcaacgcgtacctgaggggcgcgttccaccagaacgcgacacgtggcgtgacttgacaagacgatgggacagaggtggaagtggtggcctgccaggcgcgaccactagtggtggcctgccaggcgcgaccactagtggtggcctgccaggcgctaccagtagtggtggggccccaggtgcgaccactaatggtagcctgccaggcgcgtccactagtggtgggtcccaggcacgtccctcttccctataa

SEQ ID NO: 101926 - DNA, 744 bp, Glycine max
  Peptide Sequence Number=SeqID_218704
atggggaggacgctttttggtctgtcaatacccgccaattcagaacggtcattgtcctcaatgacaaggaacatgctggaagagaaggatcggtatccaacggtgcacaagtattgtggattttggacgcttgagctgattgatgagaatcgaagaggccagtgtgcggaccagctgtgcaataagcacactttcttcagctacgctctcagaagagaatgggtggtggtccgacataacatcgtagaaggaagacatggaaaacgggatgaatgcacgcggaatctgattgaaccaattccaagtggaaatctgcctcctggttttgatccaagtacttgccgcagtgtgaaatttgaccgtgaagctgatgaatggatagctagggagcacgccaaggaaattgctaacaacaagtctatggacattgtaggcatcagggataccgagatacacaattatcagataaacctgaaaggaaatggttcctctagcataactcgactaactccaaacacaaaaatggggcaaaattcaggcatgcaaaagcctgaagcatttctacttggctctatggagaatgaaatgatatctgatggtgttcttgcacaagacataaaccaagcatcatctttttggctactacgtgagttagtatttttacctcttctgaattcatacttcagttttttaaaaatcagcaagcttgaccaagttaggttggctatacaccttgcattttga

SEQ ID NO: 101927 - DNA, 567 bp, Glycine max
  Peptide Sequence Number=SeqID_218705
atggctggagtttgtaacatcacagatgatattccgttggaaatggttaaattagtggagggactatctagtgatgctgctgcaagtgttggtgcttgtgatattgcaagtgcaagtgttggtgctcttgttgctagtgtaggttataatgctagtgctagtgccattgcttttacaaattttaatgctagtattgattcttgcgttgctgcaggtgctaatgctagtagcaactattggtccacaagatcctttatcatttgcttctcagggattcctcatcatgctagtagtagtagcaatagtcacctagaatttcaaaggtaccctccatatcaaatgtttggatcaatgcacaaggtatacgtgcaattatgcctcaacataacagtagcagcaataataattagggacttctttggcttcgcccaccacttctcgcggattttccatacttcgcacctgcatgggagggaagtttggttggaagaactcacttgtatctcgaattccttagtcaaacaaagatgcgatatttcttggcattgtaacaattatgagaattga

SEQ ID NO: 101928 - DNA, 519 bp, Glycine max
  Peptide Sequence Number=SeqID_218706
atgatctttgatgtgatgcgtaatgggaaaggagctgggttagagagtatgggttggtatgaaagatggggtggtggtgattgggttggtttggatagtgcacctcatgggcagaggcagggctgggctggaatggagcatcaacgtgcaataaaatctggcggcccaaaagagagaacgacattgagaggggggttgtcgactacggttttcgggagagtggtggggaagtcatgggaggcaaggggtggtggtagctccaagtcgtcattggcaatgaacaaatgcctccatcttggtggacgaccaactcctcaagtgacaagcagcgaacaggttcatgtggttctgggcaagaaagtgttggctctgagtaaggcgaagaacaacctcgttgaggttttcgatagaggcttgtcgagtgttatgctcaggcatggtagcaagcccaagggcagggtggaatttagacatagtcctggaggtgtgttggtggtttgtgcaccctcttgggtctag

SEQ ID NO: 101929 - DNA, 321 bp, Glycine max
  Peptide Sequence Number=SeqID_218707
atgtatattttgaagccatatcggggcccctacccctcgacgctggaccctttaccaccacttaatgtcgagaaccatctcgtgattgaaccattctcaatacttgactggaaatgggacactaccggtactcctccagtccagaaggtcttggttcacaatcctcgacccaagggggtgcacaaactagaggactgggtttctcttcgcacctcctacaaccttggggacaaggttgttttgctagaggggggtgttgatagcaatcctcgactaaagagggtggacaaaccaccaaaacacctcgaggactatgtctaa

SEQ ID NO: 101930 - DNA, 429 bp, Glycine max
  Peptide Sequence Number=SeqID_218708
atggctttgttgggctatggatcagttgttcagagctgtatggttgctgctagcctcttggaagatcatggcttgcatgcaacagtggtgaatgcggctctgcaagtcagtggatcattccataattcgaagcattggaacatcgcaggaggttttgatcactgtggaagaaagatcaataggaggatttggcctgacgatctgaatgtggctactaggcttgaggcttccagctctcacaatgaagagatccaaaggtggtgcatggtgcttcttgcggtggtggagcagtcaaaacatcatgctctaagtgactcaacatcgatcgagaacgatgtcaatggggatgggatcatggtcaatgggggagacggtgctagggttgatgggggaggcaaggttactagtcccttcactttgttcacctaa

SEQ ID NO: 101931 - DNA, 669 bp, Glycine max
  Peptide Sequence Number=SeqID_218709
atggcttggtttcagggccgtcttaagattgcagactttggttggtctgtacaatctagaagtaaaaggcataccatgtgcggaaccttggattatttagcacccgaaatggtagaaaacaaagctcatgattatgcggttgataactggactctgggtaccctttgttatgagttcctttatggtgctcctccatttgaggctgagagtcaagttgataccttcaaaaggataatgaaagttgacataagtttcccttctactccctatgtttctttagaagccaaaaatcttattagtcgggcaagttcatatccaggcaaaaacagatcctttcagagaaacaaatctgctgctggtaaaagactcttcacgaaggctctcacttcagaggataatggagcatccttggataaccaagaatgcaaatcctatgggtgtctgcaactactaggggccacccagtcctgcagcatgtgggggctgttcagagatgagcatggagctgctcttgggagctttgctaattttttgggaaattctaatgctctcgaagtagagatgcttgatgctatcataactattgaagctgcgagtagtaggaactggaaattttttgtggctgaagcgttggttcaagctgtacataatcattctttggtcccatga

SEQ ID NO: 101932 - DNA, 261 bp, Glycine max
  Peptide Sequence Number=SeqID_218710
atgatgatgatggtgatgacaacagtaacattcgtagagatatcaattatggtcgtggtggcaatggtaataatagaggtggtggtagtggcaatgctaatggtggtagtggatgagacattactaatggtggtagtgacgaaggtgggagaccagtcagggtcactctgttttacaagaacactccaaccatatggggtcaacataggcttcaaggaacattcaaaccgagtgtatttacccccaaggcctacactctga

SEQ ID NO: 101933 - DNA, 534 bp, Glycine max
  Peptide Sequence Number=SeqID_218711
atggccccaaaatgcaccccctttgaaaaacagtcaacgagcaccatgataaccgaaaatccttgggagtatgggaggtgggtgatgaaatcgagcgaaatgtcttcctatatcctagaaggaatgggtaaaggtgcggcactaacgaacgaaaagtcaaatgtcgcggcaaacatggtcccaagtgaaatgggacggaacccgatgcaacatcttagcaatgcccagatgtccaccaatgggggtggtgtgaaattccatcaacaatgggcgataggatggccctttagcatcaaaacggcgcccatggcactcccagaaaagcagtctctaacacaaatgggacgaaaaattctgaaagggctaggactggagcttcaatcatggccctttttagatgctcgaaggctcgctgagaccttattctcgtgtgtgttggcttcttctatagcaatctcgggtggggctgagcttgaaaggctgcggtacaaacggttaagcatggaacagttaactgaggcagcgtttgtgtag

SEQ ID NO: 101934 - DNA, 129 bp, Glycine max
  Peptide Sequence Number=SeqID_218712
atgtcggtgactctgcacacaaacctaggcgacatcaagtgtgaaatcttctgcgacgaggtccctaaaacctccgagaaaactacgggtgtgtttggacgagcagttgcaaaattgattttggagtga

SEQ ID NO: 101935 - DNA, 543 bp, Glycine max
  Peptide Sequence Number=SeqID_218713
atgggcaacgttgccattctcacttgcaaacttggtttaagcactgatccaattgtttcaggggctctgcttgacatgtatggcaagcggggagacataattgaatctcaaagagtgttcaataagacacttgaacgaacccagtttgcttggacaaccataatattttcctatgcccaccatggagactttgaattacatgagaatatggaaatggctgagaaggttgttggtaggttgatagaaatggatcctgcaagttcaagtccatatgtgctaatggcaaacttgtatgctgagaaagggaactgggagatagaaatggatcctgcaagttcttgtccatatgtgctaatggcaaacttgtatgctgagaaagggaagtgggagataaaaatggctaagaaggttgttggtaggttgatagaaatggatcctgcaagttcaggtccatatgtgctaatggcaaacttgtatgctgagaaaaggaagtgggagaaagttgctgatgtgcaaagagggatgagaaggaggggggagtaa

SEQ ID NO: 101936 - DNA, 171 bp, Glycine max
  Peptide Sequence Number=SeqID_218714
atggctgagtggggtcccgaacttcacatgccgacttggagaagtgcctttgacaggaggggagccaacaaaacaaatgactcaaacgctcaatgtctcatgaaaaccatgcaggcaatgccaatttttagacagacagaaagtactattgaagaattgaggatgcaataa

SEQ ID NO: 101937 - DNA, 1392 bp, Glycine max
  Peptide Sequence Number=SeqID_218715
atggatagtggagtggtcacgcgcctaacaatgttgaacagtctagtgtacaaacaacgggtaggaggtggaccccagaagaagattgacatgggacacaagatggtaggtgatgttggtgttgttgttgttgatgaaagaaagagggttgttgtggtcaaggaagagaaagagaacacttcttcctacagtgttgaacttcatctcggggttgatgcttctcattctgctccacaagaaataaaccatgtgatcactgaagctcagaggcgtgagcttcaccatcaagttttcatcttcaaccatttggcatataatcttcctcctccttatcaccttgtgcaattcccgagcaacatgtcagaatacagtttcctgggttttgatcatgggagtatggtggatccagagcctcataggtgtagaagaactgatggaaagaaatggaggtgtggtaagaatgtggtgcctaaccagaagtactgtgaaagacacatgcatagaggtcgaaatcgttcaagaaagcctgtggaaacatctcaaattaactctcatctggcaacaaagccatctagcaagtcacacaacaaacccgcctcaaggacacaatttgaaatttcaaatccaaaccttatggccattcgacatagtgacacatcaagtaccccatcaaggagtctcagtgttgccaattgctcttctgctaataataggtggaaaaatagtgcaagttatgctgactacctcacatcgttttcttctgcgtctgcagtgtcccctggatccactcttgccactccagttgctcctaagatggccaccttcagcagtgtgacatccattgcttcagatagaggaagttgcctaaatatatgccagaaagataacaagtccaagagctgtatcagcaacaacatcagtgttaaaagtggtgggaaaggaagaattgttggtgacactaatggcatttctactggaataggcttctccccaacgagtgttcttcaagtttctggttgcaacccttcatacctgaatgacagaaccaacatagaatctgcatccggtaggtgccggagaacagatggtaagaagtggcaatgcaagagtgctgttcttccgggtcagaagtactgtgccacacacatgcacagaggtgctaaaaagcggctcacaagccatgaaccggcagttaccattgcgcggttgcctaactcttcagtcacaaccaaaatgcagaaagcgcattgtgcaattccaaacacaaatctttccatgtcagtcccagcaagtgaaccattcatacaatgtaatgagaaaagtcaaagtaccagtgacactgataccaccatcagtgacaccttgaatgagtgtagctatgcttctttctga

SEQ ID NO: 101938 - DNA, 1134 bp, Glycine max
  Peptide Sequence Number=SeqID_218716
gattacatccgccagtgggagcagttcctcagcgatattcagctcaacagcagcgcggatttgtcgcagcgcatcaacaccgcacgtctgctgtcgggcaaccactcgccgctgcgccagctggtggttaacctcagtaagctgctgacgctgaaccgcgcgcagccggatgagcagaacgcgcaggcgcagccggcggcgggcaacagcgccacgcgcactttagaagcgctgttcagttcctccaaagccagcgcggcgtcgggccagggcgcaacgcagcaggcaccggaacaggcggtggcggtgcacttcgctcccatccttgaactggcacagccgctgcagcagggcagtaaggtgctggcggtagatgattttctgcatcagatcgacgatctctaccgctatctgacggcggtgcaggacgcggccaacagcggcatgccgccgccgtccggcgatgccatcagtcgtctgcaggccagcgccggtcgcttaccgggttcgctgcagaatatggtttccagcatggccgtgggcgccagcagcgatgcacagcgccgcgatatggataacgtgcgcaagcgcatcaccatggaagtgggcagcttctgccgccaggcaatcgccggccgttatccgctggtgcgcaatgcgcgcagcgaagtgacgccggacgatctggcgcgcatgttcgcgccgggcagcgggctgatggacagcttcttccgcgacaatctggccagcaaagtggataccaccaacgccgcgtggcgcttcacgccgggcatcgatggcaaaacgctgccgggcggtgaagcgctgctgcgtccgttccagcaggcgcagtcgattcgtgatgccttctttgctaacggggcgaccacgccgtcgttccgcgtcacgctgcgtacggtgaaaatggataacgacattctcaacctgacgctcgacgtcgatggccagattctgcgttacagccatggcccgcaggcggtgcagatggtgagctggcccggaccgggcggcaccagccaggtgcggaagcagcttggtctgaccaacggcaccacctcaacgctggtgaccagcggtccgtgggcgctgaaccgcttctttgatcgcgctcgt

SEQ ID NO: 101939 - DNA, 264 bp, Glycine max
  Peptide Sequence Number=SeqID_218717
atgctagccgacgtcggccggctaggaaagacgacagatcgaggcctcaaaaagaagcatgaccggatgactccggtcgaacatttcctaacaggtcggctaggttttttcgtgcgagctcaaccgaagttgtttttcggccgacaccggcatgttctcatttactctgccaggaaaacattaacccacctcggcaaaaaatcattattctccgatactgattggaaaaaaaaaacgatagccgatgtcgtccgggaaaggtga

SEQ ID NO: 101940 - DNA, 192 bp, Glycine max
  Peptide Sequence Number=SeqID_218718
atgaaccactctgacattgaagagcttctttacagcttaatgaagaatgaggaacacatgaaacttccctcagatatatttgattctggaaatgggaaggggacaataacagatagtggaacaaccttggcttatcttcctgccatagtttatgatgaactgattccaaaggttttggcccggcagccttga

SEQ ID NO: 101941 - DNA, 510 bp, Glycine max
  Peptide Sequence Number=SeqID_218719
atggcccagtctaattcctctagacttgggttccctgcttttatcacaactctatgtaggtccagaggggttgcttctgacagcctagtcttcaaacgcttgagcccggtcattaacttggcctatatcaggaaaaactattggaaccctgctgatctggcatttactattggaggggctaggagagcgagggcaaggccagtcgaggctccttccacatctgcagctcctcttccagcacgtacctcagcagctctttctaccccatcttttcctccccttcacagggaagacgaaggtctcactgctcaggtaccacagcagagggaggatgagtcatcagagtcttccacgctagagcccctgatcagaagaaagagggtatttgaaacacaagaagctgcagccacgtctgagaaatctcttaaggacactgctgagccttcagaaccagtggcagatacgacttcaattcagcaggcagcagacccctccactcatgaggagtag

SEQ ID NO: 101942 - DNA, 318 bp, Glycine max
  Peptide Sequence Number=SeqID_218720
atgggactggttgtgaagggaagctttgtgggagaaaggagggctagtaaaggctttactcaaacatatgggatagattacgaggaagcctttgccccggtagccaagatgaagtctgttcgtctcctgctctctattgctgcgaatcgagattggcctctgttccaattagatgtcaactggagtggaagccaaacgacggggccgagaatctgtgatcgatccgaagaaccactgccagatacgattctgctcccccttcgtactaccaatgcgattcttgcccggctttctttcggcttaagaaggctgcggtga

SEQ ID NO: 101943 - DNA, 1283 bp, Glycine max
  Peptide Sequence Number=SeqID_218721
atgaaaactttctcgcaaggaggcataaatgcgccaatgtttcttggatttaaaacatccatgcaggacttgaattttcactaccaggatgatctcaacacgacaatggagaggttgttttaccaacaagtggaaaagtctacatgtgatatacagtacctgaaatttggtgatcaccttcccttagaagagatttggcttggtgtagttccaattccaagtgaccatagtttcaaaaatttgaaatcattatttgtggtggaatgcgaatatttacccaatgtaattcctttttatttacttccatttctttgtaacttggaagagatccatgtaatcaactgcaaatctattaaggcaatatttgatgtgcaagatatgagagtagatatgaaactaccttctcaacattctcttcctttgaagaaactgattctaagtcagttgccaaatctagagtatatttggaatctaatgtctgatgaatttctcagccttcaaagcttgcaagaagtgtacatttatagctgtgaaaagcttaaaagtttgtttccaacctcagtggccaatcatcttgttatgcttgatgtgagagattgtgcaaggttggtggaaattttggtagagaatgaagcagccttgaagggagaaactaaacagttcattttccattgtctgatatcaataacactaaggaaattgccagagctcaagtatttctacaatggaaaacactcactagaatggcctatgctagcatatcttgatatatatcattgtgacaagttgaaattgtttacatctgagcataatagtggtgaagttgcagatatagaggatcaagttggtatttcaaatcatcagcaagccattttcatagttgaaaagatttttccaaacattgagcaattgtcactcaaaaaggaagacgcgatggctatttcacatggactgtttcaggcaaaggttatccctgaattggagcatcaagcaataactacggaagacactatgattatgcgacgacaatttggtgcaaatgctgcacacctcctacaaaatttaaaacttctaacgttgttgtgctatcatgaggatgatgagtcaaatatattctcaagtggattacttgaaaagatacccaacatagaaaatcttagagttgcttgtagttccttcaatgaaatattcccctccctaaaacctagtgctggttgtaccaaaattgtttcaaatctgaaaggattatatttggattttctcctcaagcttagttccatagg

SEQ ID NO: 101944 - DNA, 2475 bp, Glycine max
  Peptide Sequence Number=SeqID_218722
atgccttcatgtgcacattcattagaagaccaagtgcaaaacaagaacaaggatattatcaccgaagttggtcaaagtgtcactgatgcttgcctttcactcttcaatgaaaaggtttcaattccaaaattagaatggttggagttatcctcaatcaatatccagaagatatggagtgaccaatctttgcattgttttcaaaatttgctgacattcaatgtgatagattgtggtaatttaaaatatttactgtcattctccatggctagaagtttggtgaatctccaaagcctttttaatattgatgtttttcctaagttgaagaaaatggagatggtcttcatggagaaactaaataccatttggcagccccatattggtcttcattcctttcacaatttggattctttgataataagacagtgtgacaaacttgtaacaatttttcctagttatatggagcaaagatttcagagtcttcaaagcttgatcattattgattgcaagttagtggaaaacatatttgactttgaaaatattccagaaacatgtgataggaatgaaacaaacttgcactacgtatttctacaagcgttaccaaaattggtgcatgtatggagggaagacactagtgaaatacttaagtataataatttgcaaagcataagcattaatgggagtccaaatttaaaatatctttttccactttttgttgccaatgaactagaaaagttggaataccttagcgtatctaattgtggggtaatgaaagagattgttgcttgggacaaaggttcaaatgaaaatgttatcacctttaagtttcctcatctaaattgtgtgtcattacaacaactatttgaacttgtgagtttctaccggggacctcacactttagagtggccatcattgaagaaattagggatacacaattgttacaagttagcattgcttcctacggaaataaaaaattcacaagcgcagccaattgttttagctacagaaaaggtgatatacaacttagaacttatggcaatgagcttgaaagaagtagagtggttgcaaaaatacattgttagtgctcacataatgcacaatctgcaaacacttaccttggtagtaagagaatgctctcaaatgacaaaattctctaatgtccaaagtgctccaaacctacagaaagtacatgttgtagttggagaaaaagacaaatggtattgggaaggtgatttgaatgtcactctacaaaaaattgtcacagatcagagtttcttgtcttttaaggttcctttcaattattcaaagcatatgagacttttcgattatcctcagatgacgggagaccaacacagcaaacctgctttttcagacaacttatttcgcaatttaaagaaattggaatttgatgtagcaggtaaaagagatattgtaattccatctcatgtacttccatacttgaagagcttagaagaattgaatgtacatagctccgacgcagtgcgggtgatatttgatatagatgacagtgatgccaataccaagaagggaatagtctttcatttgaaaaatcttacttcaaaaggcttgtcgaatttggaatgtatatggaataaaaatcccgaaggaattgttagatttcccaatttggaaaaagtggttgtagatggttgtggaagattagtaacattgttcccttcatcccttgccagaaatttggggaatcttaaagcacttgtaatatggatctgttcctcattggttgcaattgttggaaagggaaatgctgcaatggaacatggaacaactgaaatgtttgaattcccttgtttgtcgttgctaaatctttggaatatgccactgcttagttgtttttatcatggaaaacaccatctggaatgccccatattagaaaccttatatgtagtcatttgccctaagttgaagctattcacatcagaagcagttgttcccaaactgaaggcattgtcactcaatgagcaaaacattattttgttgagcgatgcacaatttccaagagacctccttggaaaattgaagattcttctcctatggtttgaggattttgacaatgagaaagatactttgccttttgatttcattctcaaggtacccagtttagaacatcttcgagtgcaaagatgctttggtctgacggagatatttccctctcaagttcgccatggaatacttgctggattgaaacaattattcttgtatgatctaaaagagctggagttgatagggttagagcagccgtgggtaaaaccatactctgaaaagcttgaagtattacaacttagactctgctcacgactagaaaaattagtgtgctttgcagtatctttcatcaatttgaaagagttagttgtgagtgactgtaaaatgatggaatatttattcacattttccactgccaaaagtttggtgcaacttgagatcctacagatagactaa

SEQ ID NO: 101945 - DNA, 727 bp, Glycine max
  Peptide Sequence Number=SeqID_218723
atgttttgcatcttcttggcggttcgtgatgtccaaaaacgtgatattgcttttattcgtgcatatgggtttgaaaatattgacccacatgcagcagaaaaaatgctttcatccagagaaaaagtcaaaactctccccgtagatttaaaagcatttgattctagggataaaagtaaagtgattgaagaatctacatttattagaaggatgataaaggatagaatacaacactctgaagccactgtcgcctatgttgcagctctagggagtattccttatttgtatatgattggtagctcaatgcgtgatgggcacttgcctttaagactatcagattttgatcgtaataaaaattgcttccaccttcttgatgcccctccaactggttccaaattaattaggaaatttggtggggagataacagaaaaaagttctattgttagttcgaatgttaacaaccagatagggctagctatttcatttacgatgaatatacagccatcggaccttcccgtagaccttagcgatcatacgctacatatccagcttgatactggattcagatttgataaccttccttctgaggaagagcaagaaaacatcactaaagaagcatcttatgttgttcgtcttggctctctttaccaggaggggttacacggtgtaatctatgtctggcattggaactctatcaaaaatgaatatgaatggagcttgaaaatttcag

SEQ ID NO: 101946 - DNA, 567 bp, Glycine max
  Peptide Sequence Number=SeqID_218724
atgaggtgcattttcgttcatgtgtcctccacacacgagtggggagccgtgcgtagtgattgtttagtgcatttctccattctcaatcttatttggacccccatgaattgcgtttttgttcatgtgtcctccatccatgagtttggagccatgcgtagtgattgcttagtgcaattctccattctcaatcctttttcggagcccatgaattgcattttcgttcatgtgtcctccacccacgagtttggagccatgcgtagtgattgcttagtgcaattctccattctcaatctttttcggaaccccatgaattgcattttcgttcatgcgtcctccacccacgagtttggagccatgcgtagtgattgcttagtgcaattctccattctcaatctttttcggaaccccatgaattgcattttcgttcatgcgtcctccacccacgagtttggagccatgcatagtgattgcttagtgcaattctccattctcaatctttttcggagccccatgaattgcattttgcgttcatgcgtcctccacccacgagtttggagccatgcgtag

SEQ ID NO: 101947 - DNA, 420 bp, Glycine max
  Peptide Sequence Number=SeqID_218725
atgactggaagcttctttccggttcattggcttttgaaatccacatccttcattatctcattgtgcgtattttgcttccaagatcttcaaaccttgcacagatccttcttaatcggtgccgctgtgattgcaacttttggttaccgtaaagagcatgatgactcttgggtaaaaaagggtgctcaacctattgatgatgaaggacatttaccagttggagaggattcctctctccttcagaggattttggacaggtttgatggtcttcaaacctatgttggtgaaaggtttgatgctctggaactacaagtggatatgcgtttcaacgagatggaatcaaggatcaccaaggttgaaggagatgtcacttacatccgcatatgctttgatctaccaccagcactgccaccatcatcttag

SEQ ID NO: 101948 - DNA, 447 bp, Glycine max
  Peptide Sequence Number=SeqID_218726
atgggggaaatgtgcgaggagtttaagattcaacatcacaattccacgccctaccaaccaaagatgaacggggccgtggaggaagccaataagaatatcaagaagattatccagaagatgaccgtgtcatacaaagattggcatgagatgctcccattcgtgttacacagttaccgaacctcagcgcgcacgtcaaccggggcaacaccattctcattggtatatggaatggaggtaggtacgcgccggttcagcgaaggggacttggtgttgaagaaagtctccgaagctctgaaagacaatagagggaagtgggccccgaactatgaagggcctttcgttgtaaaaaaggctttctccggaggggccctggtgctcaccaacatggatggcgaggagctaccttcacccgtgaactccgatgttgtcaagcgatactacgcttag

SEQ ID NO: 101949 - DNA, 489 bp, Glycine max
  Peptide Sequence Number=SeqID_218727
atgcctgtcggttggttttacacaaacaaagcggatatgaccggaaggcttcttgccggttcattggcatttgattgctgcatcctccactatcttattgttcgcattttgcttccgagatcttcaaaccttgcacaggtacctcttgattctgaaccttctgttcaaatcaagaagtccttttccattggggctgcagttgtcgcctccttcggttaccacaaagagtgtgatggctcttgggtaaagaaggatgctcagcaacatgatgttgagggttgctcgcccgctcgagaggattcttctcttttgcagagtgtcatggatagatttgacagtcttcaggcctatgttggagagagatttgactctttcgagagtcaagtagacattcgattcggagagatggattctaggatcatgaagattgaaggtgacattactttcataagagattgcttcgaccttccaccgccaccatccacttag

SEQ ID NO: 101950 - DNA, 779 bp, Glycine max
  Peptide Sequence Number=SeqID_218728
atggataggttgacgaccatgatgagtgcactcctgtcagcccagaactctcaagctgccgccgctgctgtagagcagcctttggtgagcacaaccccgctatctacggtgacttctccacccctctttttgcctccaggttgtacatggggaatgccacctccagtctgtggaagctcccagcccgctgtatctgaagctccacctccttttgctcagcagtcagcaccggttccgcaacccagtacctctttccctcaagctgcaatgacttattcagctccactgattcacactattcaacaagaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcgagaagtataaagggaactcttgtccccgcagtcacttggtgatgtacgcgcggaaaatgtccatgtatactgacaatcataagctgcttattcatttctttcaggacagcctgactggggccgctctgaagtggtatatgaatttggacagtgcgagcattcgtactttcaatgacctgggtgaagcgttcatccggcagtataagtacaatttggacatggccccagatcgtgatcagctccgtgcgatgacacaaaaagagaaggaaacgttcaagga

SEQ ID NO: 101951 - DNA, 264 bp, Glycine max
  Peptide Sequence Number=SeqID_218729
atggctagcatttatcatccccagcttaattcattggatgtcaaactctttggaggtcaagaaaagtgtgcaaggtatggagggggaggaaggaggagacaagttgatacaaatcttccaaaaatggaagaaatggcatcccttcatgcaagaagaatgtggatttgcccagtttcgtgtagtgcaatggttcagattcttgagaaggaataccctaactttgacacgggaagacctgacagaggttttgattcaaatatttga

SEQ ID NO: 101952 - DNA, 984 bp, Glycine max
  Peptide Sequence Number=SeqID_218730
atgaggctaaaccccgataaatgtgtctttggggcaaaaggagggaagttcttaggttttatcctgccacatagaggaatacatacaaaccctaataagtgtcaagccattatggagatgaggagtcctaggaacataaaagaaacacaaatgttggctggtagaatatctaccttatttagattcttgccaaggatcgttgagagggccaaacagatcataaatcttcttaaaaagacaacaaatttcaaatggaataatgagtgcgaagaaaccttttggcagtcgaaggttacacttgcaacccctccagtactttcaaaacctagcactgacaagaaactcatagtatacctcccgatttctgctgaagccataagtgcagtcctcgtcaaagaggaaaatagtgagctaagactatatacttcgtcagtcgagtgttataggattcaaaaactcgacatcaggcttctggtggacaagaaaaaggctagaaagttgaggactcaagccgcaaggtatgtcatgataaccgacgagctatattggcaacgtttctcctcaccattgcttaaatgtcttaacaaggagcaacaaggaaacctgatccatcggcccgtcaaagagctgcccatcacttacccatggccatttggcacttggggaatggatatcttaggacctttccctggggccccgggacaaagaaagtttttttttggtagttgtcaattactttatgaagtaggtagagctcgaacccctcacaacaattactgctcagagaatttcacagatcaaaagttgaacgagtttatgataggcctcagcatcaagcacagggtgacgtttgtaaaacaccctcaaacaaatggccaagccgaattggctagcaaagtaaatttggtggagctaaagaagtggttacacaatgctaaggaaagatgggtcaatgagctccttgaagtcttatgggcatactga

SEQ ID NO: 101953 - DNA, 288 bp, Glycine max
  Peptide Sequence Number=SeqID_218731
atgaagttcccctcagataccgaatccatcataacagcccatgctgacaaaagaacaactagagaaagctatttggcaagtctcaagcttggccctttaacaaacaatgagccacatcaagttatgcactatgtggagattgtggttggggctgaaaggtcgaaggagttagatttgaacccgagaaccaataatgataacagggaagagaaagatgggggaagaaaggtgtcaggcagtatggcaagaggtctccaagctgatggtagcccaacatcaaagaagtag

SEQ ID NO: 101954 - DNA, 192 bp, Glycine max
  Peptide Sequence Number=SeqID_218732
atggaggtgctcatctacgtcgttggtaccatcgtacttctcgatagtcaaattcttccaattggaagggagggtagcctctatgatgttggggacaaaaggattcttgaactgctggtgtccgcaaaggtgggatacttgcaaaaggcactccaaagctcaagtcaaggtttgactatgagcagtaagtag

SEQ ID NO: 101955 - DNA, 822 bp, Glycine max
  Peptide Sequence Number=SeqID_218733
atggcttttctcgagccactccctcagcgccttcttgccaagcctatcgttaacttgtttaaatctcccgatcttattaaggatcttgatttggttttgactgacttgtgtgcttgcttgtttcaagaatcatggcccaaggacccccctaccgatgctcttcctccccctactaatactcttcctcccctagcagagaaccaaagcaaaagggcaagagtaaacataaaaggaagcatcatgatcagaggcatgctattgtcaaacccttcggccataagggcgctggtgacaactattgcccaagatcttcaagacttttcagcagtgagcaagttcaagcttgagttgaaaaaggcttgtgtcgctgcccttaagctagagtcaaaagggttggagaatcgcgctacaaatgtcaaagactccgcaaatttaaatgtgaaggaaatggaaaggctgaaaactctgttggccttggttgagaaggagagagatgctaaaaaggaagagaaaacgtgggttgaacaaacttcctatgatgacgtgtatgaggcgtacacatctggttttaatcattgcctctgccaagtcctttttcattgtgaggttcatgatgagtcaattttttatattgaaaaaaatgtttataatggaaaattagtccctataaatgacatctcggaggatggtgcccctatcggtaagcaattgacaacctctcccagggagactcaggtgatagaaggtgcaaatgaggatgaagataatggtgatgaggaaggtgatgtgcatgaggatgcctgtcgtgataaagactcttag

SEQ ID NO: 101956 - DNA, 450 bp, Glycine max
  Peptide Sequence Number=SeqID_218734
atggggttctcgaccaagccgaatatctatctggtatacatgccccctaaactcaatgagtcctttatgaccgagacaggagttcgaggagtagagttccaaggttattggtcataccaaagtggtgttggtcgtgaattggattctgattctttagggtcagatttggttttgcttatgggtttatcctctgaaggaggttcgattgatttttttgccttcttagatagcttgccaaaacaggtagcggataacattacccatagcagagacaaagttgttgatgatactactattgtcatagatgttacggtcgaaccttcaaatcatctaacaagggtgtctcaacaacaaaggcatgcaaaggatgaacattgtgagtctttggcctcgaaaatgccaaagagtgttcacaaagaagaaggaatagtcgtctattactattcctag

SEQ ID NO: 101957 - DNA, 294 bp, Glycine max
  Peptide Sequence Number=SeqID_218735
atggactttgaagaaattgtgcaagataaaagatggagagatgtaatggacgaagaaattagatccatcgagaagaatgacacatgggaactcatctctcttccaaaatggcacaaggctattggtgtcaagtgggcaaggctagtagcaaaagctcaacacaagtggagaattgatcagatggatgtgaagtctgccttcttgaatggagtactcgaggaagaagtgtacttcgagcaaccgttgagatacaatgtgaaagaagaagaagacaaatttctcaagctaaaatag

SEQ ID NO: 101958 - DNA, 330 bp, Glycine max
  Peptide Sequence Number=SeqID_218736
atggttgctttgaaacaaccaatgattagagttgttgctattattgctggaggagtacctaagtcaaacactaagcaattggttgcatatgtcggggcaaacaataaggttgttattggtccaaccactaatggaggcattcaagcaagtgcttttaaaattagtgacacagctggaacaattgacaatataattcactgcaagctctataggtttggatctgttggatttgtatctaaatttatgacggttctgagagaagacaggtttttgaattacaggggggtgtccaatgaattatacaacactatttgtccacataacttgtga

SEQ ID NO: 101959 - DNA, 276 bp, Glycine max
  Peptide Sequence Number=SeqID_218737
atgctccactcggctcggggggatatagctcagttggtagagctccgctcttgcaattgggtcgttgcgattacgggttggatgtctaattgtccaggcgaggatcaagctggcccttgcgaacagcttgatgcactatctccctttaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 101960 - DNA, 552 bp, Glycine max
  Peptide Sequence Number=SeqID_218738
atggggacaaatcaaaacggcaaaaggttttatcaagtcaaggttaaaagtctagatgtcactagcctcaaggaattaggacgattgatgggacctctccaaaggcaagccttccgcaaagtgtacggaaagattctagatttggccgcaacggaggtatttacggaagctgtcgtatccctcgcccaatactatgaccagccgttgaggtgtttcacgtttggggacttccaaatggtcccaactattgaagagtttgaggaaatattaggatgccctctaggggggaggaaaccgtatcttttctccggttttcttccttccttgagcaagattgcggctgtggttggggattcagcaaaggagttggatcgcacgaagcaaactcggaatagcgtagtgggcttgcctcggaaatacttggaaggaaaggcaagggatatggcgagccaagagaagtggggcccgtttgcaaatattttagccttgctgattttttggggttgtcctcttcccaaacgtcgccggtttggtagacttagccgccattga

SEQ ID NO: 101961 - DNA, 216 bp, Glycine max
  Peptide Sequence Number=SeqID_218739
atgtcggttattgagttttctattcaatccctgaatgagatttgcatgatgtcgattaagaaatgctcaaggcctaagtggagaagggcgaagacccaagtggagaaggataaagcccccgagtggagaaggatgaaggcccaagtggagaatgatgaagtcccagaggcagaggcactaccaagactattaattgttgctgaaggcccaaactaa

SEQ ID NO: 101962 - DNA, 333 bp, Glycine max
  Peptide Sequence Number=SeqID_218740
atgtcatttatcttccaagaagcaaaggaatccattgatgaagaagatcctaggcctacaagctccaatggagcttacatcaccgtaaaatccgcgggttgtgcgggtttggactgtggggtccgcggtggcagcaggggcactaatgaggatgacacgatcagggaattccaccggggcatcctcgattcagatcttggcgttggtggcctcctagagcgtcttcatgagcatgttgaacttgtcgatgatggcgcccacacacaatgcatgatagaggagacgaaaggtcacgtcaccattagagtttggagtttggttcaaacttactaa

SEQ ID NO: 101963 - DNA, 327 bp, Glycine max
  Peptide Sequence Number=SeqID_218741
atgtccgttgtcgcgcaagctttgtctccttcaaccgcagtctgttggaaacaaaaccccccatcacacagtgtctcccaatgccacgaagaaccgaacgccacaaagaaagtcatatcgaggacactgaagcttttccttttgggactgttacttcaagttatccaaccgatagtcattgctttaatgtttttgactaaaacttatgtatgttgtgggtatttccatgggcacgacaaactaacatatggagttgatttgagcaagatacgctggcttggggtagttcaggttgttgggaccagtaaagttgttaacccttgctaa

SEQ ID NO: 101964 - DNA, 189 bp, Glycine max
  Peptide Sequence Number=SeqID_218742
atgccagaagtcgttaccttaaccgcaaggagggggatgccaaaggcaagtgcatctctcgtcttcgacgattgccgtttcaaagtcaaaaagtataaaaaacggcttgcgctgtatatttctcatccactgaaatttaagccagtgcctttccttgaacttgtcaatctcatttttattgcaaagtag

SEQ ID NO: 101965 - DNA, 1224 bp, Glycine max
  Peptide Sequence Number=SeqID_218743
atggcttcttctctttccccttctccctcttccctcgaccaaacccttcgcgacgtcgacgactacgttctgcgtttcaacactcgcgatttttgggaaatcgatgttaagcgagtgaaggaaaatgggtcagaaggtttgtcaagggacacacttcattatgtgtacgagcttgtgaagaatgggaatgtggcatttcgagagaacagaatggaagaggcaatcaacttttactcaagagccaataacatcaaatcaggtgatccaatcatcctcagcaatcgaagtgcagcttatattaggattagccaatatttcatgcacagaacaccatcatcttcagaacgtaggccattgagtgggcttgaacccacaacacttgctgaactgggtttgaaggatgctgagaagcttgttgaactccaaagtaattcagcaaaatcatatcttttaaaggccaatgcttttctactggagaattctcccaccctgggtctgtacctacttgatggggaactcttgagtgaaggacagttagagaaatatgaaaaagcccgggatgttattctttcaggccttcaagttgatccttttagtaattctcttcgggcttctcttcaaaatttggaaagtgtttcatctagttcaagagggatgagtacacatggacatccagaacgtaatgatgattttgattgcactctctgcctgaagttactgtatgaacctgtcacaaccccgtgtggacattctttttgctgttcgtgtctatttcagtcaatggatcgtggaaacaaatgcccattgtgcaggactgttctgtttattagtcctagaacatgttccatcagtgtgacattgaagaacatcatacaaaagaatttcccagaggaatatgctgaaaggaagcaagagcacgacagtttaatcaaagctggtgtagatttactccctctttttgtcatggatgttgtcataccatgtcaaaggtttccactcaatatatttgaacctcggtatagactcatggtaagaagaataatggaaggcaatcatcggatgggaatggctatacttgattcaacaggttccttagctgagtttgcctgtgaagtggaaatcacagagtgtgaaccacttccagatggtcgtttttatatagagctttatttaggaggacttccttctgtcaatggaattttacagatgatgagatattgctga

SEQ ID NO: 101966 - DNA, 333 bp, Glycine max
  Peptide Sequence Number=SeqID_218744
atggctcctttagaggatagtaacacttggtctttagttcctttgccttatggcaagcattgcatagccaagggctacacacgacaagctgggattgacttctccgatactttctcaccagtagccaaacttacatctgtaagagtcctaatagttgtagctgctggtagcaaacctataactctacctatggatccaaatctgaagctcagtctagttgatggtgatcttattaaggatccttcattgtacaaaagaatgatttacaggcttatgtataatgcatctgactatatctcagccagatattacttttgttgtgcacaagcttag

SEQ ID NO: 101967 - DNA, 306 bp, Glycine max
  Peptide Sequence Number=SeqID_218745
atggcaatcccaaaggaagaacaacttcaaaaatgggtttcctttgccggcagtcatttacccagccaaaaatttatctggtcagaagattttgcgttctctttcctagtttcctcattcgttattcactctcccttgaggagattctgtgtcctttacttcgggggaaaggatgaggattcttttcatgggccaaggttcaaagtagctcaaggttgtgtctcaacatggtcttctcatcgtgcgagtccgattttgatatctggggcaaaacaaattcgtgtcaaggtgtcggtctcgggttga

SEQ ID NO: 101968 - DNA, 285 bp, Glycine max
  Peptide Sequence Number=SeqID_218746
atggagcttgaattgaagaccaaagaaagagggctcatggtgaattgggcccctcaagaagaggttctggcccaccctttagtgggtggattttttactcatagtggttggaattccacattggaatgtattactaaaggcgtgcctatgctttgttggccactgatagctgatcaaacggttaatagtaggctaattgtggagaagatggtgaagaatttgatggagaatcaaatagaaagactcacaagctctacaaatgagattgcaagaaaaagctcatga

SEQ ID NO: 101969 - DNA, 557 bp, Glycine max
  Peptide Sequence Number=SeqID_218747
atggaacgtgtattggctgatgtacttagagatcaaaggaatttgggcaacaagggtgacgaaggttggaaaaggtcagcattgaatgttgcagccgcagtgttatctacaagcttcaatgttaatgtcacatcagataatgtcaaaaaccgtatcaaattatggagatcgtggtatggtattgtaagtgacatccttggccaaagtggatttgattgggatggcactaagcacatgatcacagttgagaatgaaaatgcttggaatgaatattgcacttcgcataaatcggctaaaccgtttcgatacaaggtgcttcaaaattgggatgatatagtggatttgtgtgctaaagatagagccaccggtcatggagctgaaactgctatggatgctgatgaagcgatgagtagagaaacaaatgaagtggaattcatggggttaggtgctactgccatagatttagaagaaccaaactctaatacaaaaggaaaaagacaaggttcgacttcttctggcacacatcctcatcaagagaaagatgggagaaaaagaag

SEQ ID NO: 101970 - DNA, 225 bp, Glycine max
  Peptide Sequence Number=SeqID_218748
atgttgcgaaactttacggattacgcaacaatgctctttttgacttccgaaatgttgtggaactttacggattgcgcaacaataactttacggattaccaaacaatgggggttaagtacctcgaggcggtcaagcgaaggttgcatgccaccaaataatggtccccggatgaaattagggtatgacagtaggcaatgtaaagaaatgcgaaatcccaaaaactaa

SEQ ID NO: 101971 - DNA, 1244 bp, Glycine max
  Peptide Sequence Number=SeqID_218749
cgatagctaccagctctatgtcgatacttcaggtcttccgctttatcagcgcggtaaccgtaaaaacagtattgaagcgcctttgcgtgaaaacctggcggcaggtattttaaaactcactggctggcaacccggtcaagccttgcttgaccccatgtgcggtagcgggacctttttgcttgaggccgtgatgatggcactgaatattgcgccaggcctgaaccgtaactttggttttgagaaactcaaaaactttgagtcagataccttccgtaaaattcgcaatgcggcagctaaagcggtcaaacctgtgactttccaaagcatctacggctcagatatggatttacgtgctgtacgtgtgaccaagcagaacctggagatggcaggttggctggaggccgtgcaactgactcactgggaattcacccaggtagtgccacccgccgagagtggcgtactggtggctaatccaccctatggtgtacgtatcggtgaagatgaaacgctggctgcgctctatccgcaaatggctgcgacacttaaacagaaattctctggctggaatacctacttcctgactaatgacttacgcctgcccaagctcatgcgcttgagccccagcaagaaaacgcctttgtacaatgggccgctggaatgccggctatttgaaatcaaaatggtggcagggagtaaccgccgcgaaaaggccgattctccggcagtggatgattttgtggaggagcgcgactgggcgcagtttcattcgccgaaaaatctcgccatggccatgattgtggaggcagcagaagtggtcgagcattttcaatggatgaccgaagccgatagccgccagctggatgatgccaccaaagagaaagtggggcaggaactggctgatacctttgtttacctgatgcggattgctgaagtctgtggcatagacttgattgcggcaacgaatgcaaaaattgagttgaatgcccaaaaatacccggcagataaatgcaaaggatggttgaccatggtggcgaatgtccattcaccagtgacggatttgctcaaacagcaacagatcgcttttcaagtgattgaaattccattaagcgaagataaaaaacctatccggcatttggaagagctgctttttgcgcagggactggatccgcaatctgtggtgcgcagcgtcgtgttcaaaggcgaaaacagtggattttgcttattggccgttgccggcggagggc

SEQ ID NO: 101972 - DNA, 504 bp, Glycine max
  Peptide Sequence Number=SeqID_218750
atgacggagggtgtggtgaagggtttgccttgcaaaccttcccgtttttccatgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtttgtgcctcggtggtggatcatcatgcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcgtgggatcctctag

SEQ ID NO: 101973 - DNA, 195 bp, Glycine max
  Peptide Sequence Number=SeqID_218751
atgatgatagtctccacgcgtcaacgggctcgtttcccctggttgacgaaaggtgtgggtaaccataagacgacaaaaggtggagaagatgatgttagtctcctagcgtcaacgggctcatttcccctagttgacaaaagtgcggataaccataaaggtaaccccgcatgcctcttgacttcacgggtcagatga

SEQ ID NO: 101974 - DNA, 627 bp, Glycine max
  Peptide Sequence Number=SeqID_218752
atgaccgaccctctcaacgagtcaatctcttgctttctcataagggtggacccttgggtacatgccctcaccttcagagggctacacgcccttaccttcagagggctacatgccctccgcttcagaggactacacgtcctcgccatcagaggactacacgtcctcgcctttagagggctgcatgccctcgcctttagagggctacatgtcctcgcctttagagcactgcatgccctcaccttcagaggactacatgtcctcacctttagaggactatatgtcctcgccttcagaggactacacatcctcgccatcatagggctacatgccctcaccttcagaggactacacgtcctcgccttcagagggctacacgcccttgcctttagaggactacacatcctcaccgtcattgggctgcacgacctcacttttagaaggctacatgccctcaccttcaaacgattacatgtcctcaccttcagatggctgcacgcccttgccgtcatagggctacacacccgcaccttcagagggctacacgccctcacctttagaggactacacgtcctcgccatcagagggctacacgccctcgccttcagaggactacacgccctcgcctga

SEQ ID NO: 101975 - DNA, 760 bp, Glycine max
  Peptide Sequence Number=SeqID_218753
accttcagagggctacacgctttccccttcagaggactacacgtcctcacctttagagctacacgccctcacctttagaggactgcacatcttcgcctttagaggactacatgtcctccccttcagcgtagtacatttcctcaacttccaaggaatacatgtccatgccttcagaggactacacgtgctcaccttcagaggactacacatcctcgccttcagagggctacacaccgtcaccttcagaggactacacgtcctctccttcaaagggctacacgccctcaccttcagaggactacacgtcctcgccttcagagggctacacgtcctcaccttcagagggctacacgccctaaccttcagaggactacacgtcctcgccttcagagggctacacgtcctcgccttcagagggctacacaggcttaccttcagagggctacatgccctcgccttaaaaggactacaggtcctcgcctttagagggccacaagtcctcgcctttagaggagtacacgtcctcgccttcagaggactacatagggtaacacgtcctcacattaaaaggcctacacgtcctcgctttcagagaactacatgtcctctccttcagtggagtacacgtcctcacctttcgaggactacacatcctcgccttcagaggactacacgtgctcaccttcagaggactacacatcctcgccttcagagggctacacaccgtcaccttaagaggactacacgtcctcacctctag

SEQ ID NO: 101976 - DNA, 615 bp, Glycine max
  Peptide Sequence Number=SeqID_218754
aacacatataacagcatcaatagaagaattgaaattaaacccgccttggcagcaagaatatatggagacaagtcatttttccttagatgtaatttcattagttatcaagacaccttgttcgatgcaacggggcgtcattactttaagaattgttatatagaaggtgaaatagactttatatggggttatggacaatctttttatgagaattgttcaatcaatgctgtaggaataaatagtactgaaccaggctttgttacagctcaaggacgagagtcaccaactgatccaagcggttttgtgtttgaaggaggttctcttgtcggagatggaaaggtaaatttaggaagagcttggcgtgcttactcgagggtaatatttcatggaacatatctttcttctgtggtgactcccgaaggatggaacccatggaattatactggtagcgagagtaactttacttatgctgaagttgattgcaaaggaccaggagctgatacttcaaaacgtgttaagtggataaagacattaaatcaatcgcaacttaatgaattttctttgacttctttcattaatatggatggggggatcgataatctaccaatcattttctag

SEQ ID NO: 101977 - DNA, 318 bp, Glycine max
  Peptide Sequence Number=SeqID_218755
atgtggtaccatgtcagtgaaaacctcatcgagcgcctaggagtacatgacaagacaaaccataccctattagggtcactctgtattgcgagaatgctccaatcatatgggatcagcacaagcttaaaggagtactcaaactgggtttatttacccccaagcctacactcaaaagagtttacccccaggcctacactccgaagagtccgtcagggcctctccttcctgattcaggtccaacccaggaaacattttaacagacagactctatgtatgaattgtacaaaacacatggctcctcaattgttctcaaaataa

SEQ ID NO: 101978 - DNA, 132 bp, Glycine max
  Peptide Sequence Number=SeqID_218756
atggcggcattgtcgttctcagtggcatccgtggtggaagatgtgcttcaacaacacggtactcgcctcaaagatcttgacttggaatctagaaaagcagaagaagctgtttttgaatcccgggtgctatga

SEQ ID NO: 101979 - DNA, 156 bp, Glycine max
  Peptide Sequence Number=SeqID_218757
atgcagaaatcaaagagggatgtgtacctaagagcctacttgaatggtgctttgaaaaggcttgacgatactccacaaagtaaattcaaggttgctgctaggtggattgttgttaaatatttcaatgatgctaaccattggaaccagagagattga

SEQ ID NO: 101980 - DNA, 336 bp, Glycine max
  Peptide Sequence Number=SeqID_218758
atgactccacttgatcctgaaggggattggccggggcggggggctcgggcactcgataaccctcgaacgagcacgggcgaggattccctcgagaacctctatcgactaaaggacgacctgaatgagaatgggcgggactccgagacctttaaaagattgaaagacaaaatagtgccatacgtcccaccacaaccgtccgatcctctgatggagaagatcagtcgccttgaacgggcagttaataagttgagtagggacaagtatgatgttgcagatcttgagaatctctccttataccccaaagtcaggcttccgtacggttttcagtggccatag

SEQ ID NO: 101981 - DNA, 297 bp, Glycine max
  Peptide Sequence Number=SeqID_218759
atggcatatcatgctagctctaaagctaatcaaaattcaatgcaaaataatgtgattcattttggcaagagctattctttagaagatcatcaaagggaaccagagttacaaacctaccatcaaaaggaggcagaaagaggtttcaatctggacaatttgttgatgcaattcaaggatacaattaaatcaattcaaggagcatttaaaagtacaaaaattcagattggtaagctggtagaagaagtgactcaagctatgggtagaagagaagaagaatttgtagaggttgaagcttaa

SEQ ID NO: 101982 - DNA, 511 bp, Glycine max
  Peptide Sequence Number=SeqID_218760
atgggactcatctggctcaacgagggatcatgcaggctcctcccctgcctgggcatcgggccagtctccaagccatgcaacctcacccccaaactgctccggagtagggcacgcaaaaggggcggaaccctgcccccgttgactgaggctgaactggtagagacacttgtgtatctgcacctacccacggtggttggccacctgctggcgaaccaaatgctgtggtggcggtatgtttgcggcctgatgttcatcaccctacgcctgcctaggcgtgcagtacttctcgatgaaggcctgggtgatcggtggtcggattactttactgggggtgacgggaactccgaagaactagcagaggcccgtgatcagtgccggaaaccccagggccctgttggacttatttgggtccagagggtgcctggcaagacattgctgagcagcagtgtcatccatgtctgggtcaaagtggtcattctggtgcgcatgatccacacccgcctccttgtag

SEQ ID NO: 101983 - DNA, 467 bp, Glycine max
  Peptide Sequence Number=SeqID_218761
ggaacaatccagacactggtgactcagaaaaatgcgggttgtacatcgaagaaaatcctccccgcttggttgccctaggaagagtttatgagggatccacaaccgttcacaacatccctttgttgcatgatcaagtgaaggtcggtgttgagcaggttaaagatgcagatgctcccattcttgtacccactgacgaggttattttagtggggcaagcacttaacaccttccttgcttggttgacacatctcgtcaagcatttatcagaacaaggagctgtgggaccagcaaaacctgcagataggccggatcatgaggtcgatgatcccctatatctgatgacattgaccatcccacaactatttttgaagtcgttgcaggcatctgacagagacaagtatgcgagtggggaattccgatgtgtatggattcctcgagccatagtcctctgggcaatcacaatttga

SEQ ID NO: 101984 - DNA, 210 bp, Glycine max
  Peptide Sequence Number=SeqID_218762
atggctaggtcaatttggtcatcgttccaactgtctctaattttttgtcctaacttacccggtagttttaaaaataatttttctcctaaagaactatctgtaaatcctcctgctatggaggcatacattaggaaggtttctttgaaagattcccagcaggctctagctatgtctcctagatatgtttcagctcttgctatcatgtcttga

SEQ ID NO: 101985 - DNA, 447 bp, Glycine max
  Peptide Sequence Number=SeqID_218763
gacgtgatcccgtcactgtcgcccagcccgctcgatctggcggattaccgcgatgtggtgctggcgcgctttagcaatccctacatcaaagacaccaaccagcgcgttggtgccgatggactgtcgaagattcccggcatggtgacgccgacgctgcgcgaatgctatcagcgcggcgcagaaccgaccgctaccgccgtgctgccagcgctgttctacctgttcctgcaacgctgggccagtaaccagctgccgtatgcgtatcaggatggcgtgctcaatgctgacgcgctgcgccagcagctgagcggcgagaatgcgctacaaaccttcctcagcgaccgcgcgctgtttgccgaactggccgatgaccgtgcttttcatgcgctggtgacgcgcagcgtagacgccatagagcagcagctgctgcagccggcgacggtgtaa

SEQ ID NO: 101986 - DNA, 593 bp, Glycine max
  Peptide Sequence Number=SeqID_218764
gatatggccagataggtactctggaagaattatcggacgaggaagccagagaaaattttgatgtgaacgtatttggctccttaaatgtgatcagaaatgttatgccttatttacggaatcagggttccggaaatatatttaacattgcttctgtaggaggtttatttggaagttttccgggttggggaatttattgttctactaaatttgctgttgcaggattcactgaagcccttgctgaagaagctaaagctttcggagtaaaagctacagtggtttatccgggctatttccgcacagattttcttgctaaaggttctgtaaggacacctaaaaataccattaaagcatacgaagcagcccgtgaatctgagcaattacaccttgatacaattaatggaaaccaggccaacgatccggagaaggctgctgaagtgcttattgccataagtaaggaggctcagccaccagtgcatttattgctgggaaatgatgcttatgatatacttaaaaataaaataaatatgattaaccaagatgcggaacagtggaaaagttacacattgtctaccgcatacacagaactttcataa

SEQ ID NO: 101987 - DNA, 483 bp, Glycine max
  Peptide Sequence Number=SeqID_218765
atgcgcttacacaacaatctagaatcagttgatgaacaagaaactgccacatttgctaaatggattctagacattggagatggaattatagatgatgaaaatgatggttatgctaccattcaaattcctgctcatctactcattactcaatatgatgatccaatcagcgctatagtcaaatcaacattcccagacttagatcagcatcacaataatcctgaattctttaaatcgaaggcaatactagcttcaacaaatgaaaccgtagaacaaatcaatcattacgtgctatccttcattccaagtgaccacatggaatatctaagctctgattcggttgataaatcagaaagcagtgagaattcgtatttccaatcaattactactgaattccttaattcattgaacacattcggtttgcgaactcattctatcaaacttaaaattggaagtcctataatgctgttaagtgggatcctctag

SEQ ID NO: 101988 - DNA, 174 bp, Glycine max
  Peptide Sequence Number=SeqID_218766
gaatctaaaattaaagaaatagaagagaagcaagcatcttcatctaattcttctaggccaacccttgagttgccactagtttcacccttttccatgggttcgcagtcgggttccactaggctatctcttgagccaccatctgttataccatcatcaagggtagcttctatataa

SEQ ID NO: 101989 - DNA, 555 bp, Glycine max
  Peptide Sequence Number=SeqID_218767
atgggtgaagtggaggaggtgcaagagcaggtgaaggccaacatggaggccttgaaagagcaaatggccacaatgatggagggcatgatgagcataaaggatataatggaggtcaatgcggttgcaatagccactgccagcaccattgctgagtgcaaaaacaagcatgccttcccaccatatgacttgcctctcaactatacaccacccaatgtggcatacacttccagtgaggatgtcaataactctcctcccatactcattgaaagccaacaacctcaaactgatcatgcacatgtctctcaaaccatgggggagacacatgaaattccccaccacaatctagccgacttcgagccttgcctcggatatgccactgaagggcaagcagttggtgaggaaaggctaaaggtcgttgaaggaagtgaaggttatgccttttctaacctaaaagagttgttcctggtacccaatgtcgtcaccccttccaagttcaaggtgtcggactttgacaagtacaaggagactacttgcccgaagaaccatctaaaagat

SEQ ID NO: 101990 - DNA, 474 bp, Glycine max
  Peptide Sequence Number=SeqID_218768
atggcgctaaagcgcgcgacctatacccggccgtcggggcaaggaccaagccccgatgacctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcgttgcgatggtccctgcggatgttga

SEQ ID NO: 101991 - DNA, 2022 bp, Glycine max
  Peptide Sequence Number=SeqID_218769
atggataagattaataaaatatccgacgcagaaaaggtcgccacgccaaacataaacccaatttttgaacaccctaaggcagataactgccgtcgctggctggagaaaaaagaggaacccatcacgaaccatcattgtgatagtcgtactcctggcccttatgtacaattatttaggagtgagaagacgaagacgccacaaaactatccaaagaagcttataaatatacctgtgaataacaagcaagaatcaataaaaaagtttgaatttcctcacctcaaattctgctctgtttcttccttctatgctggaggtgctggccctcaaattaattacggtttctacaacttctctcatggtcaaagcccagacagagtcaacgccattgggctctgcaggggagatgtggagccagatgagtgccgcagttgcctcaactatgccagaagcaatctcacacaagattgtccaaatcagaaagaggcaattatacaatatgacaattgcatgttgcgctactccaaccgcacaatatttggcaatctggaagttaaacctggttattgtgtgtggaacttatccaatgtaatggacggggatgagtccaagcaagcgcttgcgaacttaatgaggaaactcaaagatgtagctgcatcgggtgactctcgtcgtaagtatgctacggataatgtaactactggaaattttgaaaccatatatggtcttatgcagtgcacccctgatttgtctgagatacaatgcaatgactgcttggatggggctatctcacgaatcccacattgttgtaatataacgttctgtggtggaggtgttagacccagttgtaatatagcgtactgtggtggagttattagacccagttgtaatattagatttgaaaactaccgcttctacaaccacacgactatgttggacccagagataccaccatcatggccagcatcacctcctttcgcagacatttccccagaaccagaagttaaagaagatgaagttgaggatgaaattaaaattgccgagtcattgcaatttaacttcaacacaatacaagttgctacagaagacttctctgattctaataaacttggacaaggtggatttggagctgtttacaggctgaccgagatccattttcagggtaggctctctaatgggcagatgattgcagttaaaaggttgtcaagagattctggccaaggagataccgaatttaagaatgaggtgcttttagtggccaagcttcagcaccgaaatttagttaggctacatggtttctgcttggaaggaaatgaaaggctacttgtctatgaatttgttcctaataaaagccttgattatttcatatttgatccaaacatgaaagcacaattggattggaaaagtcgctacaaaatcattagaggtatagctcgaggccttctatacctccacgaagattctcgactgcgtattatacatcgtgatctcaaagcaagcaacattctcttagacgaagagatgagtccaaaaatagcagattttggcatggcaagactggttttagtggatcaaactcaagcaaatacaagtagaattgttggaacctatggatatatggcaccagaatatgcaatgcatggacaattttcagtgaaatcagatgtcttcagttttggtgtactagttcttgagattttaagcggccaaaataacagtggcattcatcatggggagaatgttgaggatctactaagtttcgcatggagaagttggaaggaggggacagctataaatattgtagatccatcattaaacaacaattcacgaaatgaaatgatgagatgtatccatattggtttactttgtgttcaagaaaatttagcggacagaccaaccatggctaccattatgctcatgcttgatagatattctctaagtctcccaattcccgccaaacctgcattttatatgaacagtagaactgaaagtcttccagacatgcagtcatgggaatacaactga

SEQ ID NO: 101992 - DNA, 2040 bp, Glycine max
  Peptide Sequence Number=SeqID_218770
atgtccccggttccttccatgatgctgttttcattcatttctttccttgccattctcaaatctgaagcccaggatcagctaaatttcgtgtaccatgaatgtaacaaccacttcggaaacttcacccctgcaggtgtctacggcagcaacctgaataccctcttgtccaaagtgtattcccacgaagaaatcgacaacggctactacaatttctcgtatggccaaaaccctaacaaagcttacgccatcggtttctgcagaggagatgttaagccagataagtgccgtcgctgcctggataagtccgcggtccttctcagagagcggtgcccattacagaaagaggccattgcatggtttgacgcgtgcatgctacgctacacaaaccactcaatatttggcgtcatggtaactcaacctaacaacatcttgtgcaacacaaataacgtgtcgacgaaggtgctggaacagtttgatcaagctgtggacgacttgttgagcaagttgagtaacatgacggtggacggcggtggctcccgccgcaatagcgagttctttgcggaaggagatgctccagttcaatcaagcaacaccaccatatatgctctacttcagtgcacacctgatatttcgaaacaaaactgtactgaatgcttgcagagtgctttgtcagaaatttcgacattttgtgatggaaagatgggtggtcaatatctagggccaagctgttctgttagatatgagacctacctcttctttgagcccatagtcgatgcaccagctccagcaccacagcctgccactgatcaggttaccacgcccattggagaagaaaagaggaacccatcacgaaccatcattgcgatagtcgtgccaatggttgtcgttatcgtactcctggccattatgtacaattatttaggagcgagaagacgaagacgcaacaaacctatccaaaatgaaggtgaaggtgatgatgatgaaggggaacttgctaatgacattaaaacagatgatcagttgttgcaatttgactttgcaaccatcaaatttgcaacaaatgacttctctgacgcaaataagcttggccaaggtggatttggaattgtttataagggtacgctttctgatggacaagaaattgcaattaaaagattgtctatcaattctaaccaaggagaaacagaatttaagaatgaaattttgctaacagggaggcttcagcaccgaaacttagttagactacttggattttgttttgcaagaagagaaagcctgggtatttatgtagatccaaacaaacgtgtaaatttgaattgggagatacgctacaaaatcataagaggcattgctcgaggtcttctttatcttcatgaagattcacgattaaacgttgttcatcgtgatctgaaaacaagtaacattttgttagatggagaattgaatcctaaaatatcagattttggcatggcaagattatttgagatcaatcaaactgaagccagtacaactacaattgttgggacctttggatatatggctcctgaatacattaaacatggacagttttctatcaagtcagatgtctttagttttggcgttatgattctggaaatagtatgcggccaaagaaacagtcagattcgtgatagcgaagaaaacgcacaggatttattaagctttgcatggaacaattggaggggagggacagtttcaaatattgtagatcccacattaaaggattattcttgggatgaaataaggagatgtattcacattggattactgtgtgtacaggaagatatagctgatagaccaactatgaataccgttttattaatgcttcatagcagctctttcccacttgctgaaccttctgaacctgcgtttttaatgcgccgtaaaagttctttgcctatgattatgttgtctggcagtgagcaatattcagaggtaacaagatcaagtgattcaggaagtcaatatgctcaaggatcatcaatagttaagactccaaccactgagccatatcctcgttag

SEQ ID NO: 101993 - DNA, 387 bp, Glycine max
  Peptide Sequence Number=SeqID_218771
atgaaaggagggcttaagggacccaagaaagagcagaactacatcaaaaccaatctaggcaatcccacctccatagtggcaacaatagagttccaaagtccaactttgatccagctcaactctagccctacatcctcacatcatcttccacatcctactgatccaataactcctcaagtagtggcttattccacaacacccctcttcgctgtttataacatggttgaccacaagataacaatcatcatgaggggtagtagtatgatccctgagtcgtttatcgcctcacaccctgaccatactgccactcccaaccctccatctacaacccttccttaccaacgcctaagaactccaaatacttctcgatccaggataaacaattaa

SEQ ID NO: 101994 - DNA, 141 bp, Glycine max
  Peptide Sequence Number=SeqID_218772
atggataatagtttgaaggtgaaaaagaggctaagttttgaattgcaaaaagtagcagttgggctaagctcagtagttgggctaagcgcaacttcagcgcgcttagcacaaaggagaatttggcagagtgtcaacatctaa

SEQ ID NO: 101995 - DNA, 303 bp, Glycine max
  Peptide Sequence Number=SeqID_218773
atgggtcccaagggtgtggcttttctcctctccctcaacctccttttcttttccatgattggtagcttcaatccttctttccctgcccaaaatgatgaccctagcagtcagatcagcataataagcaatcagtgctgcaccgcagtcgccgctcttcctataattggtggcgctttttgcttttgccgcgcagtgtcacttgggatccttcctccactagccactgaaatactcgcgcaaatactttttagcgcctgtggacgcaacaacactattttcgactacaattgccaacaagattag

SEQ ID NO: 101996 - DNA, 966 bp, Glycine max
  Peptide Sequence Number=SeqID_218774
agaggactacacctcctcgcctttaaagggctacacgccctcgcctttagaggactacacgtcctcctcttcagaggactacacgtcctcccctgtagaggactacacttcctttaccttccaaggactacatgtcctcacctttagaggactgcacgaccttgccttcataggactacacgtcctcgccttcaaaggctacacgccctcaccttctgagggctacatgccctcaccttcagaggactacacgtcctcagagtgttgcacgacctcaccttcagagcactacacgtcctcgccttcagagggctggacctcctcgccgacagagtactacacgtcctcgccttcagagtactacacgtcctcgccttcagaggactacacgtccttgccttcagagggctacacgccattgccttccgaggactacacgtcctcgccttctgaggactacacgtcgtccccttcagaggactacacgtcctccccttcaaaggacaacacgtccttaccttcagaggactacatgtcctcacctatagaggactacacgtcctcaccatcagaggactacacctcctcgacttcagagggctacatgccctcacctacagaggactacacatcctcgccttcagagggcagcacgccctcaccttcagaggactacacatcctcgccttcagagggctacaagccatcgcctttagaggactacacgtcctcgcctttaaagggctacacgccctcacctttagaggactacacgtcctcgcccttagagggccacaggccctcgcctttagaggactacacatcctcctcttcagaggactacacgtcctccccttcagaggactacacgtccttagcttccaaggacgacatgtcctcacctttagaggactacacgtcctcgcctttagaggactacacgtcctcgccttcagaggactacac

SEQ ID NO: 101997 - DNA, 324 bp, Glycine max
  Peptide Sequence Number=SeqID_218775
atggctttcaaaaagaccatagccacactgctagttttgagtcgactcaggctagaggtatccctactcctgtatctctcagtagttgacgaaaccaatttgctggaaatgacacaaccaacctgtggaagcaatgacttccaagattattttgatgatgccaaagaatcaagagttaagcaagttccaaagaatcaggagtcaaaaagcttcaaaaatcaagtttcaaagaatcaagattcaagaataatcaagtttcaagattcaagaacaatcaagatcaagattcaagactcaagattcaagaatcaagataagtgctaa

SEQ ID NO: 101998 - DNA, 1100 bp, Glycine max
  Peptide Sequence Number=SeqID_218776
atagtgggagttcagataacttcctccagcctagactagctcaatgcctgaagttacctgtagaaccaattcctaatttgcaggttttggttggaaatggaaatgccttgactattgaaggattaattcaagacttggaggtgaaaatccaaggtcatacactgaagctaccagtgtacctacttccagtttctggtgctgatctagtgctcggggctgcatggttggcaacaattgtgcctgatctttcagattatagtactctgacattgaagttttacttgggtaatcaatttatcaccttgcatgtctttgatgtgccatcaggattaccccctagaagaactcacaatcattcaatcccattggttgaaggtgctggaccagtaaaagtcaagccatataggtatcctcacagccggaaggatcagattgaagatggcacttggagattttgcacagattacagggccttgaatgccatcacaatcaaagatagctttcctattcccactgttgatgaactaattgatgaacttcatgggaacaggcataaaacagctttcaggacacatcaagggcattatgaatggcttgccatgccatttgggctcactaatgcccctgctacatttcagcctctcatgaatgagatcgattacttgggccacacagtatcaggcaagggagtaacaatggatcaagaaaaggttcaagcagtcttgaattggccatatcctataaatctgaagcaattgagaggcttcctcggtctgactggatactacaggaaatttatcaaaggttatgtgtcaatcgcaactcctttatccaatctgttgaagaaggaaaactttcattggaatgaccacacttccatggcttttgacaatttgaaagctgcaattaccaaggcaccagtactggcattgcctgatttttccaaagcctttacattggaaactgatgcctctggtataggcattagggctgtattgagtcaggaacaacacccaatagcttttttctctaagaagctcacacctaggatgcaaagacagtcagcttatataagggagtcctatgctaccatagaagca

SEQ ID NO: 101999 - DNA, 627 bp, Glycine max
  Peptide Sequence Number=SeqID_218777
ttctctttccaaaacatggacggtttggtggacctagtcgcgattgatgctttccttgcatatcaccatagcaaggagagtctggtggtgcgagaagaacagcgcacagattatctgctgcatacccgctctttgtgtatggttggtttcgcacctattccaacaagacataaggcacccatgtccgcttcaaagtcatcgctcgaagaaaaagagggagttctcttctcatgtggggactacccaaacattccgttgatagggatgaggggttgtattaactacaatcctgcacttgctataagacagttagggtaccccatgaagggagcaccgacggaagagagcctctcgcctttccttgtgagagatttcggcacgcaaagtctcaagattgaatggctaagagttcatacacgagggttagattggctctccaagttgaaaattttcaacgaggagaacttcgaaactccggaagaggatgaagaagtccaagctctaaaatcaaagctaggaaaggcaagactcgccaaagacaaattcaagttagttgctacagacatccggaaagagtgtgccgaattacgagaggaaaatgcggctaccgcaagagccctcgaatga

SEQ ID NO: 102000 - DNA, 479 bp, Glycine max
  Peptide Sequence Number=SeqID_218778
gtagttgtgtctccggcaaaaccacctccaaagcccgatccagaggttgatgatccgctttatctgatgacattaaccatcccagagcttttcttgaggccttatcaggttacatgggatgccaccgtgttcggggtctttaatctagatttctcactctacataaagcacgaagacctctccgaaattgcacacgatggtcaatgtctcagcatttcagtgttacagttgtggattctgcatttcactgatacaagtatgcgagcggggaattctgatatctatggattcctcgagccacagtccattcagaggtctgggcaatcgcagtttaagtctgaaagttacataaagagttggatgcagagttcaaaacgcgatgtctatcttggagcatacctaaatgggccagacaactaccttaaggggattattaacaggctaaatcaaaggctcctgctaggtggattgtcgtcaag

SEQ ID NO: 102001 - DNA, 597 bp, Glycine max
  Peptide Sequence Number=SeqID_218779
atgcatgaccctacattgaattcaatgcttactaatctaggttggaaggatgatgaatctgaacctatgactataaaagaagagcctgttaaggaagctactgttaggtgtaaacatattgtggatctatatgcacttgattcctctttaggcattcctactatagctttgagatgtaagggagagattcaaagggaaattttaacattgaaaaggaaggaacttgctctttggcgcaaggaagagatagaagaggctaaggaaattttgggccagtctaaaactttggaaggccaaatagaagattttggaaaggcttgggagtttgggagtaagtcaagacaaagacatcatagaagagatacaacaatctcaaatccatattccttttctagtcataaacatagctacgtaaaagggtgtgggaaggacaaggggcttatgatagatcacgaggaaatagaaggaattgatgatgacaaaggagatgacaaaaagctcaaagatcaatcaaagaacaactcaagtgaatcaagaacagttcaagagttcaagataagaatcaagaagaattcaaggctcaagaagaaagtttag

SEQ ID NO: 102002 - DNA, 255 bp, Glycine max
  Peptide Sequence Number=SeqID_218780
atggcggcggaaacagcaacaacaaggagaacgaagactccaccatcacctaaagcattcgagcatgtttctttatgtggagttgtctgtggaagcttcatttgggcatcgatggcctcgttcgatgaagctcctcccagaaactccaagaacggcgagaagatcttcaaaaccaagtgtgctcagtgccacaccatcgacaaaggtgtcgaccacaaacaaggtatctatcgtcactcatcaccttcactttaa

SEQ ID NO: 102003 - DNA, 708 bp, Glycine max
  Peptide Sequence Number=SeqID_218781
atgaaggagagggcgtgcagccctacgaaggcgagggcgtgcagccctacgaaggcgagggcgtgcagccctctgaaggtgaggacgtgtagtcctctgaaggcgagggcgtgtagtcctctgaaggtgagggcgtgtagtcctctgaaggtgagggcgtgtagccttctgaaggcaagggcatgtagccctctgaaggcgaggacgtgtagtcctttgaaggtgagggcgtgtagccctatgaaggtgaggacgtgtagtcctctaaaggcgagggcgtgcaaccctttgaaggtgagggtgtgtagccctctgaaggcgaggacgtgtagtcctttgaaagggagggcgtgtagccctctgaaggtgaggatgtgtagtcctcagaaggtgaggacatgtagtcctctaaaggggaggacgtgtagtcctttgaaggcgagggcgtgtagccctctaaaggggaggacgtgtagtcctctaaaggggaggacgtgtactcctctgaaagggagggcgtgtagccctgtaaaggcgaggatgtgtagtcctttgaaggcgaggacgtgtagtcctctgaaggcgaggatgtgtagtcctatgatggcgagggcgtgtagccctctgaaggcgaggacgtgtagtcccctgaaggtgagggcgtttagccctctgaaggcgaggacgtatagtcctctgaaggcgagg

SEQ ID NO: 102004 - DNA, 2040 bp, Glycine max
  Peptide Sequence Number=SeqID_218782
atggaagatgtttatggcaatgttgagaaaactcatagatttagcaccaccttcaatactatgtatattctaatagctacagtgtttgcttcattgaaggtgaggattcataagttcctagaaaagactagaagtcacccgagtaaaccgaggctgtgttttgatgctccttccttggagcattgcatctgtaacctgcctaagagaggatcactcaccgtcatcactgtaggaggtgtgggggaatcttttgtggcagttgtactcaacaaagaatggttttacgtggacaaggtgattcgcctgcctgggaaaggaagcttgaaatcagcacctagagatgaaaatgaagttttgaaccacattcttggtcaagccagtgacaaagttcccagcagacaaagatcatttggcatttcatcttcttcgagtaattccaattttgatgaaaaaatacgaaaaattgtctcaaatgacaagcctaatgttttgcgtattgatttgagatccaccactcaagatgagttacggaaggaacttgagaggcaagctgatgctttggaaattcaattaagaaattcaattaagaaaatcttagtaaaggacgatcttacttccgaacttagagagctgggatggtctgatatggatctacataatgaagacaaaaagtcatcaaacttgagtttagagggtgaattctcatcaccgattggagaagcctttacaaaaactggtgaacaaaaggacaacaagattgacaagtcccaagttgttgctctgaaaaaaaaaaatgctctaatgctgaagcgcaaggctatcagcattaattgtagcatgaataatgataaagaattatcaaatatgcacgatcatagggatggttttgattttgaacaccttttggccattgttgatgaccttcatggttggaccgaacctaaaaatgcatcttccaagtcacaaacctttgacaaagaagaattgcttagtgaaattcagtctcttaaaagaaagtctcttaatcgaaagcgagcaggtaatgtcgaagaagcaatgaaattcttgaaaaaggcaaagttattagaaaggggtcttaacaactctggacctgaagattataatactatgtcacaaaaatccactgttgtaaggaaaggtgtgagttttgaaattgctggtactagatcagactccattcaactagataagagaaatactagtgccactaataatgttgcttccagagtcgcaccaaaaagcagattgatgattcaaagagagcttttgagtttgaaaaagaaggctctcacattgagaagggaaggaaaaatgaatgaagcagaaaaagaaatgcaaaagggtgcagctcttgaatgtcaactgatggagatggacaaggctatgaatgaaggaagcgaagatgacgtaacagatcaagatatgtctgatccaacacatctttcactccttagggacttgggttggaatgatgacaataatgatgtttctaattctctaagcaagcctttgaagaaatatgatgatcattttgtgccattcaatgatgcttccttaagtaaacattctacaaatatcttggttcaagcgccaagaagtaaagctgaaattcagaaggaacttttaggtttaaagagaaaggcccttgctttcagacgtgaagggaaagttgaagatgttgaggaagttcttaaaatggccaaagcatcagaagcccaaatagtagagatggacactgcaaagagtaaagcacgggttgagattgttgtcatgaaagacagacttttcaatcctctagttgatgaagaaagatgcagcagaagacaaaagagaagaggtgagaggaggcgccatccactagggaataagccatggaagaaggagcttcaccaccaagatgagccttggataagaagcttggaaggatgcttcaatggaggaaaagaaagagggagagaaagagagatggggggagcacgaaattcaaggaaaaaaaagggagagaagtggaactttgaa

SEQ ID NO: 102005 - DNA, 987 bp, Glycine max
  Peptide Sequence Number=SeqID_218783
atggcttactatggtgaaagggatcaacctggttgtgaggttagccctattactgttgttgttgaggtcaccctcgtgtggctacaagaagtcgaatgcccctatgagcctccgtgccctgaggatgtgcctccaactccaccagccatcgagactcctgttgctgatgctactactcctgctactcttgctccttcacctccccctggtgtttctgttcaggaggctagttttggtgtggtgttgttgtccattgttgttgcacctttgttaagtgctggtgtggcaaccactagtgtttccacactgttgcctccttcctctttggctatgatggtttctccttttgctgttttggcggcggcgacattgcctttttcatcttctcaccctcgcgtctccttggaacatatgtacacccctagtgatgcttttcatcttctcaccctcgcgtctccttggaacatatgtacacctctagtgatgctgattcattgtggggtgcaacttacaagccgaagcagaagacctcgattggctttgtgtcagcctttgataagaaccttattaggtcagctgggggctactgctcacactctttggagggtggagcaccctaaggtggcgaatgccaccgtcgcttttgttgtggccgtaaggttgaactaccaactatcttccaaagttggtggtgtattggccaagttattacgcaccaggctggatggtgatgagttgttcaaatgctacaaggacttgtgggtggagagaaaggacctgggcggcaaggtggagagcattgtggcagagaaggaaaagcttacaaaggtggtttctgatttagaggcttggcttaaggagttggagtccatgctggaggagtccgagctgcgggctaccaaggagagggaagccaataaggagcttgaggaggagctgctcgtttataagaagaaggccatggagcagcatgaaaaagggttttag

SEQ ID NO: 102006 - DNA, 339 bp, Glycine max
  Peptide Sequence Number=SeqID_218784
atggatagaagcaagaccactacaggaaattacaaccaacgagtggagaaattcacctggaaataccatatctgtaggtacgatctcccatatgccattgtcacagacaacaacactcaattcaagcacctagtcacctctatcgaacatcctcagaccaatggtcaggcagaggcagctaacagagtcatcctcaaggccctgcgtactagactcgataagtctaagggtctatggaaagaagaactctacaacatgctctgggcatataccattgttcaccccagacaacaactaatgaaactgcttactgactcacatatgacacagatatcatga

SEQ ID NO: 102007 - DNA, 399 bp, Glycine max
  Peptide Sequence Number=SeqID_218785
atgccactcgttgtcggtggcatatactggagtcgtgatggtaatatgcttttgcatatatgtcactcgccgtgggtggcatacattggagtcataatggcctactcttacatgcatgcctcttacaaagtggcacatactggagacatagtgatatgctcttgcatatatgtcactcgctgtggatggcatatactagagtcatggcagtgtgctcgtgcgaacatgtcacttgccgtgggtggcatgtgctgtaggcttagtagggcatgcatgcgcataagtcactcgccatgggtgacatgtactggagacataatgctagaagaagggctcaccaagggcgaaccttgggttttaagagcctcagagctacgactatggatgctcttgtcttga

SEQ ID NO: 102008 - DNA, 1023 bp, Glycine max
  Peptide Sequence Number=SeqID_218786
atggcctccaaaaagagaaaatcatccatctccagacctcaagagccatatgacacgactagattcatttccgaggtcgcctgggaacggtatgagcaaaacatgcattccagaaacatcctccttgagaggaatgttgatttgtatgtgacccagtatgatgagttccgtaaggagctcgagaggcagagatggcataaaaccttgaccatgcagcctgatggtcacatagatgtggccctagtcaaggagttttatgctaatttatacaatccagaggacaagtcccctcgacagtgcagagtgaggggcaagcttataaagtttgacgcagagaagttgaatgcattcgaggagatccccgtgtttttggagccaggggtgcgctactccacatactccagaagtaccctggaagctcctgaggaaggatcttactactctcgcccagacctagagtatgctttcatactccaaccttgcccccacctctcatatgtggcccagtctaactcctcttggataggattccctgcacttatcactgccttgtgcattgccaaaggagttactcgggctcggggagcttctaacgcctccacctctgctccaacttctacttcagcaccagctcctactcctgcacctccacaaatcacagcaccctccagcccctccgctcagagctcagacgttctggtgtcaatgctgcagagcctccaccacagcttatgcctggtgatgcaaagtatccacgacctagctcaacatcggcccatccttagcatggaggactttatggcccaggtggcctggccaggagtccaaccttctcctacggggggaggtgaggctcctatagcccaagagccacacctagagttggaggacacaccagatgagacaccagaagacattcttgctgccacgcctttggaggccacagaggaaggagatggtgctacagacactgattatgctgcaaagcagcgcaaagcacctgggacccttggcccactctag

SEQ ID NO: 102009 - DNA, 327 bp, Glycine max
  Peptide Sequence Number=SeqID_218787
atggcgaagttaggaagacagtgtgccagaactgacaacaaccaaaatttcaacctagaaatcaaggccacaaatcaccaccacaactcaatttcttctaggcatcatataggaaacttagaaaacaagaaaagtttaacaagattacttctaggaattgatttggaacatatagaggaagcaaaagagcatcacctagatgaagatgctttgataccacatggtgtagctccctatagagcttgtaggccttggatcttcttcatcaatggagtcctttacttcttgaaaatcaatggaagcagaatggagaaggtggaaaggtga

SEQ ID NO: 102010 - DNA, 171 bp, Glycine max
  Peptide Sequence Number=SeqID_218788
atgagaggcaccatgcatgagcctcaagcgaacctaagggtagatcagaagttctcacccgaaaaagagaatcctcgaggtttcacacttgcacattggagaaaaaaactcattcgaccaggagctcgtgggaaatgcccaaagacaattgtgataatagggtacatctaa

SEQ ID NO: 102011 - DNA, 237 bp, Glycine max
  Peptide Sequence Number=SeqID_218789
atggtggaatgggttggagttatgaaggaaaacttggggtttgggagaatgaaggtgggggatggtaagaataagtgtctaatggaagagggggaggagtcgatcgtggccattggaatggagaaggattttaggaggatagtagaaatgttggtgtggttagcggtggagtttctcaagtatggttgcaacaacaatggttttggtggctacaatgattgtggtggccaccagtaa

SEQ ID NO: 102012 - DNA, 450 bp, Glycine max
  Peptide Sequence Number=SeqID_218790
atgtttagtcatagtggcgtctcctctctctcttccttctccattccgctgccatttatcttccaagaagcaaaggaatccattgatgaagaagatcctaggcctacaagctccaatggagcttgcatcatatcttctcagcttcctcttgtgcgctctctccaaatctctatattttatttctgccaacttcagtgttttaaaggctcttggacctttcagcttccaaaggctcgcttacttagtgagactgggcgcgctaagcgcgagaagagacaacgacctcgctgggcgggatggctgcatgctggggtttcccaacccgctaagcaagttgtctacctcgctttgtggatgtcactcgctaagcggatctgccttgttgagcgagtcatcagctacttgaaccttctcttctttggcctaaaattgagttggattcaacattaa

SEQ ID NO: 102013 - DNA, 249 bp, Glycine max
  Peptide Sequence Number=SeqID_218791
atgaatgcaaacaagatagaagagctaacagtgaaattagcttttcaatcaacttttgtggttgataaagagggtggaagacagggtttaggtttgttttcgcatgaaaacttggagtgtaatattatgtctcattccactaacttcgtaagggcaaagtgggctatctcttcatttggaagaggagtaaagggaaagaaaatgcagtggaagagaggttggattgtgccatggctacactacaattga

SEQ ID NO: 102014 - DNA, 2829 bp, Glycine max
  Peptide Sequence Number=SeqID_218792
atgccaccactggcaccaccgcaacctccgtccgtcaccccttttgcttctccacgtggttcctctttaccttctttgcttccccttccaccacgtccagctctgccgtccacgcccacggttcgacgcctgacgccggaagaactggcctcccgccacgagcatggcctttgcttcttatgcgacgagaagttccacatgggccacaggtgcgcccctagggttcatctcctaatagcggatgaagacgaccctgtcgagaccgtgggttctaatatagacccacacgacccgatccccagcctaatagacatacccgacccaccgacccaaataagcctcaattcctttccgggtcatgtcgcacccgaaacactccggctcgttgggaacatcgccgacaaccccattctggtgctcattgatggaaatggtcagcatctcgaatgccacactgtctgcgaggccatcaccattgaccttcagatgcaatcatttatagttgatttatatgtgttgtccatcgccggagctaatgtcatattgggatggtcaagcttcaaggggatcatgaagctcatgcttcccgatgcacctgagcccgtgttgactgagcctgttgacccaactatccaacacctcctacaccatttctctgttctatttcaggaccctaacacactaccgccgacacgagaaactgatcatcaaattcatttgctaccacacgccacaccagtgaatgtcagaccatataagtatccttactatcagaagcaagaaattgagacacaggttgaggccatgctacaaaggggcatcattcaacccagcacgagtccattctcgtcgttggtgttgctagtaaagaagagtgacgacacctggaggttttgcatggattaccgcgcgttgaatgccttgacgatcaaggatcgtttcccaattccgacaattaatgagctcttggacgagctcggcggcgctcgttgcttctccaaattggatttgctgcaaggtcttgctggtttttaccatcacttcattcacggatacgccacaattgctgcccctctggttaaggcaaccaccattgaacctttccaatggacctcctccacgaagatagcttttgagactttgaagcaagccttgacttcagctccagttctcgccttaccagactttcggttacccttcacagtggagaccgatgcctctgccatcgaaatgggagcagttttattgcagcaaggccatccaattgcattcttgaacaagccctttagcctgaagatgctacgagcctccacttatgtcagggagttgtttgccatcactgtcgcggtgaagaagtggcgacagtatctcctcggccacaacttcactattttgacaaaccaccagagcttgaaagagttgatgacccataaccaagcagctaacgcgttatcacggctgccggaaagtgattcacaagctttcctcatcctttctgttccatgtctcactttcatggatgaactccatactcaacttagtgccgatttgacattccagcagcaaatgaagaatgttcaagaacacccagaccactaccctgaatctccattgctagcaaatagtggctcgccttatggccaatttccatgcaactccagatacgttgactgccaagtgacaaaatacaagaccaagaagttagctggccttctttgccccctccctgtgccaagtcgaccctgggaagatttgtcactggattttattggtggcttacctccttaccatggcaacaccatgatccttgtggttgttgatcgcttctccaagggaattcacttggggatgttgcctcagagtcactcagctcttacagtggcaaggcttttcctggacatggtggtcaaaatccatggcatgccacgaagcttggtatcagattgtgatcctctcttcgtcagtcacctttggcaagagctattccggtccagtggcacccaacttcggatgagttcgacataccatccacagagtgatgggcaaaccaaagttttgaacagagtggtggagcaatacttgcgggcgtttgttcatcggaaaccgacaagctggggcaggctgcttccatgggtggaatggtctcacaatacttcatggatgacgaacacagacacctccccctatgaaatcacctttggccgcaaaccattcaatattccagagtatattgtgggctcctcgaagatagatgcagtggaagagctgttaactgagcgagaagctacatttcaaatgattcccaagataggaccggtggcctatcgactggagttgcctgagggtgcccgcttacaccttgttttttattgttcaaacctcaagcctttccgaggagaactggagtctacaaaaccaccaccattaccactcaactttcaggataaccaacctatcatttcgcctcttaccattttaagttatcgccgcgcttcatccgatcctcacagcccttgggaagctttggtacagtggcatgggctatcgccgaaagagacttcatgggaagactggaagcaactatgccaggactatcaccttgaggacaaggtgatcctacaagggccgaaggatgatacagggtggcttaggtataagggatgtggaatgcttcaacaagacactttatcaaaatggatgtggaggttcttgaatgaaaaagatgcattatgggtcaatataatcaaagctaagaggaaagaaggggaggacattctttgcgaacccaaaacatcatcttggtggaaggaaatttggaaagtgtgctga

SEQ ID NO: 102015 - DNA, 1128 bp, Glycine max
  Peptide Sequence Number=SeqID_218793
atgagagttagggagttatcaccctctgatggcaatggttcctctactaatgaagatgaacctttacctcaggatgcagattatattaatgttctgagtcttagtgatgagctagagacttcaatcttggcaagatttccaagatcacagcactggaagttgtgctttctcaacaagcggttcttggctctctcaaggagtggcgagatctacaaaataaggagagagttaggattcaaagaaccttcagtgttcatgctggtaagtggggagagcaattggtggggaatggagtggcctttcatgtcaagcaagaagctccctcctatccaatcagattataattttgagtttggagataaggagtcattttgtgcaggctctcacctattagtctcaggcaaggagattgatggggctgttatttggaggttcaattcgataaaaaatgaatggcgcaaagggccatctatgatcaatccaaggtgtctttttgcatcagccacttgcagtgctattgcttttgttgctggggggcttgatgcaggaacttacacccaagtcttggattctgctgagaagtacaactctgaaagccggtgttgggagcccctcccaagaatgaacaagaagagaaagttttgctcaggttgtttcatggacaacaaattctatgtccttggagggcaagatgagcatggaaaggacctcacttgtggggaattctttgatggaaaggcaaatagttggaacttgattcctgacatgtggaaggatattgtttcacagtctccacctcttcttgctgttgtgaacaatgagttgtacacactggatgcttcttccaatgagctgaaagtgtatgtgaaaggaaccaacacatggaagactttgggagtggttcctgtgagagctgatgcacaaggaggttggggtgtggcttttaagtctcttggtgatgagttgcttgttattggtgcaccttctatgccacacatagtgcatgccttgtctatgtacacttgctgccctgatcctgatgatgagaaattgaggtggaggcaaattggatgtggcagcattcagcttaatcactttatccgcaattgtgcggtgatggggacctga

SEQ ID NO: 102016 - DNA, 726 bp, Glycine max
  Peptide Sequence Number=SeqID_218794
atggggatcatactcttgtattttggtgtggcaaatgaaataaaatcttcttcttcttccgacatatacaagtatccaagtctggaaggaagctgggttgtggtctcatctggagcggtgattcgagtagtaaaaggactatctaaggttgtgttcgcaataataatgagcctggaaaagcatttggtagagagattcgcaatgatagcttggagtatctggcaatgccgaaacgggaaactgtacatgtgggtggataagatgggcaccccgagacagaattgcaagaggaactcactggaaaccccccacaggagatgcgttggaatgattccaaggcaactttctttggctagcaaggaggttttggtggattggaaacatgttgatattccaattcgtgaaggggaggcacttgttgtgcttgcttcaattaagtggttgatggacctagacacttggcttgccttcgttgagataaactgtaagcaagtcgtggacgctctcaagtgcaattcgggtgatttctttgaatttggcagtatcatttcacaatgcaaggttcttttatgtatggtacctaactttcaagttagctttgttagaaggcaggccatcctagaagcacatgctttagctagggcatcaaggaactatgcatgccttactagtttctgtattattccatattgtattgttggaaatattatcaatgaaacgagttaa

SEQ ID NO: 102017 - DNA, 219 bp, Glycine max
  Peptide Sequence Number=SeqID_218795
atgtcactatctcttcttcttcttcttcttcttcttcttcttttcttcttcttcttcttcttcttcttcttcttcttccttcttcggtatcaggggaattataagcaattgggcttgaatccggaattgggcttgaatccggaattgggcttggacttgaagagagtagacaattttattttatcaaatcttatcttatccagattttatttcatctag

SEQ ID NO: 102018 - DNA, 273 bp, Glycine max
  Peptide Sequence Number=SeqID_218796
atggaggttatcaaaggaaataattctaagtccactttcaagatgaatgcgtataaagtcaaggcatattatgagggattccaacaggtgcaaaacattgtgcacctgtccaacctttgggcaacttacccgtcacatgttaggctcgtgacgttaaacaaatcaatggcaatggaatggagaagggggaaaggtgattggagatgccacttcaaggagaagatgagtcaagaacaagctcaccactataggaaaccatggataagagcttga

SEQ ID NO: 102019 - DNA, 282 bp, Glycine max
  Peptide Sequence Number=SeqID_218797
atgccatcttatgccaagcatttgaaagtggttttatcaaacaaaggaaaattggaaaattttggcactgtgggtcttaataaggagtgttctgcaatgaaattggacataacagacttagatcctacaaacattactcttcaccttgttgatcgtttagttgtctatcctagaagggctattgaggatatgctggttaaggtggacaagttcatcattccagttgattttgaaattttagacgtagaggcagatgaagatgttcctatcatatttgaatga

SEQ ID NO: 102020 - DNA, 316 bp, Glycine max
  Peptide Sequence Number=SeqID_218798
atgacatacaataggtacactaggggacaatccaaacagttcaaaggaacctatgggaaatgtcgagtggtgataacccgactaagggcattattcttggttagtgcgggggactcacatgccacacttggcattcttgacttgagcggagctgcatccatggttggtgaaagcgtcatgtcatgttatgtgtgggacttaacatttgtgtttttggttgcgcaaggaatggagtactcactccctcattaccatattcagaagcagctaatgagcgccgtgtcgcctccctcattctacatagatgctatcggga

SEQ ID NO: 102021 - DNA, 381 bp, Glycine max
  Peptide Sequence Number=SeqID_218799
atgagatggttggagttccttaaggactatgactttgagcttagttaccacccaattaaagccaatgtagtggttgacgccttgagtaggaaatccttgcatatatctgcattgatgattcagaagttgaacctcattgaacaatttagagacatgagccttgtgtgtgagcttacccctaagactgtgaggttaggtatgttaaaagtaactaatgggttggtagatgagattataaaaggaagggaatgggaatatcttgagtattcaccccggagccaccaagatgtatcaagacctcaaaaagatgttatggcagtctggtatgaagaaggaggtagtcaagtttacgtatgcatgtctagtgtgttggaaagctaa

SEQ ID NO: 102022 - DNA, 339 bp, Glycine max
  Peptide Sequence Number=SeqID_218800
atgtgtaatgcaagtgattatgcagtcggagcagttatgggtcaaagaaaaaataaaaattttcatgtcatacactatgcaagcaaggagtttgacttagagatcaaggataaaaagggaagtgaaaattatgtagctgatcatttgtctagactgaccattgatgaggtgaaaaagaggctaagtcatgaagtgctaaaagtgacaattgagcttagctcatcacagttgtcttcagccaggctcagcgcacgactggcgctaagatcaaatccccttactcacgctaagcgcaagggtggcactaagtgcaatgtcacgaattcagagcctatttaa

SEQ ID NO: 102023 - DNA, 564 bp, Glycine max
  Peptide Sequence Number=SeqID_218801
atggagaagacaaaattgtttcaagcaccgacagaaccggaagcaccctttgtttcaaagtttcaaagaggggaggacggatatcatcatctacttccagaaagccgtatgctttgtaagaagcttgtacaagttggggaagaggcacggcaaatacataacatagaaatcacactcggaaagggtggacaattagctagagcagcaggtgctgtagcgaaactaattgcaaaagaggggaaatcggccacattaaaattaccttctggggaggtccgtttgatatccaaaaactgctcggcaacagtcggacaagtgggaaatgttggagtaaaccagaaaaatttaggtagagccggatctaaatgttggctaggtaagcgtcctgtagtaagaggagtagttatgaaccccgtagaccatccgcatggggttggtgaagggagggccccaattggtagaaaaaaacccgcaactccttggggttttcctgcacttggaagaagaagtagaaaaaggaagaaatatagtgataatttgattcttcgtcgtcgtactaaatag

SEQ ID NO: 102024 - DNA, 282 bp, Glycine max
  Peptide Sequence Number=SeqID_218802
atgctggaaccccttcctcagctccccttcacgcctatttatagaaaaaaggcacttggtggacttgtagctcgcccaggtgagcctagacttactcctaaagtaactggctcgcctaggcgagttgattcctttagcttgaagtcttttggtgggtcaggtgagctagaggctagcctgggcgagctatggtccaagaaactcaaggaaaagacccttatgcccccattttgtgtcgaacaacgcaagtcgactagcaaggatcaaaagatcaacggatga

SEQ ID NO: 102025 - DNA, 744 bp, Glycine max
  Peptide Sequence Number=SeqID_218803
atgaagaccgacatggaggccatgaaaaagaaaatgaccacaatgatggaagccatgataagtatgagaaaagtgatggaggtcaacatggctacaatcattgtcgctagccagggaggcaaagcattggaaagtgcgggcagcccctattttgtgcaggttcacagcaagcattccttccaatcatatggcttgcctcccaactatacaccacccaatgttgcacacactcccaatgagaacgtcgataactctgctcccatacccattgagagccaacaaccgcaatctggtcatgcacatgtctctcaacccatgggggaggcacataatgtaccccgaggtcacgctctagccaacttcaagcctcacctcggacatgccactgaggggcaggcattttgtggtgaacccctgccaaacactttggggggccctcaatatcgcccacaatcacaacccttgcattttgcggtgggaagagtccctcctggtatggtgaaaagggagagatttgatcatataaaggagaggctgagggctattgaaggaggcggagattatgcctttgctgacatggtagaactatgcctagtgcctgacatcgctatccatccaaagttcaaggtgccagattttgataaatacaaggggactacttgccccaagaatcacctgaagatatacaatagaaaaatgggggcatactcgaaaaatgacaaattgttgatgcatttcttctag

SEQ ID NO: 102026 - DNA, 99 bp, Glycine max
  Peptide Sequence Number=SeqID_218804
atgagaggcaccatggatgagcctcaagcaaacctaggggcagataagaagttctcacccggatcaacccatgtcattaagcttcagtgggatcgatag

SEQ ID NO: 102027 - DNA, 276 bp, Glycine max
  Peptide Sequence Number=SeqID_218805
gcaaagggtcactttggggcagttgcagctcgcccaggcgagctgaaacttagtgctgaagcaatgagcttgcccaggcgagttggtttcttcaccatgaagctatttggtggcccagccgagccagaggctagcttggcgttcaacactgtaagtcaactaccaaggatcaaaagatcaatgaatgatagtcccaggacgaaattagggtatgacaatatgcttcaaatcaattccaagtccactaaccataattttcctcacacaatgtgctaa

SEQ ID NO: 102028 - DNA, 267 bp, Glycine max
  Peptide Sequence Number=SeqID_218806
atggaagcggtactcccatttgaggtagaggtcccttcccagaaaatactagcggaatcgggcctagaagaatcagagtgggctcaaacacgctacgaccaactcaacctttttgaagataatcgagggaagtgggccctgaactatgaagggcctttcattatgaaaagggctttttctagaagggctctggtgctcaccaacatggatggcgaggagctaccctcacccgtaaactccgatgttgtcaagcgatactacgcttaa

SEQ ID NO: 102029 - DNA, 672 bp, Glycine max
  Peptide Sequence Number=SeqID_218807
atgcaatcacatggactcacactgcctcctgagcttgaggttggtccttcagctgctcatgtcagtacaaaggagagttgtgttgatcattcagggaacgatccaggtacgggtgactcagagaaatgcgagttgtacgtcgaagaaaatcctccttgcctggttgccctaggaagactttatgaggggtcgacaaccattcacaacatccctttgctccatgatcaagtcaaggttggtgttgaggaagttagagatgcagattctcccattcctgtacccactaaagaggttcagttagtggggcaggcacttaacacagttgtgggaccggcgaaacctgcagataggccggatcatgatgtcaatgatcgcctatatcagatgacattgaccatcccacagctttttcttaagtcattgcaagttatgtgggatgctaccatgtttggggtgtttaatgacaacttccccttgtacataaagcctgaagatttgattgaaatagcacacggtgatcaatatctcagcatctctgttatacagttgtggattttgcatgtgaatgagacaaaaagttatattaagaattggatgcagaaatcaaagatgtacctaagagctagcctacttgaatggtgcacattggcaaatgcttgtcattttgcttaa

SEQ ID NO: 102030 - DNA, 181 bp, Glycine max
  Peptide Sequence Number=SeqID_218808
atggacaaagacgtgcgagaggtccttagagccggtccaaagtattgtttgatcgtgacaccgactccagcagcacgcacacgaccagggtattctggtcgtccaatggcaatagtcagtacatccttacatccatgggcgacaaaggaaccctgtgaggcctgctcctccaaagaatcct

SEQ ID NO: 102031 - DNA, 255 bp, Glycine max
  Peptide Sequence Number=SeqID_218809
atggacgcgttactattgttctactatgagaagattgtaggttacatgccttcgaattttgcagatctagtgtttgctggcgagagaattgaagcaggtttgaggaaaggaaaatttaattatgttgcttctgtgaatcctagtaatggaggacccaagaggagtggcgagaggaagaaggagggagaacctcatgttgtggctgcagttcctgcatggccaaactttccactaaccccttataatcctatgtaa

SEQ ID NO: 102032 - DNA, 231 bp, Glycine max
  misc_feature (37)..(37): n is a, c, g, or t
  Peptide Sequence Number=SeqID_218810
atgagggttcactgttatcaagcaagtcggagacccnacatgatcatagattcacctccactccttatgttcccatggacccggattaataggcctaactctctaaaaacactccccagcggagttgccaactgtcacaacctacccttcggcgggagggtgacgcagaggctcacgggtgcgtcttccaaggaaggagaatgcgcgaagtcgccatcaacgtttatttga

SEQ ID NO: 102033 - DNA, 231 bp, Glycine max
  Peptide Sequence Number=SeqID_218811
atgactttattttgcacatgctttcttatcgaacaaaaagatcacacgcacgatctcggatcaacaggattttctcgaaggtgggatgggatatcgccagtcgagaacgactttgaacggcaatcccaaaggaagaaccacttaaaaatgggttttcctttgccggcagtcatttacctcgccgaaaatttatttggtccaaagattcttgtcctctctttcttttattga

SEQ ID NO: 102034 - DNA, 816 bp, Glycine max
  Peptide Sequence Number=SeqID_218812
atggcagcctgtaatcgattacaacatcctgtaatcgattaccagaaggcttattactcctgtaatcgattaccaagccttgtaatcgattacaactcatcctcgtctataaatactcacgaaatcagagttgttgcgcagtcatggccctctctcacgcctcctccatacctaaatcttccaaccttcgtatctcactcaattcttcaccaaatcacgtcccgtaaagcccaatcttcctctttttcactcctctttcactatcacggaataagatccactaaaacttcttcaaatggtagagccatcgaagaagagaaagggatcatcctccaccgccgctatgcttcccatcaccgccacggaccatccggagcacccacagcacctattcatccatctttgtcttctccaagatcatccacattgttttcttccgattatcagcgtctacggtacctttctcaattttcttctaggatcatcttagaccctaagtacctagatgtagatttctttaatgatgaaacgtttgattgctatcaagtgtttcaaaattctggccttgttgatttcatgtcattaaaattgccacattatcctgaacttgtaaaggtcttctacttcaatttaaaaattcaagatggcattattacctctgaggtgctttgtattcctatggtcattgatcagtcattgttcttttctttgactcatttaccctgtcaaggtgcaccttttgagggcaccattgttgatgactggaaatttgattattctggtcatgatgctcgccgtatggtctgcactgactag

SEQ ID NO: 102035 - DNA, 303 bp, Glycine max
  Peptide Sequence Number=SeqID_218813
atgaaagcaagtgaagtaacaacgactatatcaaaagaagaaagagagagagagaaggaacatggatcttggccttgctgttgtcgatggtatcgttactctccacctcaaagtggagaaagagagaatgaagaagatgaaggtgcaatgcttttgccacaactggctcatcgtcatgcgcttaagtcatccatcacacacacgaggtggaagatgaaggttaaggaggaagagcgaaagggaatcagacagaggtggaagatggagaaacccctagcgcagaaacgcgagaggttggcatag

SEQ ID NO: 102036 - DNA, 324 bp, Glycine max
  Peptide Sequence Number=SeqID_218814
atggatatgatggttgtgtaccaagaaggagcttatgagcgcctatgcaggtgggttcaggccgaatgtagaaaattgggtgacactgacaatccagaagttagtgagctttcgaaaactgcagtgcactacctcaaggaaaaatctgtcctcttcaaatattgtgcagaacagtttttcttgggattaaaatttggtcatcttccaagggagcatgacactgctgctctgcaacaatatggaggggttgtaggactatcaaatttgttgaaaaccaatcctgagaagggtattcatggtgatgatgctgatttactaaaatga

SEQ ID NO: 102037 - DNA, 1119 bp, Glycine max
  Peptide Sequence Number=SeqID_218815
atgacttcggcgcgcaggacaagtgagagtagtctccagcgagctaggcgccccgaacgacgttgggatcgtagcttttccgcgctcgtaattgttgcggttctcggcgtgtgcgtttcacgtcataaagatgttatacgatcatctccccccaaaccagccggggtcgacgcgtgcgatttcgccaatctgttcgaggatatgtgggaagaaaaagatgcagaggcgctgctacgcgtaattgagaaacgaggtggtgccgacgaatctgttcgtcagaaattcatgcaagatttatttagtgtctttcactcacatggcgtgaaattctggctcgaagaaggaacgctcattcagatggttcgaaatgtgactgggatgccagacgaaccagctacgctaccgtttggtgacattgacgtgggcattcgtgatactgagcttttcgcatccggacctttggcgcaggcgatggttgttttaaaattgcaccgttttcgaataatacgttgtcatcgtccaatattcacgctcgagcgggacggcgattacgtcgacgtcatggtttttgcttcgagcgctccggcgtgccaggtgcgtgaacccaactcggtacacaagtgctccgacgggatcgcgccgtacgttcttcacacgcatcagcaacagtggaacttcttaaagggtggtttagtttccttgccggggagcagcctacttgaaacagtcgactacttggaagccatgttcggtacgacatggtatcagcacgatgtgcccaactggcgacgcacacaatcgccgaatcctggcggaggaggttcatcggcaaactgggagcggactgattctagactcaaatcgaaaccaaaaagatttactttggatagattgggcgcagtgccagatcccaaaatgtgcgcagctccgtgcttgtacacatttcagagcgtgttagcccatggtaagcgcttggtgcgcatagacgactatccatacccggataaaacaccaatcgcacttcaacgtaagtggctcgagcaagcaatcatgccatttgaacgtagcggcgtcccgtatctgcttggagtttcaccacatcgtttagcttacgatgat

SEQ ID NO: 102038 - DNA, 673 bp, Glycine max
  Peptide Sequence Number=SeqID_218816
atgcgcggcgcgagcgccactctgttcgctctcgcgctagtctttttcagaaggattcatgccgccgaacgtgaagccgttcgagcgactcgcttcaacgctcgcaacttttgcgaacaaacctcgacgagagagcttgagccgtggaataaccacaaaaaggttttgtctttcagcctatttgcgccctctagcgagggcgaagaagcagactttccttggtttctcaatggcgtcgtgcagaatgcgaaagacgcgaagctctactatcccgattgggtcgtgcgtgtctacgtcatcggtctcgacatcaaaaccgaaggcatattactgagacagtcaaacattgagctcgtgcgatgcgagctcactctaccgttgaatagctcgagctctcgaaagatgctcactcgcttcttggtttacgacgatcccaaagtcagcgtcgccgtcgtgagagatgcggacagtcgtctaagtccgcgagagctctttgcggtgaatgcatggatctcgagtgatttctgttttcacgtcatgcgcgatcacgcgtcgcacgacgtggctgtactcggcgggatgtttggaatgaagcgcggagcgctgagagacgcgtcgatgtcgcaactgatcacgcgagctttgatcgaaaacccaccccacatcagggggc

SEQ ID NO: 102039 - DNA, 1132 bp, Glycine max
  Peptide Sequence Number=SeqID_218817
atgcgcggacgaacgggggcgtgtggagcggtgataccgacgtcggggagactggctcgcggcggcggcggcgacgcgcggcgaacgcgcgcggcgttcgggcgacgagacacgcgcgcgagcggtgcgggaggcgtcgatcgatgcgttcgatcgatgagtctgccgagatcggcgatcggtggcgaacgcgagcgcgaacgcgcgagagagaccaggacgcgggcaagagcgccggcgacgaggcgaacgaagagtttcacgggcgaactcgtctcgacgacgagatcgacgatatcgacgacgacgacgacgcgagcgttgagtgggtcggaggctggtgcgatgacgctcgagttggacgtcgcgcacggaccggccaaggaggaattttacgccgagtcgtttacggtttcgcagagagcgcgcgtggaggacgacattcggatccgcgtcgagacgaatggtgtgcgatacagggtgagcgtggagacggatctcgcttcgaacgatttactattacactggggcgtggcagagaccaaggagcgatgggacgagtggaaaaatccaccagagaagattagaccaaaactcacgcgcgaaatcgtcggcgtgtgtcaaacgaaatttacgagcggtccggcgcaacgattcggttcgtccaaactccagacgaccatcgaaggggacgtcatcgatggattttacgcgatcaatttcgtgttgtacgataaaaagctcgaccagtggattcataataaacagggtggattttggcacgtgcacctgccgcaaccgccgcaaccagaaaccgtcacgcgcacggtgacgagaacggaggaatacgaggacgagatcgaagaggaggaggagtacgaggaagaagtcgaggaggaggaggaggaggagaccgcgtcgacaccgatggtgaaccttgatttgcacgcgcaggcgtctgtagatgcgccggtgaaggaggaggcgatttcgtcttcgtctttgtcgacgacgacgacgccgtccaacacgtggcgacgtttattaacacctcctgtcgatcccaaaccgttcaccggcgccagcgatgacatcgacagtctcatgcagtctctcatggctgaacgccagg

SEQ ID NO: 102040 - DNA, 483 bp, Glycine max
  Peptide Sequence Number=SeqID_218818
cgcgccgtcgtcgaaaacctcgacacgagcaatttgcctccgttgttcttggtgtggcttgaaagaggaaacgcgagtcacagcggacgcgtgcattcgcgcgtaaagaaacgcttcgaagacggcgaacggtcaatcgtcgacgccgtccagcggttgtccgcgttgacggagcgcgcagcggcgtgcgtgcgacaatcttcaaacgccgtcgccagcgcgcttccagagttgatgaatctgaatttcaccattcgtcgcgaactcttcgacgacgacgagctcggcgtgctcaatctcgaaatggtgagagttttacgcgacgagtgcggatacggcgtcaagtttgcgggcagcggaggagcctgcgtcgtcgcgggcgcgggcgtggacgacgccggcgcagaattgctagcgagggcgtgtcgcgcgcgcggttggaagcacgaaaggatcgcgatacatcctccgcatcacgcgacg

SEQ ID NO: 102041 - DNA, 788 bp, Glycine max
  Peptide Sequence Number=SeqID_218819
cgaacgcgctcgcgagcaagcgagcggcgtccgttgaaaacgaacggctcggtgtcgagagacgcgcaaacgtccacgacctacgaaacctacgtaccaccccatcgcatcacgacatcagtcagtcttcacgtcttccgcgtgctctcgaagtgattctccgtcggcgcgcgtccactcggcgtcgagcgcctcgcgcgtctgatgattctcctcccgcgcgcccacgcgagcgcccccgttccgtcctcgcgcccgtgaccattcaacgcgcgtcctcacgcgcgcgtccgctccccgtcctcgccgcgtccacccctcgcgcgtcgtcctcgctcgacgaagacgctcgacccccaaaacggtgggcggtcgccgaccgtcgcccgctttttttcccgcccgtctcccctcgtctcgcgcgcgcgttccacctcgaacgagacgcacgcaccgcgttaaagagcgacgatctcgagcgcgcgcgcgaacgatgtccggcggcgtgtgcgggacgggaagaccgcgcgctcgacggaaattctccgagtcgattcattccccaacgactgaccaagggacgtgacgagtcagcacttgagaagcagtgtctccactttttcaaaaaacccttcgcccagggggggtcaatggcgagtcgtgaatcgtcgatggagaatcgtgaatcgtcgggcgtggtatattgggagcccctcgaggggagagaggagtcggtgagaggaggtggagaccgtggacgttttgttacacgcagtcgtcgttcgtga

SEQ ID NO: 102042 - DNA, 2151 bp, Glycine max
  Peptide Sequence Number=SeqID_218820
atgaaacgcgccatgttagatggcgccgttccgggcgaggcgggcgcgttcgatactctcaaaccgacacacatcgaagtcaaggagacgaagaagcgcccgccgccgagcgaaaacgctctcgcgaggcgacaattcgtcaccggtttcggtaacaagcgcgagcgtcaggaggcgacggagagttcaaagagagataaggaacgccggaagaaccacaactcacacaacccgacgcgcacgcgttcggacgcacgaccgaggctcgcgcggcgcgtcaaatcgatcgtcgccattcatttttcgtttcgccgcgcgctctgcggcgtcgctcccgcggtgttcactccgagagagtgtgccatcgtggcgacgtcatcgtacactttttcgacatcgcctgttctcgagctcggccgtcaacgcggacgcggtgcacgcggtgtgagagagatcgcacgctcgatgacgagcgatacgtcggcgcccgcagcgtctccgggccggacgcgcatcatcatttggtttagaaacgatttgagactgttggacaacgcggtggtgactcgagcggcggaactcttcaagcggtccggcaagacggcggaggtcgtgcccgtgtacgtgttcgacaagacttttttccaaacgacgaagcgtggaacggaacgtttcagcgcaggacgcgcgaagtttgtgctcgagtgcgtggaagacttgaagaaatcactccgggaacgcggcagcgacttgttggtgagaagcggcaacacggtggacgtgatccgtgagctcacgctcacgggagcgaacgagcggacggtggtcttgacccaagaagaagtgacgagcgaggagaccaacatggatagggtggtcgagaggatgataaaagatcgagctcgaagcggcgcagcggcggcgacgatggaacggctgtggggctcgacgctctatcatatcgacgacatcccgttcgatgtcgagggtggattgaaagacttacccgacgtcttcacgccgttcaggaaaaaagttgaaacgaagagctctactcgcgaatctatgccagcgccgggaaagaatgcactcggaagcatgccgccggatgtcgccggattggaatgggtaccgacaccaagcgatttgccgtttgtgtcagctgaaaccaccaaagcgtgcgaggaatggatcaaggatggtccacacggtagttcggtattcgatttcaaggggggtgaatctcacgctttggcgagagtcaagtactatttatgggactcggatcttttggcgtcgtacttcgaaacacgaaacggcatgctcggaggtgactatagcacgaagctcgctccgtggctcgctctaggctgcgtttctcctcgttacgtcgcaaacgaaattcgtcgctacgagagcgaacgtgtggaaaacaagagcacgtattgggtcatctttgaactcatttggcgggactttttcaaatttttcgcgctcaagcatgggaataaaattttccatctccacggaacgacgcacaggcgcgcctcctggaaagatgacgagaaaatcatcaacgcgtggaagacaggcacaacagggtatccgctcatcgacgcgaacatgagagaactcgccgccacaggtttcatgtcaaaccgaggcagacaaaacgtcgcgtcttggctcgccctagacgcgggcatcgattggcggtacggtgcggattggttcgagcaacacctgttagattacgaccccgcatcaaactggggtaactggtgcgcagcggctggcatgacgggcggtcgtatcaatcgattcaacattgccaaacagacaaaggattacgatccgacaggcgaatacatcaaaacgtgggtgcccgaactcacccagatcccagccgcttacatcgccgatccgaatcaagcccctcgcgagcttcgcgatcgcattggtctcgactatcccaacaaaatctctctccctaggcgcgatttcaccgaattgggttccccgccaggtccgaacaaacgtggcggcggcggcggaggtcgaggcggcagaggtcgaggcggcagaggtcgaggcggcaaaccgcgaggttcctccgcccctcgaagcatccacgaggcggtgtacggataa

SEQ ID NO: 102043 - DNA, 1341 bp, Glycine max
  Peptide Sequence Number=SeqID_218821
atgaggatttgtctagaaggtggttatcatgttttagatgaatctactcactacagcagtgatcttcgcccaacagcgaaacagctgtggatgcctggtattggtgttcttgaactagggatattgaatgctcagggtttgatgccaatgaagacaaaagatgggagggggacaacggatgcttattgtgtagcaaaatatgggcagaagtgggtcaggacaaggacaatcattgatagctttgcaccgaggtggaatgagcaatatacttgggaggtttttgatccatgcactgtcattacaattggtgtatttgataactgtcatctgcatggtggtgacaaggctggaggggcaagagatgcaaagattggaaaggtacgggttcgtctttccacccttgagactgatcgggtctacacacattcctatccacttcttgttcttcacccgaatggggtgaagaagatgggtgagattcacttggctatgaggttcacttgttcatcttttgtcaatatgatgcacatgtattcacggcccttgttgccaagaatgcactatatacacccattgactgttagccagcttgacagtttgaggcatcaagctactcagattgtttcaatgagactgagtcgcgctgagccacctctgagaaaagaggtagtggaatatatgctggatgttggttctcacatgtggagtatgagaagaagcaaagctaacttcttcaggattatgggggttttgagcggcctaattgctgtaggaaaatggtttgatcagatttgcaattggagaagtccaatcactacaattctgatccatatcttgttcataatattggttatgtatccagagcttatcttaccaacaattttcctttacctcttcttgattggaatttggtactatagatggaggccaaggcaccctcctcacatggacacgcgtctctctcacgcggattcagcgcatcctgatgaacttgatgaagaatttgacacattcccgacctcccggccaaatgacctcgtgaggatgagatatgatagacttagaagcattgctggtaggattcaaactgtggttggggacttggccactcagggtgaaaggctgcaatctttgctgagttggcgtgatcctagagctacatcactatttgtgattttctgtctggttgctgctactgtactgtatgtcactccattccaagttgtggccctctttactggaatttatgttttgagacatccaaggtttcgttacatgcttccttcggtgccgctgaatttcttcaggaggctgcctgcaagaactgattgcatgctttga

SEQ ID NO: 102044 - DNA, 189 bp, Glycine max
  Peptide Sequence Number=SeqID_218822
atgaataaaacatttatgatgaaggcatggtggaggttgagcacgcgtaaggattccttatcggctcaagtggttcgccataaatataaatgtgttagtgtgacccccttttcatcgccatctggaagtggaagggtctggaacaagctagacttcacctttggaaggtggccaaggaggcacttctag

SEQ ID NO: 102045 - DNA, 414 bp, Glycine max
  Peptide Sequence Number=SeqID_218823
atggcacttactccttttgaaggattattaggcgtgaaattcctgcttggattaagtttttttgtacaggcacctggtgaaattccatatcgcagagtatattatgatccccagaagaggaaaaatatgtcttggataagaggaactgcacttacatattcagagcttgtttgtgccaccacagtcttcgtaccttcatttcacaactacagaatttggtctttccttggccttggcatgaccacatacacagcttggtacatgaacattgcagccattgctcatggccaggtgcacccaaaatccaaagcaaaattgactaaaaaagatgagagaattgtgtctaatttcttacctacttggactgaacaagaattgtctcatattcacaatatatttaaactaatcaactaa

SEQ ID NO: 102046 - DNA, 219 bp, Glycine max
  Peptide Sequence Number=SeqID_218824
atgtcgtcacgcacgcgttgtatgttgctctcgtcttttgtcatgggaagccggaaggtctatatcaccttcttaactacacacatggggcactgcgtccccgaatgcgcaagtggaagcaacctagctcgcttgggcgagctaggtggcaaccagctcccccgttttgttaaaaaatgggtttccggggcttccgagacacccgtaatgcttccgtaa

SEQ ID NO: 102047 - DNA, 678 bp, Glycine max
  Peptide Sequence Number=SeqID_218825
ccgcacgccgtttacaaactaccgcattggttcgacgaaggtttcgaagagcggcgagcaaaagcggtcgacgagccgacgagccgcttcgcgtcctcgggatcgttcgctgatctccttcgcacgaccatcaccaacgcgttaggatttcgtaagcatggcgtcgcaaaggaagaaagacgttcggccagcgacggcgaaccggacgtcgaagctccggattcgagaagacttcagacacgtcacgttcccgtcaaagtcgagccgaaaacgttcttcgcgaacgagcgaacgctgctgcagtggttgtcgatggcgatactccttctatttctcgggcttggtctgatgacgctcgaaacagcggggtcttccgtctccggtgggacgccgaacgtttccgcggccgttttcggtggaggacattcgcatgcgagcgccgtgtgcggtgtgatcatcgcgcccattgcggtggtcttcatgatttacgccttgtggaccttcatcgtgcgcgcgaaacgaatcgctcgtcgagagccgagcacgcggtacgacgacgttttcggtcccgtcgctttagtcgtcattctttgcgtcgtcgccacggcgagcatcgcgctctccgccgcgagcgtcgattggaaccgtcacgcgtacgcgcgtccgacgagatcttga

SEQ ID NO: 102048 - DNA, 228 bp, Glycine max
  Peptide Sequence Number=SeqID_218826
atggacagtgcagaaatttctaacagggagatcaagagaattttagggaagattgtgcagccaagaaggaaagattggagtaccatgcttgatgatgctctctgggcacatcggactgcctacaaagcacccataggaatgtctccttatcgggttgtctttggaaagcttggactcatgagtggtaagttgaggtctaagtggattggtcctttcgtttgttactaa

SEQ ID NO: 102049 - DNA, 399 bp, Glycine max
  Peptide Sequence Number=SeqID_218827
atgtggaagattatggccaaagaatgggaagagattgataaactttggaggaaaaaggaaatgcataatttagcaaaggaacttgtaaacttgctagcaccaaaagactattcatggcgaaatactgctatagcaagggatagaacagtttccatggggagatcacaacaagaaggaaagtctaaagaaataaaaggggaacaagagggtgcaaggaaaccaacttatacccccttgcttatggctgcttgcaatggaattacggagattgttgaagtaataattcatttccatcctcattcaattgagcatgttagtgacgacgagcagaacatattgtacatggctgtcaaacaccgccagaagaaaatttaccaaatcttaaagaaattgaaaatg

SEQ ID NO: 102050 - DNA, 438 bp, Glycine max
  Peptide Sequence Number=SeqID_218828
atggttgcctcaaataaaatcgcgaaggttagattgggcttcattctctaccaaaccgcgagacaagcttggaagattccgcttcgattgaagggttcttctcagtgtggggtttcaacaaagaacaacggtagtccgtggtggccaccggtggttgtgggtggtggagaagaagcttgggatgttagggaagggttttggaagacagaaggagaaaggaatgaaaagaagtgtttctcacgcaccaaaagacatatcgcagatcgcaacggtaagatcatgaaaatctgtcctttgaacctccagaccaaatttcgagaagatccaatggttatcgaatgcaggagggtgcttttaccaagacagcttcaagcagcttccttgagaatcttttctcgagaggcttctatgagaagcttccttgagaggcttctttga

SEQ ID NO: 102051 - DNA, 378 bp, Glycine max
  Peptide Sequence Number=SeqID_218829
atggcagaatcgtcaaagaaacgaaagggttcttccgcctccgcttcggcttcaagagctcatcgttccggagccactagcgcatccacagcaccaattccaccatcattgtcctcttccccagtgttttcttccaacgaacagcagaaacggtactccaatcttttctcatctcgttccattatcgaccctaactttattgatatggaattcttttctgctgaaacctttgattgcattcaagcctttcagaacttaggtcttctaccttttatgtcattacaattgcctatttatcctgaattggttaaagctttttattgtaatcttgaaattcaggataatactctgatttctgaaatttttgggataaaaatg

SEQ ID NO: 102052 - DNA, 129 bp, Glycine max
  Peptide Sequence Number=SeqID_218830
atgagtgagatacgaagatttggaggtttgggaatggaggaacgtcgtgagagaaaaggggttgcgcagggatttctagaaaatgtgatatttatagagcaggacgcgtggccatctgttctagtgtaa

SEQ ID NO: 102053 - DNA, 380 bp, Glycine max
  Peptide Sequence Number=SeqID_218831
cccagtctaacacttctagacttgggttccctactcttatcaccgcattatgcggagccagaggggttgtatctgatagccttaccttcgagcgcctgagcccggtcattaacctagcctacataaggaagaactgttggaaccccgaggatctaacaatctttatccgaggggctaggagggcgagggcaaggctaactgagcttccttctacttctatagctcctactccagcatccacttcagtagccccttctgtcccagctaagacaaattctcagtgctttaaagccatgctccaaagcattcatcagggacagatcattttactacagagtttacagatgatggcacctccagactctattcctatagtatag

SEQ ID NO: 102054 - DNA, 243 bp, Glycine max
  Peptide Sequence Number=SeqID_218832
atgtggccccacaagccgacacaggctttgataaacactgtttccagagcgtggaacatcagtagagtttcgaggccatcaagggatggtcattcctcagacagagacagaggcggctgtgggatgatgaatttccgcacttccttggaggaggtggagccatacagccaggatcgccaaacttgtgatttatcctttattactactttcagttattttcttattttgttatttcccttgtga

SEQ ID NO: 102055 - DNA, 159 bp, Glycine max
  Peptide Sequence Number=SeqID_218833
atgagtgacccttctttcttaggagaccccaccgttccttcttctgaaggcaaggatagaaattctcatcctgggtcaaggtttatgaaattttatgcaaaattggtcatgcatgcacatatgtggacactcaagcatcaagtttttatggtcatgtga

SEQ ID NO: 102056 - DNA, 252 bp, Glycine max
  Peptide Sequence Number=SeqID_218834
atggaggaagctgtcgaaatcatggatacccttggcaaaatgaagcctatagctagacctttatggattctattctcatcaaaattccccactaaggagataatgaagattgggatgatgatgatcaaggagcctaaaacaaatcttctcgaaaaagaaaaactccttcttctagcagtatgggacatcaagtatttcaagttctctaatacttttagctttattctccatgaattttataaacatgagtaa

SEQ ID NO: 102057 - DNA, 396 bp, Glycine max
  Peptide Sequence Number=SeqID_218835
atggaagaagaaatctctcttcaagagaagaatattacaatgaagatcatctatttctcaaccctgtcttctgtggcctcctctcaacataatacttctgctgatcaaatgacctctatgaacactaagggaagcacaccactaccaacacatattgtatcaacgatgacctccaacaaaggcattaagctaattctcattccaggacatgaagaagagtgcaaaaaagtatgggaaacccatgtactactcctagcttctttgaactctaaaaacatttgctttggaggtccttatcgtcccgaactagattatgaagccattagtggttggttcaccacttatgaggatgaaaatcctataaccacaaggaaaccattaggagtgacttcttga

SEQ ID NO: 102058 - DNA, 291 bp, Glycine max
  Peptide Sequence Number=SeqID_218836
atggctagcaaccactccagagctcagaagaaagctaagacctccaagaggaagcaagaaaagtgttctcaggtttctcttaacaggcttggtacatggttcgcggatgagagtaagaagaacgacttcaagatgatatacgcagtgaagaatgtgagaatacccagcatagggtctatccaagcttgtgcagatggaaggaactttctatctggagctagtgaaaatcttctatacctatgcatgtgccgatttggaaggagaattataagcaattgggtttcaatctag

SEQ ID NO: 102059 - DNA, 519 bp, Glycine max
  Peptide Sequence Number=SeqID_218837
atgccaacccaaggacaatttaataggattccttcctactggcaatcaccagaactaggggagttcaagctgaactgcgatgaggcggtaactagtggtggagaatcagcatgtgcaggagtgttgctggatgacaaagtgtcgcaacctacccttcggcgggagggcgatgcggggctcacaggtgcgtcttctaagggaggaagacgcgtggagtcgccaccaacatttattcgaggaaaacgtcggaaaaaccgaaacgtgtggtctatgaactttaagtgtgaaaggttccggagttgtttttacacacggggaagaactaataacgcacgaagaatgacaaagaacgggaaaaatcttgacgaaattgctcacggaaacgtctcggaagcattacggaagcacctcggcttgaattttcttcacgaaaacatgtttttttcacccaaaacagctgaaatgcatagtgtaggagtcaagaaccctttggaacagcccgccttggcctatttatag

SEQ ID NO: 102060 - DNA, 381 bp, Glycine max
  Peptide Sequence Number=SeqID_218838
atggggtcgtttttgaagtatttccgcgagggggctcttttggacgtaaaacgcatgcatgcagcacccaaaccgccagtggaactggcaagtttggtctccgtgaagaaatcgccagtgctaatggcgatatacgtgccagtgggaaccgccagtcaaactggcgagttccaggtacatgatgaattcggttataacagtgttgtatttcaatggaagggcagtaaaaaagcgattcagattaaacgtggaattagtttcagtgctttgaagaaaaaaattggagacaaggaaaatatattgccttgcaaatttgtgatgaggaagacgttgaaacgatgctggaaagttttaaacaacaacaacaaatatcaattctag

SEQ ID NO: 102061 - DNA, 372 bp, Glycine max
  Peptide Sequence Number=SeqID_218839
atgaagttgtttctgtacaccgctagtctcccctttctctctctgcctattttcgtgaaaggcacagacctgaggctcgtggttgttgaggtagctttccaaaggttgccattccttccagtcaataaccacgaaacttcggcattatccatcgggtatccatcctccttccaaccggtggttaatccggtcgatatctgctccacgacgccgtcgtttggcacggtaatgttgtgtggggggttggggcgttggtccgtcggcgtagatcaaggaagctcatggtttgcacccgcaaaccttgtcggtcttaagagttcatcacctgtgaggctgtcggcggactctatttcctctgacgagtcactgtag

SEQ ID NO: 102062 - DNA, 291 bp, Glycine max
  Peptide Sequence Number=SeqID_218840
atgaaaactgaacaacatcctccacaacgaagttcactagtcattgccagtatgtatgatgaaggactacaaccacatcctcaattatatgaattcatgacacaacctcattatcatcaagaagattatgggtacaatctgtacttcttcaatgctagcggagaagactttatgagcaacctcatagttgttggtatgaattatgggagaacacttgatcacctattatatatagcaatgggggttagatgcaactcaatacctttgtttgatattcaccatattgcttaa

SEQ ID NO: 102063 - DNA, 915 bp, Glycine max
  Peptide Sequence Number=SeqID_218841
atggttcatgggctaggggctatccgatcacctgccaagagacccgatgcagactgcagcctttggaagaaggcagatgcacagttagttgttctcctatggcattctatcgatcctacactcatggtctacttttacaactacaacacttgtcacgccatatggacgaaagcccgagacttatactcaaacgatgtccaatgcctctatgatgccattcataatttgtctacattgagcatgatcgacaatcttccttcgtactgtagcagagttcaatctgctatcggtgcgttgaagacacttataatttctgatgaccagaagatcagaaagttggacaatgtgtgtatggtgtatgtactccatgacctccacaaagagtttgagtttgttcacaatcaaattttgatgaatcccagtgtttctacctcagaggaattcatgggacgacttcttaggattcctttccaagaaaccatatcaggtattggttcttccacaggtggagaatcttcaaatcttgttgcaagacgtggaggtcgtggccaaggtcgagacagttatactggtagagaaagtgcttgtagtggcggaggtggacacccacagtgttcatactgcaagccttgcctctctcactcaccttttgttggatcttggatagactctggtgcttctgatcacattgctgaccgaaggacaggaaggatgattgacataggatatgagtcacatgggctctactacttccactcatcaacagttgttgcatgcaccactattgagtctcccagtcttctccaccatcatttaggtcatcctagtctgaatacattgaaggcaatggttcccagcctttctgagttgcagtccttggagagtgaatcttgtcagcttggcaaacatgtttga

SEQ ID NO: 102064 - DNA, 342 bp, Glycine max
  Peptide Sequence Number=SeqID_218842
atggatatggattactataacatgcttccttttgctttctaccaagacatgggaatgcatagatcagcagcagccaaatttgacaaaacaagcagcaagggaaaagtaaaagctttaacctatatttggaaaacccttggcaggtctctcaacgatccaaaagataccaaagggttctttcttcaaacgtccgttcaaggtgcagggaacagagagccaaacatcaacaaattcgaacaaggcctaaatctaaaacaaagtgtggggtttgatggcagcatgaattccaataacattcaacagagaagtatgagagggaacttaaaaatcaacgttcgttga

SEQ ID NO: 102065 - DNA, 1275 bp, Glycine max
  Peptide Sequence Number=SeqID_218843
atggaaagggagtcatttggggaggacattgcagatacagaaacagagaaatctgattacagtgaagatgagtatgatgatagttttattgatgatgacgaggaagcttctcatgatagcagagaaaaaggtaggaaaggcagccttagacggctgaggaaaaagtaccagtcagtagagtctgatgatgatggccgtcacgaagaaaagataattgctgatgacagtatggatgaccaaacccaggaaatcaaagatgatgaagatatcctacctatttcatctctttacaagaataaagcctctcaaagggtcttggacgaggaaatggatgctagtgttgacagacaggcaggtgatgccagcaacaagaatggtgaagatggtggaaatagtattgttgaaacaaatttaaaagctgaccatgaccttgtagatagtcagacgctcagggaagctcaaccctcaaaccacttggtagatccttgcattgttctggatgttggggatattaaaaatttaaaaaagaaaaagaagagaaagggaaaagagattgatagctccagtaatgatcattctatcaaactagatagtggtataggaggtgagccaaaaatggaaaagatgacccaggattttgtggcaggaaacaaacaacagcagcatgatgatgataaggatgccaatatttcaggcaatgttgcattgccttctgctgacacaggtcctaaaaaaaatagaacaaagaagaaaaagaaagaacaggtaaacaaaagtgacaacggatatcaagaaggtatcatccaagaggacaaagccaaaagagatgcagcagagtcccagaatctgatccataaagtttttgcagaaaaagaactgcatgagaatctaactaatgagaagagtgtggacaatggtgctcatgagtttcctgatggaaatctatctgatgatagaaaagttaagaaaaggaagaaaatgagtaagagtccgggcaatggggaagttgcaaattctgatatgcctgtatctgttgagcaaagtggtgaaactgagatgatggaggaagacagaaataagagggaagatgcaaagccttcccaagttagaacattggcaaatggactagttattcaagaactagaaaaggggaggcaagatggaaaaatagctgctttggggaaaaaggtgaggtcataccatcacggactaggaagcatcaacacctctgtagaacgtgtggatgtgacaaacacttctcggacacgcttttga

SEQ ID NO: 102066 - DNA, 621 bp, Glycine max
  Peptide Sequence Number=SeqID_218844
atgacaagattgatcgttttaaagcccgattggtggcaaaaggctacactccggagtttgatcaggactactatgacacattctcactgtggccaagatggactctgtcagactgttattctcccttgcagtcatgtcattggcctctcttccaacactattaaaaatgtttttctgcatggagatcttgaggaggaagtacacatggaggaaccacctggttttgttgctcagggggaggcctctaccatgatttgccgactttgcagacccctctatggacttaaacagtctccgagagcatggtttgacaaattttgtactgttgtacaacagtttgggtcagttcgtagtgatgaccactcaattttttatctccattcaccacaaggatgtatctacctcgtgtatgcagatgacattgctatcactggaggagatcaacatggcatagcacaactgaagcaatacctttctcgcatcgaagttgctcagtccaaggatggtgtagtgatctctcagaggaagtatgttcttgacatcctagaagaaactggctttatgaatgctaagccaatggacactcctatagaccctagtgtcaaattggtacctgattag

SEQ ID NO: 102067 - DNA, 579 bp, Glycine max
  Peptide Sequence Number=SeqID_218845
atggcggtggaatggagaaagaagagagagaggagacgccacttcaaggagaagatgagtctagaagaagctcaccaccataggaggccatggataagagcttggaggaaaaacgagataaatgaagggagaggaagagaagagcacgaaattttatgctctaaaagagctctgaaatctgaaatatggttcagcccattaatccaagatcaagtccaagattttccattaagtgtgcttaggtgtcatgaggcatcctatgggcccaaaatctaccctaaggctcatgagaaccctagggccttcttttgcatctttggcccaatcttcttggagtcttctatccaattcccttggggggtaggattgaatcacacaatgaatgaaaagatgcaatctatgtcacttaatgtcgtatgggagttagttgagttgcttgagaattataaggcaattggttgtaaatgggtcttcaagacaaagatggactcaaatgataacattgagagatttaaggctagactggtggaaaaggattttacacagaaggagggtgttgactttaaagagatgttttag

SEQ ID NO: 102068 - DNA, 318 bp, Glycine max
  Peptide Sequence Number=SeqID_218846
atggcttttatgagggagatgtcaccacacgttatgcaggatggtggaagcagtcaatactggatcatcatcatgattttgcaaagaatattactcggtgaaacagcagtctatgcaatgatgttggtgtttccacctgaattttatcctttgaaaactattttatttggaaatctttctcaagacatcgttgaaccactgatggatgctttggaggaagattataaagatggaaatgagataaatgaatcaaggcaatttattggaggagtattggatcttgaaaagagaatcaatagactagatacattgacttag

SEQ ID NO: 102069 - DNA, 135 bp, Glycine max
  Peptide Sequence Number=SeqID_218847
caagcaacggtggctcgtggcggtcatcgatggtcatgggtggtggaaaaagggggtgttaggatctcgcttaacgagctcgtcttgctaagcggaagttcacgttttgcgcttagagctacaattcgtgcttag

SEQ ID NO: 102070 - DNA, 432 bp, Glycine max
  Peptide Sequence Number=SeqID_218848
atgcataaacgtttgacaattgaaaaaagagagaagagaagagtcactgtgaaaacctctaatggaaggtcaaaattgttgggaattccaacattgaatatccaaattcatattctgagaatgatcaacgtgagcgagtttgccggaaaaggcgatctgggcctcgacgtcggaggggctgcggcggcggcgggcggcggcggagggggaggagagtggctgcgaggtggggcggaggaagcgctcgaagatggccatgacgaggaacatggagatgagaacggcggtggcgacgaaaccgaaggagacggcgttgacggagctgtcgaagttggtccaatgctcgtctctgtggacgtccagaggcgcaccgattggtggccacgcattggtgatggtgtggtcttcgaccagcattgttgttgcagttga

SEQ ID NO: 102071 - DNA, 786 bp, Glycine max
  Peptide Sequence Number=SeqID_218849
atgggttgttgtgttagtagtcacaaaaccccaacctcttcttcactagcaaaattccatgatccaccaaaacctctcattaaaccttcagaaagcagtagtgcagaggaggctgtgaaggaactgctcttggaaacccccaaatggaacccgacaacctttgccaaatcaaaaccacaaaagccacaccaaaacacaaactttcacagatttaaggatgaaaaaagcaaggttgagaagagggcattgacattgtccatttacaaagccgaagacaccacctcagcagaagtttgcagcttgagcgaaaccgtgtccacagatacttcaatcgccaaccagatagaagaaacgcgcaaaagggtcgatacatctcagcccaaattgcagaaaaatcgttcatttcccggtgaaagaagagagagaacggtggtgcatggcgcaaggaacaatagtgttgggtctgtgaagttggttcagtgcagagaccaaacagctaagaaaattggtaacggcggaacgcgtcgccggagagatcccaccgagaattctctccggcggtcaaggtcgccggccaccgtttccggcgccggagaagctaggcccgtcacgggtcggagcccatctgttaaaaaacttgaccggtccactacaaggatcagaaccggaacggcggaaaacggttgccggaaaagggaaaatccgacgacggcggggaaatggtattccgccggtgagtcattggagaatccacttgtgtcattggaatgcttcatctttacatag

SEQ ID NO: 102072 - DNA, 342 bp, Glycine max
  Peptide Sequence Number=SeqID_218850
atggaaggggacacacgatggaatggaagaatgcaggttgattacgatgaagggagggatggactcgtgatgcagcaggaagggaaaggaggtgtcaatggcatgggtgattggtttcatcctcttaagcacaagagacaaataggtcatctaccatcaatcttgtggaatgatatggctatgcagaaaggaatgtcccaaggctcgaagttcaaaattcaacccaaaagagcagcaacatatttcagagctttcgggattcgtcaatatctgcctccagtgaaatttaaatcggtcatggttttgattactcttggagtgtctttggatggaaaaatttaa

SEQ ID NO: 102073 - DNA, 2166 bp, Glycine max
  Peptide Sequence Number=SeqID_218851
atgggttgtgcgaattcggagttgaatttgcaaattttcatcttgtcaatgttgattttcactgcaagtttgtgtgttggggacactgacccacttgatgttgcggcaatcaatagtttgtatgtggctcttggctcaccaccccttgaggggtggaaagccataggaggagatccttgtttggaacaatgggaaggtgtgagttgtgtcttctccaacataactgcattacggctgggaggcatgaatttaagcggacagctggggagtaatttggatttcccatccatcatagacatggatcttagcaacaaccagattggagggaccattccatccactttgtcccctactttgaggaacttgtcactgtcagctaatcatttaaatggaagcattccagatgctttgtcctcgttaactcaattgtcagacttgtcattaaaagataaccatctgaatgggcaaatcccaaatgtgtttctacagctcactggtttgatgaatatggatctgtctggcaacaatttgagtggtcagctgcctccctcaatggggaatttgtcatctcttatcatattgacctccctcttcaggatctgtatatttctcagaaaccatattctctttacagacatagaaattagtcagatgactgttgtctatatacctagcaacaagaatatagagaacaatatattctctgggccaattcccccagagttgttgagtatccctaatttcagaaaagatgggaatccatttaatactactatcattccatcacctccagctgcttcccctgaacctgctgctatggctccttccccagaaaaatcaccttggaaagtgacacataatccctctgataccataaaagcaccaatacctgcaattgctgggagatctttcaaaactacaaaattagtttggattgttggtgcaggctttttgatatttattgcattaggagtctgtcttctaatgctgtggtgctttaagagaagacaggagaacaagaaatataagaaacacaacacgaatgtgtatacaagatctttgcataaacgtacaagcagcgactccccttttgaagcaactactgacaaggagaaaggatggagttccaaacttccacccctgcagccagcaccaccacatcatatcccaatcattccaggagagaatttaataataaatcaagctatatctaccacagcaaccaaaagacaaattgtaacaaattccatcaaagtttatactgttgcatcacttcagcagtacacaaatagtttttcccaagaaaattatataggggaaggcatgcttggccctgtttacagagctgaactccctgatggaaagttactggcagttaggaagctgaatgctactgcttctatggggcaaaatcatgaacagtttcttcaattagctttcagtatctccaaaattcaacatgctaatattgtaaagcttatgggctactgtgctgagtatagtcaacgactacttgtacatgagtattgcagtaatggtaccctacatgatgcattgcatactgatgataaacttcagattaaactttcatgggataatcgcatttgggtgtcacttggagcggcaagagctttagagtatttgcatgagcactgtcagccacctattgtgcaccaaaactttaggtctgctaatgtactcctcaatgacaatttggaagtgcgtgtctctgattgtggattaggttctttactatcttcaggctctgctagtcagggttgtgcttttgtaagacagcagcaattaaagttggtgggatgccacctcacagctaatggttacagtgctcctgaatttgagtatggaagttatacactgcaaagtgatgtctttagctttggagtcgtaatgctagaactcctcactggacgaaaatcctatgacagctcactgcctcgtggagaacaatttttggtgagatgggcagtccctcaactccatgacatagatgcattgtcaaaaatggttgacccctccttgaatggagaatatcctaagaaatcattgtcacgttttgcagacattatttcttcatgtatacagcatgaacctgaatttcgaccagtgatgtcagaaattgttcaggacctcttgcgaatgatgtag

SEQ ID NO: 102074 - DNA, 1329 bp, Glycine max
  Peptide Sequence Number=SeqID_218852
atgcagagtttgtgtggtcatactagttcagtagaatcagtgacttttgactctgcagaagtgttggttctttctggagcatcgtcaggggtaataaagctttgggatttggaagaagcaaagatggttcgcactcttaccggacacaaatctaattgcactgctgttgagtttcatccatttggtgagttttttgcatctggctcctcggacactaatctaaatatttgggatatccgaaaaaaaggatgcattcaaacatacaagggtcatagccagggcatcagtactatcaaattcagtccagatggccgttgggttgtttctggtggatttgataatgttgtgaaggtctgggatctaacaggtggaaagctcttgcatgactttaagttccacaaaggacacattaggtccctagattttcatcctcttgagtttcttatggctacaggttcagcagacagaacagtgaaattttgggatttagaaacctttgaactgattggatctaccagacatgaggtattgggggtacgctcaatagcttttcatcctgatggacgaactctatttgctggacttgaggatagcttgaaggtgtattcatgggaacctgttatatgtcatgatgttgttgacatgggatggacaacgcttggcgacctatgtattcatgatgagaagcttttgggttgctcgttctacagtaattctgttggagtatgggtgtcagatatttcgctaaaaaggtatgattgtagaattactacttatatggctgctattatgttaattgctagttttaaatgcgaagccgccatttctgtggtgctacatgtcaacaatgaatgtcatgactacatgccttccatattacttatagagccatatagtggtggcttggaaactgagaaaaaagaaagcacagagcaggaacttggtctccagggaagacaaatggagaaagtagaagctagtgtgggactgacttttgggttgtgcagtatgtctcctgacaatgactcaaaagagataaagaatatatatatagactcttctggagggaatcccgataccttactaagatccaggtcttacaattctccaaaagtagatcttcctgaggaatccaaagaaatgctaaactggagtcctgcaacaagagctcgagaaaaacaaaatgaagcacttagaaagtcttacattgtgccaaacgttgtacatcgggacattctcaatggtaaggactcagcaaccttttcgaagacaaaagctgggatgttgcttaagccagttcatgttcaaggagcacccactgacatttga

SEQ ID NO: 102075 - DNA, 117 bp, Glycine max
  Peptide Sequence Number=SeqID_218853
acatgtgaaggtgtcactggatatgctgcttaagcttgtggcagtttttggtccaacagtacgttcaaccatttcagcacctccctctgttggggttgatctacatgcagagcaaag

SEQ ID NO: 102076 - DNA, 1788 bp, Glycine max
  Peptide Sequence Number=SeqID_218854
atggcttcaaattccgataaggattccccaacaccaccttcacctgattcatcttcatcccaatccccgccatcatctcctccaccatcccaagatagttcatcgcccccaccatcatctcaggataattcgtcgccgccaccatcgtcccccccgccatcatccccaccaccatcatcttcgcctcctccgtccccgccaccgccgtcatcaaatgatcagaaatccccgcctccgccatctgactcatcctcctcccccccatctccaccaccgccgccacctcctgataaggattcaggcagccaccggtcgccaccgcctccgccacattcaagacatgagttttctcctcctccgcctccgaaccaccggttgtctccacccaagtcgtcatcatcaggttcctcggatggattgaaagacagtgaaagccattcattgagcatgccagttataataggaattgcagctggagctggcattttgctccttctccttctcgtagtcgtttgtgcgtgttcaagaaggaagaagagatctcagccttccgttagttactacgctaatcaaccttcagatgatggatattataaaagaccaaggggaggtcaaaatcagtatgggtacaataacaacggcgagcacgttctgaatattcctccacctccaggagcaggttggggagcagcaccccaacctccccagatgattagtagtgacatgagcaactccagtttctcgggttcccacggtcccgttttgccacctccacaccctacagtggcccttggattcaaccaaagctccttcacttatgacgagctctcagctgccaccggagggtttagccaacgcaacttgctcggtcaaggtgggttcggatatgtgcacaaaggtgttctacccaatggtaaggaaattgcagtgaagagcctcaagtccaccgggggacaaggaaagggccgacctgtcatggattggaataccaggctcaaaattgcgattggatcggccaaaggacttgcttatttacatgaggattgtcaccctcgtatcattcaccgagacataaagggtgcgaacattctacttgagaacaacttcgaagccaaagtggcagattttgggttggcaaagattagtcaagacactaacactcatgtttctactcgtgtaatgggaacattcggttatatggctccagagtatgcatcaagtggtaagctaactgacaaatctgatgtgttctcgttcggtattatgcttttggagctcataactggtaggcgccctgtgaacaacactggggaatatgaagatactttggtcgactgggcaagaccactttgtacaaaggcaatggaaaatggaacttttgaaggactagtggatccacgtttagaggataattacgacaagcagcaaatggcttctatggtggcttgtgctgcttttagcgttaggcactcagcaaagaggcgcccaagaatgagtcagattgtacgagtactggagggtgatgtgtcactagatgcccttaatcatgagggagtgaaacctggacaaagttcaatgttcagcagcgcgagcagggagtatggtgcggaggcatacggtgctgacatgatgagattcaggaaactagcattagatagtggcgtgggaagcagtgagtatggtggaaccagtgagtatggccttaacccttccagctcaagcagtgaacaatcatctgctgaatatgccaggaggaccacaggaggaggccggatgcacactccttga

SEQ ID NO: 102077 - DNA, 225 bp, Glycine max
  Peptide Sequence Number=SeqID_218855
atgaagcccaatgagttagctcctgctccttttctgccagaagcttcaaggaaaaacaaagaaatgagacttggatttgcttcttggagattcatcctatgcaccctagttgtctttttgattctacaagacagtgtagctagaaagatagctacaacatctgggaatgaagttcaactgaaggaagtatcctatgatttgcaaaagcttgcaacagagggtctt

SEQ ID NO: 102078 - DNA, 369 bp, Glycine max
  Peptide Sequence Number=SeqID_218856
atgtcaagtggaagtgatgcctcatcgtatgaagagcacattcctaagattgagacaatgttaattcacactaagaacgaagtaatcgtccatattgaacacttcttcgacatccagaacttggaaggcatctactatattgcactgctcaataaaatcttatgggatcaaggagtctatctagtcttcaatggactagacgatgccaccaagaatgagattatggttaagaggaccatgatagcccgacaacagaactttggccccttaaaaattaaatccatgagattgaccatgaagataacttggagagaggttcctcaagtggacgaggaagagaaaaacataatgagaaaggtcatatgttga

SEQ ID NO: 102079 - DNA, 885 bp, Glycine max
  Peptide Sequence Number=SeqID_218857
atggataattttttccgtgccgcaggaatgaagaacgcaagggacttagaagatcatgagcatgatctcactctctcactcaggtgtggtagtccaaagagaaccacgcactcttcttccccttcccttcctcaaataaacatctccttgatggaactacaaatgccttaccctaattatttggtgccatcttctaaccacaacattaaccctttatttgagtcatgttctaaccacaactctactaacccttcattggcgtcatcttccaaccataacattgaccctttgttggtggtgtcaccttccagcgctccaggtgctgctgctcctacacccgttttgacacgtcgctcccgtcgtgcctcgtctcaacgccgccgccggagccaaggaaagagcgaaaccatccctgcaccttttccttgggcgacggatcgccgggccaccgtccacaaccgcaaatatctattggaaaacaatgttctcgtcatcaccggaagggttcagtgcaggaggtgcgagcaggagttcgagatgacgcttgatctggaggagaaagtgaacgagttgcgcaaattcattcagaaagaaagcaggtccatgcatgatagagccccggcggcgtgggtgaatccggtgacgccgaaatgtgtgcattgcggacgagaaaattgcatcaaaccaatccttgtgtacactaagaaaagatcaattaattggttgttcttgttgctgggacaaatgctgggtttctgcacccttaatcaactcagatatttctgcaagcacaccaataaccatcgaactggtgccaaagatcgccttctttattgtgcctacatgaccctcagcaaacagcttgttcccgagtggttcgattaa

SEQ ID NO: 102080 - DNA, 186 bp, Glycine max
  Peptide Sequence Number=SeqID_218858
atggagggagagttcaagctgcagctatttgccacatggacacctctaagtgggaccgagaccacgtgtcctttcgtgtgctcaaagttgagccgggaacctcacctgtataacataagttctagacctggtgtactagctaggaaagcgcgccttgatgaaaaactatgtatgtatctacgttaa

SEQ ID NO: 102081 - DNA, 597 bp, Glycine max
  Peptide Sequence Number=SeqID_218859
atgggttatcaggtgcccgtcaacaaatttctgatgcagtcctattacgacagatacacgattttacacgattcggattttgataattttatgtctcaagcaatcccttctggttcttcgtgtggatttgtgttgagattgtcagatttaaagcgcactcttattggtgaagttttcagtgatgtagctgtctttggtgacacaaatctggagctgccttcattcttgtccaatcgttctgctgttgaaattcacttgcttgttgacccaaatatattgcaagagccaactgatataaaaatggagcttccattgcatgctcgatatcaaccccttaatgaaagtgggtactcgacggttgaatttggtgcaccggatatgttagtgcgctgcggcacaaaaggaaaggtggaaaaccactattgcttcttcaaattggaaaaggatgacgccaatctgtatggtcctcatactgtttggagaataccttctggaataaaggcacatgctgatcttgtttctgcagctacatttattgcagctttgttatcaactcttgcaattgttgttgcatcattatattattccaatagctga

SEQ ID NO: 102082 - DNA, 222 bp, Glycine max
  Peptide Sequence Number=SeqID_218860
atggtaaaaaagtatcatgataaaaagctgctcaagaaggactttcaactaggacaacaggtgttgcttttcaactcaaaagatcctcgcaggacatgggtagtgaatgaacaaaggttgaagcaatatcatgcgatgaatgcgctaagcgtgcctgcttcacttagccagatgatcgcgctaagccaaccatttcgcgctaagcacattcatccctgctga

SEQ ID NO: 102083 - DNA, 234 bp, Glycine max
  Peptide Sequence Number=SeqID_218861
atgggtattatgtggttagtttcacgtttactgcatgatgccatttcctttattcaaaagcttaaaggcagtttatttgtgaccataggagttaacgaaatgatgaacatggctaggaatagtttaaattgttgcaaagctgagctcgcctgggcgagcatgtctgaaccagaaatgaggaggggtgaagccattcttcaccccaaaatcttccccaacattcaaaaagtgtag

SEQ ID NO: 102084 - DNA, 300 bp, Glycine max
  Peptide Sequence Number=SeqID_218862
atgactaaagcatgtcaaaagggggtacggaaatgtatatgcctatatgttcttggtagaagtaggaatagcggggggcaagatatgcgggttaggctaattaagggagagaaatccataactgggagctccacacaaagcttcaacctttggccatcatttctgctccaaatcgtgaaaggagagcattttcgaggccgtgaagtgcgtggctacgagtgggacttcgaaaattcagggttttgtgatgatgtttatatgctgaaattgcctatggaaactgttagagatgaagggtag

SEQ ID NO: 102085 - DNA, 351 bp, Glycine max
  Peptide Sequence Number=SeqID_218863
atggctcattccttcaacaaagatgcattgcatgcccaagagcttccgttttcacatttaacggatcctaggcgcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 102086 - DNA, 384 bp, Glycine max
  Peptide Sequence Number=SeqID_218864
atgacgttgctacttagcaacattctgcccagcgaccgcgatgccgatctccccccggcaaaagtatcagttggtatgtcccgtcacgacataggtaaggatcgcgcccacaagacacccaatggacccggagaagtccaacaggtcatagggtttccagctctgattacgggcctctgtcagtcctacagggtgcccgtcccccctacaagggatcgcacccgcaagacaaatagtggacccggagaagtccaacagggtcttaaggtttccagctctaattacgagcctctgtcagttctacaaagtgctcgtcgcccccaacaaggtcatcaagcccctattaacagggctttcatcgagaagtactgcgcccccaggtag

SEQ ID NO: 102087 - DNA, 201 bp, Glycine max
  Peptide Sequence Number=SeqID_218865
atggaagacgtgcagctattcgaactacaagaacaaggaggaacccaggaagacccagataactgtcaattttttcaatgggttgaagaagaaaaccaactttctaattcgtcttctgtctcaagagaaacaatggtagtggctgatttgaggctacaaattgaagctttgcagaagaaaatgagaaaggggatcctctag

SEQ ID NO: 102088 - DNA, 585 bp, Glycine max
  Peptide Sequence Number=SeqID_218866
gtagcgcatctagatagcatagctgaaagcggccttcaaaagcctagcaacggaattgccgatacctatctctatctcttcctatcggcaggagtcttacccgcggatactcttattcgagagatggaattgggaatctgtttcgagacttcgtcattgagagctactaactgccattattccgaggcttatggagacccggttccccgtaaagcattgtccctgggcaagactaaccacccagctcccccgcttgaaagcttcatctttatgacatacctgccttgcccaccattacaagcaagccctgctcctgctctttttagtcgtttccagaagaaagaattgattgacgaatctccgggttctttctgtccaatacgggggaatcagcttcattcaatgccagcatctctctcagctgcaagaagatcaactgcattgccaagctccaactctgcttttagctttagtcggctgagcgactctcctcctggagttaggaatcggcaagagataagagggacgtacttaacagcaaggaagtggaatcaatcccgtttgctacaggattctttcgatctg

SEQ ID NO: 102089 - DNA, 624 bp, Glycine max
  Peptide Sequence Number=SeqID_218867
atggacacggagggtctatgttgtcattgcatggagttaaccctgcttcagctacgccgcgcagatgtcattattgccgatatttcaggtgaatacaggaatcctcgggtttcgcgcccgctatatcctgttgccgttgagctactgatgcggccagaaagcacgttgctttctgaaatggagccgattgaaggcgtggtggcggctattcgggctggtcgcgagcgggcggagcggataagccagacgttattaaccccggaacctcagggagtggaagaggaagacgagtcatttatcgcgctcacccactccgaacgcaaggtattacggctgttaggtaagggatggggtattaaccaaatcgccacgttgctcaagaagagcaataaaacgattagtgcccaaaaaaacagtgcgatgcgacggctctccttacgaagtaatgccgatatgtacgcctggatcaacactttaagaaggcgcttcatcaggtcaattttttctcgctcatctattcactttccgatgcgcgagaagaacggcgtaactgcctggcacatctgcgggacctcgcgttcacgcatagccatatccagcgcattatcctggtctctgatgtga

SEQ ID NO: 102090 - DNA, 288 bp, Glycine max
  Peptide Sequence Number=SeqID_218868
atgtcttttgctgattttgactcctcatccaaagatattgatgcaagctctccttctttgatgtctcctcattcggtgttgtcaaaggcctgggtaccacccagggtggatatggtggatcttgtgtcggaggatgagggagaggacctggaggaggacatatcgtacgaggaagatctgtctatggacgaggaggaccctgtcatagagcctaagattatggaggaggattccccgtatgattcgtctgaggagtcctacaaggagactttcctccatctgacttga

SEQ ID NO: 102091 - DNA, 300 bp, Glycine max
  Peptide Sequence Number=SeqID_218869
atgtcgcagaggagcaatgcatcatcatctcgaacaagagtttcatcacaagttgttcttctttgtggttgtggtagaagagctgttaggcgtgttgctggaacaaatattaacagaggaaggacgtttttcacttgttcaattaataaggatgaagttggatattgtgggtactttatttgggttgatcaattgattgaagcacttggagttgatgattcacttgggacattttccatggaacaaagaagacaatttggaagagaggaagataagacaatgtggaaaggctcaagttaa

SEQ ID NO: 102092 - DNA, 252 bp, Glycine max
  Peptide Sequence Number=SeqID_218870
atgggggatttcatcagcagactctccttccccgaaaacaccgagactttttcaagtctcacaagttatccagaactacgtaggtctgaattcctcatgggaggatacgtaggagcaagagcctcgcttttgtcgaccacaccgccttttgttgccatgactcaagagctggtagcccgcggagataccttacggttatccgcatctttttgtcatccagaggcggcgggcccgatgacaagcagagaccaa

SEQ ID NO: 102093 - DNA, 273 bp, Glycine max
  Peptide Sequence Number=SeqID_218871
atgatgtcttccagaaaaagaaagagcattggtgcaaggcccatagctcaatatgacacaagaatattccactccttcgaggcctggaccagatacatagacaatgtgataggaagacatatactagataagaggaaggtagaaatatacaatatagagttggatgagttcaaggctgaattggagaggcgtaacttccataagcgcctcaccaatttagctgacagcagcatcgacctagccttggtgaaggagttatacgccaacctctaa

SEQ ID NO: 102094 - DNA, 165 bp, Glycine max
  Peptide Sequence Number=SeqID_218872
atggataaccatgagcatgcaaatcatcgtgatacagcacaagccaagataaagaataaacgtatcaggcagcacaaagttaatgatcaggctcaaaatattgattttaatattcgtgattcatcagaggatgagcgttctgaatcaacacaaggtaccaattaa

SEQ ID NO: 102095 - DNA, 458 bp, Glycine max
  Peptide Sequence Number=SeqID_218873
agtttctgcctttgctttgttttgcttggctgtgatagcttgtgctgtgtgaatgttgttttgcttggatgttgtggaagcttgggaggattgatggggacccggggatggtgggtttatgcgcgcattgtggatgtggaaaacttgttgtgcaccatcgcccgaccgccacctagtaccacatgtgatggagtggtacctggagatatgtcgcgggggtcaggagaccttggggacgtcaggcgagctcctggcagtcaacagataaaagggaaacaagaccacaaagcaaggaggcttgtggtggctggccagctgcttgaaaacgaggtcaggaagctaaggaagcctctggtaatcgattaccaagggatcgtgatggcggcgcagctaatccgtgatcgagtagagatggagtgcttagagggagcttgggagaccctcaaaggcaacacgag

SEQ ID NO: 102096 - DNA, 153 bp, Glycine max
  Peptide Sequence Number=SeqID_218874
ggagtagaagagaagactgccaagttgaaaggaagtgagaaggctctagttgcacggcatgaagctagtcatgttgtagtaggtactgcagtagcaaaccttcttgctggacagccacatgttgaggcgatttttatcaaatacgatttgtaa

SEQ ID NO: 102097 - DNA, 192 bp, Glycine max
  Peptide Sequence Number=SeqID_218875
atggcttcctatgctgaggaaaaggactccattgatgaagaagatccaaggcctacaagctccacatggagctacatcacttatcattattgcatgaaaagagggcacacatgttataaatgctatgttaggagatttgatgttcctaaaggtgtgcctaaaagcaagagactaactatggtacttggatag

SEQ ID NO: 102098 - DNA, 196 bp, Glycine max
  Peptide Sequence Number=SeqID_218876
atgtatttgcattggatatgccaggttgagcaatacatgaagatcttaaaagggtatacaaagactctacaccatcttgaagcatctattgttgaaaggtacattgcagaagaagctattgagttttgttctgagtacatcaaaaaggtaaaagctattggggattcagagtctcgagatgatgaaagagtgggag

SEQ ID NO: 102099 - DNA, 144 bp, Glycine max
  Peptide Sequence Number=SeqID_218877
atgaaggatggttttgttggtcaaaggaggttgttgtatgaagatactggattattaaggtctatgttgttatacggtaactgttgtggaggcggtagttgtagttatggacatgagggttgtggagacgatggttgtggttga

SEQ ID NO: 102100 - DNA, 651 bp, Glycine max
  Peptide Sequence Number=SeqID_218878
atgatggaaaagttaaggcttgtccgttctgcacaacaatcaaaatcagcttaccaaaacattcaagataatgaattatcattgtcaatatccaagctgccacctactgataaattaaacctcactgctttagttcccgttgttaatgaaggggtgactgaggcggcgacaataaaagatatcgttgatttactcgatggaggatcgcttggtgatatcaagttagaccccagcgcgaataacttgctaagtaatagtaacgcgggacttatgttagaccgttacaaggccccttgcgtgggtattaccggcacgtatgtgagtaccggcgcggggcctgacttcactaaggataacgcttttagtgaaacgggcggcatttggagagtaaaaaacacgctcatgcttagccgagtaccaagcacggctaatggtgcggtcattgttgatatcactctagggaaaataccctgtgatagctcggggatccctttacaatatacgctaagtgtcgggacaacaagtaaaaaggtcggtggagtctggcgccagcattctgtcatgatattggccattgtgggcgctcccatcaaattaatggatgttgttaccggagttttagaagattacaaagagggagtagcgtggggg

SEQ ID NO: 102101 - DNA, 478 bp, Glycine max
  Peptide Sequence Number=SeqID_218879
ggtatccacaccataccacccccaaaccaatggacaggcagaaatttctaacagagagatcaagagaattttagagaagattatgcagccaagcaggaaggattggagtaccatgcttaattatgctctttgggcacatcgaactgcctacaaagcacccataggaatgtctccttatcgggttgtctttggaaaggcatatccgctagaagcgtatgagaatgccaagttctacaaagaaaagaccaagaagttccatgatagcatgataattaagaaggacttcagggttaggcaaaaagtgttattgtataattctaagctcggactcacgagtgttgagatcaaaagtgactccacaaacaagagcttcaaggtcaatggacaccgacttaagccattcctcacaaacccttctttagtggacgtagtggtggaagagacttccttactccatcctactcttcctccaccatga

SEQ ID NO: 102102 - DNA, 204 bp, Glycine max
  Peptide Sequence Number=SeqID_218880
atgaataccaagggtgctgaaccccttcccctcagcctcccacgcccttttatagccaaaataggggaggagctagccgcccagttcagaagcaacatgctcgcccaggtgagctcaactcgcccaggtgagctcaactcgcccaggcgagctagttgcttcatgttgaagcttcctaatgggcctagatgggcccagggctaa

SEQ ID NO: 102103 - DNA, 711 bp, Glycine max
  Peptide Sequence Number=SeqID_218881
atgtatgtgcatcctagagaagcatacgcatcgacgtgcgatgcatccaagaaggacaccactggagagggttctagtgcggccccgcaagctgacatggacttcgacaggcaccgggatgatgagtttcctgactttcagggagagataggccgcaggtgctgggcactacttgtgacacccatggctaaattcgatctggagataatcatggagttctacactaatgactggcctaccgaggaggagagggccagcagtgcgagtacagccagaggaggagtcaggcctttggctttgatgaggaggctatcgcctagctgctatgcataccagggcaagacttcacttagaccgtcacagggagacgggaattgcacctatgagacaccttgtgaacccggagaagtccaacaaggccctagggttcccgctctaattacgagcctctgtcagttctacagagtgaccgtcgcccccgacagggtcatccggcaagcgcagggccaggaaccacagcagcctggggacggccagcaacaagcggctaaggacgcaccaatgccacctccggagttggaacgctgtatacgacatgtggctgaccagcaggcagccaaccacaggggtcagttcgaggctgcaatagcatggcccggagatttgcctgatttcttcgcggggacctccgaaggtggagacaaagcctaa

SEQ ID NO: 102104 - DNA, 321 bp, Glycine max
  Peptide Sequence Number=SeqID_218882
atgacgatgttggatgagtcaatagggtgcatgttggggcagcatgacgattccgaaaagagggaacgggttgtctactacttgagcaagaaattcactgcttcccactgtctaaggcagtacatgctaagccacaccacttggttggtatccaagatggacccagtcaagtacattttcaagaaacccgctctcaccagacggatcgctcggtggcgggttttgatgtttgagttcaacattgcttatgtcactcaaaaggcaataaagggaagtgccttggcagaatatctagcccaacagcccctcaatgactactaa

SEQ ID NO: 102105 - DNA, 333 bp, Glycine max
  Peptide Sequence Number=SeqID_218883
atggtgggtcccacttctgcaatgtgcagttgcaaaaaagtcttgggacactacaatgtcagacataaggctgcttctccatacaatcctcagacaaatggacaagctgaggtgtcaaatatggaactgaagagtaatcttgagaaaactgttgtatcttcaagaaaggattggatgatgaaactagatgatgccttatgggcctataagactgcttttaagaccccaattggtctgtctccattccaaatggtctatgggaaggcttgtcacctcccagtagagatgaagcacaaggactatggggctctcaaattccttaactttgattag

SEQ ID NO: 102106 - DNA, 549 bp, Glycine max
  Peptide Sequence Number=SeqID_218884
atgtctttggtgaaagaatgtcccagccaaagtagctctaggaaatctttagtgttagagagtgttatcgggaaggactttttacctcgtgcctctgggattgttactcggcgtcctcttgttttgcagcttcataagattgatgaagggagagaatacgttgaatttatgcaccttccaaggaagaaatttattgattttgttgtcaatgtgactcttgttgatcttccagggattactaaagtagctgttgatggtcaaccagataccattatgcaagacattgaaaatatggtttgggcctttattgagaagatttgtgactttgtcagtaaagcctgcaaaccaattatcaactacaacagcttaaagtccaaactgaagttaataaccgacgttgtatgtcatatttccagtagtgaaactgatgcaatcttccctaggaagcgaccaatcactagagccatgagccggaggctccatgaggattgggctagagctgttgaagaaggccttagggttcccatgaacctcagggtagatttctga

SEQ ID NO: 102107 - DNA, 354 bp, Glycine max
  Peptide Sequence Number=SeqID_218885
atgatgcgcatgagcacagggaatgcgatgatggaaagggcgactcccatgaagacaaggaactgcaggaacctggctttgtcagcgccgtccacaattttgcggaggatgacggcgacgctgatgccgcatatgaaaggaagagagatcccgacggggacgatgcagaatgcttttcgactgctccagcgaatggagtggagatcaagctctagacccacaaggaagagggaaaaaaagaaggcctatgctggctacagattcaagcgtgggcatgagtcaaaggaagcgcgagagagtggagggagaaatgaaagggctttcaaaggagcgaggctagggatttcaaattaa

SEQ ID NO: 102108 - DNA, 189 bp, Glycine max
  Peptide Sequence Number=SeqID_218886
atgtttggacacaagtactacatattgggcaggttgtcatctgaagttggatggagctactatgataccatcaggtatttgtcataccctaatttcatccggggacaattgtttgtcggcatgcggatttttgccggtcatgttgagctgcttaaagccaatttccgtgtgatccgtaagatttcatga

SEQ ID NO: 102109 - DNA, 870 bp, Glycine max
  Peptide Sequence Number=SeqID_218887
atggagggatttggcggctcaggtagcacctcccatgatggaaagggagatgatcacctgatagtggacacactcccagtgttctactatgagaagttagtaggctacatgccctctagctttgtggatctagtattcacgggcgagaggattgaggtaggcctaaaaagggggaagtttgactatgtcgcccttgctagcacaagcaacagaagatccgggccgactggggcaaagaggaaagaatgggatgctcacgcccttttcggcccgcgtcggaaactcctccaactcagcacccatccagcaaggacatctgccccgccacaaagagccctcgctcaaaccccggctcctgcgcagcctcgtcctgtaggtaattcaaatcctagcataagttccaattcagggatgaaccctctaataaagaagcttccagagtggtacaaccccaacgcgacctgcgcgtatcacgggggtactccggggccttcgatcgaacagtgcatgaccctcaatcataaagtccaaagcttgattgacgcgaggtggctaacattccaagaatatggcctgaatgtgaagatgaatctgcttgccaatcatggaggatccagggtaaatgcaatagaggcgtgtgaactacagaggcttaagcaaatgaaggacgtgataacctctaggaggtttatctttgaggcactgcatgaggcgggaatagtttcctttgacgggcacaagggagactcctgtttgatgcatccgggtgcgtcgcatgacatggaaacatgttcaacagtggaggagttgttacaacaaatgatggaccaaggtcagttcgaaattggtggtgcaagcgaggaagaatga

SEQ ID NO: 102110 - DNA, 165 bp, Glycine max
  Peptide Sequence Number=SeqID_218888
atggagtgtgaacccaggttggtgttggtgttggtggatgcagaggatgagcacggtctccctgggcaaaggaatgcatggatgaggaagtatgtggtggtacaaattttgcatagattgcacctcacatgggattggacgtggctaacaattaatgcagcatga

SEQ ID NO: 102111 - DNA, 642 bp, Glycine max
  Peptide Sequence Number=SeqID_218889
atggccgcggcagcgttcaacgatgtcgtcgcatggatcctactcgccctcgcgggagatggcggaggacacaagatccccctcgtgttcgtctgggttctcctctccggccttgggtttgtcgtcttcatgattgtggttattcaacccgtgatgaaggttgtctcttgtaagggcgaaaacgacaccgttgatgagatttatgtctgtttaacattggcgggggtgctagtgtacgatttcgtaactgaccttatagggattcattctatattcggggcttttgagttcgggttaacggttccaaagaatgggagcttcgtgaggaggttgatggagaggatcgaggattttgttttgggtttgttgctactgttatactttgcctctagcaggttgaagactgatgtaactactattcatagcggtgcggtgtgggggcttctttgtctggtgatattcacggcgtgtgctacgaagattctagggactttcatggtggccatgttttgcatgatccctgctagagaatcgctcacgcttgctgtgctcatgaacaccaaaggaatggttgacattgactttgagaaggagccaattgggacagggaaagatggcatgcaccatcaggctattcagtaa

SEQ ID NO: 102112 - DNA, 270 bp, Glycine max
  Peptide Sequence Number=SeqID_218890
atggagacatgtcctatgctttcccagtcaacacttcagcccctagtggctttatccaccacagaggctaatcttatacctccatcaacaattgtaccaacataccacatgctagcacagatgcataatgttgaccttgaatctaattttcaagattttgaatacagtcatacgttggatcgcatagaagtccaacatttagcaggaaccaccctctttgaagggatgcattttgaaaccaaagaagaagttcagcatgctttgcaataa

SEQ ID NO: 102113 - DNA, 699 bp, Glycine max
  Peptide Sequence Number=SeqID_218891
atgcattcgttaattctcttatctctgtctgatgagattctttatgaattttatgaagaattggttgaagttgggctttggctcaaattagagaaactctttaggatgaaaacaatctgcaatgatttacttctaaaaaggaaattttttggccttcgaatgagggaaggcatgtcactagaggaacatcttgatgagctaaactatatcctgatggagctaagcaacattgatgtcaagatggaagacgaagatctgacaatgattttgttagcctctcttcctccctactatgagaattttgttagttctcttagtgtaggcaaggactccattacacttgaaaaaaagaagaagaaaggcaaaggtgacaataagagcaaagttgatcctaaggacatctgcaactacagaaaagaacatggttgttggaaacattggtttgtgacatatgagaggaagtttggtggtaaagtcctcatgggtaacgatgctacttgtaattttataggtggagttatgcatatcaaagggaaagggaagtttatgcatcaaacgacgttcccaaaagttgtgcacacaacaaaagccatgttggattacgtccattctaactactgggggctttcaagagttccatcactaggaggagcaaggtatttcctttccatcatcgatgattactctaggatgaaatga

SEQ ID NO: 102114 - DNA, 630 bp, Glycine max
  Peptide Sequence Number=SeqID_218892
atggggtttggagatggaggcaaaggatttagagtttattccccatctgaaagaaaggtcattctaagtagaaatttcatctttgacgaactctctatgttgcattctaaatctgatgaagatttgtacaagactaagaatgtcactaagcagtttgaagcaccttataagactgatcaagatcttcaaatgcatcctcaacatcgtaattcaacaccggttaaggggatggactggatgagtgaaaaccatccaaagcagccgaaaaccacaacacctagaaagtcacaaaggcaaatcaaagctcctaaaagatatggctttgatatagtgtcttatgcactacagctacctaaagtcaaacaagtagtgaggtgcaaatggatcttcaagaagaaatccagatcgtccatcgaagaattcattcattataaagcacatttagtagttaagggttacagtcagaaggaaggagtggactacaatgagacattctctctagtagctcgacacacctccatatgtgttttgctagacctagtggcaactctagacgtagagttagagcaactagatgtcaaaactacctttatccatggaagactaaaggaagacattctgatgcaataa

SEQ ID NO: 102115 - DNA, 609 bp, Glycine max
  Peptide Sequence Number=SeqID_218893
atggcttgtcaacccccaaagcctagaaaagtgttgtccgggctgcttctgtcaagttgtccaagatggacacgtctttggcatgtcaggtgcattgaagacaaacgttacgttctgtctattgttgttcgcatgtgttgcgcacacgcagttctcttgcatgtgtcacttacggagtgggcacgtactagagttgtggtgtgtggatcatttctattggcggttactcgtcgaaggatactcgccgtggtgccttcgacaatgagtcctcctcttcggagagggagaggtagtagtggtggagatgtcagagtgtctcccttcctgctacgtagccatagcattaggtttccatcttctacacttgtcgtcgctagctatgagtgggtgaagctggcaagccctgaggactcctgcaagatagttgttcaagcttgcgggagtgatgaattcccttttatagggtggcgctgggtagtccgcccttctattttaggtattatgggtgacttcgcttggaagcaactcttgaagcaggtcggacctacaggtaggactgtgccatcgtctgttgctgctcctgttgttggagaagggggttgctggtga

SEQ ID NO: 102116 - DNA, 447 bp, Glycine max
  Peptide Sequence Number=SeqID_218894
atgaaggaagaacaaaaagaaaaagtagaaaaagaaaaaaatcagaaaaatgaaaaagaaaaagagaaggttgatgaggagaaaaagaagagcaagagtgagtttcaagagagaaaaagagagagattacttcagctgaagaagctggagatcactttgccttttggagaagctctccaacagatgccactctatgccaaatttttaaaagacatgctgacaaagaagaaccaatacatacacagtgacataatagttgtggaaggaaatcgtagtactgtcattcaacacaaccttcccccaaagcacaaagatcctggaagtgtcactataccgtgttccattggcgaggttgctatggagatagagataatgcccacacgcatgaccctccagttggctgatcgctccatcacaagaccatatggagtgatcgacgacatatag

SEQ ID NO: 102117 - DNA, 540 bp, Glycine max
  Peptide Sequence Number=SeqID_218895
atggcaaagggccaagggaaactcagactgtggagattgtcaggaggaccagctcgcaccacttttgtggcaagggagcatcctccactcgccatcaaggatgacatagtagctggccttccgtttgaggcatcgggaggtcatccagtttggttcctccttttctttggccataacttactcaacatctatgttgggagtttgaagggtctcttggatgatagtcttgaggtgtctggccttcttgcaacactatttctctggtctggtatctgctggcaacctgtccttggacaagctgcaagctctgaagttgagcttgagggcttactcttaggtaatattgtgagggccttcgaggatgattcctgccctgcttccttttatgctggatacactgtcaacgtaaaggttccaccagtctgggatggccactatcctttctgcgagttccagctttcgcaaaacccatttgattgggtagttcattttgactaccgcttgatgactctagaagtaggacctgagtcgtcaagctga

SEQ ID NO: 102118 - DNA, 960 bp, Glycine max
  Peptide Sequence Number=SeqID_218896
atgccaagcaaaaaaatttgcatttttgtgaagcaagttggcgatgcaccgatgcttatgattggtgttgtcgcacggatctatgttgaattcattatccaggcttgcttggtagacagtcagggctcggattggagacccttcatgcacgctcatgacttaagtgccatcagtcattatggggtgaggcttggcaaactccctaccttgactgtcacaatctccctgattagggtagggaatttcattttcaaatggggtatggagactgtggcttcaagctcgttaaatgtcttcatgtcaatcaaatctctcgcttgcaaagccaaggagtggatctgcgtgaaggatatcagtggcactgccctagtcgatgatgaccttggacaccatcaagttcgcaatgatgatggagacaaccatagggtcatcctggatgatggggttgatacccttgaagtccatatccgtgataggagggagactttgttgaaatggtgcatcaaaaaaattgatgtcgatgtctcgaatggcatgaagatggcatttttgggattggctagactgtcctcctccataggaaaatttgcctgtaatggtgttgtcgctcacactgttgttgctggtgtctctgtctacctcgatcttcttgtctatctcttcttctatctactttgtggttcctttgttgctcctcttggtgtcctcttagtcttgctcctgcttggtggttgtccggcttatgaggtttcgttggggagattatccgtaaacttgttcgatcataaagcgaagagcatggaatgcaacgccacctctagccaaggtagccgaggtcatgcaacgagatctgctagttatgtagtgcgtgttgaaacgtttgacgaaggttcgcctgagtcaggaaggcatctaggtgctcatctagatctgtggtcccatcatactgctcaaggttaa

SEQ ID NO: 102119 - DNA, 470 bp, Glycine max
  Peptide Sequence Number=SeqID_218897
gtcgaccattaagtgagcaagatgtgcttccagctccaaatgccgtcgaggctcctattgttgttgttgctactcctgttactcctgctccatcacctcctcccgctgtacctgttcaggaggtcactcatgttgttgttgttaatgtgccagccacttcggttggtcctatcatggtttcgttgtccatcgttgttgcccccttgttgagtactagtgtggctactgctagtgctcctatagtgtcgcctcctccttcttcgactccaccaattccaacctttgttgtattggcgatgggtgtagaacgctacggattctgccaaagcctttctccagagaagtttggcgattctggaggagaatggacaatggtactaagaggctttgcacaaggtagagtccttggcggcagaggtctccaaatggagggctattacttgcaccgtttagagagtgcagcgccttaa

SEQ ID NO: 102120 - DNA, 645 bp, Glycine max
  Peptide Sequence Number=SeqID_218898
atggtggtcttgcaaaaagtcttgtcacccatctggtggggattccttctgctttgtggagcttctcctctgatgcttatgaggagtatattcaacttgcctctggttgaagatcttgccaaccagtctggggataggttgcttgacctactgagtttctcctctgatggttatgaggatatgacttccacctacttgaaggtcttgccaaatagtctagtggtagttcgttttgttgaacttagacctttgacaacggccatcgagtacataccaagggtggaccttaggttttggaggagtgtgtaccaaaggcaaaccttagttcctatggagatggaacttagcaacagatacggctcaccaagagtaaatcttgggtttgtcgagccttggaccgaggacgtgtttgccctgggttttgtcaagcttgttgagctatgtcgaggcttaccaagggcgggacttggattttgtgaacctgtgaggatcaccaagtgtgaagcttgggtttgtcgagtttgcagcacatttgctatgcttttgcatatatggcactcgtcgtgggtggcatgtactggagacgtaatggcatgctcttgcatatatgtcactcttcgtgggtggcatatactaaagacttag

SEQ ID NO: 102121 - DNA, 186 bp, Glycine max
  Peptide Sequence Number=SeqID_218899
atgggaaattatggccagcgaggtggagaaattcacctgaaaacacctcatttactaacggtcaggcagagtcagctaacagagtcatcctctgggccttgcctactagactcaacaagtctaaggttttatggaaagcggaactccccaacatactctaggcgtaccattgttcaccccaaatag

SEQ ID NO: 102122 - DNA, 1158 bp, Glycine max
  Peptide Sequence Number=SeqID_218900
atggttagcattcggtctggcctcatacgcgatacccttttcgaggactcccatcctcatctgacaactatgatagacatagatactctacagcagctccaaaaccgtatcgcaaagatggagcgatgccataaaaaggagctgagaaagctaaaggctgaccacgatcaactggaggctcgtattagatgcccccagggtgaataccactccactcacacttttcttgagcacacccaaggggaatcgcacccccaatgcacaatcaacactctagatgacttaagtctctcccacatgcaccgtccaacaggaagcaccaagattgacttacacaagtcggacaagcgccagcctctcccaaaagggcctaggtacaagcgttgcacacccctagtgaccaatcacactataattcttgaggaagctttcagcttagaggtacctatcaaactacccccaacgaaacctcataagcctgggttagacacaaccaaatactgcataagattgctaagccctaaaggacaagataaaagagcttatacaagctgggtacctagtctactttgtcaaaaaaccggacaaccaccaagcaggagcaagactaagaggacaccaagaggagcaacaaaggaaccacaaagcaaattttcctatggaggaggacagtctagccaatcccaaaaatgccatcttcatgccattcgagacatcgacatcaatttttttgatgcaccatttcaacaaagtctccctcctatcacggatatggacttcaagggtatcaaccccatcatccaggatgaccctatggttgtctccatcatcattgcgaacttgatggtgtccaagagactcaaggtctcccctgatactattcaccttcacgcagatccactccttggctttgcaagcgagagactagagaccagaggcttcatggacttaatgaccaccttcgatcaaggcaagctctccaagagcttcattgtaagatatctacttgttgatgcagacacatcatattttactttgattgacatgaagacatttaacgagcttgaagccacagtctccataccccatttgaaaatgaaattccctaccctaatcagggagattgtgacagtcaaggctgaccaaaaacaagcatga

SEQ ID NO: 102123 - DNA, 645 bp, Glycine max
  Peptide Sequence Number=SeqID_218901
atggtgggcgccaaatgttctcaccaaaatccaaagataggacatgtcagggtggacgtggccaaagtgggctcccaaacttcaaacatgggctttgagagcaagtatatgcgtatgagagcaagtatgcgtgagctcaagggggagcaacatgaagacttagccttgaagcttaaagaagagcttgaagaagtacttttgatagaagacatcatgttaaagagtcatcggttagtggactacgaatttccttatgtcatgcttgccccaagattcattgactatttcaatgtcgatgtatctaatgagatagtggattttaccaaagcatctagtgagattaccgaaagacatctcaagaagcttggaatgagatttgttgaccatgagtggataatggctgaagagccagcaacaggaaacatgaatgaagatgttgaagttgaagctccacaagagcctacatatcaatggagtccttttgagtcactcatgattcagaaaatggatgctatgcttcacctccgtcaagagcactcagctgaagttcacagttcactggagaacataactacccgactagaaaacatagacactaggctaacccctagcaacctccttaaccccgatgaggatgaagcttag

SEQ ID NO: 102124 - DNA, 222 bp, Glycine max
  Peptide Sequence Number=SeqID_218902
atggacgtggctcaattgtcaccaaggtttgtgctccattttgtaaaacgtgctgctagcgctagggcttactattcagacaaaagaaacaaacaaaatggagtgaatgtgatgcttggaagacagccaacaggggtagggagtgtcccacaatgctggcctcgtgtggttgccttgtcttgttcgatttcgatggtaccccgtcagaagtggcaccaataa

SEQ ID NO: 102125 - DNA, 867 bp, Glycine max
  Peptide Sequence Number=SeqID_218903
atgttgcttagaatcctagggttctggtcaacaactatcaatggatttgtactcccaaaagctatggttgccccaactctccttgatgtagcagatattctaaacttgtcgattcatggcaaggaattgttgtcactctatgggacatgttatgtcctttccactaccattggcatcaaattctccaaagataactctgagtattccaaattcatgcttcccaatgccaagaagaatggtgttatttcactaagtgagcccaatgattttattttgatgtggttttgttggaacttcatctatatgagtttagtgttgtgcttagcgagtattgtatctttgtctcagctattacattcgaccatgacttggctttgggtcctctccttttctccacactgtatggggacattttccatcttctccacaacctcaaagactatcgtactaagaacaatactgattatgcctacatcaaggaacaacaagctagttgttgaggcttattatccttactcttttgtaaggcaatttggtttgattcaatccatccccaagatactaagttgtcccacccgtcttccgattaatttgtgtacttcttgtcagctcaatgagattttggcagttttggaggacattgaagacaagcttcacccttttgtgcttaagcatttggcttttagtcccaacaatgtggaattcttcacagaatggtggggagttatattagctacgttatcccttgggttagcagccaatttcatcactaggttgattgatgaaatgtctgatgatgagctaccatctcctaccactgtcaagtgtagtcaaaagagaataattgattctaattcagttgtctaa

SEQ ID NO: 102126 - DNA, 402 bp, Glycine max
  Peptide Sequence Number=SeqID_218904
atggtgaggacaactgcccctcaaactattgatctcaatatgatagtagctgcaatttgtacacatcttggggtgcagttaaagcccgtcaacaagccagtgtacaaaaaaccttatctagaaaggattgacaagatagtctttttgccacgaggatacaagatcctatatattgcaaccttctcaggggaagataggaaatccaccatggagcatgacaaggaaggctctggtgatgacttgcctacaaatcagatggcgtctgagttggtcaaatggaaaccttattcttgtcctaccttacagtctttcaaagggaaagaagctgaaggaaatgagccttaccttttcgatatttccagggtagaacaaatctttgactacttggttaaagatcaatag

SEQ ID NO: 102127 - DNA, 168 bp, Glycine max
  Peptide Sequence Number=SeqID_218905
atggtgtggagggtcataagctctagtgtgaaccccaatgaaagttggtgttgcactagatcgataggagtaatagaggcctacacacaacatcaagggtgttcaagcaatgacaagggtggtagtgcaaccacaaaatatcgagaacttgttgattcacaaagatga

SEQ ID NO: 102128 - DNA, 207 bp, Glycine max
  Peptide Sequence Number=SeqID_218906
atgtgggacaaaggaactaagaccacaaactctaacagggacttgactaattcaacgatcttaaggaacatgggtgtaggtataggtcattttcttcttgcctacaaaatcacacttcaaggaatagggaagcttcaggttaatgaagctcgcttgagtgaagacttgaaccaatgctgggaggtgcttgttgaaccaattcaaaat

SEQ ID NO: 102129 - DNA, 468 bp, Glycine max
  Peptide Sequence Number=SeqID_218907
atggagaatttacttgctactcctacaagaagtcgacccatgaagaaagagtgtctgagcgacgcgtcgttcttctcctacgcttgttccgtcttccgccacctcattaacaacaccatgatccgaggctacctccaatgccggtcacccctccacgccgtgtcctgctacttgaccatgttcgggatccgtgacgacccttacgtggtgagcgcgtttattgagttttactttgtttctcgtgaggtggacacggcaagagtgttgttcgataaaacggcaaataaagatgtcgttttggggactgcgatggttgagggttctgggaaaatggggaacgtagaaagtgctagacagagatgcagaacgagggaacatagccgaacgagtctacattccgtactcactgcgcgtgcgcaccttggtgcgctcacgctgcgacttttggtgcattcctatgccaggtga

SEQ ID NO: 102130 - DNA, 546 bp, Glycine max
  Peptide Sequence Number=SeqID_218908
atgaaggcgtttagagagagagagttgagaggttctgcctggatgatgctctctcgcccatttattgaatactgtatatggggttgggacaacttacccagaatagtcttgatgtattacgccaactttctgtcttcccccgaagggtattttcacacagtcatctgcaatgccgaggagtttcgtaacactaccgttaatcatgacctccacttcatatcatgggacaaccctcctaaacaacacccacattttcttacagttaatgactaccagagaatggtggacagcaatgctccatttgctaggaaatttggcaggaatgaaccagtcttggacaagattgatactgaactcttgggacaaaatgcagatggttatgttcctggcaggtggttcagtcaggcaaattcaagcatcactaaacagtactccggcataagaaatatcactgacctaaggcctggcccaggagctgaaaggcttggacaccttataaatggtttattatcagcagaaaattttcaggcaaatcggtgtttttga

SEQ ID NO: 102131 - DNA, 354 bp, Glycine max
  Peptide Sequence Number=SeqID_218909
atgcccttgcggggtaggattgcatcaaactctttcatggcaatggctggagtttgtaacatcacagttgttcctctcttcctcaacctcaaatctaaatctacacacataagcctatacagtgatcaaccaaatgctggtacgtgtaaaaaccctttctctccaatccatgagcttgaaccccaaatccccctcccttcccgtaatttgccacttacggctgccccaagtgtgatgcaatcctaccccgcaagggcattggatagaagactccaagtagattgggccatagatccaagggaaggccctagggttctcatgagccttagggtagattttgagcccatgggctaa

SEQ ID NO: 102132 - DNA, 189 bp, Glycine max
  Peptide Sequence Number=SeqID_218910
atggtcactaatacccttcacgccgctgctattttgttgaaccaagctggggactgggattggttcattaatttgagtgcttctgattatcctttggtaacccaagatgatctgctgcatacgctttcgtctattcccagacacctgaacttcattgaacacaccagtgatattggttggaaggtgtaa

SEQ ID NO: 102133 - DNA, 355 bp, Glycine max
  Peptide Sequence Number=SeqID_218911
aggaaacgaagacggagaggaggatgaggaaggtggagatgaggagagagaggatgagtgggaggaaccattttttcttggtcttgttctggtgttgttggtggtgcttgttgggttccatcgtgttggtggtagtgtgggagtgagaagagggaaaagaaagcgtggtgtaacggcgcaaggatctatctatgttggcgtgaaactcgcagtggggtgtgtgtgggcgaatcaagattggagaaacatgccacttaaattcttagtgggtgttgctgtcactatgattatgatgcgagtcagtgagtggccgataataataaataaaaaagttttccctctttttaaaaagtaa

SEQ ID NO: 102134 - DNA, 498 bp, Glycine max
  Peptide Sequence Number=SeqID_218912
atgcttttacttggttcaccacattgccaccaaattcaatatatacttgggcacgactcgaaagagtgttccgtgaacatttctttggaggagagactaaggtttagatttttcaattcgaaagaagatggtaaatcaacagtcttcaatccacccattgatgatatgagatgccatataaagccactccatctggctgctatggtggaagaccaacttattaacaagatcttgatcgatggagaggttgtatttaatatcctgccaaggtctatgctgcacaagtttggaaggattgttaaggatttgattcctcacaatatagtggtatcggacttttgcggaaaaccttcagattctgagggaatgatttgtttggatgtttcagtaggtagtaagaggaggcctatgatgtttttagtaatttcttcacaagccaatttttcaatatgttattgggaaaggaagggattcacggagttggagttgttcctttga

SEQ ID NO: 102135 - DNA, 453 bp, Glycine max
  Peptide Sequence Number=SeqID_218913
atgatgacgtgcttgacagcttgcaacacaaatcaatgttcctcgcagcagtcttcttctccattttggttgcatcccttcgtgttcttcattgggttgtttgagcgtttcttccgccatcgagacgaagttcttccgcaagaacaagcttcttccgcgcgtgtgttaggggataaaaatggagtcagcggaagaaggtgttcttccgcgagctcctgcggaagaaaggtgaaaggttcttccgcaggagcccgcggaagaaggtggaacaccttctttcgctggctccattttcgatttgtcacactcgcggaagaacaccttccgcagactgcattttctgctcgcagaagatcctgcggaaccttcttccgtaggctttcttcttgcggaagaacctaccaaacttcttccgcaggatgcattttgctgtatattggttatttttcttga

SEQ ID NO: 102136 - DNA, 201 bp, Glycine max
  Peptide Sequence Number=SeqID_218914
atgtctcaggtattgtcagcagccaaaattgccaaaaagatgaagctaaaatttactaaagcatggactgcatatcttagatttcctcttccaattgatgtttacaaagaggttgccatgagatccaatgtaggagcagaaggggggaagaaacacaaatggtggaattgtaacatgggttgtaagatgctagtagaatag

SEQ ID NO: 102137 - DNA, 393 bp, Glycine max
  Peptide Sequence Number=SeqID_218915
atgacaattatcaacaaaattggcataacatacaatactatgaagaagcttgtggtacagagaagagtggaaggtgccgccgttggcaacctttacgaactccatgagcgtgtccagcacgagttccttgagcatctcatctccctatggcaaagcgaggacgttgatgagggacttaaggaactcttcgaacttggaacggaaccaggagaagtagatgaactcgaatggatccatggtacgacacaatacgcacaggtcgctgccgtcgatgaagcacccaccgtccagaccgtccacacttctcttttgtcgagagggtttggaggggaggagtggggtgcggtgttatacgaagctagggttagtaacttagtaaacattataaagtaa

SEQ ID NO: 102138 - DNA, 366 bp, Glycine max
  Peptide Sequence Number=SeqID_218916
atgaccctaggggcacaactaaaaaactgtctttttacgacgcacattctaagacggttatgtggaaccgtcttagaatgttacgcggtgacaattttccaccacatcagcgccgctaaaggaccgcaaagttcagatctcaagcttccatggcttgaggtctggttccgcaatgccctctcccttccttcattgttgaatactagcgagaatagggatgtgaggaaagaaattgatagtgcgtatatatcggagtctaaatctgcttctgtgctacctcatgcagctcaatctttctctattggatacattcaggaattgaagctcgaggttttatttttggtcctcccattgcgctggctatag

SEQ ID NO: 102139 - DNA, 303 bp, Glycine max
  Peptide Sequence Number=SeqID_218917
atgtattctgttcttagtgggagatttaagatatacacaagttgttatcatggaattcttaggctagtggatgctgagaaggaaatctttgatctggtatttgagagtgatgaaagtatatttgctctctctcaaccaacaaacgtgacaaattgcctatatcttgctgagggttctggaggtctaactatttgggataacatgattgggataacatggaggatgcaactgttattaatcataagaatcagactggcagatggctttctactttcaggtgcagtttttgggggagtatcttaa

SEQ ID NO: 102140 - DNA, 337 bp, Glycine max
  Peptide Sequence Number=SeqID_218918
gaatttacaagatagtggaactctcaagcgggttgcttggggattggacgtaggcacaaaggtgttccaagaacctgtccacagagagtttatttctacatctacacctgaatggacaaggtatgactatcaacacacaccatcagagacctatagggctctacctacaaatgttattgtttctcttgagactcctaaatggatgctaccagtgcatcccaacctggtcaggctgcaaccacactggttaatccctagtacacaacaatgtatgtgtccatccatggaggaaaaaccagtggaggcgtgggagaagatgaagaagaaaggcacctaa

SEQ ID NO: 102141 - DNA, 345 bp, Glycine max
  Peptide Sequence Number=SeqID_218919
atggattcggatcaaggcaagcttttcatcggtgggatttcatgggatacgacggaggacaagctcaaggagcatttcggtaactacgacgacgttttgagcacttccgtcatgcgggagaagaacactgggaagccaaggggcttcggtttcgtcgtttttgcggatcctaacattctagatagggttatggaagacaaacatgtcatagatggcagaacgagaaaagtgaagcttagaaatacaactcttatttataagtcacagtgtacagcggatataacgggaaatcataaaggtcttaactgttctcgcggtttgttcatggaggtagggcttatttag

SEQ ID NO: 102142 - DNA, 156 bp, Glycine max
  Peptide Sequence Number=SeqID_218920
atggcctcagcagctgaaccacttccttatagctcaagaagaagagatgagtcacagttcaatttgagagaatgggcagtgaaagctcgaatcagccgtgaggtaaccaactccagaagcctcacttgcttaaaaataataaagcatcctctttaa

SEQ ID NO: 102143 - DNA, 709 bp, Glycine max
  Peptide Sequence Number=SeqID_218921
atggcacctacactctttgcacacacagtgagttactgggccctatacccagtccctactgccacaatgcttgatatcaaagaggatgatatctctagaaacctcttcaagagcctagaactagccagcttgcaaaagctagggcagcgcatggaccaagttcaacatcaagatttccgcaaagcatatgggaaaatctgggatttggccatgatagaagtatctattgaagccatcacatcccccgctcagtactacgcccaatcactcagatgcttcacatttggggactttcagttggcaccaacaatagaaaagtttgaagggatcttgggatgccaactgggaggaaggaagtcgtatttgttttccggattctacccctatatggcaagagtagcaaaagtggtcaagatctcggcacaagagttaaaccgactaaagcaaaatagaaatggagtggtagggataacaaggcagcgcttggaggagaaggcaaaagctttggcagatcaaggagaatggacttcattcattgatgttttagcactattggtgtttgggatcgcccactttccaaatgtagaagggctagtggatctagcagcgatcgacgcttttcttgcttatcaccatagcaaggaaagcccggttgttgctattttcgccaatgcctatgacacattcgactggagatgcgagaagagaa

SEQ ID NO: 102144 - DNA, 1086 bp, Glycine max
  Peptide Sequence Number=SeqID_218922
atggatgggaacaaggacgacgcgttgaaatgtttgagtatcggcaaagaggcgttggaaagcggcgatcggtcacgtgcgttgaagttcgtaacgaaggcacgtcgcctcgaccccaccctccccgtcgacgatctattgtccacgatagacgcggatgcaggggatcagcctgccgccgcggaggcggcggagtccacaaagtctcccgatcagccttctatccgccggagggctgctggggcggccgctgccgctccaaaggggccctcgtcggcctcgtcctcttcggcctcatacacagaagagcaagtctcaattatcagagagataaagagaaagaagaacttttatgagatattgggattggagaagacttgcactattgaggacgtgaggaagtcgtacaggaaactgtctcttaaggttcatcccgataagaacaaagcccatggggccgaggaagcgttcaaggccgtttcaaaggcgtttcagtgtcttagtaatgaagagagtaagaggaagtatgatgtttcgggagaggatgaagcgatctacgagcagcgcactgcaaggccggcagccaggggttataatggttactatgaagctgatattgatgctgaggagatattcaggaacttcttctttggaggaatggcccctgcagccaattttggaggattcagttttggaccagctgggttcaatgggttcaatggtcataggcatgctgctgaacatggttctggtggttttaatgttcgcacattaattcagttactgccagtgctgctgattctactattgaactttttgccttcttcggagcccttgtactcgctatcgaagagttatccttatgaacatcggtttaccacacccaagggtgtcaactattatgtcaaatctacaaactttgttcaggagtatcccttgcggagcgaggaacgatcaaaaattgaagaaagggtagagagggagtacttcagcattctccgccagaattgtcattttgagttgcagcgtcgccaatggggttatatccgggaaacaccccactgcgatatgttgcggaagtttgag

SEQ ID NO: 102145 - DNA, 420 bp, Glycine max
  Peptide Sequence Number=SeqID_218923
atgacgaatgtagtgatgatgcaaccacaacaacagtcatccaacaaaggtgtgctggtatcttccaataattccaagacaattggtcatttgtatccaaattttagggaggaggctagaaacctaaggcttggtcttgcttcagatagaatgaatgattctgcgggtccaagacagtcaagaaatgatattgatttctatctcactccgttgattgaagacttgagaaaattgtgggaaatgtgcaaaatattcaaaagaagggcaaaagggtcacttttggggcatttttcagcccctgggcccactagaaagcttagggatgaagtaaccagctcgtctgggagagctaggttacttctggaggaagcaagcagctcagtgagctgctttacaacctccacccctcattttctataa

SEQ ID NO: 102146 - DNA, 102 bp, Glycine max
  Peptide Sequence Number=SeqID_218924
atgcccctgggcccactagatgacttaggggagaagcaactagctcgcttgggcgagcaagttgcttctggagtaagccaccagttcgcctgggcaagttaa

SEQ ID NO: 102147 - DNA, 519 bp, Glycine max
  Peptide Sequence Number=SeqID_218925
atggcaagattcaagaggactgaacaaagagtaaaagaactagtggttctatttccttctgtgagaaggggttggtgtacaatgtatccgtatgtagcgatcgctcccgactgtcatcgacatgattttgtaagaccatcaagacctgggaggattggtggcagtgattgggcccaatggagtggagtactcacccttgcaaccaccatttcagggggaggtcatggagcatccataaaggatgctcacttggataaatccccggataccgtcaatcactgtagaggcacacactacgtatcacttgtaggtcttggagggtcattatgtgtgattactgaggtagctccatgtggagcttgtgggccttggatcttcttcatcaatggagtcctttgcttcttgaagatcaatggcagcgaaatggagaagaagaaagatgattggagactccacttcaaggagaagatgagtcaagaacaagctcaccaccataggaaaccatggataagagcttga

SEQ ID NO: 102148 - DNA, 372 bp, Glycine max
  Peptide Sequence Number=SeqID_218926
atgcatgctttgttagggtcattcaatagtggaaactggtctgactctaaagtccttcatagtgcagggctgagttgttgtgctttcacgaggaatcggggaacagggcagagaggaaaaggaaacttctgcaagacaaaacagttgcatccattcttgagtaggagactcatttctctgacttattatcacctgattcaccatcatcaagggaatccgccactcaaattcctaaagccatcaccatggcagaagagcatgactagaggattacccttgaggattactcaagtagttcagtaccacaatttttcaccagcattgcacgtcctgaagtgcaagctaacaacatcaattatccacattccttaa

SEQ ID NO: 102149 - DNA, 213 bp, Glycine max
  Peptide Sequence Number=SeqID_218927
atgtcaagcacctcacaaggaccaaagaaaggtcgcatgtcatcaagcaaagcccatgggcctaaaatctaccctaaggctcatgagaaccccaaggccttctcttgcatctttggcccaatcttcttggagtcttctaagggaattggaatggaggattggtgccatcccttgaagaatttgagtcaagaagcaaggggaaaaccaccttaa

SEQ ID NO: 102150 - DNA, 207 bp, Glycine max
  Peptide Sequence Number=SeqID_218928
atggaaagtaaggatcacgtggagcagaagttgtctcagatgattttggacaagaagtttgctggaaccgcaactgccaccgcgacctccccctccccctcccccttccgccactccccctccctctcccccttcttcctccctcccccgccacgcccaacgtcaactcaagattttatgggtctgcacctcgacagcgtgttgtga

SEQ ID NO: 102151 - DNA, 1040 bp, Glycine max
  Peptide Sequence Number=SeqID_218929
tcattggaagtgcgcttagtgcaggtagtggcgctaagcctgaatcactcactaaagcgctaagtgttgttgttgcgctaagccccaaatgcttactggaaggagtgaaaacctctgagtatcttctgggattcgcgatgaacgtgctaagcgcgcctgctgtgcttagcctgttcatcgcaactatagcttctaggaaaagaaaggcaccatctgcacccacccaagttagatttgacagattaagattcacttcccaagaggcttgggaaagatacatagatgttattgtgcctaagaagcttttgccaaagaggaacatggatgaggagttgactgattttggtgacggcaacatcgttgttgccattgtgaaggaattctacgccaacctctatgaccccgaggacaaatcacctaaacatgtgagggtgagaggtcatctgattaaatttaatgaggatacgctcaatactttcttgaagacccatgttattgtggaagagggggaatcactctgtgcttattccagatttgcactcctaaagcctgatcctcaggagttggctgctagtctctgtatcccagggaggggatttgagcttaatgctgatgggcagcccctgaagattttgaggaagaacatgacaaccctagctcaaacatggagtgctaggggagttcaatctgattcgaggtccctggggagcctgagtcctgccattaatttggcttatattaagaagaactattggaatctggatgatccaacaataacttttagaggacccaagaaggccagagggaagagatatgaggccccttccacaacaccatcagaggcaccggcaccttcttcttctacagttcctaccccttcaaccactcaaactccagttattcctcctgcacccacacagataccacttccagctccagtatctgcaagtccagcagattttactttcactcctcagatgcttcactccatgctccagagcatccataggggccagtccatcatcatgcaaagcctttag

SEQ ID NO: 102152 - DNA, 237 bp, Glycine max
  Peptide Sequence Number=SeqID_218930
atggaaaatcctccagcagctcaacaacatcattactcagccaatatcagcccttctcattacccactgcccagtcatccacaaaattcatccccaaatcagccacaaggcctacctgcttaccacacgcctaatgcccaaacaccacctttagcacaaaccaaaacaccaatcaaggaaggaattttgcagcaaaaagcatatagaattcaccccaattccagtgtcctatgctaa

SEQ ID NO: 102153 - DNA, 732 bp, Glycine max
  Peptide Sequence Number=SeqID_218931
atggcgtcatcactatcaacaatagctctattcctgccccaatcgctctatattaagccccgcctggcgccacggcctcttcctccccctcaattccgctcccttttcctaacctcaccggcgggtgctcgtactgctactgtcatgcctagaagggcggcggtcatcgtgtcggcggcgacggcggagacgccgaagaagaagggcgaatcgaaagggttcgtggaagagatgaggttcgtggcgatgaggctgcacacgagggaccaggccagggagggcgagaaggaggtcaagcagcccgaggagaaagccgttaccaagtgggacccatccgtcgaagggtacctgaaatttcttgtggacagtaagctcgtttatgacacgctggagaaaatcgttcaagaggctcctcatccttcttggttccgctttctgtttgctggtttatgtttgttagttttggattgtgttgcaaatattgggtgtgggaagacagggttacaagatgctgaattcagaaacactggattggaaaggtctgcaagtttggcagaagatttggagtggttcaaggagcaaggttataccattcctgaaccttcttctcctggtcttacctatgcacaatatcttaaggagttatctgtgaaggatccccaagcattcatttgccatttttacaatatctactttgctcattcagctggtggtcgaatgattgggaaaaag

SEQ ID NO: 102154 - DNA, 445 bp, Glycine max
  Peptide Sequence Number=SeqID_218932
gattggtttcgagaatcacaagaggggttcaacaaatcagacttgccaagtcaatgcacttatagatataaggtgtacattgaaggttctgtttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacattagagagaaaggaaagctcaattcaacaagttgaatcatgggagaaaagttattgggataatcaaaccataacatcttaa

SEQ ID NO: 102155 - DNA, 393 bp, Glycine max
  Peptide Sequence Number=SeqID_218933
atggacgatgaagttcagtatgaagcacctccatctgcaagactatctacaagattccttttggggcttacagagaaaaggccagctatgataaggacatcattgggtggttttgcaagatcaatgcacaatagattaatccgtcctctgatgatttcttgcctccgtttcttcgtccaaagcacgctaattgatcaatggccaagctatcctctgggtctacacatccggtgcacaacttccatcaagctcgtgccttatcaaatagctctaaggtttccacccttggacctaagaaagaagaaaggcaaagttcctcctcacagcaagcacatgcctcatcagggcccaaaagacaatgttgcctttgaaaatgatgatggaactcaataa

SEQ ID NO: 102156 - DNA, 396 bp, Glycine max
  Peptide Sequence Number=SeqID_218934
atgggggggtgttttaaggggttagaaggttcaacacgaaagggaattgagagaattgagagaaaacaagaagaaagagaaaaagaagaagaagaaagaagaggaaatgaagccgagatgctaacgaatcgcgatcgcgatcagtccctacgtcatttcttgttctgtgttctttgttcggtagtcggggtcatttttgccaaggcgagactttgtcttgccaaggcaaaatggcttccaaaggcgttgtttgctttaagagccaatctcgctataatagtaagaaccaagaatcaatcatatgatgagccttcttcaaagaagaggatgcaaccttccaagggtaaaccatccaagaaacacccgccaaggacccacaacctcaaaaagccatag

SEQ ID NO: 102157 - DNA, 318 bp, Glycine max
  Peptide Sequence Number=SeqID_218935
atggaaagaaggttccttgctgaacacatggagaccaatttgcttatcaagaacaccttagactcatcactcaaatccttcaatgattctattctcttcaacatgaatctactgatgcaacaaaggcttcctccctctgtccaaccacctccacgaccaccaaccgctgttatgcaacctcatcctaaggttcttgcaccagtagttcctgcattagaggcagctatatctgttaatcctatgcttgtgcctatgcctttgccaccaaaggcaccacctcccatctctcaacctctatccactaaaggttggcaatga

SEQ ID NO: 102158 - DNA, 1019 bp, Glycine max
  Peptide Sequence Number=SeqID_218936
atggcaaaactagcaactggtcaaggaaccaacgagcgcatcatcaacttcaaacaagctccaactgaatcactatttgacgcatgggagagatacaaagccctcctaaggagttgcccttgtcacggatacaatcaattcttgcaaatttcaatgttcatgcaaggaatcactaatgattgtaggaggatgatcaatgcatcgaccagaggaaactacctcaataaaacaaccactcaagtgaataccataattgaagatttggtgactagtgagagaaccatagaaacaaaccggtcaaatccccaaaaaggtttccaaaacatacatggaaactacaaccaagtaggagacaacaaaccacaacaaagaccaaacttgtgggaccacaccacaaagttggaagaagccttgaccaaactcaccgatgtggtaatcaccaatcacaaaaatatcgaagccgcgatcaaaagcatggagactcaaatagggcaattaactaagcaattgcaaacctctttaattggctttttcgcagctatcaaggagaacccaaagggccattgcaaggctattatcttcaccatagagtgtgacgagggagatgcacaacataagggtgggcacaacataagggaggccatagccaccaacaactgtgccattaacacggtgatggattctctgcgtggcttctccctacatgtcaccactggagctaccggaccctatcattgcccatcccaagaggagtacgcaacctatggaggtggccaggttgcacaagaagaagctatggaggaagatgctatgcatgatggaggtggagatgagagccattcaaccctagctagagcttgcgatattggtactaagaaggccaaagttgctaatgagactgatattgaggaggttggagatgttagggaagttgttgttgttgttaaaggagaggatacacattttgatgcttgtgttgaggagtctcaacctatggaggagaagaatgccatagattg

SEQ ID NO: 102159 - DNA, 285 bp, Glycine max
  Peptide Sequence Number=SeqID_218937
gtacgacctcgatcagtagttttgttccccatggtcgtgaagacatactcaatattgtcattgggcgatcagagcatccaggtcgtgtttgtgtagcggggtctagtatcacaatcagtcaatactatggaagggcatcacgtggctccaatagttcctctacatcaatcactcaacaacagttggctgagataattggaagccttaaggaagagtggaggaatgagattatcggaaacctcaaggaagaagtcgggaatgagattgaagaagaaaacaagcaga

SEQ ID NO: 102160 - DNA, 726 bp, Glycine max
  Peptide Sequence Number=SeqID_218938
atggttgccaagtctcaaagcatagcccagcatgtggtggacctggaagaagtctttggggaactccgcaaatatgacatgtgcttgaaccttgaaaaatccaaccccaacaaatgcactgccatactggagatgcacagccccaccaacatccaagaagttcataagttgaatcgtaggttagcatccctgtccaggttcttgccaaagctcgccaaaaaggcgaagttgttttacaaaccgctcaagaaaactgagcccttccagacttgtgaacaagccttcttagctttcaagaagaccatagctacactgctagttttgagtcaacctaagccaagagtacccctactcctgtatctctcagtagctgacgaagtcgttagctcaaccctcatacaagaggaaaggaagcaccagctccctatctatttcactagctgcatactccatgacgccgagaagtgctaccaaacaatagaaaaggtggtccttagtttgatgactcagcccctacttccagagtcatcaagtggtagtcaaaacaaactacctcatcaagtagaatttgctggaaacgaaacaaccacctcaaactggtggaacctttacattgacaatgtgtctaacataaaaggaagcgtggcaaggatcatccttaaaggtcctaacaatataactctagagcaagcccttaagctcaacttcagagcctcaaacaattag

SEQ ID NO: 102161 - DNA, 327 bp, Glycine max
  Peptide Sequence Number=SeqID_218939
atgggagtcttcgagaggggtctcgcgtctgaggccagactgagtgggtggatgtggccaaagtgggctccagaacttcacacgtcggctttgatgatgacctttgttgagagaataggaggaggaacctgcaaaacaaaggaccttgatgctcaagaagagaagaaaccagaggaaaacaaagtggaggagaaaaaagcagaggaagaagagaaaaaaccagagaaatcaaaagatgacaaggaatccaaggaggaatctgcgtcgccagaaatcgtgcaaggcacaaccttcgcaatgcttggacactttaagcatgatctctga

SEQ ID NO: 102162 - DNA, 1428 bp, Glycine max
  Peptide Sequence Number=SeqID_218940
atggacatatttgggtgcacaaccatccaaatccaaaatcttaaccccgaggtggcattgcattccatcctcctcgccctacgcctcaacaagtttgcagacagtctgtgtaaaaaaccaccaggtagcatggacgagttgcgcgagcgagccaaggactacatccagatggaagaaatgtctagattcatgaatgaagtccgacaagctggacataagcatgacaagcgagatggaattacgaagatggacttacatatgttggacaagaggcacaagccagacaagcgcctgcctctctccaaagggcttaggtataagtgttacgcacccttaacggtcaatcacacaacaatttcggaggaagctttcaacttggaggtacccatctggctatccccgaggaaacctcccaggccagggtcagaggcaatcaaatattgtagatatcatcgcaatattggtcataacacagaagactattgggccctaaaagataagataaaagaacttatacgggttaggtacttagcccagtttgttaagaggccgaacaaccaccaagctttccagaggctcgaggtctcccccgacacagtccaccctcacaccagtccactcctcgactttgccagcgagagagtagagactagaggctacgttgacttaatgaccaccttcagtcaaggcaagctctccaggagcttcatcataagatatctactagttgatgcggacacatcatactttgctttagtcggcaggaagacacttaacgagcttggagccatagtctccacgccctatttgaaaatgaaactccctaccctgacaagggagattgtgacagtcaagagcctgaaggtagcaccacatcctcccaccaaggagcttactaagcctcaccccatagtgactgaaggcactcaagtcatgagcgtggacaaatggtctcaaatccgagccctgaccgtctaccaagcaagcctaggcgatgaattcgacatagatccacaagaggacacctctgacagaggcttgaaacctctcaaagagcttatcaagctgcaactcggacatcaactcgggcagtgcacatggctcaatagggacctcaccagccgtgagcatcggcgcattgccgacgtgctacatagaatcatggatttgtttgcttggcaaccatctgacatgccgagaattcatcctagcataatctgccacaaacttaagaaaagaaagataggagaagaactatgtaaagccatcaaagaagaaatcgacaaactcctcaatgcaaatttcatccaagaagtcagggtgtgccccaaagacacataccctctacccagcattaataggctagtagatggagcgtccgggttccaagtgctaagcttcctagacgcttactccgaatacaactag

SEQ ID NO: 102163 - DNA, 612 bp, Glycine max
  Peptide Sequence Number=SeqID_218941
atgtggaaatcaagtcaccaagcggttgagtatatggttgtcaccggtcatttcattgatgtggatccagagtggaaacttcaaaagagggttttaagttttgtgaaggtgcctactccgaggcaaggaattgatgtagcagatgccatttttaagtgcttgaaggcgtgggggattgaagtaaagatgttttctgtgtcagttgacaatgcttcttacaatgactcatgtttgaagaatttgaaagagaacttattacttagaacaaaattagttttgaatggagatttgtttcatgttagatgttgcacacacatattgaacttgttggtacaagttgggcttggtaagataaaagctatcattcaaaatgttcgtgaaagtgtgaagtgtattaaccataatgatgcgagatggaaggtcttcaatgatgtttttgaacaaaagcatctaaaagaaagaaagctcatccttgattgtccaactaggtggaattctacattccaaatgttgttaactgcattgaaattcaaaattgacttttcagcttatggagaacgagatcctctttatacttatgcactttcaaatgaagattgggaaaaagtttga

SEQ ID NO: 102164 - DNA, 423 bp, Glycine max
  Peptide Sequence Number=SeqID_218942
atgcttccatttgatttccgttgtgtcacggaaacttacggattgtgcatcaatattttttggttttccggcatgtcctggaatttcacaaattgcctaatgatgggtgccaagcacctcacaaggaccaaagaaaggtcgcatgtcatcaagcaaaggtccccggacgaaattaggattctgcaaacattaagatatttttggggatctaaaatattgaatattgataaagatcaaggaagtccttcgagaagagaagtaagaactaagaggaagaatccagtaattgaactaaaagaacttgtgaaaggaagagcgcatagggttgaccccaaggttaggctggaaataccaatgagaggaagtataaagataccgaaggataatttagaggttatcaacaaattacatggtcacacctaa

SEQ ID NO: 102165 - DNA, 174 bp, Glycine max
  Peptide Sequence Number=SeqID_218943
atggagaatatgcaagctcttgctgtgctgagatccctctccgctaaagggtgcccaacctctgtgagtcaatttcactatggcgagatccctttctgccaaagtgaaatgacttatagtgggtaccttgagttcgagatatccatttgccaaggcgagatccctcttcgctaa

SEQ ID NO: 102166 - DNA, 178 bp, Glycine max
  Peptide Sequence Number=SeqID_218944
gttgctgaaaagttacttaacaacaaggcgttggagttctacaaatgggatgatgaccttccacgattgttgcagaatgtgagagacaagttgaataaagttgctgaaggtggtggtgaagatggaggaggtggttctataggggctaaagttggtgatggaaggtccaaagacgcag

SEQ ID NO: 102167 - DNA, 1092 bp, Glycine max
  Peptide Sequence Number=SeqID_218945
atgaacctcatcgaagcgggaaccgatgagtatagcgggttaactttcaagatgccgcggcgtttcgcggcgaaaacccaggccgatgatgcggccgaacaggcgcggcaaccagcggctgttgccgacgcgggcgatcaggcgcgaaccgcccgctgcgcggcgttcgcccggcttgcgctggctcattttgatctgcaaaaactggatggcccgggtggggaattcgcgccggcgctgcacgctcagcagatgcttcagctgcagccgatgctggcgcagcggcgggatcagggcgttggcggcggccaccgcgtcctgaatcgccaggttgacgcccacgccgccgatcggcgacatgacgtgcgcggcgtcgccgatgcacagcacccccggtttggcccagctatccagacgatcgatgcggatgctcagcagcttcacctgatcccactcgacgatctcctgcaggcgatcgtcctggaatggcgccacctcggcgaggtgcagcaaaaatttctccaggccgctgcggcggatcgcgtcgaagctgcctttatcgatcgagtagccgcactgccagtagtcgccgcggtcgatcatgatgaagttctgcttcggcccggtatggcccatcgaccaggccggatcgcccggttgcttgctgagcttcatccacaagacgtcgcgaggggcgccgaaggagcggctgctgagcgccgcctgctcgcgcaccaccgagttgcggccgtcggtgccgatcaccagctggctgcgcacgcggatcgggccttccggcgtgtcggccagcacgccgcatacctggccgcggtcgtagagcagcttatgaacctgcgtcgaggtgagcagcctgaaatgggggaacgcggcggcctgctgcgccaaaaagttgaggaactcccactgcggcataaaggcgataaatttgcagcgcgtcggcaggcgagtgaaatccgccagcttaatgtcgcgcccggcgacttcggcgtgcagggattcggcgcgctggtgcggcagcgccagcagttcgtcgagcaggcccagctggtgcatgacttccagcgtcgacgg

SEQ ID NO: 102168 - DNA, 1028 bp, Glycine max
  Peptide Sequence Number=SeqID_218946
atgagtgtttgtcatcacctctgctattccaagacatatcaagaagagggcaaccaaggccaacctaagattggtgacaaggaatgggcagctgcctttactgggaacaaggaggactcagcctcatcatcatcatcatcatcatcaccatcatcatatagtgaaagggcaactcctagggaacctttaacaaatgctcagaggtttcgtttggcatttattaatgataatcctacacctgaaaccccatactctgagtctatactttatgaacctgttgcaagggaaacaatcattgtccaagcacctacctggacaaaacatgattgtgagcatactccaactgaggcctttaaggctctaccaataaataagggacccttcgcaagaagtggaaccccaaagatcgagtttcagaaaaaggtgcatatgtggatgccaatcaccaaactcttactagtgcatcctgttgatctcaatctctctcaagaagaatgttcatcccttggcaaattgcatgaacaaatgtacttgaaagaccacgccattgcccaccctcttggtctacacatcttaagggccaccgatattaagatggttgctgataaagtaagtccatgcctacagaagttgattcgcactcctgatgtttatgatgccaggacattatggaatcaaattgtatggatggactctaaaaaagccttcactactggctatgatggaagtgataatactgagcatcacgatgtcattcaagtgctacgtcctgttaggaagtaccactttgatgatgcttgtgtctacttcaaaaaggatgatgaggaagaagctgttgctattgtcgtgaaagaagatgttgcctcagtccaagctaaagtatctgctaaagttgtggatgacaccattgtacatggggttatcattgatcttaccaacactggtgtcatggacgaaactctggaggcatctaatgcaactataaatggcgaagttgaacgcaacgctcttgaacttgcatccaagca

SEQ ID NO: 102169 - DNA, 573 bp, Glycine max
  Peptide Sequence Number=SeqID_218947
atggcggccagccgcacgccggtgcgtcaggcgctgtttcgactcgagcgcgaaggctatgtcgaggtgctgtttcgcagcggctggcaggtgcggccgttcgattttgcctacttcgaagagctgtacgacctgcgcatcgtgctggaacaagaggcggtgaaacggctgtgcgaatggccggccggggaaacgccggccgcgctggcggcgctgaaccgtttttggaccgaagcgccgcgtctggcggacggccaggcggtgtcgcagcacgacgagcagtttcatcaggcgttggtggccgcggcgggcaatggcgaaatggcgcgcatccaccgcgagctgaccgaaaagatccgcatcattcgccggctggatttcacccagcaggcgcgggtggacgccacctaccgcgaacacgccgccattttgcaggcgatcctgcagcggcaaagcggggcggcgcaagcgctgctcggcgagcatatcgccgtcagcaaggcagaggtacgaaaaataacgctgcacatgttgcaccaggcgcgggcccagcagctggcgcgctcggcgtaa

SEQ ID NO: 102170 - DNA, 288 bp, Glycine max
  Peptide Sequence Number=SeqID_218948
atgaggtggtacaggcgtgaaacaaaagtttatgtcaacccaaaacatgcaagaagaggactattgggtgaaatcgctgaaacactgcattttatggtgtcgcctgttgggagaagggtttgtacttttgacgatttactgccatgtattgagaagatcactcttttgtctgacgaagaggataggatacttgaggcacatgaagatgctcccccttctcagccacaatttgaacatcaacagtttaatatactacagcgaagtgcggagactcgaggcttagcgtga

SEQ ID NO: 102171 - DNA, 159 bp, Glycine max
  Peptide Sequence Number=SeqID_218949
atgctctcgggaacggaagctttgagcacacttcagatatcttctcaaagatcccaatggtcagatcatggacaaggtgttacagctgctactaagactgcaacgccttttgaaaactcatattggaaaagtggagatataaaaacttcaacactatag

SEQ ID NO: 102172 - DNA, 447 bp, Glycine max
  Peptide Sequence Number=SeqID_218950
atgacccaagagctggtagcccgcggagacaccttacggttattcgcacctcgtcattcagtgaccccaagtgtgattgacgagcagaggccaatgtggtcatctgcgccctttccggagatgtcatcatcttccgatggagacttttcaagtctcacaagttatctagaactacaggcggcgggcccgatgatacgcggagataccttacgattattcgcacccttttgtcatccagaggcggcgggcccgatgacaagcagagacaaaatttggtcattctgcacccttgtgtcatccagaggcggcgggcccgatgatacgcgaagataccttacggttatccgcacccttttgtcatccagaggcggcgggcccgatgacaagcagagacaaaatttggtcattctgcacccttgtgtcatccagaggcggcgggcccgatga

SEQ ID NO: 102173 - DNA, 5538 bp, Glycine max
  Peptide Sequence Number=SeqID_218951
atggaagcgttgatcgagttatgcgacctcattgcgcagaatccgtcgctattctccgacaagctctcgtggatatgcgacaaatgccccccgccggagtacctctcggcgggatctcctagggtttcgcgctctcagctcaatgccgtcctcgccgtcgcgcgcttcctctccaactgccccgattccgccgatctgcgcccaaagtccgtcgtcctcgagttcctccgctccgttccccattccttcacgcaatccttctggccccaccctttcagcctcgattccgtcgcctctttcttcctcgatttcatcggctacgtctccaaggccgcacaatcctcaccggatttcgccgaggagctcgccgccttcgccggcgaagtagtgatttccgcgatcggcgaacagcgctctggcattgctagggctttcttggccgctctctcgcagaactttcttccaatttcgtccttcgatgccaacagattggtgacttgtttaatcgatcaattcgctgcgcctacggtggggcctgttccaggcatgccgagggaacaacttgctgcggaaaattcctcggctcagagctcgcccatcagtgtgaaccaccaatccctaaccaattacaatgacagtcccgggaatgagaatgcttcgggttcctcgagcagtgtggcttctaaggccgcggatgatgtcagcacggcgtcgtcgagagggatggtgaatgggggaaaccatgtttggaggaccggtgctgatcaattggcgcagaatttgggtttaaatgatggtggtcttggcgcgttctcgtctggccaacaagttgttttgttcgaggaagagtctgtggagttcttggagaggcaggaaatagcttttaagttgattgctcacgtgttggagaaggcccacgttgaacctgcgcttttggagcaggttaggttaatcgggaagaagcagatacagtccatgtctgtgtttctgaagataaggaagagggattggcatgagcaggggtctcttttaaaagctaggattaataccaaactgtcagtttataaagcagcggtgaacctgaaaatcaagagcctctcagcactggattccgattcgaggtctgttaagaggttggtttatgaggcagttgcgatattgatagatgctgccgaggcgtgcttactctctggatggcgtaagttgagattgtgtgaagagctcttcagttcattgcttcttggggtagcacatattgctattgcccgaggaggacagccgctgcgtattttgctcattcgcctaaagccaattgttctcaacgtttgtgctcagcctgatacatggagtaatacccacggaggcatgtttgagagtgtcatgaaggtcagctgtcagataattgaatcctgctggaataaggagcgagcccctgttgacacatacataatgggattagccacaagcatacgtgaacgaaatgattatgaagaacaggacaaccaagagaaacctgcagttccttttgtacagcttaatgttatacacctgtttgctgagctgagcgctgcagtcaacaagtctgagctggtagacgtgttattacctctttttattgaaagcctagaagagggtgatgcttcaactcctagtttgttgagactccgacttcttgatgccgtgtctcgaatggccagtttaggttttgagaaatcttaccgtgaaacagtggttttgatgactagaagttacctgaacaaactttccagtgtaggatcagctgaaagcaaaacagaggcaactgaagccacaactgagcgagttgaaactctacccgcaggatttcttcttattgctagtggtcttactagtgatagactgcgttcagattttcgtcatcgattgctctccctatgctcagacgttggtttagctgctgaggctaaaagtggaaggagtggagcagatttcctgggtcctttgctccctgcagttgctgcaatttgttccgattttgatcctactttaaatgtggagccatcacttttaaaactatttcgcaacctatggttctatgttgctctttttggcctagcgccaccggtacagaagactccagtaactacaaagtcagtttcaagtacactgaacagtgtgggaagcatgggtgcaatttcccttcaagctgtaaatggaccatatatgtggaatgtggactggtcttctgctgttcaacgaatttctcaggggactcctccactagttgttagctcagtgaaatggctcgaggatgagttagaactaaatgctttgcacaacccaggcagtcgtcaaggcagtggcaatgaaaaggctgcacttgcacaaagagctgctctttctgcagctttaggagggagagttgatgtcacagcaatgaccacaatctcaggagtgaaggctacttatcttcttgctgtagcttttcttgagatcatccgcttcagcagcaatggtggaatcttaactggtggcaccactatggatgctgcaagaagtgcctttacttgtgtctttgaatatctcaagactccaaatttaatgccagctgtcttccagtgtttagcagcaatcgtccacagggcttttgaaacagcagtgtcatggctggataaactctgtaaagcaaatacttggcaaagagcacagcccacaattgatgttgttttacttttatctgagataagaattggcaccgggaaaaatgacaattggccaatacaaacagcaaatattcctgcagtcacggctgcagcagctgcagcttcaggggcaaacttaaaagcatcagagtcttttaatttggatgttattagttctggtaagtgtaaccaagctgcagcgacagttaagtgcaaccatgctggagaaattgctgggatgagaaggttgtataacagcattggtggatttcagtccagtactgcaccttctggtcttggacttggagctgggcttcaaagaattatatctggagcttttcctcagcagccacaagctgaggatgactcgttcaatggaatgttgcttaataagtttgtgcgattacttcaacagtttgtcaacatagcagagaaaggtggggaagtggtcaggtctgaatttcgtgatacttgctctcaggccactgtgctgcttttatcaaatttggtaaacacatttcttagttctggatccaaatcaaacgtggagggcttctcacaacttcttcgtcttctttgctggtgtcctgcttacatttccactcatgatgcaatggaaactggtgttttcatatggacatggttggtttctgctgcacctgaacttggagctctcgttcttgctgagcttgttgatgcatggttatggacaattgacaccaagcggggtctttttgcatctgaagcaaggtattctggacctgctgcaaaactcaggcctcacctatcccctggggagcctgaattgcagcctgagactgatcccgtggagcagataattgctcatcgactatggcttggatttctaattgatcgctttgagccagaatggtatgacacaaactatacaaactttgctcagtgtgaggctcaatctgtttctctatttgttcaataccttacaaatatgaaaggagatactgtccaagttggttcaaaaggaaatggacaagaaaatgggaatcctttggctgatgtgagtgatcaccatcatcctgtttggggtcaaatggagaactatgctgcaggaagagaaaaacggaggcagctacttttaatgctttgccagcatgaggctgataggcttgatgtctgggcacagccgactaacacaaaggaaagtagttcccgacccaagattagtgcagataaatggatagaatatactaggactgccttctctgtggatcctaggcttgctttatccttggcctcaaggttcccgaccaatgcatttgtaaaaactgaagtaactcagcttgtacaggcaaatatagtggatgtgcgcaacataccagaagcattaccttactttatcaccccaaaggcagttgatgataattcagtgctcttgcaacaattgcctcattgggctccttgttctattacacaagctctagagtttctttctcctgcatacaagggtcatccacgggtcatggcatacattctaagggttctggaatcctatcctcctgaacgagtaacttttttcatgccacagctggtgcagtcgttgcgacatgatgaagggaaattggttgaagggtatttgcttagagctgctcaaagaagtgacatatttgcccatattcttatctggcatttgcagggtgagactgtacctgagacaggaaaagacccaaacagtgggaagaatggttcatttctagaactgctgccagcggtaaggcagcgtataattgatggttttaatccaaaggcacttgacatatttaaaagagagtttgatttctttgacaaagttacatccatctctggtgtactatttccactccctaaagaagaacgccgagctggtatccggagggagttggagaaaattgaaatggatggtgaggacctttatttaccgacagctcctaacaagcttgttaggggtattcgagtagatagtggtattcccttacaatcagctgcaaaagtcccaatcatgataacttttaatgtaattgatcgagatggggatgagaatgatgtaaagccacaagcttgcattttcaaggttggagatgactgtagacaagatgttcttgcccttcaagtaatagcactacttagagatttatttgaagccgttggcttaaatctttatctatttccttatggtgtactgcctactggtcctgagagaggtataatagaggttgtgccaaatacgcgcagtagaagtcagatgggggaaacaactgatggaggtttgtttgagatatttcagcaagattatgggcctgttgggtctgccagttttgaggctgcacgccagaactttatcattagcagtgctggttatgctgttgctagtcttttgcttcaaccaaaggataggcacaatgggaaccttctctttgataatgttgggaggcttgttcatattgacttcggtttcatcctagaaacttctccgggtgggaatatgcgttttgaaagtgctcattttaagctgagccatgagatgacacaattactagatccatctggtgttatgaagagtgatacatggaaccaatttttaagtttgtgcgtgaaggggtaccttgctgcccgtcgacgaatggatgggatcatcactactgtgtcattaatgctagacagtgggttaccttgcttcagcaggggtgacccgattggcaatcttcggaagagatttcatccggagatgagtgagcgtgaagcagccaatttcatgacccatgtttgtaaagatgcttataataagtggaccactgctggctatgacttgatacagtatctgcagcaaggcatcgagaagtga

SEQ ID NO: 102174 - DNA, 313 bp, Glycine max
  Peptide Sequence Number=SeqID_218952
ggacattcgtggtgtggctgttgatggtgttgagggagagccagttaacctcactgaacccgttgccgaagcaataggagctgcttttgctgcatggtttagattgttccttatctgcagcaagatgataaacgaagaagaaagccaatctattttggttagtggagaaagtggtgttggtaaaactgaaagtacagaaatgcttatgcattgtcttgcctttttgggagggagagcagcaactgaagagagctttgcacccgatgatctaaacatcaactatggatccaaacaagacgatgatgggccttag

SEQ ID NO: 102175 - DNA, 660 bp, Glycine max
  Peptide Sequence Number=SeqID_218953
atgctgaagcatttcaatttcaacatgaacattttcttcacgttgcttatagttgtcacattagctagtttctatgttccccagttgaagcctcgtccttcaattacaatagctttttgcatggttgcaaccctagtataccaatttataatgagaacacccaacaaaatttacttggtggactttgcatgcttcaagccaagccttgcatgcctctgctccaaggaaatgttgctcgaccgagcgaatcgcgtcggcttcctctccgaggaaaattacaaacttgtgaacaagattctcgaccggtccggtctgggaccatggacctacgtcccggagggcctgctggagatccctccgagactaacatttgaggaggcgaggaaggagacggacacggtgctcttcggggctgtcgacgagctcttggaaaaaaccggtgttgaagccaaagacattggggttcttgtggtgaactgttgcttgttcaaccctacaccatcgctctctgactccattgtcaaccggtacaagcttagagggaacattttggcctacaatcttagtggcatggggtgcagtgctggggttcttgctgttgactttgccaaacagctcctacagtattccaaaatcagtttgaaggataaacttaattag

SEQ ID NO: 102176 - DNA, 681 bp, Glycine max
  Peptide Sequence Number=SeqID_218954
atggtgaatgtatgcttcgccttggtgaatgcacttccagaagcttcaatgagattcatgatgcaagatgaacttgcaaatgatacccagagattctttaacaaatatgttgaggctaggtaccatgccagcctcaagagggaaatttatagtgagaggaagaacccaagtgtttatagtgaacctctagttaaagagttctatgcaaacattgtacttaatgatggttatatggagaggaaagctttggagcaagaggcaatgattgttgaggtggaagatcttttatgcctcactaacataaattttaggtctaagggtggtggagcaaacaatagactacacaagattgatgatgattctttgcttgctccatgttttcctactctcaaatctctgagcattaatgaaagattggagaagatgcataaagaggaggaagtgttagttgccattggttggcctactcctcctagggaacaagctttagaaggccaaaggggtggtgaggcaactaatggagctggagtcagagctgaagatgttagtgatgctagtggagttgaagatggaattgatgaagaaagcactactatagaggaagagattgatgctaaggatagtactgagggtgtgcctcaagagagtatcattgaagaagaatttacaaatattgaatga

SEQ ID NO: 102177 - DNA, 372 bp, Glycine max
  Peptide Sequence Number=SeqID_218955
atggatcaaacacttgcatttgtagagattcactggtcaaactctgagtttctaggtttaatcattgggatttggcttggaactcaagcttgttacatgcataagccctacacattaagaagtaacacatccaatgaactattgcaaacatatgatgaatcccttggagaagcttggcaaagacttagagattttttgaggcaaacttccacccatggttttgatgaagctctccaaatcaacatattcctaggtggattgagagctcaaattaagcttatgcttgatgtttcagtatgtgggaagatctctctcaagactgcaagaaaggttatagaaatcattgaaaacatggatgccaatgctatttaa

SEQ ID NO: 102178 - DNA, 360 bp, Glycine max
  Peptide Sequence Number=SeqID_218956
atggcgagtagctggagaagaacgtttggcaacatgaggtccttcgtaagcaattcgatgggtggtctcaggggcggaagcaaccttgcttcttgggtcgtcgccggaaccctagcttacttcctctggatcaaaccctcccaagacctcaagcgtgaacagcaggagaaggccgctcttgccgccgccgagtctgatccttatcgttacgttgagactcgtaaacccattcccgatcctcaggttcgctttcctcttcaacttctttattcatattcatattctcttcaacacttacaagttacgggtttgatatatggaaacaagaacaaggacaaaccaaccaaaccagaggattga

SEQ ID NO: 102179 - DNA, 396 bp, Glycine max
  Peptide Sequence Number=SeqID_218957
atggcataccaagcgatgcagggtccgagttcgggatcgagttcgagttcggggtttcagttattgaattctccgttcggagacaccacctacaccaaagtcttcgtcggaggattggcctgggagactcagagcgaaaccatgcgccgctacttcgaccagttcggcgagattctcgaggccgtcgtcatcaccgataagaacaccggaagatccaagggctacggtttcgtgactttccgggatcccgaggccgcaaggagagcgtgtgctgatccatctcctgttattgatggcagaagggccaattgtaatttggcttcacttggtcgaccacggccccctctgccttatggtattctattctgtttaattcgttttcatcactatgaatga

SEQ ID NO: 102180 - DNA, 684 bp, Glycine max
  Peptide Sequence Number=SeqID_218958
atggttcttctctcaatcaatcagcctaaaaatattgatgaagaattgagtgaagattctaaggtgattgctatggaagaggaactaagtcagttcattaataacaagacagtgattggaaccaagtggatgttcaaaaacaagcttaatgaagaaggagaattgttcaaacataaggatagactagttgctcaaaagtacaatccacatgaaaggattccctatgaggaaacctttgaacttgtagcaagagttaaagccatcagaatacttttagcctataaagtatatgtgaagcagccacctagatttgaagataaggagaaacctcatcatgtgtacaagcttgtcaaagctctatatggattgaaacaagctccaagagcttggtatgaaaggctaagctcattcctagttcataatggattcactagaggaataatggacactacactattcagaaaggccgagaaaggaaaacttcttattgttcaaatctatatagatgacataatctttggtgcaacctcaaaaaggatgtgcaaggatttttctgagctaatgaaagaaagaagattggagactcatccaccaagagaagtacacacaggacctattgaagaggttcagaatggaggaagccagacctatggctacccttatgcatccttccacaatcattga

SEQ ID NO: 102181 - DNA, 558 bp, Glycine max
  Peptide Sequence Number=SeqID_218959
atgtgtaatggtctgcatcaacataagcattctagcctaccctgctactcaggacggatcagacctgcctccccttatgttggaagtttgcaaccagctcgtggtgcttatgttgggggttttggctaccagcaaccagtttcctacagctatcaacaaggattggtttaccctccttatgggtatacgtcatacggacctgagtacatctacccacagagtctgtacaacccatatatggggcaacagtaccttcagatatatggagtgcctggggcagtgaatacaacaactatttatccttatggacaagtgggtcaggctattaccagcggtcatggttattcggctatgcagggttatacagtaccaggtcatcagattgtgccctatggtggatccaatgttaatgccataacaacttcacctatgcctgccattcaagcttcatatcctagtggaattgctgcaccagttcctggccaaccacaatttattgttcctgctccttctcctcagtttatgcaaggtagtggtcctgaccaaacagctgggtga

SEQ ID NO: 102182 - DNA, 291 bp, Glycine max
  Peptide Sequence Number=SeqID_218960
atggagacacgtcttgtgctctcgttggcaacacttcagcccatagtggctttatccactatagaggcggagtacatggctcttgcaaaagcagtaaaggaagggatatggctgaagggtctgattagcaatcttaggtttccacaagaaaaggttatcattttctgcaacagtctgagtgcaatctatttagccaatgatcaagtccatcatgaaaggactaagcacattgacatcatataccacttcatccgttctgagaagaggtcgaagttcagaaagttcatatga

SEQ ID NO: 102183 - DNA, 165 bp, Glycine max
  Peptide Sequence Number=SeqID_218961
atggagggagctgttaaggcgttggaccttaaaatgatctcaattttagaacccttaaacccttcccatgcatggctatttataggaaaaggccatttggcgcaggggattctcgcacaggtgagctggttgcttaaagctgaaggtatcagctcgcctaggtga

SEQ ID NO: 102184 - DNA, 879 bp, Glycine max
  Peptide Sequence Number=SeqID_218962
atggttaacacaatcaagatggagaacttcatagggaagcatagcttcaacgttctttatgaagtttttgaagaactgactgttgttgggatttggcataaattggagaaactcttcatgatgaaatcaatctgcaacaagttgcttctgaaatcacttttttggcctttgtatgagagaagtatgccactaaaggaacattttaatgagataaagtttgttttgatggagctacacaacattgatgtcaagatggaaaacaaagatctagcaatgattctgttagcctctcttcatccctcctatgagaattttgtgagttttcttggtgtaggcaatgactctattacacttgacgaagtcaagtctagtctctattctagagagcttcgactaaaggcatctggaaatggtcaggaagcctctacattcgtactattgggaactaattatgctaaagggctgaagaagcaaaaaacaaaatgtggtaagaagagcaagaagaaatctggtggtaacgtcttcatggtagtgatgctccttcttaagaaatatcttgtatctatgggtgccatggattcgatgggttttcttgttgggctaaaggtgtttggatgtctaacatactatcacgtaactgaaggtaagctggagcccaaagccaagaagggattctttatgggctatgaagatggagtcaatgaattcttagtctcgtctctatctaaaagaaaggtcattctaagtagagatgtcatctttgacaaacactctatgctacattctaaatctaatgaagatttaggcaaggctgaggatgtcactaagcaagtggagtttgagagctccacaatcagaaacattagtgatcaaaagtag

SEQ ID NO: 102185 - DNA, 761 bp, Glycine max
  Peptide Sequence Number=SeqID_218963
gcagagaagctgatctgaaaggaatggcgtccatttcgcggttctgttgtgtgcatatgcgagcgtctctatgcaacttcacagcccagaaaggtccatcacctcccacaaccttggacttggagcatcataaaacaacaccatgtttgctttcttccatcgaagaaggacgtgcggttaataggagacaacttattcttcacacgccagtagcagtagctgcatttgcagtcccaaatgcattggcactcaatgatgtgtctgaggatgttcgtgtctacactgacgatgagaacaagttcaagattgagattccccaagagtggcaagtgggaacaggagacggagaatctagtgggtttaaatccataactgctttctacccaacagtggcatccaattccaatgtgagcgttgtgatcacagggctgggaccggatttcactaggatggaatcctttggcaaagttgacgagtttgcccagactctagttagtgggcttgacagaagctggcgaaaacccccgggtgtggctgctaaactcatagattgtaaatcatctgatgctatcgggatggcatcaaatggttggtataacagactgtatacggtgacaggacagtatgtggaagaggaaacagacaagtatgcttcaaaagttcagaaggttcatatgatgaacatggtcatgacgaggaagaaattttctcacagcccttcttcatcttttctatttcataacggatttgtgtctgcttag

SEQ ID NO: 102186 - DNA, 1455 bp, Glycine max
  Peptide Sequence Number=SeqID_218964
atggccaccgccgccaccgaacctctcccttccaccaccgaaacgcctccggcaccgcctccaccgaagcaacccccgcctcccgcgccgcaacctccggcggcggcggcggcggcggcagtgaagccggaggctccattgcccgattcgaaaacttcggcggaggcgaacgtaatcgtggtgccgagctactctcggtggttctcgtgggattcgattgacgaatgcgaggcgcgtcacctccctgagttcttcgaatcggcgtccaagagccctagggtttacaagtactacaggaactccatcgtgaagtacttcaggtacaatcccacccgcaaaatcaccttcaccgatgtccgcaaaaccctcgtcggagacgtcggttccatccgcagagtcttcgatttcctcgaaacttggggtctcatcaattaccacccctcttcgtcgctcaccaaacccttgaagtgggacgacaaagagaccaaatccgattctgcatccaactccaccgaatcttcttccgctcccgtcaaagaaaacactaagagactctgcagtggctgcaaagtcgtttgtaccattgcttgttttgcctgtgacaagtatgatttgacactttgtgcgaggtgttatgttcgtggcaattatcgagttggtgtgaactcttcggattttaggcgagtggagataagtgaggagacaaagacggattggagtgaaaaggagatcacgaatcttctggaagctatttcgcattacggtgatgattggaagagggtttctcagcatgttcctggcagaactgagaaggagtgtgttgctcattttctgaagcttccttttgcgaatcaattccagcattatcaacaacaccctgctgtcaatggcacagatgacggttgtaatctgttaaagatggtaactaatgctgatgctgaatctgaattggatactgttgcctctgctgaacccagtaagagaatgcgtctcacgcctcttgcagatgcaagcaatcccattatggctcaggctgctttcctgtctgctttggctgggtcagaggttgcacaagctgctgctcaagctgcattgacaactctgtctgaggtttacaaagcaactaaaataaattatcgggcgtttccaaggaatacattgctgcaagatgctggtatcacgtctaacggtggtaatacttcagattcatttcaaggatctcgattgcatgcaaacatacagcttgagaaggaagagttagatgtggaaaaagcaatttctgagattatagaagttcagatgaaaaatatccaagataagcttgttcattttgaagatttggacctgctgatggaaaaagaaggccagcagatggagcaaatgaaaaatatgtttttccttgatcagcttactcttttatttcataaatcatctgcaccaaaaactggagaatga

SEQ ID NO: 102187 - DNA, 582 bp, Glycine max
  Peptide Sequence Number=SeqID_218965
atgggtcatcatcaagataggcctttatttcaaccgttcactacttcatacaaaaactttaaggtgaggttttttaaggtgataattctttctagtttgggtgacaaccatttgtttgatgtcaaatggaaacctctgttggaagacttagaagccattcttaagtttattgggatggatgccttggacttccgcaacgtgtgtcaagaagttggtgttaatgtcgtcaatgcctcagtggtcagtcctgttaataagatccctcctccttgtcgtacgctcattgatgttctcgctcctcctgtcaaaaataaagacataaggaagaagggaaaaaggagggacactaaagaggatactcgaccttcaaagaagttacaccaacaaactcttcaccatttcaacactctgttggctgttgacaatgccaagttaaaggatagtgtgaagaagttggaggatagagaggctttatgggctcaaaaattgaagagggagaaggactcgatgtcatctctcaaggtggaaataactagggatctgatcaatgataatgtatcttactttgtgctgctcgtctaa

SEQ ID NO: 102188 - DNA, 345 bp, Glycine max
  Peptide Sequence Number=SeqID_218966
gcatgtcaatattcgtattgtgatgaggaagattgtgatcttatgtttcaattgcttaccaaaaagcttagtcgattgaaacttaagcatggtgttgaacgatctccaaatcctgtctctaatgagcttgaaaatgttgaggttgatgttgaagatcctcttattttgcgtacaaagggaagtggtcgtacttcaaccactgtgcgtgggagagttatgaggatccaaaattgcaacaagtatggactgaatagacacaacaaaagatcatgtacgagtgtcccatctagccagaccgttgccaatggaagtaatagtgagggcattgtggcagaagatacatga

SEQ ID NO: 102189 - DNA, 111 bp, Glycine max
  Peptide Sequence Number=SeqID_218967
atgtcgcgcttcattatgctgccacgagtacctatgtcattgataaaaaagtatggttatgcctgtgctaggggcgaaaagatgttggagcaatggaggccagtgatatag

SEQ ID NO: 102190 - DNA, 396 bp, Glycine max
  Peptide Sequence Number=SeqID_218968
atggtatattatgcgactcaatcggacatccgagtcaaaacttttgcccgtcagaatttgcccgagtcttccctattaaattctgagtgtctcattagttttccggccttatgcgaagatccggaggaaaggttatggccgtttgtatttgtgatggcttcagttttcaacaacgagcgtctcaatatcataaacatctatcggacatccaagtcaaaagttatggttgtccgaattcacgtgggcattcgatttccactttcgagcaccatgatatattatggggctcaatcggaccgcctagtcaaaacttccgcccgtaggaatttgcccgagtcttccttgtttatttatgggtgtctcaataggtttccggccatatgcggagatccttag

SEQ ID NO: 102191 - DNA, 824 bp, Glycine max
  Peptide Sequence Number=SeqID_218969
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcaccgagttttatgctcggtcgatctgagatcgacgattcttcatatttccaagccgaagtgtttttgcgagagggtggtcaaaactatgatgtaatggattggacgcaagaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 102192 - DNA, 237 bp, Glycine max
  Peptide Sequence Number=SeqID_218970
atgctggatgaacacaacacccatgcaaaaagttttaggatgataagagatagattggcacatagtgaagtacataatgtcaggctgaaattgatcgctaatcgtgaaaaagatgctcgtacatataatgtacctactatttcagaagttgctacacttattgcagatatagagctgacatacttcatcgtgctacatcaagtggccaaaaaagaaagagaaatcatcttacaatga

SEQ ID NO: 102193 - DNA, 360 bp, Glycine max
  Peptide Sequence Number=SeqID_218971
atgcttgtaatcgattacaagacttgtgtaatcgattacatgttttcaaaacttttcaaaaaaaatttaaaaggtgttgagactttttggtacaaggctgcaggcaaggatctaaatcatggtttgaaacaactgtttgatgacattggtgctttggagatggttgacattgctagatgtgaagggcatgggactgaaggtaatggagggaatgatgaaaatgttgaagagaatattcctgatgcaaatgttggttctacaacaggtagttctggtgcaacaaaagatgctgatgttacaataaccttaaatgattcggaagaagaaaccaatgaaagagaagggtttgtggggaagtaa

SEQ ID NO: 102194 - DNA, 468 bp, Glycine max
  Peptide Sequence Number=SeqID_218972
atgtacctccagtgcatgtttctggatatatgccccaacatcatcaattacaagtacaatattaatcagcgggcttctctggatacgcgtcttaaggatgtcaacaaagtattcaaccatcaaggttctcatcatatatgcctcaatactcatttgaagttctttctacctcaaatgttttttatggaccctcacaaagatgatctaccaccatcgagcttttattatcgtgacatgggtcatgaaaacgaggaggaagataatgataacaacaataataatgatgatgacaacggttgtgatcatgttcctcaacaacaatacacaatcattttagaacaagaggaggtagaggtcatagaacaggaggacaacaagcacatgcaaatccaatccaaaaagaagagagacatcaacacatatcaagaagagctcgttattggacatcatctcattattaaattttaa

SEQ ID NO: 102195 - DNA, 276 bp, Glycine max
  Peptide Sequence Number=SeqID_218973
atggtttcagttgctctgatggcaacttattgttcaccagctgtaaaacatgcacttagtctttcacctaactatttttctaccaacattccacaatttgcaagttaccaaaaatggtgcatggaagtcgaaccctacgcaacgacttcaaagtccactattagaaataacactttcaacatcggttatttagggcattctacatcggctctaaagccgatgttgaaagtgacgatgttgaatgtatcatcattaacatctgttttcaaaaactga

SEQ ID NO: 102196 - DNA, 1136 bp, Glycine max
  Peptide Sequence Number=SeqID_218974
ttgttgttattgttgttgaatctgccgcaccagacaccgattcattcgaccaaaacataagcatgtcgggatctgacatggcaagcagggagcaattcacggttgggatgcacaaaccccaaccccaaccccaacaacaacaacctcagcttcatcaaaacaacatgcgtatggactatgctgctgctgacggcaccgctgttttcgcccctcctaccgttaccgttaacattaacggcggagaatcctctccggcggtgcctccgggcctgggcctggcccagccccagccccagccccagcccatgatggttaactcctccgaaccaatcaagagaaagaggggaaggcccaggaaatatgggcctcacggtggcatggccttggctttgaacaccaccactcctcctggcggcgccgccgtgccggttggccagtccggtggggcatttccaccggctcctctttcggattcggcctcagctggtatcgtgaagcgcaggggcagacctcgtggttctgtcaacaagaataagaagaataacagctctaagtattctgggccaggatcttggtttactccgcatgtcattaccgtgaaagctggagaggatttgtcagcaagaattatgacaatttcccagagtagttcaagaaatatttgcatcttaacagcaaatggagccatatctaatgtgacacttcgacaacctgcctcatctggaggaactgtgacttatgaggggcgatttgagatcctatcacttggaggttctttttttcttgctggaactgaaagggctggggggctgagtgtgtccttgtcagggccagatggccgtgtcttgggcggtggagttgcaggtcttttggtagctgcttcccctgttcagattgttttggcaagctttgtttctgatgtacgcaagcacttcaagcatgcaaagcagatgcagaatgcaaaggtttccatagcagcaggccaaagcagctcaccatcaagaggcactctcagtgagtcttcaggtggggttgggagtgggagcccactaaaccaaagcacaggagcctgcaacaacaccatgaacaactgtaccaccccaacacaaagctttcaaggcatgccctggaagtag

SEQ ID NO: 102197 - DNA, 192 bp, Glycine max
  Peptide Sequence Number=SeqID_218975
atgaggatgcttagtacatgggcaatcaaaggcaagggaaatacaacaactacaacattcagggatagacttcatcctagcataggacaaggtcaagatcaaggtggaagttccaatgccatgcctaggcaaaacttgtacgagaatacaagcaatttggaagagactcttacacaattcatgcaagagtga

SEQ ID NO: 102198 - DNA, 231 bp, Glycine max
  Peptide Sequence Number=SeqID_218976
atgcaacttgcaggagccattggcgagtttggcgtcgaggtgacagctggcactggtctcgccagtgatgctagcgattttaggggagttctgaaggttgcaggcatgcagaggccatttccgagagtgcagactgagcagcgcgcagaggagcagggaatcgccaggcaaactggcgatttgcttgaggtgcataaatcgccaaccccaacagcgatttcagttgcttaa

SEQ ID NO: 102199 - DNA, 1086 bp, Glycine max
  Peptide Sequence Number=SeqID_218977
atggcctctgtttggacactgcactttcgctcgctttctcttcgtccatgcctctacattagtcgcagtaacagtagcactgccactagaaattgcattagcatcagaaatggaatctccaattggcgctctggcacccaacaactcaaacacgattccatcaattccattaccaaatttcaccatcaactcgttaattccgtcgccattcctccctttctgttgaatcgaaacggtggaggcaattttcctatttgggtatgtgttgcggttgtggttttggttgtagcggtgagagtgagggtagtttccagaaaaaaggagcgtcctggttccgtggctgatctagtaagacgtggccaacttagatctgatagaagaggcatttcgaggcctctcaagtatgaagaccccttcaataatcccttcgtcaaggttggtaaaagtgactcaactgttgagatgtgcggaaaggtttaccgtttagcccctgttactcttactcaagagcaacaggctactcaccagaagaggagattgcgggcctaccagtggaagcgacccaccatcttccttagagaaggggacttggttcctccggatgttgatcctgacactgtcaggtggattccagctaatcatccctttgctaccactgccactgatttggatgaggacttggcacaaaacaatgtgtatcaaaagcatggagttccttttcggattcaagccgaacacgaggccctgcagaaaaagctcgaagccctacaaaatgaccagaaactgaataaactagtgatagatcctatcaatgctaaagaatttgagaggccattcaactcccacgccagattaaatgatcaagcagataagagctctgtaaacaatcaggagcagaaacacaataaactagtgatagatcctattgatgctaaagaaattgagagaccattcaactccgacaccagattaaatgatcaagccgaaaagagctctgtaaacaatcaggcgagtgcttctgactccccaagagtagatagtggcccaaatcactttgatagtacatcatcagaagattcaagttaa

SEQ ID NO: 102200 - DNA, 2484 bp, Glycine max
  Peptide Sequence Number=SeqID_218978
atggggatatatgtaatgcaagaaaggttggaggtgtctgaaaaaggaaaaacaggttcgacttgcaagaattcacaggcaccgcttcaacttcaccatatctccgaaatgaaaggtgccgtcctcgtcgccattgccgcttccatcggcaatttcctccagggatgggataatgctaccatcgccggggccattgtttacattaagaaagaccttgcgttgcaaacaactatggaagggcttgtggtggccatgtccctgattggagcaacggtaatcaccacatgctctggtcctatagcggattggctcggtcggcgacccatgatgataatctcatctgtgctctatttcttgggtggtttggtgatgctgtggtccccaaatgtgtatgtgttgtgcttggcgaggctacttgatggatttgggattggccttgctgtgactcttgtcccggtctatatatctgaaacggcgccgtctgaaataagggggtcgttgaatacgcttcctcagttcagtggctctggaggaatgtttttgtcgtactgtatggtttttggcatgtcattgagtcccgcgcctagctggaggctcatgcttggggttctgtctattccttctctcttgtattttgcattgaccatttttttcttgcccgagtctcctcggtggctggtcagcaaaggaaggatgctcgaggctaagaaggtgctccaaagattgcgcggaagggaggatgtgtcagattttttgggacccaaacaactgctcattgttgcatatctccttcttgccaacctctgtttgctactcagtgttatcccagctcttcctaaatttttgctcatacaaatttacagacctgggatggggtttattctctcctctagagcacttgtgcaaggcgagatggcattgctggttgaaggtctcgggattgggggtgatacatctatcgaagagtacataattggccctgctgacgaggtggctgatggtcatgaacatgcaacagagaaagataaaattcgattatatggatcccaagcaggcctttcttggttagcaaaacctgtcactggacagagttctattggccttgcgtcacgccatggaagcatcatcaaccaaagcatgcccctcatggatcctctggtgacactgtttggtagcattcatgagaagctccccgagacaggagcaggaggaagcatgcgaagcactctgtttccaaattttggaagcatgttcagcactgctgagccgcatgctaaaaatgaacagtgggatgaagagagcttacaaagggaaggtgaggactacatgtcagatgcagccggtggggactctgatgataatttgcacagtcctttaatctcacgccaaacaacaagccttgaaaaagacttgcctcctcctcctccttcccatggcagtatccttggcagcatgaggcgtcacagtagtctcatgcaagggtcaggtgagcaaggtggtagtacaggtattggtggtggctggcaactggcatggaaatggactgataaaggtgaggatggaaaacaacaaggagggtttaaaaggatttatttacatgaggagggagtttctgcatctcgtcgtggatccattgtatcgattcccggtgaaggcgaatttgtccaggctgctgccttggtaagccaacccgctctttactccaaggagcttattgatggacacccagttgggcctgcaatggttcacccatctgagacagcttcaaaggggccaagttggaaagctcttcttgaaccaggggttaagcatgcattggttgttggagttggaatacaaatacttcagcagttttcagggataaatggggttctatattacacacctcaaatccttgaagaggccggtgttgaagttcttctttcagatataggcattggctcagagtcggcatcattccttatcagtgctttcacaaccttcttgatgcttccctgtataggcgtagccatgaagctcatggatgtttcaggcagaaggcagttgttacttactacaatccccgtgctgattgggtcactcattattttggtcattggaagcctggtaaattttggcaatgtcgcccatgcagcaatctcaacagtatgcgttgtggtttatttctgctgctttgtgatgggttatggaccaattccaaacatcctttgctcagagattttccccactagggtgcgtggcctctgcattgctatctgtgcattagtgttctggattggagacatcatcatcacatactcgctgcctgtgatgctgggctctttaggacttggtggtgtattcgccatttacgcagttgtttgtttcatctcgtggatatttgtgtttttgaaggttccagaaacaaagggcatgccccttgaagtcatctctgaattcttttctgttggagcaaagcaggctgcttctgccaagaatgagtga

SEQ ID NO: 102201 - DNA, 998 bp, Glycine max
  Peptide Sequence Number=SeqID_218979
caccgtaccctatgtggggtagaaggagaactgcctttaccattggatatggcttgccacttcgagacttcttatctggatcggatggacagcgcttccttaatatctcttgcggtgcccctattagtgagttggtcattgacacactctttgtgaaggttgttttgccagagggttctaaagatatttcagtatctgttccatttcctgtgaaacaatcgcaggagacaaagctttcccacttggatattgttggtagacctgttgttgtgctggagaagaacaatgttgtacctgagcataatgagcattttcaggataaaattagaaacgaagctattagagagagggttggagtagcgcctattgtagagaagatggtggaaaatagacttaggtggtttgggcatgtagagagaagaccggtctactataagttcaacagtctttctatgctcagggagcctttgatgttgatttctggctttttatttctgtttgttgcgtgcattgtctacacgcatgcagatatatcaatctccaaatcttctgcatcttatttggcaaagctccagtgggacgaggtgcaagcaactattcagcaggtccatggtatcattggccgctgcttaactgcacatgacaagctagaagcgtcattacacgatctttccaggacaggagacactcaagcctgtaaagcaactcgaaaatcagttgatagctcgttgaaagagctctctaaagagttgaagcaaccattggcaattttgcaatcttctccgcaagctgctcaaatattacccaaggtggaggaacttgttactaaggagagagagttgcaggataaacttctagtaaaacactctacaattgtagacgcctatgagaagaaagcaggaagggaaattgagaatcggattgcttcacaacagcagaaaattactgctttgagacgggagattgatgatcttatggacttgattgatgagatatga

SEQ ID NO: 102202 - DNA, 1572 bp, Glycine max
  Peptide Sequence Number=SeqID_218980
atggcgggaggaggagaaggaggtgacaccaggcagctagatctcacacctacatgggccgtcgctgcggtttgtgcaattatcgttatcatttctatactcttggaaaaaattatacacaaattcgcaaagatgtttgaagagagaaagcagcatgcattgctagaagctcttgaaaagattaaagccgagcttatggttttgggatttatttctttgctcttaacatttggccaaaattacatttctaaaatgtgtattccctccaagtatgcgaaaacaatgctcccctgtgtcccccctgaagaacgtcatggagctggacatcacacagaggaggcgggtggtggtgaggccaaagatggtggccatcgccgcaggcttttatcgtatgaacgtaggtttctagcatctgggggtggaggccaaagttgtaaaccggggtacacacctcttatatcagtgaccggactgcatcaactacacatttttatatttttcttggctgtcttccatgtgatatacagtgccataacaatgacgcttggaagagcaaagattcgtggatggaaggcatgggaagcagaccatatcgtggatcaagatgccttgaatgatcctagaagattcagacttactcatgagacatcatttgtgagggatcacaacagtatctggactaaaacaccagtttcgttctatcttgtatgcttttttcgacaatttttcagatctgttcgtagggccgactacttgaccatgagacatggatttgtgactgttagtagttttggcaatgcaacttcagtaatatgcttgcactgtttgtctttatcattaactaagaggtcattagaagatgactttaaggtagttgtaggaatcagtaatttagcttcatggagtgatgttgttaagaggatggcatgctgctttctgggtgtcttttcttccactactggtgagcagatatatcttcagtgccaattgcgcgtgattctggccgttggaacaaagcttcaaggaattataactcgaatggcacttgacatatcagaaaggcatgctgtagtgcaagggatccctcttgtgcaagtctctgacaagtatttttggtttgcatggcctcagttagttctttatctcatccattatgtcctctttcagtatgagtttggttgggcatcttgcttctacgaggatgatagtctcatgattgtcagagtagctctcgggttaggagctcaagtggtttgcagttatgtgacacttccactctatgcgcttgttactcagatgggatccacgatgaagaagtcaatatttgatgagcaaacatccaaggcactgaaacagtggcataagaatgctctaaagaagaaaccatccaagggacgcaccgaaactcaaacgttaggtgcgactgggggcccaagagatcattcgccggagcagtcgccgcggcgtccatcgggagccggagatacagaaatggctgagcagagcgccaccatagtcaccgccgtggatcacgaaccctacgataaccgcgacctactaagtgggccgtga

SEQ ID NO: 102203 - DNA, 888 bp, Glycine max
  Peptide Sequence Number=SeqID_218981
atgaaaagaggcatcatgagttcgaatctgtttctgtttccaattctcttttcatttgcctttctgtcctcgcccgtcctctctgcttcggatctgatcctcgccaaggttgaccgtcgcattgatctgacttcacagattgtgcgcatcactacttcactaaaggtacagaatacgggatctgatgttgtatctgagattttgctgtcctttcctgagaaccagacaagtaacttggcatacttgaaggcagcacttggtgaagggaagggaaaagcaaaaccatcttctggtgttggtttacccgtcgaagttgtccacctgaaagatgtgccgcctgccttgacaatttattccgtatctttacctaaggggcttgggaagggagatattctgacgctggatgtcttggctgtttttacccactcattgcaaccatttccagagaaaatcaaccaggctgacatccagcttctactatttcaagaaagtgcacgctatctctccccatatgcagtcaaggtccaatcactcactgttaaattgcctgatgcaagaatagagtcctatacaaaactaggaaatgcaaaacttcagggatctgaattaaaatatggtccatatgagaatcttcctccattttcatacttgccaatagttgttcactttgagaataaccaacccttcgctgttgctaaagagttggtgcgagagatcgaaatttcccattgggggcaatatacagatcacagagcattacagtattatccatgctggtgctcagagcaaggagaattttctaggtcaccttgtttctttgattcggagttatttgatgttttgttagttgggcatgtcataatagtatgttttctgctacaggcttga

SEQ ID NO: 102204 - DNA, 814 bp, Glycine max
  Peptide Sequence Number=SeqID_218982
aagactacacgtcctcaccttgagagggctacacgccctagccatcagaggactacatgtcctcggctttagagtgctacacgccctcacctttagaggactacacgtcatccccttcagaggactacacgttctcgtcttcacagggctacacgccctcatcttaagaggactacacgtcctcgtctttagagggctacacgatctcaccttcagaggagtacacgtcctcgcctttagagggctacacgccttcaccttcagaggacaacacgtcctccccttaagagggctacacgccgtcgcattcaaagggctacacgtcctcatcttcagaggattacacgtccttgctttagaggactacacgtcgcctccttcagaggggtacacactctcgccttcactggggtacatgttctccccttcagagggctgcacgacatctcctttagaggacaacacgtcttcaccttcagagggttacatgccctcgccttcagaggactataagtccttaccttcagaggactacacgtcctcaccacaagagggctacacgccctcgcctctagagggctacatgccctcgccttcagaggactacacgtcctcaccttcagtgggctacacgccctcgccttcaaaggactacacgtcctcgccttcagaggactacacatcctccgcttctgaggtctgcacgccctcaccttcagagggctacacgatctcacctgcagaggagtacacgtcctcgccttcagagggctacacgccctcaccttcagaggacaacacgtcctccccttaa

SEQ ID NO: 102205 - DNA, 888 bp, Glycine max
  Peptide Sequence Number=SeqID_218983
atgcaggcacattttgctcccgatagcaaatttgactttcaaaaatacattaaaagatccatggaggacgactttaaagtggtcgtgggtataagcattccgttatgggtttttgcaatcgtctttatgcttgtgaacgtttacaaatggtacacgctcacttggctatcattagcaccactagtgatacttctattagtgggcaccaagcttgaacttataatcatggaaatggcccaacaaatccaagaccgagccacaattgttagaggagtccctattgtagagccaaacaacaagtatttttggtttaaccggccccagtggattatcttcttaattcattttaccttgttcgagaatgcattccaaatagcctttttcttgtggacatggtatgagtttaagatcacatcttgcttccatgaaaacttgcccctaatactgacaagggttgtccttgggatagccttacaagtcgtatgcagttacatcacattccctctctattccctagtaacacagatgggatctcacatgaagaaaacaatctttgaggagcaaactgcaaaggcacttaagaaatggcaaaaggctgcaaaggacaagagaaagttaaggaaagcaggaatagatattccttcagggactatgagtggggaaacaacaccaagccaaggcacatcacccttgcatttgcttcacaagtacaagccaagccacacagacacagatagtgttctttattctccacgatcataccaatctgacactgacttgtccgagacagagggatcttcacaccaattgaatgaaataacacaaacgcgtcaagcttcaagaaatggagaaactcataatatcgatttttcctttgtgaagccttaa

SEQ ID NO: 102206 - DNA, 585 bp, Glycine max
  Peptide Sequence Number=SeqID_218984
atgcttctattcaatatcactcgcttgctagcttctgcactctggcaaaagctttggctacaactagactcatctatcatttgtgtatgttttttcctaactgagcgtctactgttgcaaaaacttttgctagcatcctccataaacaaggtggaccactctctggtcaagatcaaaccatacaacttctctctcaatctaaatcgtcaagggaccatgcaaacatctttaaccagaaggcctctaacaattcaagctacgtatagtgatggtggaaggcccagcagtgctagtgtatttgttggtgggtttctcttgggaggattaatagttggtactcttggttgcgtgtatgcacctcagatcagcaaggccctagctggagctgacaggaaggagttaatgagaaaattgccaaagtttatatatgatgaagaaaaggctttagagaaaacccggaaagtactggctgagaagattgaacaactgaatgctgccatagatgatgtttctgctcagctaaggtcagaggaggcctcaaatggagtagctgtgaactctgatgaaattgaagctgccacatga

SEQ ID NO: 102207 - DNA, 795 bp, Glycine max
  Peptide Sequence Number=SeqID_218985
atggctggtggtgctgctactgcagaaagaagcttaaaggagacacccacatgggcagtagctgctgtttgttcagtgttcatcatcatctctgtattaattgaacacggaatccattcacttggaaagtggtttcaaaaacgacataagaaggccatgaatgaagccttggagaaaatcaaatcggaattaatgttattaggattcatatccctattaataacttttggtacaaaatacattgcaaagatatgcatccctgtgtcagctggtgacataatgcttccatgcaagaaggtggaagtgtcagattcagatgatgactcaaatgacagaaggaagctactttcttttgacgacaacgtggtggaatggcgtcgagttttagcagctgcatctgggggtgactattgctcacaaaaaggtaaagtgcctttgatctctcagtctggggtgcaccagttgcatatatttatatttgtcctcgctgtttttcacattttctacagcgtcatgaccatggttctagccagagcaaaaatgaagaaatggaaggcttgggaagcagaaacatcttccctggagtatcaatttacaaatgatcctgcaaggttcaggttagcgcatcaaacatcattcgttaggcgtcactctggttggtctaggatgccaggaattcgatggatagtggcattcttcaggcaatttttcgggtctgtcactaaggtggattacatgaccatgcggcacggatttattaacgtgggtgccaatgcttacatgtatagtatataa

SEQ ID NO: 102208 - DNA, 549 bp, Glycine max
  Peptide Sequence Number=SeqID_218986
atgaaggcccgggctcagccagcgctcgcgttccaggccgatgccggtgtcgggcaggtcgccgtcggcggggcgatgttcgtcggccagggcggcccagagcgcggtcaggtcctcatcgtcggcctcccaaccaggcttcaagcgcagccatcagccgcccgggaactccaggttgtggccgtcggccagcagcaggttgaatggggcgtaggcgccagccaccgttgccagtcggtcgatatgcacggcggcggggtcgcggccgcgcaggaacgggtcgcggacattggtgaccacggccatgcgtccaccggcaccgacgccggcccagccgccgccggagcgcaggtcgcgccccccgatgacggaggtctcatcttgccagggggccagcgccgcggtcgggcgggcgtggaactcatcacggttgccggtcatcaccagccgccagcgcgggtggtgcatccagccaagagcgagcaggcacatggcctcattgtgcacggtttgcgcagtctggcgccgcttccggcccgtcccggatga

SEQ ID NO: 102209 - DNA, 327 bp, Glycine max
  Peptide Sequence Number=SeqID_218987
atgagaagtgtcttgaaacgcgaacttttgggcaatatagacaagcagcgaaggtggcagtcacgtacactagtgctggccattttgatcacaaaccacccttgtttcagcaccttaggaaaccacccttcttacgccatcaatgcttactatcagatgcatggcagaaactactggaactgcgacttcaagtccagtgaggatcatgaacaggctttgcagcgtgccggtatcctcgccaggaatgtcatgaatcatgataattcagaaagagagaggatccaaaattttctactttccgcactgttcgtttctgtagaattttga

SEQ ID NO: 102210 - DNA, 509 bp, Glycine max
  Peptide Sequence Number=SeqID_218988
atgttgggtgttgttgtccaacctcctcctattgtccagcaacaaccaactccaatggatgatatagtctgtatcttgttttctgcatatcttattgaaattcttcagcttactattgaagtctttcttagaaagcaagaggatggcatagtgggcacaaatcttggtgttgaaggggtggatccaagaccaatgtctaaagctaatgagataattgttgttgttgctttgtttaaagaaatggatgaggacaaactgaggaaaaaggaaaaggaatatggagtgaaagaacgaaacaaagatgtgatgaaaccaaatgcaagacctccacattgtctcattctagcaaggccaactattaagcctccacttgttgtgcccattaacccaaatgtgaagatccgccatgtccgcgaacggatagtcgcgaaagccttcaacaactttcaatctgtcttcgatgatgtcacaacctacccttcgacgggagggcgacgcggggctcacgg

SEQ ID NO: 102211 - DNA, 2802 bp, Glycine max
  Peptide Sequence Number=SeqID_218989
atgaatttgttctgggttgtttgttgggtggtgtcgtgtttgggagtatcatcagtaactccttttgtggcggctgcaaatttgtcatcctcaagacccgcctttgtgcacattggagcaatcttcagcatggattctgttcttgggaaagtcgctaaaattacattggaggaagccgtcaaagatgtaaacgccgacaaaaccattctacatggaactcaacttgttctctctatgcaaaattccaatcacagtggtttcgtaggcatggttcaagctttgcggttcatggagactgatgtgattgctataatagggccacaatcttctgtgactgcccacataatatcccatgttgcaaatgaactccgggttcctttagtgtcatttgcggctacagaccccaccctttcatcgctgcagttccctttctttgtgaggacaacacagagtgatttgtaccaaatgaaggcagttgctgaaattattgattattatggttggaaggaggtgattgccatatatgtggatgatgattatgggcgaaatggcgtggccgcattggatgatgaactagcttcaaggcgttgtagaatctccttcaaagaaggaattaaatcaggaaccaaagttgaccggggtgaaattacaagtttacttgtgaaagtggcactgatgcaatctcgggtcattgttctccatgcacaaactgattctggatttatgattttcaatttggcgcgttatcttgggatgacagacaatggctatgtgtggatagtcacagactggctctcttcttttctggattcctcttctctcccttcagagacaatggatgttctccaaggagtgcttgttttgcgccagcatacacctgattcggatagaaaaagggcatttctctctaggtggaagaagttaactggtggctctttggggttacattcttatggcctctatgcttatgattctgtttggctagttgcacgggctattgatgcttttttcagtcagggtgggattgtttcgtgtaccaattacacaagtttaggtggtgataagggaggtgatcttaaccttgatgcaatgagcatttttgacaatggaactcttctgttgaagaacatattgcagagtgactttgttggattatcaggtcaaatgaaatttgaaccagaccggtctcttgttcatcctgcctatgacgtccttaatgtggttggaaatggccttaggagggttggttactggtccaactattctggtctgtcaattgtatctcctgagatattctatgcaaagccacctaatagatcaagtgcaaatcagaagctatacagtgtgatatggcctggagaaacattatctaaacctcgtgggtgggtcttcccaaacaatggtagacaattgagaattggtgtgcctatccgagtcagttaccgtgaatttgtggcaccggtgcagggaacagagatgtttaaaggtttctgtgttgatgtattcacagcagcagtaaacttgttgccttatgctgttccttaccgtttcgtcccatttggagacggccacaaaaatccaagctacacacaacttgtcaacttaatcacaactggttactttgatggcgccattggtgacattgctattgtcacaaaccggacaaggattgtagattttacacagccatatgctgcgtctggacttgttgtggtggcccctttcaagaaaatcaattctggtggttggtctttcttgcagccatttactcctcttatgtggattgtgactggttgtttattccttttcattgggatagttgtatggattctggaacacaggataaatgatgagttcaggggtccacctaggcagcaaattataaccatgttgtggtttagcctatcaactctgtttttttcccacagagagaataccatgagttctcttggtcggttggtgatgctcatatggttatttgtggttttgatcctcacttccagctacactgcaagtttaacatccatactcacagtgcagcagttatattctcctatcagtggaatagagagcttaaaagctagtgacgaacctatagggttcccagtgggttcatttgcagaacattacttgattcaagatttaggaatagccaaatctaggcttattccacttggatctccagaagaatatgctaaggcactccagcttggtcctaaaagaggaggagttgctgctattgttgatgaacgaccctatgtcgaaatcttcttatcaagccagtgcacattcaggattgtaggtcaggagttcaccagaagtggctggggttttgcattccctagggactctcctttggctgtagacatgtcaactgccattctacagctttctgaaactggtgatctacagcggattcatgataagtggatgacacgaagctcttgtagtttagagaatgctgaaattgattcagatcgtcttcagcttaaaagcttctggggtctctttctcatttgcgggatagcttgctttattgctcttgttttgcattttatgcagcttatgttccagttatggcaatctcctccttctgaacctgcttctagtgctagctcaatttctggtcgttttcaaagatttcttacactcattgatgagaaggaagatccatctaagagtaaaggaagaaagaggaatggagatgaaagatcgcttgaagatcaactgggaaggcagccaaagaggaagatggagatgcaaacaaaatggggagcgacttatcaaaagtgggatgaatga

SEQ ID NO: 102212 - DNA, 888 bp, Glycine max
  Peptide Sequence Number=SeqID_218990
ggaacgggagtgtttgtggatggccctggggctggcaaacacatccaagcaggtgctaagaaggttatcatcactgctccagcaaagggtgctgatattccaacttatgttgtcggagtaaatgaaggggactacactcatgagatctctaacattataagcaacgcttcctgcaccacaaactgtcttgctccctttgtgaagatcctggatgcagagtttggaattgtgaagggaaccatgacaaccacgcattcctacactggagaccagaggcttttggatgcttcacaccgtgacttgagaagagccagggctgcagcacttaacattgtcccaaccagcacaggagctgccaaggccgtgtctctagtgttgccacagctgaagggcaagctcaatggaatagcgctccgtgtgcctacacccaatgtttcagttgttgaccttgttgtgaatgttgagaagaagggtcttactgctgaagatgtgaatgcagcattcagaaaggcagctgaggggccgctcaaaggtgtattggacgtgtgtgatgttccacttgtgtctatcgacttccgctgctctgatgtttcctctactattgactcctccttgactatggtcatgggagatgatatggttaaagtggttgcttggtatgacaatgaatggggttacagtattcaattggttgaattgaagctacttgttataatggatcacgctattgatggttactgtgttggggattgcagccaaagagtggtcgatttggcacatctagtagcaagcaagtggccaggggcacctaaagcggggagtggagacccattggaggatttctgcgagacaaaccctgctgatgaggaatgcaaagtttatgaatag

SEQ ID NO: 102213 - DNA, 288 bp, Glycine max
  Peptide Sequence Number=SeqID_218991
atgccagccgacgtcggccaggaaaagatgacagatcgaggtctcaagaagaagcatgaccggatgactccgatcgaacatttccaaatcgacatcgtccaaccaacattgcgcaatttctttcacaaacgctggccgataatatttctttacggtaaaggtcggctaggttttttcgtgcgagctcaaccaaagttgtgtttcggccgacaccggcatgttctcgtttactctgccaggaacacattaacccacctcggcaaaacaaccattattctccgatactga

SEQ ID NO: 102214 - DNA, 540 bp, Glycine max
  Peptide Sequence Number=SeqID_218992
atggacaaaccaattccaaataagcctaagaaatgcttattatgcaaaagtgaagaacacagtcgtactaactatctatacaaacaaggaacatcaacaataaacctagctggaaactcccacaaccaccacaattgccacgaccttccttctctgaacaacctctgccatcgctgttgccccttcctccacctcacctgcatcgaaaccgtagataacttcttctccagcgatggcaacaacgaggagaaggaagaatcaatggaggaaaagctagatttgcaattcttcgtgaaagggatcgaggtgggtcaccgcaacatggcggcactgttcttcttggtgaacttcttctccgacgtgtacggatggatgatccttgtttttctcgtgacttactcgtgggtgttgggcatcattttcatttctattgtgaatgagctgttgggtaggtttagctctgtcaccattttggcttgggaaggttcaaggaggaagagagaaaagaggcaggaagagagagaccaaaaagaagggtaa

SEQ ID NO: 102215 - DNA, 171 bp, Glycine max
  Peptide Sequence Number=SeqID_218993
atgacaagagattccttattggtaacagtagcagaagataatcgtgacctcttatctacagtgctgtacggtgccgccggtagggtagtgcattcgcgtcacggaccaatgggaggtcgctttcgcacgcgcgagggtagtatcgtaattgtgagtgactggtgggggtga

SEQ ID NO: 102216 - DNA, 2397 bp, Glycine max
  Peptide Sequence Number=SeqID_218994
atgatcattgtggctaaccagctaccgttgaaggcaaagcgaaaagaggacaacaaagggtggagtttcagttggaatgaggattcattgcttttacagcttaaggatggactcccggatgacatggaggttctttatgttggttcattacgcgttgacattgatccagctgaacaggatgatgtatcacagtatttattggataaattcaaatgtgtgccgacttttttacccgctgacgttttggcaaaattttatgacggcttctgtaaacggcagttatggccactttttcattatatgttaccattttcaacagataaaagccaccgatttgatcgttctttgtgggaagcttacgtgctggcaaacaagcttttttttcagaaggtagttgaaataataaacccagaggatgattacatttggattcatgattatcatttgatggtgctgccaacttttataagaaggcgttttaacagggttaaaatgggatttttcctgcatagcccctttccatcatcagagatatacaggactcttccggtcagggaagagatactgaaagctttactaaactctgatatcatcggattccatacctttgactatgctcgtcatttcctttcctgttgcagtcgtatgttgggtctggagtatcagtcaaagaggggttatttaggattggagtattatggaaggacaatcagtattaagattatgcctgttgggattcacatgggtcgaattgagtcagttatgagaatggcagatgaggaatgcaaggtaagggagctcaaacagaaatttgaaggaaaaaccatcttgcttggtattgatgatatggacatttttaaaggcataaatttgaagattttggctatggagcagatgctcagacagcatcccaaatggcaaggaagagctgttctggtccagatagttaatcctgctagaggtaaagggatacatctggaggagatacatgctgaaatacaagaaagctgcaacaggatcaacagagtgtttgggagacctggttatgaacctattgtttttattgatagagcagttcctattgctgaaaaagttgcttattactgcattgctgagtgtgttattgtcacagctgtaagggatggaatgaacctaactccttatgagtatattgcatgtagacagggaatatctggttctgaatcatgttccaatgtcaatgaccctaagaagagtatgctagtaatatcagaatttattgggtgttctccatcacttagtggggcaatccgtgtcaatccatggaatgttgaagcaacttcagaggcaatgaatgaggccatctcaactggtgatggagagaaacagttgcggcacgagaagcattaccgttatgtcagcactcatgatgtggcttactggtcacgtagtttcttgcaagacatggagcgggcttgcacagaccttctaaggaaaagatgttggggaataggtcttagctttggatttagagttgtggcacttgaccctaattttaaaaagctctcaatcgatgctatggtttcagcttacaagagggcaaagaatagggccattttgttggactatgatggtactgtgatgccacagaactccattaataagagtccaagcaaggaggtcttgtctattttggaatcacttagtgaagaccccaaaaatgttgttttcattgttagtggacgggggaggaatagcttaagtgactggtttaattcctgtgaaaaacttggaattgctgcagaacatgggtacttcttgagatggtcccacaatcgagaatgggaaaattgtggtaagagctccgactttggatggatgcagattgctgaacctgtaatgaaactctatacagaggcgactgatggttcctctattgaaagaaaagaaagtgctttggtctggcaataccgtgatgcagaccttggttttggatctgctcaggctaaggaaatgttagatcatctagaaagtgttttggccaatgagcctgttgctgtgaagagtggccagtttattgttgaagtaaaaccccaggatgtgagcaaaggcttagtcgccgagaagatattttcgtcaatggacgggaagggcaaacaggccgactttgtgttgtgtgttggtgatgacagatcagatgaggacatgtttgagatagttagtagtgccatctcaaggaatattcttgccaccaatgcttctgtgtttgcttgcacggttggacaaaaaccaagcaaagcaaagtattatttggatgatacaactgaggtaacaagcatgttggaatctttggctgaagaatcagatgcttcaccctacatagaagaaactggagattcctctcggaggcaagtgtga

SEQ ID NO: 102217 - DNA, 216 bp, Glycine max
  Peptide Sequence Number=SeqID_218995
atgtttgttatcacattcaatacttcatcatatgcgtacaacctgccaccattgagctattattatcgttcatcattacctactcaaatgtatgacatgggttatgaggatgaggaggaagatgatgataacaacaataataaggatgatgatgatgatgatgatgataatgatcatgatcatgatggtgatattcatgatcatcaacaacaataa

SEQ ID NO: 102218 - DNA, 240 bp, Glycine max
  Peptide Sequence Number=SeqID_218996
atgaaaaaggtgggatgtgagaaagaaggtcctttggtagtgaaagaagtagtctttgtgttacacttgattggactccacataaagaatcttatgccacatggtttagggttcttaaatgtgattcttcaaggtgcaggatatccaaatctgatatctatagtcatttccaaacttcatatcatgcaatctaagattcttcaacacactatacatgagcttggcaatatttgtgcatga

SEQ ID NO: 102219 - DNA, 357 bp, Glycine max
  Peptide Sequence Number=SeqID_218997
atggggacaaatcaaacgggcaaaaggttttatcaagtcaagattaaggacctagatatcaccagcattaaggagttggggcggttgatgggacctctccaaatgcaagccttccgcaaggcatatggaaagatcttagaattgaccatagcaaagatattcatagaagccattgcatcactcacccaatactatgaccatcctttgagatgcttcacgtttggggacttccaattagtatcgaccgttgaagaatttgaggagattctaggatgtcctcttgggggaaggaaactgtatcttttctccaggtttcttccctccttgagaaaaattgcagttgtggtcagggattag

SEQ ID NO: 102220 - DNA, 774 bp, Glycine max
  Peptide Sequence Number=SeqID_218998
gatgtgcgcaaaaaggcacaggccatccagaagcagaacactgcctcccacgttctgtctcgtgggggttatgactatttggagcagaagcagaacactgcacagtcaggaaacgttgatggcgtcatcgaccctccatccccggtcagatgccacgtgaagtggaagatggcccgcacgaagaaaataggggagatgacgactgaggccccaaaggaaatcgctgagaagatcgattcctttgaggagcaggcgacacaaggatccttcgtcccccatggacgtcaggatgttctcaccgctgctattggatgtctagagcaccctggacgtgtctgtgctgctggagccggtgtcaccatcaagcaatactttggatcggctccacgaacgtcccgcagctcttcctccctgcctcctgaagaattgcagcagctgacccagcaaatcagggaccagttagaggagtccatcacagaaaaagtggcgcggcagctcatggcatccttcagccagatgcagtcccagattcagtcgcagatgcaatctcagggacttgcactgcctcccgagcctttggttggtccctccggtcctcgagtaagcacaaaggggagttgcgttgatccctcaggaaacgatcctgagacgggtgactcagataggttcggcttgtacatcaaagcagatcctgcccgcttggttgccctggggagagtttatgagggatccactattgttcataacactcctttgttgcctggccaagtaatg

SEQ ID NO: 102221 - DNA, 597 bp, Glycine max
  Peptide Sequence Number=SeqID_218999
atgcctgtgggaatggattttcctcctccgtttactatgttagaggccaaagacagtgcatttgtggtggatgatcagaaatcaggggatttgaatgatataaaaccgatgactaagggtaagcctccacgccatgcttcgactttgaggcacagcattagcaacaccagattgctggccatatcagatttgagtttggatgtgggggttactgggagcaagtcatcttctgaagaaaacacggagtttctaccaatacttcggtcaggaagctgtgctgaaagaggacctaaacaatatatggaagacgaacacatatgtatagataatcttattcagcatataggtcctgcttcaactattcctttacctggagctttttatggggtgtttgatggccatgggggtacagatgcagctttgttcataagaaataacatcctcagattcatagttgaggactcccattttccaacttgcgtgggggaggcaattacaagtgcgtttgtaaaagctgattatgcatttgcagattctagttcgcttgatatctcatctggcaccactgctttaactgctcttgtattcggaaggtaa

SEQ ID NO: 102222 - DNA, 600 bp, Glycine max
  Peptide Sequence Number=SeqID_219000
atgatggaagccatgatgagtgtgagaaggatgatagaggtcaatgcggctatagttgttgccacaagtactgccatagaattggacccgactcacccacctggcttcaatcaagtaaatcatctagcctcggatatggtcttcagcaagcattccttcccaccatatggcttgcctcccaactatacaccacccaatgttgcacacactcccaatgagactgtcgacaactctactcccatacccattgagagccaacatccccaatctggtcagtatcgccaaaaaccacaacccttgcattttgtggtaggaattgctaaggtggaaagggagagatttgatcatatagaggagaggttgagggctattgaaggaggcagagattatgcctttgctaacatggcagaactgtgcctagtgcccaacgtcgttatccctctaatgttaaaggtgctggattttgataaatacaaggagactacttgtcccaagaatcacctaaagatgtacaataggaaaatgggggcatactcgaaaaatgaaaaattgttgatgcatttcttccaggaaagtcttactaaggcagtcgtcacctag

SEQ ID NO: 102223 - DNA, 339 bp, Glycine max
  Peptide Sequence Number=SeqID_219001
atgaaggagatgcccctgcaggtgaacggaggaggagatggacaagtgcgggatgcaccttcttgcattaccgcacgtgtagaggtaacgatgagtcccacgtcctgcacgtgtcctcccgctatgccgacactcacctcgccacgctcctcaaacaccaagaacaaggcacccacccctccaacggccactgaacctgttcgtcgatgcgggcgacaaccgccaccactttccgaggctcgatatggtcagatcgccttctctctctgcagatccatacactgtttctctctcttcgtgttccttctggccattggggtaagaaagtttcaaagatga

SEQ ID NO: 102224 - DNA, 522 bp, Glycine max
  Peptide Sequence Number=SeqID_219002
atggtgatgagaggattcctgtgtatctgtttcatgagttttaggactgtattgtggatcatgaaagactacaaagcgcagtcatcttggacctggaccaagtcattcgtcatgtctactagttattttcctgttcgctatccctttttccccgatatgcttcacaaaaaatgtgtgacagaagacaagacagcaaaagacataattcaaactcaaggatttgtgcttggaaatgctttagatacttcagggaccttaggaatctcaggcatattagacagctcaagttttgacaattcggggaccttaggcagctcagctcaggaacttttggtggaggtggcagctcaggtttgggaagttagggcacttctagctttgacaacgtcaattctagaagattgtgtgctccaacagctattgtgtgactgcttgcagacaataatgttagagccacaaatgaaaaaaacactgtcgacaaactatgttgtatgtgggacttttatagacaaaactgtctaa

SEQ ID NO: 102225 - DNA, 2439 bp, Glycine max
  Peptide Sequence Number=SeqID_219003
atggctgcgagctgggatggaagtagtgaccctggcagtcagtcagatgatagctttcttgagaggttgcacattgagcctctttatgatgcctttgtatgtccgctgacgaagcaagttatgcgtgatcctgttactttagaaaatgggcagacttttgaacgtgaagcaattgaaaaatggttcaaggaatgtagagagagcgggcggagactgctatgccctttgactcttcaagaactaagaagtacagagctgaatccaagtatggctttgcgtaacaccattgaagaatggactgccaggaatgaagctgcacagctggatatggctcgccggtcattgaatatggggagtccagaaaatgagactcttcaggccttaaagtatgtccagcacatctgccgaagaagtcgatcaaacaaatacactgtccgcaatgcagggcttatcccaatgattgttgacatgctgaagagtagcagccgtaaggttcgttgtagagctctggaaacccttagagttgtggtagaggaagatgatgagaataaggaattgttggctgaaggggatactgttcgcactgtagtaaaattcctttcacatgagctttctaaagaaagagaggaggctgtctccttgctttacgagctctcaaaatctgcaaccctttgtgagaagattggttctatcaatggtgccattcttatactagtagggatgacaagcagcaaatcagaagatcttctcactgttgagaaggcagataaaacattggagaatctggagaagtgtgagagtaatgtgcggcagatggccgaaaatggtagattgcagcctcttctgacccagcttcttgaaggtccaccagaaaccaaactctccatggctacataccttggtgagctggttttaaacaatgatgttaaagtccttgttgctggaactgtgggttcatctctgatcaatataatgaaaagtggtaatatgcaatcaagagaagcagcactgagggcactaaatcagatatcatcatgtgacccaagtgcaaaaattttaatagaggctggaatactttctcctcttgtcaatgacctttttgcagtcggtcctaatcagcttccaacacgattaaaagagatctccgctacaattcttgctagtgttgtaaactcaggagaagacttttattccattccatttgggcctgaccaccaaactctggtctcagaggatatagttcgtaatctactccatcttataagtaacactggtccagcaatagagtgcaaacttctccaagttcttgttggacttactatttctccaactacagttctgagtgttgtggctgctatcaaaagctctggtgccaccatcagtctagttcagttcattgaggcaccacagaaagatctgcgtgtagcttccataaaacttcttcagaatttgtctcctcatatgggtcaggaactagctgatgcactacgcggctcagttggacagcttggtagtctaattaaagtcatatcagaaaatacaggaatcactgaagagcaggcagcggccgttggccttttagcggatcttcctgaacgggacttgggcctcacaagacagctactagatgaaggtgcctttgtgatggtcatatccagggtgattgccatcaggcagggagagatccgaggcactcgcttcatgacaccatttcttgaggggcttgtaaagattgttgcaagggttacatatgtcttggcagaagagcctgatgccattgctctctgccgtgatcacaatcttgccgctctctttattgatctgcttcagtccaatggacttgataacgtacagatggtttctgctacagctctggagaatttatcccaagaatcgaaaaacttaaccagactacctgaaatgccatcgctgggtttttgtgcttcagtgttttcatgcttcagcaagcagccagtcataactggattgtgtaggctccaccgagggatatgttctttaaaagaaacattctgtctctatgaagggcaggcagtgcttaagttagtaggtctactggaccacacaaatgtgattgtggtcgaggcagcacttgcagccttagctactttaatagatgatggagtagatattgagcaaggagtggcaattttgtgtgaagcagagggagtgaagcctatactggatgtgctacttgagaaaagaacagaaacattgaggaggagggcagtttgggcagtggagagactattgagaacagatgatatagcctatgaagtttctggggaccaaaatgtgagtactgcacttgtggatgctttccagcatggtgactatcgaactcggcagacagctgagcgtgccctcaagcatgttgataagattccaaacttctcaggaatctttccaaacatgggatga

SEQ ID NO: 102226 - DNA, 636 bp, Glycine max
  Peptide Sequence Number=SeqID_219004
atggtggcaatatctgtgctaatactaagatatatcccaccagatgaggttctattgctcccttccctccaagaaccaattgtttcagcgtcaacacaatatagttggtgcagcttggaagcaaatgaagaagatgcaaagacacatgttggtgcttctgggagcaagaagcctacagtttttaaagaggatgtaccaattgattgtcctcttattgctaaagatcctgtcataggcaaatatgtacatgagggtaacaggagaaaacattttatgtttggcattaccagttctgttcgttttgcattatgtggagttggtggctgtcttcttctgtctggttttgtcttcctaacctgtatggatcaagatgatgcaaggcacaactttgggcactctggaggttttacttgcccatttgtgcctctgcttcccgtagcttgcattcttatcaattcctatttacttgttaatcttggggctgctacttgggcacgtgtttctatatggctggctataggagttattgtttatgtattttatggccgaacccatagcactctgaaagatgcagtttgtgtgccagcaactcaagttgttgatatctatcacacatccacaagctgtcttgcttaa

SEQ ID NO: 102227 - DNA, 474 bp, Glycine max
  Peptide Sequence Number=SeqID_219005
atggagggtgttgcaatgcattggttctacatttggaaccaaaagaacccaaattcagattgggattcattttccatagccttgatcaaaagatttagagatcgctatggtaaccacttctttgaaagattgagtatcttgaagcaagataaaactgagacaaaaacttgcattgaagaaagggagacttccatagtgttcttgaaagagaggaccaacaatgaggaggtgttccggaaggaggaacccaaatcttgtgggttgcaccatcattcttgcaaagttagcattttagagttgaagcatgggctactaaaaagttcagaaaaaattcttaaggttaaaagggaggaaagcgtggaggcacaatcctttgaaatcaagatcaagaaaatcattgagggaattaaagagatcaaacaaatgttacaattgttgatcaagaaaaagggcatcaatgttgagtccaaataa

SEQ ID NO: 102228 - DNA, 291 bp, Glycine max
  Peptide Sequence Number=SeqID_219006
atgggcgaggtatctgaaagtaccatgacgaagaggaagaagaagggacgcccctctcttttggatcttcaaaagcgatctctcaaaaaagaacagcaaaatcaccaccagcagcgacacaattcaaccaacgttgttccccacgacgacgacgaggacgagcgcaaggagaagaagcacaagctcttggttggtctcaattcccatctccaccacccaacattattgcccaattcccaacccttcaattccgatcccaagaggcgcaagattattgaccctctccaaacg

SEQ ID NO: 102229 - DNA, 861 bp, Glycine max
  Peptide Sequence Number=SeqID_219007
atggaagcagagacctcaaacggtggtggtattggaggcctttacgtcaaagttatgaccgacgaccaaatggaactgctcaggcaacagatttctgtctacgccaccatctgtgaacagctcgttgagatgcacaaggccgtcactacccaacaggacctcgcagggctgaggctgggtaatttgtactgtgatccgttgatggcatgctctggacacaagataactgcgaggcagcgctggactccaacgcctctgcagcttcaaatacttgagcgtatttttgatgagggaaatggcactccgagcaagcagaagatcaaagacataaccattgagctgggccagcatggccaaatatcagagacaaatgtttataactggttccagaatagaagagctcgttcaaagcggaagcaactcactcctgcacccaatgttgtggagccagaagttgagtctccaaaagagaaaaagactcgtgcagaaggctttcaggttcaaccctatgagaattcatcacctcataggatcaaggatatgtacatccagagtcctgacatagataaggaactaaaaaggtgctttgcagtgctaactgttgacaaccgttactgtgtgacatgttacaattttacaagtttaaacattatttcttctcctaattactctaaacaatttaaggaacatctccctacctggagggatctgataaacagcaacacggctacactttgtagcaaattattccagaaaaatagaaaagaaagcaccttcctaaaactagctgttgaatgtacagaaaaaaggttaaaccgttcatccaaaagttctgcatatcgacatgagattgaagcttaa

SEQ ID NO: 102230 - DNA, 414 bp, Glycine max
  Peptide Sequence Number=SeqID_219008
ggcgcgtcccattcgccattcaggctgcgcaactgttgggaagggcgatcggtgcgggcctcttcgctattacgccagctggcgaaagggggatgtgctgcaaggcgattaagttgggagcccgtgagccacatcagccacaggtgatctccacgtggctcacctttctgatccttcagagagcacacactagaaaatgcctcctcagagcactgagaagggcaaagcccccaggcttcaacattctgggacattccgggagctctgtggaaggagaagaactgaagccagccttagtcgggaaacctgtcgtgccagctgcattaatgaatcggccaacgcgcggggagaggcggtttgcgtattgggcgctagcggagtgtatactggcttactatgttggcactgatgagg

SEQ ID NO: 102231 - DNA, 339 bp, Glycine max
  Peptide Sequence Number=SeqID_219009
gatgtgaaggttccgaaagcgactgacagtaaacaacatggttcgcagggagagtccggtcccactacgcctttgccagacaaaaagctcttgctgtttatccttgacaggcttcaaaattggctatttgatgttctgtactgctcacaaccttcttgcagaaaggacacacatggggtgttctctgagccagtggatccagaagagcttcctgattatcttgacatcattaaacacccgatggattttggaactgtcaggaagaaattggatggggggctatatactgacttggaacattttgaggttggcgctgcaattttcagagcagctttctag

SEQ ID NO: 102232 - DNA, 315 bp, Glycine max
  Peptide Sequence Number=SeqID_219010
atgacgaggatgacccgtgattttggggatactatgcaaaaagatgcagtgccggcggtgtcggctgatataatatttgcttctcttcggtttcctaattacaaaatcggagttaacaatcagatcatggagacaaaggatagtccaaaagtgctatctatgaaggaggttgttgcgcgagagactgcacagctgttggaccagcagaaacgtctgtcggttcatgatcttgccagtaaatttgagaagggtttggcagctgcaggggagggaagagcaacagtgaaagggaaaatgggtttacttcatttttga

SEQ ID NO: 102233 - DNA, 990 bp, Glycine max
  Peptide Sequence Number=SeqID_219011
atgagttgcttttcgtgctttgtttctcgccggaaagatgtgagaagggttgaaattgacaatggctctcgatctgctaccgctactgctacttcttcttctgagagtgaaaggaagagggaatcctcagaggggaaggggaagaagagtgtgagtagtagcagtaacaaaggaagtacggcagcggcaagtttcggttttcgcgaactggcagaggcaacgaggggtttcaaggaagtgaacttactcggggaaggtggttttggaagggtttacaagggtcgtcttgcaacgggagagtatgttgccgtgaaacaattgagtcatgatggtcggcaaggttttcaggagtttgtgacggaggttcttatgttgagcctgctgcacaattctaatcttgtcaagttaattggctactgcactgatggagatcaaaggcttttggtttatgagtacatgcccatgggttcacttgaagaccatctatttgatcctcacccagacaaagaaccactaagttggagtactcgaatgaagattgctgttggagctgctcgtggccttgaatatctccattgtaaagcagatccacctgttatctacagggacttgaaatctgcaaacatcttgttagataatgaattcaacccaaaactgtcagattttgggcttgctaaacttggacctgttggagacaatacccatgtttcaaccagagtgatgggaacatatggttactgtgcgccagagtatgccatgagcggcaaattaactcttaaatctgatatatatagctttggtgtggttttgttggagttgatcactggacgtagggcaatagatactaatagaagaccaggagagcaaaacttggtttcatgggcaatggctataactgctatgtgtatccaggagcaaccgaaattccgtccacttattggtgatattgttgttgcactggaatacctagcttctcatagtaatccctga

SEQ ID NO: 102234 - DNA, 975 bp, Glycine max
  Peptide Sequence Number=SeqID_219012
atgggaaactgtttcagaaagacagcagctgatgacaacaagattcacaagaatgagtataagactcccaccaccaataatccacgcccttctcccccagagagattggtgaaggaaacagtggaagaaagaggtgagcgtccacaaaacaacagcgttccaaagcttataaagtacacgttggatgagttgagaagtgcgaccagaaacttcagaccagacacggtcctaggcgagggtggttttggacgtgttttcaaagggtggattgataagaacaccttcaagccctcaagagttggtgttggaatccccgtggctgtgaagaagtctaaccccgatagcctccagggtctagaagaatggcagagtgaagtgcaacttttggggaaattctctcatccaaacctggttaaactaattggctattgctgggaggaaagtcaattcctgctcgtatacgaatacatgcaaaagggcagcctcgaaagccacctctttagaagaggcccaaaaccactttcatgggatataagactcaagatagccataggagctgccagaggtctagctttcttgcatacatcggaaaagtctgtcatctatagagacttcaagtcttccaacattttgcttgatggggattttaatgcaaaactatcggactttggattggcaaagtttggccctgtcaacggaaaatcccacgtaaccacgcggatcatgggcacgtatggttacgcggcccctgaatacatggccacagaaatgctaacaggtagagcagctctagacacaaatcagccaacgggtatgcagaatttggtagagtgcactatgtcatctctacatgccaaaaagagactgaaagagccaaagaaacgaccgtctatggaggaggttttggaaaccttagaaaaagttgaagccataaaatacaaacccaatgtgaagaaaagaagtgcggttcgttag

SEQ ID NO: 102235 - DNA, 317 bp, Glycine max
  Peptide Sequence Number=SeqID_219013
caaacagaccaatggcttacacccacattccggtgaaagttgaaaatcctgacctcgcaccctacacttcagagccctacaatgctcaatggaacgccccggggcttctccgtgacaagcacacgttgcgttcgagtcgtattctcggagaaatggaggttgatgaacctcggctagggtggtcttcgtcattggaagtgcgtaatgacattgttgggtttggtgggaaacttggccgtataggaatgacagtcacagcatgggtttctccctcatcctcaccctctttatttgccccagttttctcattcgtctaa

SEQ ID NO: 102236 - DNA, 129 bp, Glycine max
  Peptide Sequence Number=SeqID_219014
atggagaatgatgagctaaggagtgaggactcggaggaggaagagtctcactcaacagcaagtacacatgacaacacactttgcatgctaatatgcccggtgcccgttaacagtcatataagcagttaa

SEQ ID NO: 102237 - DNA, 687 bp, Glycine max
  Peptide Sequence Number=SeqID_219015
atgaagctttatgagtttgtagtgatatttggatacttcatgctgattttggctcaaatgccacatattaatctggtgtctttggtcatgtgcttatcctacagtgcctgtgctactgcagcttccatatatattggaaaatcatcaaatgggccagaaaagtattactctttaataggtgacacaacaaatcgcttatttggaatctttaatgccattcccatcgttgccaacacttatggttgtggaatagttccagaaattcaggcaacgttagcacccccggtagaagggaaaatgctcaaaggactatgtgtttgttatgttgtagttgcattgagtttctttagcgtagctatctctggctattgggcatttggatatcaagctgcaggcctcatttttagcaactttgtagattattacagcaagcctttggctcccaagtggcttatttatttgcccaacatttgcacaatagctcaattattagctaatggtgtgaatcaagctcaaaatctcgtgcaaaaccctaaccatgcgcttatccatcaaatcactattaggatcaatcttcatggaaaccacgaaaggagaaacataaggaagcttctgaaactcctccatccacatcctcacttttgtttgtgcgcagtagcccctcggaaacctcatcggaaaagctaa

SEQ ID NO: 102238 - DNA, 411 bp, Glycine max
  Peptide Sequence Number=SeqID_219016
atggttctatctaatagcacttcctttatagaaaaaaccgttatgaatctacctagagttggttgcaaaaattgtgccaatgtagcctgtgatgtgtttggaatagaagaagaatttggaagagccagagtgtacagccaatgcgggaagcctgaattagttcaacaggctattgatagttgccctgtggactgcattcattggacatcagctgcacagctatcattgcttgaagatgaaatgcgccgcgtagaaagagtcaatgttgccctaatgctttctggaatgggatcagcaggaactgatgttttcagaatgtatttatgtgtcgtctcctctaacatgatccaaccaactaataatgacaggcaagttcccgatgggaaaagaggcaggcaaaagtcttggtaa

SEQ ID NO: 102239 - DNA, 288 bp, Glycine max
  Peptide Sequence Number=SeqID_219017
atgccgataagagtggctacatggggagttgctacgtgcacccaacaatattgtcggggcacccagcaaacagtgaatgagccattttgcccttctacgaagcctgtatctggaagaccctcttttctgaaaaatttcggaagacgtaactccaaaaaactcccggaagaccttcttccggaagaagaagttgggcttccagaaggacgtgttccggactttttccggaagaagggtcttccaggaagaccaccttcttcttccggaagaagattctttcggaagtaa

SEQ ID NO: 102240 - DNA, 877 bp, Glycine max
  Peptide Sequence Number=SeqID_219018
atggctgcagaacatgttctgaggttgctagattcattctggtttgaggcttcaattctctccagcaaaatccctccaacaaatcctatctctcataatcacaaggtggtggaggaagtgcttcctcttgatgatgcaaagcttctactagttccaactccaacccttgaagttaggtcctatagtgaccaaaacttggactccacaacatgtgttttgtgtgattattccccatcaccaaattctgtgctcaccccacaaaggcttaggacaatcccttctgagagggaaatcagagaattctctagtggaaatcatggaaaagaaggtatgagcaataagagaaaacaaaaaggctttggtcatggaagaaggcctaggcaagtgagaaccagcaggagcctctcagagcttgagtttaaggagctaaaagggtttatggatttggggtttgtgttctctgaggaggacaaggactcaaaattggcatctttgatacctggcttgcaaagactgggaagagaagatgatgaagtgcagtgtgatgatcaaagtgtggtttctgacaataataagccttatttgtctgaggcttgggatgtgttggaccaaagggagttgagaaatcctttgctgaattggagggtaccagctaggggtaatgagattgacatgaaagacaaccttaggttctgggctcacactgttgcatccatttcaaagattcttatatcttcacatgctgacgaggacagcctcctggccgtcatagaggtgacaaaagttgcgaatgagcttgaccttgtagagggagtccacggcgatctccatgtgccgcatcagggccatatcatggaagaagagctccaaggagaag

SEQ ID NO: 102241 - DNA, 2970 bp, Glycine max
  Peptide Sequence Number=SeqID_219019
atgagagagagagagggtgagagagagaatgagagcgagtggacaacagtggtcagaaggaaaggtaaacagagggaaggggagagactgagagtggatcccaaaacgaactacaacaaccacaagcttggtcaatttcagaggtatcaccaccacaactggagggataaggatgacatcacaacgttttacttcacaagcttccacgaacacataaccgaagaggatctctgggctcagtttaagaaatggggggacatgagggagatttttatcaacaaacacaggaacaaaggaggtagaaggtttggttttgccagattcaaaggggtattggacaaatacagactagaaaaacagcttgacaacatcttagatggactcaagatgtatgttaatgttccaaaatacgggagaggaaaggggagggtcaaggagggtacctctaaacctggtatcctgaaggaaggccatagcagggaagtcgaggttgtgcgacacagagcaggacagtatcggaatccgcagaagtcatatgccaaggtggtctccactattcaaacggacgctggtaagatgaagcaccccaaactcccacaacagagatacgttgaatcccactcctcaatacaccttcaagtggcagtgggggaaaagaaatggttcacagatgcatgggtgggcaggcttaagaaattgcgggctctggaaaggatagaggatgacataccttgggagttagctgtgaacgttgtgccgaaatatctcggcgacgacttggtgctccttcttgggctggcggacgacaaagcagagcacatcatcgccgaagagactcagaatggcacatccccattccactcactggaaaggtggaacccgacgctgagaccgggtcatagacttgacttagggaacattcacaaaattgcggcggccattggaaagcttgttgaggttgacgacgatgttgaagagatgaggaggatggatagggctagaatcctcatcaggaccccatggaaaccgttctttcatcacgcggtttcagtcaccataggcgaggagcttcatcaagtggttattgtcgaggagggggcgagtaacgatgggtggcatttttcctcgggtcgaagaccgtcatactcatcggaagagcttgattccgatgatatcgacggagagtcagtgatatccccacactcgtcctggtacgacctccgacgtcaaccaaacaacccatacgatgacccagaagcagtcgtagacaatgatggcggtccccacataggcaccggcatacctatcggaagagcaacaaacccaccggaagcgaaccactccgtcgactctggcggcaaccctctgaaggcggctcatgtgcagttgacctcacgtcggaggaggcccgacggagacaccgaccctgtcgctaccaacaatccgaggccccctttatccaaaggatctacagtgactgaaaacccagtggataatgaccagggaagctgggaagacaaaggcaagggaccagagacagcaatcaagaatggggaaacaaacgcagatgaggcacaaaaaaggaaactgcagggggaaattgaatcaatgacagagacaactgttcatcctgaagctactataaaggaaatagttgttgaggaactgccacctccaattgaaacattgggctctcctcaacatattcgacccagcccaattcttcaagttacggaccatcaattgctaacaccaccacctataatccaaaacttaccaaacgttgaggatgggccaaacaatggggtaggcctccctcaatacactaccacaaatagctctaatcaaaataatgttggcccaatgtatccatcagctgaggggaataagcagtggaagattgaagagccactaacccaatgggagctagcaaaactcatgggggtgtctacagattctgagcagacaacaatcatccataaaattattgacatggagaccagagacaagaaagaggctgaggatttggggcttgggagaggagtcaaatgggcttttgttcggaggcttgttagaaaacacaaagtggacatcttgtgcattcaagaaacaaagaaagagcaaattgataaacctacatgtcaagccttatggggagacatggatgttgtttgggaattccaacctgcagtaaatacagcaggaggattattgtgtatatggaacgaacaagttttcaaagtggaaagaagagtaaaaggaacaggatatattcttttggaaggggtctggacacacgaaaatcagaggatattcatagtcaatatatattccccctgtgacagccaaaacaaaagagaactatgggaatcacttatgcaactgagacaacagatccctgaaggaatgtggtgcctcttgggagatttcaacagcattagacatccctctgaaagacaaggtgtgtctcataggggagtggaagcagctaccattaatgagtttaatgaatggatatctgaaatggagcttactgaaattcctagtgtggggaggcaattcacttggttcaaaccaaatggggtttcgaagagtaaaatagacagatttcttgcatcccatgagtggctcctaaaatggccagattgcaacacttttgtcttggacaggaacttttctgaccactgccccattctccttaatgccaccaacactgattgggggccaaaaccttttaagaagattaaaaacctcaaggagacactgaagttgtggaacaagatgcactacggagacacactcaacaaagtacataagattgaggcagagttaaacagcttggaagacacaagttctactagacagctgagtactcaagagttggagacccacaagaaattgcaggaggaattatgggcagcagcacattcccacgagtccttgatgagacaaaaggcaagagtgagatga

SEQ ID NO: 102242 - DNA, 1170 bp, Glycine max
  Peptide Sequence Number=SeqID_219020
atggctaatggctcatgggtagatgatcctagaagagtgaaagaggaaatctacacattttttgagaacagattcgttgaacctaaacaacacaggccaatcttagatggaactagattctttgggatagatcagcagcaaaatgacatgttggtggcaagcttcacagaggaagaaataagagcggctgtttggaactgcggaagtgaaaaaagcccgagaccggatggtctaaatttcaaatttattaaacagttttgggagttgttaaagcccgaattcagccggttcattgctgaatttcatgccaatggggtatttccgaggggcaccaatgcatctttcattgctttgatcccaaaggtgaaggatacacttcatcttaatgaatacagacctatctcattaataggctgtatttacaagattgtggctaaacttttagcacatagattgaagaaggtgttgccaaacataattgatgagaggcaattagcttttatcactggaagacagctgctgcacagcgttctgattgccaacgaggcggtggaggaagcaaaaaggcggaacaagccatgcctcgtgtttaaagtggactacgaaaaagcttatgactcggtctcgtggaacttcttatcatatatgatgaagaggctaggattctgccttaagtggattagattgatagagggctgtctcaaatcagcctccatgtctgtccttgtcaacggcagccccacaaatgaattttatccccatagaggccttagacaaggcgaccctctagcgcctttactattcaacgttgtggcggaaggcctaaccggactaatgagagaagcattggacaagagcctctacagcaatttcatggtgggaaaaaacaagatactagtcaacatattacaatatgctgacgacaccattttccttggtgaagccacaatgcagaatgtgaagacaataaaatccatgttgagagtttttgaacttgcgtccgatttaaagataaattttgcaaagagcagttttggggtaataggtaaacctgatcattggcaaaaggaagcggctgaatacctcaattgcagaaatttgaccttgccattcttatacttgggtatccccattggggataatccaagacgtaggttccctcaaaagtaa

SEQ ID NO: 102243 - DNA, 1049 bp, Glycine max
  Peptide Sequence Number=SeqID_219021
gggctgaaggggttatcatggtggctgagggcaataatttcttggtgaaaagaaagaacaaacagaagccaagtcaaaccaggtcagcacctcagcagcagaggaaggagggagacacaaacgtgaaccatattacgaccacaagttctaggagatcaatctccccaataacgttcaccgatgtcgacttcacgggagtcgatcctgagcaagacgacccaatcgtgattacggttggaatcatcaattgggatgttagaaaagttttgatagacgaaggaagctcgattgggggacaagtccacacccacggtgttgtagagttggaaaccacctttggaattggagatttgtcaagaacaacatcgttgaaagccctaggcgtgattgtctcaatgccgcatctcacgatgaagttccccaaccctaatggcggcatactcacggtcaaggcagatcaaatggaagctcgagaatgttatgccaaaagcctacttatcaagccatacatactcacctccacgaagctcgccaaagtagtagatgttaacaatgtggaaggagctttgccgagctgggccaattttgacccaaggagagatgaagaagacaggaggccaacaccaatagaggatgccgctgacatgctcgacatagatcttaatttcatatgccacaaatttttcattttctctaaagcaaaactcgtagcacaaagacaaggaaagctcgacgaagaaaggagacaggttatgaagaaagaatccgagaaactactcaaggttggcttcatcagagaagtcaaatactcaacgtggttgtcaaacgttgcaatggtcaagaagcccaacagaaagtggagagtgtggatcaaaatgtacccaccggacgaaagcaaggcaacattcatcatggaagatgcaaaattatactacaaagtcatgccatttggtttaaagaacgttggtactacatacccgagattaatcgacaaggtcttcaaagatctattggggaaaaatattgaagtttacgttgacgatatggtg

SEQ ID NO: 102244 - DNA, 486 bp, Glycine max
  Peptide Sequence Number=SeqID_219022
atggcatcatcggtgattatcgacgaagaaaacttcgaagctccggaagaggatgaagaagtccaagctctaaaaacagaactaggaaaagcaagacttgccaaagaaaaattcaagttggtcactatagacgttcaaaaaacgtgtgccgggttacgagaagaaaatgaaactaccgcgagagcccttgaacaagaaaccaagagggctcgcaaggaagagcatggccgagacaaatttcgtggagctttatggggcagcaacagtgagctcgagcttcgaagggaagagagagaccaatcaaggtccaaaagaaacttgtctcagcgcttatgcgagacagagaccaacatgttagccatcattagcaagtaccaagaagaactaaatctagccacggctcacaagcataaagtgacggacgagtatgcccaagtgtacgtggaaaaggaggctagaggaagggtgatcggctcgttacattaa

SEQ ID NO: 102245 - DNA, 285 bp, Glycine max
  Peptide Sequence Number=SeqID_219023
atggccacaatgatggaggccatgatgagcatgaagaagataatggaggtaaatgtggctgcagttgccgctaccagtgccgttgctggggtggacccgattcccccatctggccttaaccaaataattcatccaacctcagatatggtaggtcaaggaggcaaagaatttggaagtacgggtgccccccattatgtgcgaattcaaaacaagcacgccttcctgccatatggcttgcctttcaactacacaccacccaatgtggtgcacactcccaatgagaat

SEQ ID NO: 102246 - DNA, 213 bp, Glycine max
  Peptide Sequence Number=SeqID_219024
atgaacgccaagttggaagattccgcttcggttgaagagttcctctcggtgtgggtctcaacggagaacaatgacggtttgtggtggctaatggtggttgtgggtgatggagaaaaagcttgggtcgttggaaatgactttggaagaaagaaaggagaagaaatggcgtttttcctaagctacacgaaagctaaggctgaaatgcttaaataa

SEQ ID NO: 102247 - DNA, 339 bp, Glycine max
  Peptide Sequence Number=SeqID_219025
atggggatcgcacccacaaagacacccagtggacctgaagaagtccaacagggccctggggtttccagctctgggaatgcttgtcgcccccagcaaggtcatcaggtcccccctaccaatcgagctttcatcaagaagttctgcgtctccaggcaggcgcagggcgaaacaccacagcagcctggcgatggccggcagcgggcaacagacgcaccgccatcacctctagagttcacctctgctcatccacaaaaaggtttgagtattgcctacaccacatggccgaccaataggcgaccaagtccaaagccaaaggtaagcaaagtactaggtcagtga

SEQ ID NO: 102248 - DNA, 519 bp, Glycine max
  Peptide Sequence Number=SeqID_219026
atgggaaagttggatcatctagaggaaaggctcagggccattgaaggaggtgaagattatgcctttgctaacctagaagagttattcctaatacccaatatcatcacccctcccaagttcaaggtgctggactttaacaagtacaaggggactacttgccccaagaaccatctaaagatgtattgtcggaagatgggggcatacgcaaaaaatgaggaattgctgatacattccttccaagaaagtcttactggggtagctgttacctggtacactaacttggaactttcccgagtccattcttggaaggacctaatggttgccttcattaggcagtatcagtacaattttgatatggctccggataggatgcaacaacataacatgtgcaaaaaaggggcacagatctttcaaagaatacgcctaaaggtggagagacctggcagctcaagtggcatctcaatgacggagaaaaaaaatgataatgatagtagacacattaccagtattctactatga

SEQ ID NO: 102249 - DNA, 342 bp, Glycine max
  Peptide Sequence Number=SeqID_219027
atggtgaaattctttgattccatagtcaacagtacaagagtggtaagcaaagcatcatcagcattagtggttgttttgtcagttattgcttcaaatgtgatgaaagatgatcctttggttgctgagaaaatgaatcagcaagaaaattgggattttgatttttggattggttcttttattctgaatttcacggctctaaacacatactttctcatagtcttgtgttggaggagccaagctatggttgttttcatgctccttagtgcaacagggccaccgatcaaaagaagagctggtttgagaattaaacaagcagggagaggttcatacagaggaagctag

SEQ ID NO: 102250 - DNA, 1924 bp, Glycine max
  Peptide Sequence Number=SeqID_219028
gaatttgacctgggaaaatggttaccagaaaagagatgaggttgaggaaagtatgtggggtgacctcagtttgaaatccccagatgagttgtattcttcaaacggtgaaaatgctgattattcggctcgattactcatgattgaaatgtctcatcacaaatacagtttgggagaaggggttgttggcaaaatagccctttccagggatcattgttgggtttcctatgaggatattctcaccggtagatttgacacagatttaatccctgagtgtcctgatgagtggcttcttcaatttgcatgtggcatcaagactattgtgctggtaccagtgcttccgctaggggttttgcaattcggttcatttgaagcggttgctgaagacaaggaatttgttaccaatatcatggacaaattccatttcactcatcatctggaagcaaatattacccctttaaacttgggaactgattgtcaagatttgtcattctcagacctaatgcataatttgatggacagtttggacgaatcatattctgttacaaaaagtatattgaaaactgaagtttcaactagtactgctgccctcaattcaaatgtttcaaggttgaacccaacaatgctttcatttattcaggatgactgttgcttttctagagaaaatctactaaaatctctgaaaatagaaaatgagataggttcctcatcatctgaaatgccaactgttccaagacatatcgataaggtggggacaaaaccaaatcatatggaagaagagatatggtcctggtctcacttgctcaacaatgttggagtatttggagagatgtcaaatggattagactctttctccgttataaatacgacacagaaacaacttggagggactgaaactgttcatgatgctaagaatgtgaatgacttcgcttttccctcagagtctgaattacacaaagcacttggatcagttggatatggagagacaggcgaatttatgtcaaaatgtatccctgttgaggaaacatacagtaactcaactcttgtaatcaacaaaaaagagcatgatcatattaaaggtttggagtttcccaaagatgttgacctggaagatcttttagatgctgttgttggcaatttatgtggtgccactgatgatacttcaagtatatccaacagtgtcaggtctcttacaaccatgccaacagagtttacaggttccgttcagcctgaaaattattcagaagaaagcactttgattgtggataactcagatgtgaaaaatgatcttatgcctgcagttatggtcaagggaaaagatcaattttctaaccattatacatcatcttttgatggaaatgcatgcttattgattgatgaggcgcggcaggaaaaggctaatagtcatatgcagcctgttggtggaccaaagctctctagcacaagcaagaaaagaacaagagttggtaacaaccaaaagtcaaggccaagagatagacagctgatcatggacaggatgaaggagttaagagaacttgtcccggaaggtggtaggtgtagcattgacaacctcttggaacggaccataaagcacatgctgtacttgagaaagataacaagccaggctgagaaactgaaacgaattgccaatcgggcggttcctgagtgcaaaagacagaaagtcaatgctagccacccaggaaggagctgtgcatttgactttgaaagtcaactatcatggcctatagtcatagaagatctggaatgctcagggcacatgctcatagagatgatatgcaatgagcatggacttttcttggagattgctcaggtgatccgaaagcttgatgtcaccatcttgaaagggatcttggaaaaccgttccagcaacagttgggcttgtttcattgttgaggtagcaatatag

SEQ ID NO: 102251 - DNA, 393 bp, Glycine max
  Peptide Sequence Number=SeqID_219029
atggctacttctgatcctattttttcattttctggaaccccaaccattgcaactgccaagctcaattggaaaaattatttgtcatggtctgctttagttgagttgtggtttcttggtcaagggtaccatgaccacctagagaaaaacgtcaatgctgttccaaacgacaagaaacctgaatgggagaagcaatctaaccatgacatgattgcacatatgggtaaagcttgggcagcagtagaagagctgagaatgtttcttgtggctgattcgttggaagaggtgaatagaaaactggacaagttctacatggtccttatcttgaggagtctacactcagattttgatcatgtatgtgatcaggtcctagctggagatcaagtcccatcggat

SEQ ID NO: 102252 - DNA, 1485 bp, Glycine max
  Peptide Sequence Number=SeqID_219030
atggagttcacagttgccaccacaactttcacgaagaagctctcaaacggcagtggctacggcgtctccggaagatccgcgtatgacggcgtcttcgccactcctatcaagctccacactccaaaattctcctctcagttcgacgactaccgcgagattttctgcgctgctgctggaacgtccattccgatcctcgaacttccggagctcaacaatagaaaaaacaacgacgttcggtactccaagttcgattactcaaatgtcttcggcgggcttgagaatctaggcgctgctgcggtgcctttcccggagcttgttgctgagcctaagaagaaaaatagcttcagagcaaggagcaaggtcaaaggagaaaaccaatcttccagggaagatcaaactaattgttcaaaggaaattccagtggcatcatggtcatctaatgataccagaaggatcaatatgtcatatcacaaagttaaccaaggaagcgaaaatggaacaaatgggacgacacatattgctcaactccgtgctgtccctgcttacactcaattaattgaagaagtcaatccggtgaagatgaacagggctaataagtctataccagtagcacaggatactacttgttctggtagtcatggcaatgaggggaaaaaagaagctgcacattctactaaatcatttactggtgcttcacctgataattctaagaaacagtcttccaacaatggagtgaaagttacaagtagatccgattctattgatctgttttttgatgcatgtgagattagcaatggaagtaatggaacacattatgtcaaagttcctctatccgagactacagaaggtaacagtgaagctatgaaatcaatgccaaccaaatgccaggcatctaaaagtagctcatccgaaggtgttgctggtgctgattcgccttcatacttagatgacatggtagacttaaattcagaggtagctgcttctgtagctgctttaagaaaggcaatggatgaggctcaagtaagaatgaaggttgcaaaagagttgatgagaagaaagaaagaaggttttcctgatcgtgtcaaacaaaagtctaacattgaattgaaagctgagagaaaaaaagaggctaaagtcacatataaaacaaagaaaattgatacaaggcaaacatttagagaaatggatgcttttcaaaatgcttcttctgaggtagggaagtcaacaatgagaatagagcaagtgaggccagatctgggggcaaaagaaacaagtgttgctaaagtagctgtacaaaaagcacagaagaaattgaaatcaactcaagtgaaatatgagaaagaggttgaacagaaagaagcgaatcataaaggaaaaattcttgagcttaaacaggcagaaaataacaagaaagagctgtacgttaaaaacacggataagaatgccactgataaaccagaaggacctgatcaaacaatagaaatt

SEQ ID NO: 102253 - DNA, 1659 bp, Glycine max
  Peptide Sequence Number=SeqID_219031
actatcctccaaagactcgaacttgcctgggccctcaacccccttaccgccctcaaactcgtctgcaacctccgcggtgtccgcggcactggcaagtccgaccgtcagagcttctaccccgccgccctctggctccaccgccgtcaccccaaaaccctcgctgccaacgtctcctccctcgccgaatttggatactttaaggatctccctgagatcctctacctccttctagaaggatccgatgcccgcaaggtccaaaaagaagcgtggcagaatcgcaagagaggggctcacaataacaaaaagaaaaaccctaggacccagaagatgcagaaggtgaaaacgaaatctttggcccaaagggtcaacgtagaaaaggaaaaggagtcttccgagaaggagattgcgcatgttgccagagaagagaaaagggttgcactggcgaagaagcttgttgaacgttatgcaaaagacccagattttcgtttccttcacgatcgtgtctctgattactttgctgagtgtctgaggaaggatcacgagtttttgaaatctgggctggtgacaaaagtcagtcttgcggcgaaatggtgtccctctgtcgattcctctttcgatcgtcacacgttgttgtgtgaaactattggcaagagggtttttcctcgtgatgagtataaggagtatgagggggttgaggaggcttattatgcttacagggttcgcgatcggttgaggaaggaggtgttggtgcctttgaggaaggtgttggagttgcctgaggtgtttataggagcaaatcgttgggatttgattccttataatagggttgcttctgttgctatgaaattttataaagagaagtttttgaagcatgataaggagaggtttgaggcttacttggaggatgtgaagtcagggaagagtaccattgctgctggtgctctgcttccccatcagattatagggtctttgaatgatggggatggtggggatgtggctgagttgcaatggaagaggattgtggatgatttgttgaagaaggggaagatgaagaattgtttggctgtttgtgacgtgtctgggagtatgagtggggtccccatggaggtttctgtcgcattggggttgttggtgtctgagttgtgtgaggagccttggaaggggaaggttgtaactttcagtgaaaaccctcagcttcatttgattgaaggggatgatctcgggtccaagactgaatttattaggaacatggagtgggggatgaacactgattttcagaaggtgtttgatctcttgttggaggtggctgtgagtgggaatctgaagcctgatcagatgatcaagaggttgtttgtgtttagtgacatggagtttgatcaagcatcagcaaacccttgggagacagattaccaagcaatcactagaaagtttggtgagaaagggtttggtgatgcagtgcctcagatagtcttttggaatctgagagactcaaaggctaccccagtgccagccactcagaaaggagtggcactgcttagtgggttttctaagaatttgctgacactgttcttggataaggagggggagctgagccctgaagaagccatggaagcagctatttctggcccagaatatcagaaactagttgtgctggattaa

SEQ ID NO: 102254 - DNA, 297 bp, Glycine max
  Peptide Sequence Number=SeqID_219032
atggccttagtggatacacttacttcttcagcacatctcttaacacttgcaaatctacttggagaagacttcacaaacttacatgcaactcttatttttctaatggataggtcaatttctttcaacccatcaccaacaaggggtctaacaacttttttttccttacctctgcttgtgcaaattcaggttgttgtccttgtccttgttgtggtggagtttcatatccttgtggttgtgaaggagtttatgtcccctgttgtgattgactttgagtatgacatggagagggagagctaa

SEQ ID NO: 102255 - DNA, 612 bp, Glycine max
  Peptide Sequence Number=SeqID_219033
atgagtagagttgtgagtgagagcgagagtgataacgagaaggagatcgcgagagtgagaacgagagtcagagatgatagcaagagcgagagcgagaacagtgtggccacatcgccgaagagagtgcgtgagagtaataatgagacaacaaatgaagttgcaaccataaatggatgggaagaggaagatgaggctgagcccaagagatcttcattttggttatataatggatattattactcgtggactaaatttggtgttgcctttgtgtgtagattggtgatgagggcgatggtggtggagttgccttgcaacatgtcccttagggtcaacaagctctctctattgccgaggaggtgcttatgtagcttagtgaggacatcaaactatttgctttcaagaaactcctcgtggatatgtttatatacgaaaaatgaggttacattaagcaaaaagggcaaaaaaaatgaagagaaagaaagagttctgaagcaggcccagcctaatactcgcgctaagcgagtaaagaaggcaggcgctaagcgaagcgttaagctcgaagatgcagaatccgttacgcgcgctaagcccagctatgcgctgagcgcgtga

SEQ ID NO: 102256 - DNA, 144 bp, Glycine max
  Peptide Sequence Number=SeqID_219034
atggcacaactggaaaatgaactaagaacacttggtggcgacaaagggattacagttgtagtggcacaagcaagaaacacaatcaagaaaaaaatgatacatgggacaacgcctactcatttgtacatagtgacatcactgtaa

SEQ ID NO: 102257 - DNA, 555 bp, Glycine max
  Peptide Sequence Number=SeqID_219035
atggaagagcttgaatgctacaatcagaaatacaagacaagattagatgaagttggagcgctaggagagatacctgttgatttggctctggagtacttaacaaagcataattttgcttcgaaggtttcatccccaggcgctgagaggctactaaaagtgccagatgatattagtcgattcaaagacatgactatgagagtctgttatactgaaaatatagagtccaattgcccagaaagggatggagtttttttgttagattctatagaaaatgactcggagatgtgtgtgtggaagtttgcagacgttaaagagaatagagacccccttaaaaaaggcagacctttaagtcgtaaacagaaggattggagattaaaactgccatttaacttgcatacaatggtttgtactgtgtgtttggtagtgctttcaccaggtccaatgtgcaacaaaactgaaggaactaaaaaagcttccacattttttttgataatatgtggtgatttaagcctcaaaaatgcatatttgaagcggatccaaacatgcattgtctaa

SEQ ID NO: 102258 - DNA, 228 bp, Glycine max
  Peptide Sequence Number=SeqID_219036
atggagttcatccgctttggtgtcatcagagccaccgccatcggcaccatagtcggtcttctgacacttcctctcattgaaaatctcggtcttcttgcgcttcctcagatcttcgaggacaccgaatcactctcttctttcacctctgttttcaaactccgaaacattaaaacccccaaatggccaaaccctttacaagagaaaggaggtgagatggcatcgagttga

SEQ ID NO: 102259 - DNA, 690 bp, Glycine max
  Peptide Sequence Number=SeqID_219037
atgcgcccgcctcaaccagaggagtcacccatgaaatcgcagacaatcgcgccaaaacgctggtggtatatcatgcccatcgtgtttatcacctacagtctggcgtatctggaccgggcgaactttagcttcgcctctgccgcagggataaatgaggatctcggtatcaccaaaggcatgtcatcgctgctcggtgccctgttcttccttggctacttcttctttcagatccctggcgcagtctatgccgagcgccgcagcgtaaaaaaactgattttctggtgtctgattctgtggggcggctgcgcctcgctgaccggtatcgtcagcaatattccgatgctggccgccatccgctttgtgctcggcgtggtggaagcggcggtgatgccggcgatgctgatctacatcagcaactggtttaccaaatccgagcgctcacgcgcgaataccttcctgatcctcggcaacccggtgacggtgctgtggatgtcggtggtgtccggctacctgattaactcctttggctggcgcgagatgttcatcatcgagggcttcccggcggtgatctgggcgattgcctggtggtttatggtgcaggataaacctgcccaggccaaatggatgagcgacgaggagaaagcggcgctgcaggcgcagctgcagaaggagcaggagaacattaaagcg

SEQ ID NO: 102260 - DNA, 903 bp, Glycine max
  Peptide Sequence Number=SeqID_219038
atggcgatgtttattgccgggcaaaccggcgatctcgccgcagccgatcagttcacgaagcgcattgccggtgccgagcttaacgtggcgattggtctggcgcgcctcggtttgcaggtgggctgggtcagccgcgtcggcgacgacagcttcggccgttttaccctgcagcagctggcgaaagagcacgttgaccaccgctgcgtgaccattgataaccgctatcgcaccggttttcagctcaaagcgcgcgtggacgacggctccgatccggaagtggagtatttccgtaaaggctccgccgccagccacctgtcaccggatgatttcgacgaaaactattttggcagcgcgcgccatctgcatctgagcggcgtggccgccgcgctttccgatagctcgctggcgctggctaaacatgcggcgaaagagatgcgcgcccgcggcaaaactatctcctttgatcctaatctgcgtccggtgctgtggcgcagtgaagaagagatgcgtaagcagctgaatttgctggcagaatacgccgactgggtgctgccaggtgaaaaagaggggctgattctgaccggctaccgtcagcctgaagcgatcgcggatttctacctcgacaaaggcgtgcgggcggtggtgattaaaaccggcagcgacggcgcctggtataaaaccgccgcgggcgaacagggccagattgcgccgattcacgtggagaacgtagtggataccgtcggcgcgggcgatggctttgcggtcgggctgatcagcgcgctgctggaagggaaatcgctgccgcaggcgattctgcgcggtaacaaaattggttcgctggcgattcaggttgccggcgacagcgaaggtctgccgacgcgcgcagcgctcggcgattattaa

SEQ ID NO: 102261 - DNA, 189 bp, Glycine max
  Peptide Sequence Number=SeqID_219039
atggttttcggggcttccctggcttccgtaaaatttctgaaaaccttggataggggtgtaaatagcaattcgagtctaggcccttctagaacattttcaaagttgggttgcttaaggaggaaacaactaggcggcaagctcctccacgtttttgaaaaatggtttccggggcttccgttgcttccgtaa

SEQ ID NO: 102262 - DNA, 921 bp, Glycine max
  Peptide Sequence Number=SeqID_219040
atgtcatgttttagaattagtgatatcgtagagacgaggcgggtaagcaaagttccttcaaagtctggacaaaggaagaaactgaaagcttcaaccattgaagtcaatatagagaagtatgtcccaatctgttcccaaattcataagaaaccatcaaatccaccaccatcagatgtatctcacattgcatattggcttaacgaaggtgtagtagatatctcttcttcccaagagcaagaggatgatagtgatcaagatagggacctcaatgtgacttccaagacccccattgatctcatccctgaagaaaccaaagaaactgagatcgaaagagaagctgaagctatggaagaggaaatcaagcttttgaaggaagaggtcaatgaaagtgaagacattggcaacaacgccttcaaatcttcaaaaagtcatgttccttcgacaaaagatgaacaaaaggcaagccaaagcgagtctttccttaataagactataagtggaggagcagcacaatcaaggccaactaaaggagatccctcgaatattgctcacaccagcagtgaagcaattattcgagtaaatttggagacgaaaggctatactgaacaagttaatgctataattgagatagtgataactttcaatgaagatcaactcgatgaaaaccttaatgacgagatcaaagaattcttaaatttgttgaataaagcatgcaagttgaaacaaagagagaatgctgccaatgagactattgcacaagctaacacaaacactcaaagtggaatccttgaactcgagaaaaaccaaaaaagtgttaataaagctcaagaagataacaaacagtctcaaactgcttttgttgaatttttgaagaaaaaacttgatctcaaagccaatgttcttgaactacataatcaatag

SEQ ID NO: 102263 - DNA, 477 bp, Glycine max
  Peptide Sequence Number=SeqID_219041
atgacgcacattctaagacggttattaataaccgccttagaatgtgacacgggttcaagcacgaggtttacgacgacaacaagaggtggtggtggtgaacaacgaggagattcacctcgtttcaatgccgagcaagaggaagaagttctcgtgcttctgacgctcatcgtggcgaacacgacgaagtattttgaggataggattgaggccttgagggggtggcttttccacgagattgatccgttacgggtccaggggatgtcctcggagcttaagaggtacctcgaggaacggttgttgctgaagcagtatgcagagagtgacactatggaggaggcaccaccactgtccggtagccacgagaaattggttcagccagttgttcggttgcaggagaggaatattgtcctcacgaggattaatcctgaggctttaagtttggggttttgggaattggtgaaatttgatgagaggtga

SEQ ID NO: 102264 - DNA, 1161 bp, Glycine max
  Peptide Sequence Number=SeqID_219042
atgttaaaagtgattgcaaagaatttatgtactatggtttgcaaggatgttgagctggaagggagggaacttcaagttataaactcagcgagaggtcttctttgcatatggaggaaaggtatatttgaaattgatccagttttctcaggcaatggttttttgggtattaagggtttgtggaaggaagaggattttaactttgcaaagaggatggaggaaatgaggaactccaataattatttgacaagagaaaaggactttgaggagtttaatatgcttattagggatatagatattgaagatactcctatggtgggtagaaaatataattggtataggtctactgagcattccaagaatggactatacaggttcttgtgtcaaaatggtggatgcatgaatggacaatggatcaatgagttggatactttggatgcagctgatgggcttcaggaggatggacttaaaaggaggggaaggctcatgaaggagttttggaagcatggaaaatttcccaaaggtggtaatccttcttttattcccttgattcctaaaaagaataatccacagggccttgatgactttatacctatctccctcattaggcgtgtcattgccaaagttctatcaagaggtggtagaggattcaaagataaaaaaggaataagtgcttattgtttaaagtggactttgagaaagaggttgggtttctatgagagatggattacatggattagaggatgtttggagtctgctactatgtcagtccaagggcttagaatgattataagaaaggccctaagttgtggtttttactcaggatataagatgggtgcagatgaggtggagatatcccttatgcaatttgcggatgacacacttttcttggacaaccctgatcatgctaatgtcttatgcatgagttttgatgataacaaagatgatgacaaaaagctcaaaagtcaagatcacttcatgataacaaagatgatgacattcaagaatgagttcaagattgagtcaagaacacttcaaggatcaagaggaaatttgatttcaagaatcaagaatcaagattcaagattcaagaataatcaagatcaagattcaagactcaaagattcaagaatcaagagaagacttaatcaagataagtattaa

SEQ ID NO: 102265 - DNA, 681 bp, Glycine max
  Peptide Sequence Number=SeqID_219043
gcatttgaagatggtgcaagggagaactttggggtggaggatcctctttcgatgcctaagataggtgtttcaaggatgttgtcattattggatgtcagtatgttgggaaaaagggataaggagaattcaaatatggagcatgattttggtaaggttggtgagcatcacaaggaagggacaacaacgttgaggaattgggtaactcaagtccctgtggagatgatctcttttataaaatctataacctacgacgacattgttacacttgccaatagtctaacacaaggagaatgctttattcatgttgtagaaggaaaaggtatcaagaaagcaaaggtcccatgtgagggtatgaaattggttggtttgggtctaggttgcgggggtggctctactgaggtgagcccaaagaggctagcgaataggtctttgacaaagaggatgaacgggttccctatagtgtggaaaaagctgcaagtgagtagaagggataagggggaaagaaatatctccttaacagagaaagaaggaggtagtaaacagaacaacatcctagattttcaacaagggttaaggttgtcttctattgcttcatgtaacaatagtaaggagtcatttcttctcaaggacaatgtagtggaagcaaggaaaacatgggagataggaaagtctttagtgtga

SEQ ID NO: 102266 - DNA, 1185 bp, Glycine max
  Peptide Sequence Number=SeqID_219044
atggctatggagggagagctacaaccatcacaagttcaactcagggtaaactctaggcagtggaggaacgaggtaaatgtacattcaatggagatagacccatctttcacttcaaaagttgaacacagggaagtgaagcatttcaaggaatggtttccttggttgattcccttctttgtcattgccaatgttattgtgttcatcatcaccatgtatgtcaatgattgctccaagactttggccacttgcattgccccgttcctgggtcgtttttcctttcagcctttcaatgagaatcctctcctggggccatcattaataacgctacggaaaatgggggctctggatgcgaacaaagtggttcacagacaccagggttggcgcctcatcacttgcatgtggctacatggtggagtattccatctagtggcaaatatgtttggtcttctagtggttggaattcagcttgagaaagaatttgggttcgtgcttattggattgctatttgtcatttctggatttgggggtagcttgctttctgctcttttcattggggaaaaagtctctgttggtgcttctggtgctctttttggcttactaggaggcatgctttcagaactccttactaactggtcattgtatgaaaaaaagctaggagctctcttcacttttgtgtttgtcattgctatcaatctagcagtgggggttctcccacatgtggacaactttgctcatattggagggtttctttcaggatttcttcttggatttgtgttcttgatccgtccccagtttggatggattaagcaacgaaatgctcctcagccatattctccaacattaattaaaccaaaattcaacaaatatcagtgcatctcctggatcctagccctgatcctgttaattgttgggtttaccactggtctgattgcacttctccgtggtattgatgcaaatgattactgctcctggtgccattatctgtcttgtgttccaacttcaagatggaactgcaatccaccaaaatcttcatcttgtgttgtggtaagcatttgtgctgaaatatgttcatctgaattgtcagttaacagagcagattggcaaccagctgaacttgatatgctcaagcaatggaaaatccagtacatattatatgcaaaatccgaccgatccccagatctatga

SEQ ID NO: 102267 - DNA, 522 bp, Glycine max
  Peptide Sequence Number=SeqID_219045
atggatgagtatgtgtgcattggtgaaacaactgcagtggaatgcttacagaagtttgctaaaggagtgaatgaggtatttgggactaagtacctgagaagacccaacgacaataataatgaacgtttattgaaaattggagatgcatgcgaatttccagcatggaaatgccaatctcaaagaggagatcacaacaaagcaactattatgctagaagcagtggcatcgcatgacttgcaaatttggcatgcatactttggtgtggttggttcaaacaacgacgtcaatgttttcaaccaatctgatgtctttaatgaagatttgcaaggccaacctcctaagccatggtatttatccataatgggctacatttgtaaaaatcatcctaaagccacaaggagaaaaaagaaaattatttgtccaacatcaagaagcagcaagaaaagatgtcgaaagagcttctggaatgcttcaatcatgatttgcaattatatgtggcccgacacgattttggaaaattga

SEQ ID NO: 102268 - DNA, 270 bp, Glycine max
  Peptide Sequence Number=SeqID_219046
atgctcacatgggagtgggtatggtcgtgcgaagtaacagagactatgagttacacatgttgtaccctagtacatttcgtgccaatagagaatccagatatagtgatcgctaccgtagaccacatgttatcttgctatatcccatggggatttacttctcatttagagctttgttattatgaggacattcacgtgtatcttggacttgaagacctcgtcataattcttgttgactttggtggagtacaatggatcgggcaacattcctag

SEQ ID NO: 102269 - DNA, 267 bp, Glycine max
  Peptide Sequence Number=SeqID_219047
atgtcttttcaaaaagacttttctgaatttttttcactagtaatcgattacaggtttctggactcaaagtcctcaccattatctttcataggactcaaagtccttgcctttatctttcacatgactcaaagtcctcgcttttatcttgtagaagcaagcttcatgatgatgaatcaagttgattcaagtagttttgatgatgacaaagatgatgacaaaaagcccaagagaatgatttcaagattgagtcaacaagatcaagattaa

SEQ ID NO: 102270 - DNA, 460 bp, Glycine max
  Peptide Sequence Number=SeqID_219048
atggggattggtcttaggaacgtccagccaaaatgggaagacaatccaacggttgatgaatccagcatcgtggcatcaatgaataacaagaacgtggaggtattctccaaggaacatcttgctgtgtctctggccaaatatgttgctgatctatccaataaattcatcaaagaaagaggatacttcgctatcgctctttccgctgggtctatcaagtacctcaggaagctagtggaacctcactattctaacactatccaatggtctaagtggcatatattttgggtagatgagaaagtggtgccaaagactcacgtggatagcaactacaagcttgcttacgatggatttatctccaaggtgccaattcctccatacaatgtcaacacaattgatgatgccttgccagctgatggagcagctgatgtttatgagacaactctcaaacgcttggttgcaa

SEQ ID NO: 102271 - DNA, 183 bp, Glycine max
  Peptide Sequence Number=SeqID_219049
atggtggtgactggtgctggtaaagcagatgcagtctactctgcactggaggaagctcctagtgattataagctccctgctcaattggtttcacctagagaaggagagttgaaatggttcttagacaagggagctgcatcaaggtggagaacaaaatttcataacaagactaaaactaagtaa

SEQ ID NO: 102272 - DNA, 456 bp, Glycine max
  Peptide Sequence Number=SeqID_219050
atgaaaatgcatgtgattattgtatggtacggttggcttacaatcgtagtatgtggtagtcacaggaacttgagcatgagttttggtgttgatcagaatcctattctagtaggcattgcacgtcttgaaagatgtgcattacttggaatctattctagtaatgatagtgtgattgagagacatgaaattggatgcaattacatagtggaatgcggcaagtacaagttgaagaaagttgcatggggcatcgtgctagaagtctatcaaagctcacaagacagagagttgagaattgttctaggactcattctccatttatcgtcgttcagtacagtgcgcaataggaccccacaacgacaagaatataaatcctcaatgaggaatgtattgagtagccaatccttaaagtttaggatggccttacagagtggtacatggggtatgctccctgactag

SEQ ID NO: 102273 - DNA, 231 bp, Glycine max
  Peptide Sequence Number=SeqID_219051
atggagcgtgactttccacttagggtcaaaccccgtgcattgaccttggaaggggctgacggttgtgtggtggcaccaccaatttttgacttaggggacgaagaggaggaagaaaaggtccctactaagggagatcgagagtccaccgatcatgatatgaatgatagcggaatggagaaggaagaaagagagaccatggataagagcttggaggaagaaggagatgaatga

SEQ ID NO: 102274 - DNA, 411 bp, Glycine max
  Peptide Sequence Number=SeqID_219052
atgaggcactatgagagcttttccatgcaagaaggagaatttgtggatgacatgtttggaatacttcaagtacttctaaacagacttatgattagtcaaagaatccccaaaattgaagaaaattttcataacagagataacaccaataccattactcaatccaaaaataacaattcacaatctgacccacttgggccttccagatccttcctccagaaggctgttgcttctggaggaagcaaccttgctcgcctggacgagctgggtggcaagctcctcccctattttgctataaatagggggagaagtgaagaagaaaagggttcagccttcttggcacttcttattctctcgaaattgctgaggaaaattattttcgtgaagaaaatccaagccgaagcgcttccgtaa

SEQ ID NO: 102275 - DNA, 180 bp, Glycine max
  Peptide Sequence Number=SeqID_219053
atgactatccccacaacacgagagttttcaacgtattttgtcctcactcacatgcttaatgagaatcttcccggaagatacactccaccaccatttgtggaggagctcatggaggagcatcaccatgaggaggtttttccaaaatcgataagaatatctcttttaaaacttacattttag

SEQ ID NO: 102276 - DNA, 246 bp, Glycine max
  Peptide Sequence Number=SeqID_219054
atggttgacattcctgaggatgttaacccaaggaatgtaaggactccagttgctgaggagaatgtaaataaggctctggatgagttcaaaaatgaagttgaaggagcatttcctcgagtaggagatactttggctgaaattttgcttcgaaagaaggactgcaacagggacatcatgttgtatccttgttgcagtgtagttttcgacaagtctactgcaagggccttcaaatcatctgaagtttga

SEQ ID NO: 102277 - DNA, 182 bp, Glycine max
  Peptide Sequence Number=SeqID_219055
atgtcaggattttcacgcaattctcctcaaatttcagccagcccgcatcaattagtccttgcaccttacgcttcagagccccacaatgctcaatgcaattccccggggctcctaggagacaagcacacgttgcgttcgagtcgtattattagagaaatggaggttgatgaaccttggctagg

SEQ ID NO: 102278 - DNA, 420 bp, Glycine max
  Peptide Sequence Number=SeqID_219056
atggccaacttagccgaaaaaagggacaaagagatggccctcaaaaccatcgaaaaagaaaaccatgaaaaaggacaaacgatgctcgaagctaagaccaatcaaaacaatcaaacaatagctggtggctttgagcaaggtgggagtgtagataaaccttcgaaagaagctaatcaaagatttgactgcatctatgacaactcacctttgggatttgagaagtccatatctccaccaatcaaaaagatgaaggctcaaaaccctcttggtgatataaatatgggagatgagactaataaaaaatcaacctacattaattttcgagatttaaattcagcaactcctaaagatgagtatcctatatatatcaaaaagcaacttttcgttgtcccgatgccttggacacttatgaatggatag

SEQ ID NO: 102279 - DNA, 294 bp, Glycine max
  Peptide Sequence Number=SeqID_219057
atggatttgattggccaaattcaccctccttcttcgaaaggacacaaatatatactaattgcaatagactattttaccaagtgggtgaaagtgattcctctaaaaaacgtggaacaaagtgaaattattgatttcaccaacgagcacatcatacataggaatgttaagttattcacttctactccttactatgcacaagccaatggccaagttgaagccattaacaaggttttaataagcttgatcaagaagcatgttggtaataaaaagaatttgcatgagaccctatgttaa

SEQ ID NO: 102280 - DNA, 219 bp, Glycine max
  Peptide Sequence Number=SeqID_219058
atgacaagtgcaaaggtatcgtcgaaagaattgaagttgtataatgatttgggtgatttgcaattcctttgggggcttgggcttcgagaggatgaggcagaatgctgtgacgtttatggcttagatgaagagcttttggaaatggttccaaagcccgttcttgccgtgctttttctttatcccataaccacccaaagtgaagaagagaggttgcagtag

SEQ ID NO: 102281 - DNA, 3003 bp, Glycine max
  Peptide Sequence Number=SeqID_219059
atgcttggcttggcttttgctgttgttttccttttaactgcatttgtagtgttatcttcatgtggtcattcaccacttggctgcaatgaagaagaaaggcatgctcttcaatggatcaaaggaagcttcaaagatccatcatcgaggctttcctcttgggaagaagaggattgttgtcaatggaaaggtgtagtttgcagcaatattacaggacatgttgtcaagctggacctcaggaatccttgcttcccacaaaagaaccaaggaggtcaaccaaactgtgacttcaacaaatatgttcttgaagctaatcatgttcatccttctatatcgcagcttaaatatctcacttatttagatttgagtggaaacaaatttaatagttcaataccaatgttcatccaaactatggagcatctgcaattcctttctctctctgattgtcattttagtgggaggatcccttacaatcttgggaaccttacaaaattgatccttcttgatttcagcttcaatcctcttctgtatgctgatgacttttattggatttctcaactttcatcactccaatacctttacatgcgtgatgtgcctcttggtaaggcacaaaatttgttgcaggcactcagcatgcttccttctttgttagaaatagaattgaggaattgtggactaaacaagttacacacttatcaacttgttagagccacaaacctttcccgagtggaggttctggatctagcagaaaatgaacttcaagctccaattctgaatgcttttcaaaacatgtcttccattgcagagattgacttttctttcaacaacctgagttccactccattctggttgggaacctgtagtaatctggtctatctatctgttgaaaataatgctctttatggctcacttccatctactttacagaatctgacttccttgatttacctcgacctttcagaaaacaatttagattctgttccatcctggttaggtgagttaaagggtcttcaatccttgtatctttcaggcaatgatttaaaacatattgaaggatctctagcatcttttctgggaaactgttgtcatcttcattcattagatatgtcaagtaacaatcttaaaggagatgcacttggagtctacatacggtctggatgcattaggtatgatttaatgcaattggatttgagtcacaatgaatttaatgatagtttgccaccatggttgggacaacttgaaaatctatctgacttgtatattcatgacagtaatttggttgggaaccttccttgtgatatgataacaaaacttatcaatctgaagaagttggtactttccaataacaacttaaacgggtgtcttcctaactgtattggccaacttctgaatttaaacaccttaattctttcttctaatcattttcatggtgtcattcctaggagtctagagcaacttgtaagcctaaaatctctagatctttcaagaaactgtttaaacggtacaattccccaaaatattggtcaacttaaaaatttgatcaccctctatctttttgataataatttacatggaaacataccttatagtcttggtcaacttctaaacctgcaaaactttgacatgtccctaaatcatttggagagttcggtgtctgacataagatggcctaagcaacttgtttacctgaacctcaccaataacaatatcactgggtcacttccacaagatattgctgataggttgcccaatgttagtcacttgctttttggaaacaaccttataaatggttccattccaaattcattgtgcaaaatagactccttgtacaatcttgacctttcaagcaacttgttatctggtgacattcctgatttttggagtgctactcaaagtctcaatgtgttaaatttggcatccaacaaattatcaggtgttattccaagctctctcggtaacctacccacgttggcatggtttcatttgaacaataacagtcttcagggtgggattccatcatctttgagaaatttaaagcaacttttaattctggatctaggagagaaccatctgtctgggattatacctttatggatggggaacattttctcctcaatgcagattctaaggctacggcaaaacatgttgattggaaaaattccttcacaactatgccaactttctgcactgcaaatcttggacctttcaaacaacaacctgatgggatcaatccctcactgcattggaaatctcacagcaatgatttcaggaaagaaatcttctgtcatccaacctagtgaagagcatagagatgttgaatggtatgaacaagaggtcagacaagtcattaaaggaagggaacttgactataccagaaatctaaaactggtagccaacatggacttgtcaaataacaatttgagtggtactattcctgaaggaatagcattgctttctgcattgcaaggcctaaatctatcacacaattatctgtcaggacatatccctaaaaggataggggacatgaaatctctagaatctcttgacctctctcatgaccaactttcaggcacaatttccgacagcatatcaagtttaacttcgttaagccacttgaatttgtcctacaacaatctttcaggacccattccaagaggaactcaattgtcaacccttgatgatccttttatttatacgggcaaccaatttctctgtgggcctcctatgccaaacgagtgttctcctgatgattccctacatgacaatgtagatgaagatgaagatggcaaaaaggataaagtagagaaattgtggttttactttgtcattgcccttggctatgctcttggattttgggctgtgattggaagcttgttgattaagacaagttggaggcgttcttactttcaatacattgacgactcaactcaaaggataaatgtatcatgggcaatacatttatcaaatttcaaggcaagatttataggaagccctgttgctgagtga

SEQ ID NO: 102282 - DNA, 651 bp, Glycine max
  Peptide Sequence Number=SeqID_219060
atggcagaagaggctcactcccaagttatagaccagaaagccaggagaattgctggcggatttaatttaccaattattggcatacatcacatggaagctcatgctctagttgccaggttaattgagaaagatttgcagtttccattcatggccctacttatttcagtgactggaaggtgcagagacaaggtatataactttgtaaaattggcagaactttactatgtgggaagtcatggcatggacatcactggtccaacaaagagtccaaagcaacattattgctggggcacccagcaaacagtgaagtggcaaaactgcccttcagcaattcttcttccggaagaagatttttccggaaactttctggaaaacctctttccgaaacttttccggaagaaccttcttccggaagaagaatttgtgtcttccggaagaacgtcatccggaatgtttccggaagatttccattttcttccggctgtgttttactgcgctttcttctttgtttcttcttccgtttgctttgtttgtttcttccgtttgcttgctgttgtttcggtggtggtcccttttgcagtctccgttggtggtcccgtgaagtatttgaagatttggtggtcccgtgttccgtatttgaagttttattag

SEQ ID NO: 102283 - DNA, 417 bp, Glycine max
  Peptide Sequence Number=SeqID_219061
atgacatactggaataaaagtgtctcaactcaattgctttttaatataggaaataggatcctaagtgatatctttgaaaggaaaaatggagatgtacctcaggttgagcaaactaaatttgaggagaagaagaaacttgaagagcaggatttttctcgtttaaagaaagaaaaggaactgagagctgccatgaagtctgtcaaagatgatgtgataaaaacaaaaaagaaactacttagaggaattcaaatgtatttacaactaacaagatgtgtatatgtaggaatcaagttgaaaggtctagctgaggctgctgaaatttatcatgtagttatagatgaaaataggaaattgtataatgaagttcaagatttgaaagttcgtgatttactatcaaacaatggtcctcaaaagtga

SEQ ID NO: 102284 - DNA, 816 bp, Glycine max
  Peptide Sequence Number=SeqID_219062
atggagagagaaaagagagagaacctaggaagcgagagaaactggggaaaagaaagatacgccattggaatgagcacaagtttacaaacactgaatagtttttccttcaggcatgacaccctgcacctgctagtagctaagtttagtgcctcaactattcaacagtcagcctcttcctcttctttctctaaccctctacacctgcattcaaaagccgtaggacaccacgtcgtgcaccgccgcgtgccaccacccactaaaccaccaacctccacacccagcccaacacaagcatcgttgtcggttttgtttctcttcctccctctctggttttgggtcttggagtgtccttctagctcttccaacccaattcgcggagatgaagttttggaggtctttgcaacaatgagtattttaatgtatctaggggaacccaggcataagctttttgctgccaggaagtatcttaaaggagtgggtttttcctcttttcacactgcttcaaattcctctgtagagcactcacaagaagaggaagtagtgattgctctgggaagtaatgtaggtgacaggctgcataacttcaaggaagccttgaaattgatgaggaactcaggcattaacatcacaagacatgcttgtttgtatgagacagcgccggcatatgttactgatcaacctcgctttatctactcagcagttagagctgttactaaactaggtccacatgaactattgtctacactcaaaagaattgagaaggacttgggccgtacagatggtatgaggtatggtgtccaaggccaattgacttag

SEQ ID NO: 102285 - DNA, 342 bp, Glycine max
  Peptide Sequence Number=SeqID_219063
atgacgtccagggtctgcacggaagggccagagattgctggaggtgctggaggaggaaccagtgctagtgcagctgctggtgtgggaactggagtaggagcaggggtagaagtggaagcgtctgagggtccccgagcccgggccttgcgggacccaggaaatgtgattgtcggatcatctgggttccagcagttcttccgagtatatgtcaagttaatgaccgggctcagagactcaaaagtgagtgagtcagggacgactcctctggctatgcacaaagctgtgataagtacaggaaatctgagcccaaatgagctggattgggccatctgggagatctga

SEQ ID NO: 102286 - DNA, 270 bp, Glycine max
  Peptide Sequence Number=SeqID_219064
gtaacttctgctcagggtggtggtgacaaggactacaaggaggtacccccacctcctttgtttaaacctgcagggggacacattaaccaagctgtgaccttcaacagatcttattacaaggagacaaccgtagtagtaataggaccattctacgatggttctcaggagacaaccgtcgtagaacaggattatgtctacgacggtgctgtccccatggccgtcgtagtctttcgttacttctacgacggggctgtccggcagccgtgttag

SEQ ID NO: 102287 - DNA, 408 bp, Glycine max
  Peptide Sequence Number=SeqID_219065
atgacttggctcaacatcgacccatcatcagcatggaggactttatggcccaggtggcctgcccaggagccgcagccagagctggaggtgaaggagatgtcaggacacacctatgccagcctaggatgcccccacatcacctcaggacgacctgctaaagaagagaaggttgaagctgctgatgactcgcttagcgaggaagatccgctcaatgagactcatcagcttagcaaggcatccagctcgcctagcggatgggaaaccctagaagaggataagtcagagatctgcatgcccagcgcgcagccagcccgcctagcgaggacgttgtctcttctcgcgctcagcgcgcccactcttgctaagcgaaaatccactaactctcgcttagcgagacatgcttgctaa

SEQ ID NO: 102288 - DNA, 672 bp, Glycine max
  Peptide Sequence Number=SeqID_219066
atgatggctgaagaagaagaagaacctcttcgcggcaacctcctcttcacggcaacaatggtgacaaatggaaacgccgatgaggtgagtaagaagaagacgaaaacggttgaggtggtgccttcgcattacacgcagactagtgagggcgagaagctaataaaactaaatctacagcctgatgcaaaagacctcgaaaggcagggccaaggtcaggttgtaacttgctctggagcttacaatggaatagggattaatgaacagctttcaaagacggtcaaagaaaaccgtcgtagacattatagaattctaagacgggctgccggacagccccgtcttagaacttgcgagagactacgacggacatggggacaacaccgtcataaacataatcttgttctacgatggttgtatcctacggaccgtcgtagaatggtccacaattctaacacggctgccggacagccccgtcgtagaagtaacgaaagactacgacggccatggggacagcaccgtcgtagacataatcctgttctacgacggttgtctcctgagaaccatcgtagaatggtcctattactactacggttgtctcctgagaaccgtcgtagaatgatcctattactactacggtgttttgttgcggacgaccgtcataagagacagtgttaa

SEQ ID NO: 102289 - DNA, 1580 bp, Glycine max
  Peptide Sequence Number=SeqID_219067
atgacgacaccccctccatctcccacacaggccgagattccttctgatgagacgtctaggaaaactagacaagccactcggctaagaaggttgacagcaagaacattggagcaagcaagggcaacagttagtgtgaatccagcgactgacaagattccaattgttcacgctagctggaatgatgtacctgaaacactgaagaacatgatatgggatgacatattggcagaattcgacatccccgagggtgataatgccaaaaagaaggtgatgtcaactgtggcaacgcgttggaggcaatttaagtcggcgttgacaacaaaatatgtgtatggtaacactgacggccaagcaaaagatgatcctttggttaaatatggcattaatgaaaaagattgggtcgagattgcaaaaatgaggcaaacccctacctggaaggactctttggaagagcaaagcaggcagggcagcattgtgccttcaggacgtgacgatattttgaacatggctattggaagaccggagcatcctgttcgtgtacgtggggctgggacaggggttacaattacgcagtactttggtccagcatcgcgttggtctaccacttcatcaaacatcactgtagaacagttggctgatataattggtaacctaaaagaagaatggcaaagacaggctgaacaagaaaacattaaaagagaggagttgtcacaaattgcatcacaacattcagccccacttcaaccaaatgatatacaagtattagcagcaagggtaagcacgaagggaagctgtgcaacagcagagacaaatgcattagctaaaaaaccctctcagttgaatggtgacaacgtcaggctgcatgtaactgccgagaactccaataaattagtggcagtgggcaaacagtgcgacagttttggcaccatccacaacgtgccctatgctgatgatgttgttcacgtgagtgtggtggaagttattttcggtgatgcggaggaagcagagaaggatgtgagctcaccattgaagactgttgaggaggaaaaggcagttgaggttattgatccattgggagagttggtgaagaacttgttcgacatttaccaaaggcccgttgaggtgtcatgggatggtgctaaatttggaatcaataatgtccaagatggcttctttatcacacatgctgatgtgagcgagataatattaggagacaagtgtttaaacatctccattctacagctatggcttattgcgagcattggttatggagcattgtatgggttccttgaaccccagtgtatccacaatgcaagcagtagacgtcaagagtgtgaaaattacattggaaggtggttgaaggaagcaggaaaacaaatttacatagcaccttatttaaaccaggcccattggcagctcgttgtattgtgcctaggcaacaatctagtggtttggttttgttctttgcgaaagaagtcggatgctgccatcaagggtgcagtaaacagtgcaatgaaatcagtcaccaaaactgcagagggaaagccacctcagcatgggcctcagtggatgaagcaaag

SEQ ID NO: 102290 - DNA, 162 bp, Glycine max
  Peptide Sequence Number=SeqID_219068
atgggtagtcctagcatgggaggctcaaagagaaggctttcaagcagagggcttggaggagcccttaggcagcaaagggcaaggctttacataattagaagtctccctctatcgatagagatatcctcctatagtttattctccttacttgggcttctatag

SEQ ID NO: 102291 - DNA, 1263 bp, Glycine max
  Peptide Sequence Number=SeqID_219069
atgccacacaatattgctcctcctaatgtgtactccacttcaagatccatggggaacaataaggacgtcaacatgagtttcaatctcacgtggatcttccaagttgatccgggttccatgtaccttacaaggttgcatttttgtgactatttctattccaaagtgaatgaaattgttttcaaaatcttcatcaacaatcaaacggcggaggctgaagctgatgtgattgggtggacaggaggtaaaggcgtgccaacttatacagattatgtgatatatgtgaaagatgaggcaggtgatgatcaactctggcttgctttgcaccctgcacttgaaacaaagccaaaattttatgattcattgctcaatggggtggaggtgttcaagctcaatgacacagacttatctggttttgccttagtggctgcaatacttgttgttgttcaacaccaagagaaaaagcaagctccaggatcatacaacacatcaagttggctacctatttacgggaattcacacaccgcaggcaccaaaacctctgggtcagggaagagtgttggtagtgccaacatatctgccatggctcaaggattgtgccgttatttctccttacaagagatgaaacaagcgaccaagaattttgatgagtcaaatgtgataggggtaggagggtttggaaaggtttacaagggtgttattgataatgggttcaaaatggctatcaaaagatcgaatccgcaatcagaacaaggagtaaacgagttccagactgagattgagatgttgtccaagttgagacacaagcatttggtgtccttgattggtttttgcgaggagggtaatgagatgtgtctggtttatgactacatggcacatgacaccatgagggagcacctttacaaaggaaacaagccattggacacactatcttggaagcaaaggttggagatctgcataggagctgcaagaggccttcactaccttcacacgggtgcaaagtacaccatcattcatagagatgtcaaaacaaccaacattctccttgatgaaaattgggttgccaaggtttcagattttggactttccaaaacgggcccaaacatgaaccaaggtcatgttagtacacccttgaaaggtagctttggatacttggatcctgaatatttcaggaggcatcaattgaccgagaaatcagatgtgtactcatttggggttgttttatttgaggcactttatttgaggaaggtagctttggatacttga

SEQ ID NO: 102292 - DNA, 195 bp, Glycine max
  Peptide Sequence Number=SeqID_219070
atggctgtacgaggtgcgacgctttttggtctggagctagaaacaactgcgcggcttgttgggaagaacagtccctgtgtgaaggatggatatcatgtcaacatcgacaatgataatcatgttaaagaacacggagactgtggtagtgacaatgataacactcataatcatgatagtcatcaactcatggtgtga

SEQ ID NO: 102293 - DNA, 120 bp, Glycine max
  Peptide Sequence Number=SeqID_219071
atggtagaatcccacgacacctgcaaaggcttgaggaaaagctatgggatagtcaatgtcataaggttttacaagatgtgtcggccaagcaaggaaggtgttaagtgtctatcccactaa

SEQ ID NO: 102294 - DNA, 462 bp, Glycine max
  Peptide Sequence Number=SeqID_219072
cgtgactcaaatgtcagtatgacagatcttgtgagcacggaagatgacatatcaaaaaagaatgtttgtacggataaccactcgggtatttccgccggacagcgtgactcaaatgtgagtatgacagatcttgtgagcgcggaagatgacgtaaatctccagacagcaaaaaagaatgtttatacggataaccactcgggtatttccgcccgtcagcatgactcaaatgtcagtatgacagatcttgtgagcgccgaagatgacggcgcagaagatgaccgtgactcaaatgtgagtatgacagatcttgtgagcgcggaagatgacgtaaatttctgcgtgtcaacaggcttctcagccgcgattgacgaagggcgcagaagacgacgtttgtctccgcgtgctatcaggcttttcgtcttacagacagcaaaaaagaatgttatacggataatcactcgg

SEQ ID NO: 102295 - DNA, 288 bp, Glycine max
  Peptide Sequence Number=SeqID_219073
atgtggtcatctgcaccctttccggagatgtcaacatcttccggtagagactattttagtctcacacctctttcgcaaaaactaggagcaaaagcctcgcttttgtcgactgccccacctttccctatcatgacctgtgagtccgatgacgtgtggagataccgtatggttatccgcacctttcgtcaaccaggggcaaacaagcccattgacatgcagggactaatgtcatcctctgcacctttcgtcaaccaggggaaagcgagcctgttgacgcgcagagactaa

SEQ ID NO: 102296 - DNA, 378 bp, Glycine max
  Peptide Sequence Number=SeqID_219074
atgacattcttgggagaaacaagcagtcagaccaatgctaactcgagattagccttcattttttccaatggatcaatcagccacaaccaaactggtgtttattttcaatgtctcactccaacaccaatgcgatttcctaatgactgttcttttgagacactcaagagtagaatgcacaacacccttcagctaaccaatgatcaattagtgtatgaaattgatgcaagctccattggagcttgtaggcctaggatcttcttcatcaatggattcatttgcttcttggaagataaatggcagcggaatggagaaggaagagagagagaggagacgtcacttcaaggagaagatgagtctagaagaagctcaccaccatag

SEQ ID NO: 102297 - DNA, 705 bp, Glycine max
  Peptide Sequence Number=SeqID_219075
atgtctacgtccaacgctgggggtgctggatccaatgattccaatgctaccaggagacaaagcaagagacccaagtactcaaagtttacacaacaagaacttccagcatgcaaacctattctcacaccaagagcggttatttcagcattcttgattgtcaccattgtgttcattcccattggagttgcttcattaattgcttcgcatgatgttgttgaaattatcgatcggtacgacttgcgctgcataccgtcaaatgtgacagacaaggtggcatacattcagactcctggagaaaagcaatgcaacaggcagctaactgtggacaagcgtatgaaatcccctatctatgtttactaccagcttgacaacttttaccagaatcatcgccggtatgttaaaagccgaaacgatgaacagctgagggattctggaaaagcaaactccgtaagtggttgtgagcctgaaaataatgcaaatggaaaggcaattttaccttgtggtcttatagcttggagcttgttcaatgatacatacagcttctcacgcaacagcaagaatttgacagtgaacaagaaagacatctcatggaagagtgacagggaccacaaatttggaagtgacgtttttcctaaaaatttccagaatggttctataataggcggtggtagcctcaatgaaagtataccaagttcagaacagtaa

SEQ ID NO: 102298 - DNA, 471 bp, Glycine max
  Peptide Sequence Number=SeqID_219076
atggtgatggtaatgatgtttgtagtggcggcgacagtagatatatcaatagtggttgtggtggcagtaggagtagcaatagtggcaacaatagtggtggcggaggtggcattggtcatggtggcaatgccaatgccaatggttgtgctagtgttggtggtagcaacggttatagaagtggtattagcaatggtggtcattgaaatgttggtgggttgcggtgacgttggtggtggggatggtgatgaaggtggtattgttggtagtggtggtgatagtgacaatgtttgcaacggtggtggtggtggtggtggtggtgtaatagatggaggtggtgacagtgacgatggtggtggcaatgacgaatgtgataatgggggtgataacaatgttgatggtgatggtggtagtggtaacaatgttggtagtcgtggtgatagcaacgacgataataaaaagtgtcaaatatga

SEQ ID NO: 102299 - DNA, 165 bp, Glycine max
  Peptide Sequence Number=SeqID_219077
atggcgagtttgctgtgcaagttgccagttcctctagcgagtctggtcacaggtttccagtttcacttttcagagggaggcacgtggttgcagctttttcagaaggaacgtttttcaagtaagggagttgtaactcccaccagcgagttagggcacaagaattag

SEQ ID NO: 102300 - DNA, 327 bp, Glycine max
  Peptide Sequence Number=SeqID_219078
atgacgtgcgaccattctttggtcctcgtgaggtgcttggcacccatcattaggcaatttgtgaaattccaggacatgccgaaaaaccaaaaaaatattgatgcacaatcccacccaggcccacttgggccctctggaatattcctccagaaggcggttgcttctggaggaagcaaccctgctcgcctgggcgagctgggcggcaaccacctcccctattttgctataaataggggaggaagtgaagaagaaaggggttcagcccctttggcacttctctctctttcgaatttgcttggaaaaattgtttccgtgaagaaaatctaa

SEQ ID NO: 102301 - DNA, 213 bp, Glycine max
  Peptide Sequence Number=SeqID_219079
atggtagctaacaaaggggttattcttaacagcattgataatccaaagggcgatcttaaaaaaagtatggataaaagtagtggcaaatatggtacttctggaaatacaaatgtgagaaaggcattggctgatgtaagcaatgttcaagaaaacttcacaacaactgttggtgttgctagctcaaaaatgaagaatcttttttatgtcggatag

SEQ ID NO: 102302 - DNA, 261 bp, Glycine max
  Peptide Sequence Number=SeqID_219080
atgccgtcccttttttcacttcacattgactctgatctcactcactcttcaacgccccgagtccgcatccccccgctgttgcagccaccaggtcgttgtcgcacacgccgcaccaccttcgcgttagctgctgcaaagttgctttcgtggctgtcgtcacctgcattgttttccacggatacacttcagatcaaaggaggacagcctcccttcccgcgactgtgtattcatgatttgcggcatcttatttcgaaaatttga

SEQ ID NO: 102303 - DNA, 666 bp, Glycine max
  Peptide Sequence Number=SeqID_219081
atgaaggagagcgcggataagcaaagacgcaatgtccaatttgaagtaggaactcaggtcttggtcaaactacgacctcaacaccagtcaacggccactggaagtcaatattccaaattggctaaaagattttacgtcccttttcaaattgtgcaaaagataggacttgtggcttataagcttgacttgtcggagtcatcaagcatacaccttgtatttcattactctctactcaagccatatctaccattcaccactcagcaggaggcccctctcagtctgccacccttgtcagaagaacaccaacccctcattactcctctggtcatccttgacactaagtggactcaattaagggaggacaaggacttacttgtcctcgtgcaatgggctagcttgctgccgaaagatacatcatgggagccttgggcacaattaaaggccgaatataaccttgaggacaaggttattttggaagtgctaggggatgttaagtgtagaaaaacacaagcagaaaaggcagcagaagcagacatagagcaacaagcagcaaggaagcaacaggggaatgtagaaacaagctacgagacaaagaagggagaaggacaaaggctaaagagggaaattcacaaaccacagtacctcagagactttgtgagcaagtag

SEQ ID NO: 102304 - DNA, 2505 bp, Glycine max
  Peptide Sequence Number=SeqID_219082
atggggaatgttagggggcttcttgctgaaagtgatttcatacggcgacataccagtggcagagtgtatggacgtgtttttctggtggataaatgcccggagatattgctcgatcacgcgattcatcacctatgtttggccgttcgtctaaggatgatacgccgtgctcatcttgagcttagtgccactgagcttgaaaagttcctgccaaaatcaactcataaaaaggggatcatgatcgaagacaaggcttctgggcatgccgtgaatctttctggtggtctccatgaatatcttagccactatagtagcagtgcaatgcgttggaagtatcccaatgtgtatccccttggagaaactgtccaccatgaccagcattgttgtgtgaccttgagaaggaggcaagccaactataaagtcgagggagaggtcctcccaaggcaagtggcgatgaataactggacatcctgcttcatggatggccaaacgaaattttcgctgatgcatgccatggatagtggagatggcctggagacctttgggaagccatatacgacccttctgaagtatgaagtcatgacgtatggagtagtcagggtattgagaaggattgtcttgaatgcagcggcgaaagtccacgaagaagggattgttgaggagttgttgtttaagttcttgcaaaaaaaaggaagtatggaatggttagaagaaaaaattggccaaagggggcttcttttggctaccgtgagagggcatcgactgctgcattggatcttccgacacgatagtgaattgtatagtcatagcctagtaatcgtgccaggcggtggtaatggcgacaagctccctgacataagtggaagcacgaaggagcttagaacagaagggtttgctgaagaaggcgattgtgtgaatggaatggagaagttcgacaagcttaagacaggggcacaacatagagctttcttcaggctgaggaaggcttcgtcaacatcaacgttccagtggaaggagtccttagccaggagagccgagttggccaattctggacagcttcgatctttgccggcattggtgccactccttggtgaggtaggatatgacctggatattccacttgagaagttgcaaaggaacacttcgaaagcttcgaaaaaaattggtgtaagctcaagatttcgaaggccttgcggagagcccaaatggcatgatgaggaattcgtagtggccatggtgcgtccgaaaggaagttttggcgatggccctgtagtctacacaaaatctccaggagtcatccctctccttaaccaggagaatagggtagcgatatggtcggacgatgactggagttgtgtggggttgaaggaggatggagtgattagtaggccgaggaggcagaagagtgttgggaaggggagacccgtatgtgaaataattcactggcaccattggtctggaccagtcgccggagttgcggtgggagatggcttccaggtcctgggtagtattgcccttgagttgaatgatcatgccaccatggacgaacttcatggtcagggagttgtagtccgtcaatacggggccaagggacttcagccaatgcattctgaggaccacatcggctccactaattgggtagattttgtggcactcaatttcattgccattgacgacgaggacacagagggccagcgtgggtgtggttgggaggttcaggtgccggaccagccgagcttgcacgaagttgtgcgtgctcccaccgtcgatgaggatcatgacgggctggtcttgggagtttggttcttcggggctcgggagaaagaagcgggaagcgcagtggtgcctgcgtgtgaacctctcatcgctattgaagcagaggtcgcgctcttgtcggtagcgaagtgggtggtgggagaggtaggggggaagatggaggtgggaatggtagggcggagccatgggtggtgcgaccgcgggatgggtggcattgttccgcaagcttatcctcctgaaggtgtgccaacctggcagcttgaacgtgggttaggggctggagggcctgtacttcatggcggatgttgggatccaagcccaagacgaagcagctcaagaggagcgatggcgttgggtcctcgtatggtgagtgagcgaagtgggtatcaatggcctgcaaaaatcccgcccaagtggggaactggtggttgcgggtcatccactggaactaagccaggggtcagtgccatcaaacctagggacatcaagtttcatttcggggttgttgataatggctgttttgggtacatcaaacctagggacatcaagtttcgaaggaggagatcctctaatttttcagtaaccgcaatttggctcgaggcaagctgggagattgcttccttaatgcattccaatggagacttagctcgaggggagtccaccatggatgaaggaaatgaaagtatcagatttgttaagaacagaatgaacttcctagcattcgaggcctag

SEQ ID NO: 102305 - DNA, 354 bp, Glycine max
  Peptide Sequence Number=SeqID_219083
atgacctttctagaaaaaggtttctggaacacctactctggaagtaacacctttctggaaagcctgttttggaatatttttcttttggataagccctttcgaaatacctttccgaaagccaaaaatcctttttggaaagcctattccggagtacaggtgcttctttcggagtgggctttccgtaagcccaatattgctttctggaacaccccttcgggtatatcattcttgacatttgcttctgaaatgaacgttccagaaaaaggttattctggaacaccttttccgaaagcttattcgttgcggaaagcctattctagaatataccttttgcttccagaaaggcctttctag

SEQ ID NO: 102306 - DNA, 336 bp, Glycine max
  Peptide Sequence Number=SeqID_219084
atggaggcgtggatttatgttatggattgtccgacagagtgtgcctatgaagatcatctgacaaagtttgaagttgtttgtgcaccctggggtgagtttgctgcctatgtcaaagaaacttggttgatcctgcacaagaaaagatttgtaaaggcattgaccgataaagtcatgcacatgggtagcacaacaaccaacagggattgggcgcatatgatactgaagttccacaaagctgtcgggattggaaagttgaaggttacatatgaaaaatactctagacaagaactcattagggctgcagcagtgaaaccgttggatagacttcccctgtga

SEQ ID NO: 102307 - DNA, 729 bp, Glycine max
  Peptide Sequence Number=SeqID_219085
atgcaaaagttcaagggtcattacaaacaagtggtatcattgaagaaaagtggttgcacagataacaatgtcatgcttcatgcatatgccatttggaaggaaggtgaaggtagtgattttggtttggaacatgcttggcgacttctgaaagatcaaccgaaatggttagatcagcttactgaaaattgctttaaaaggacaaagatttccgcatttggggcatattcatcgtcatttaatccagaaacactggtagaagattctaaagctgacacactacctcaaattttacatccaatgggacaaaaagcagccaaaaggaagagaaaggggaaaagaataagaacatctaccaatcatgtggacttgactggtgtggaggaagcaatgagggaaagaaatgttctcaatgccagactagcagtcctaagggagaaagaattggaaaatgagtactatgacattctaatgaaggacacttctacaataatggatccaaataatgacttcgacagagtttggaaacaatttttttatgaaacacttgacgatgatagttatgaacaaatcatgagctacttatgtgcgatgcaacaacaaggaggaaacaacagtcaaggcagaagacctagaagagttattcatcgtaatcgtgaagatggacatctacgattgatgactgactacttcttagaaaatttggtatacacagagactcaattccaatga

SEQ ID NO: 102308 - DNA, 144 bp, Glycine max
  Peptide Sequence Number=SeqID_219086
atggagataatgctgaagaagctaccccattcatctcatcttctaagcaacgaaggaaatcaagggcaggacaacaacggcaacaggcaacagagaatatttatcctcagttgcacaagagtgaaaggcaaaaatgagatctag

SEQ ID NO: 102309 - DNA, 240 bp, Glycine max
  Peptide Sequence Number=SeqID_219087
atggtggttcgtggtggctactggtggttgtgggtgatggaaaagaagtttgggacgctagaaatggttttggaagaaggaaggagaaggaaatggcgtttttccaaggctacacgaaaagcaaagtctaaaacactcaagtgcttctgctcgcgagaaaggaagcgttcctcacacgccagatgtcttatcgaagattgcaatggtcagatcgtggacatttgtcctatgaacctctag

SEQ ID NO: 102310 - DNA, 745 bp, Glycine max
  Peptide Sequence Number=SeqID_219088
gccaatagcatcggcacatagacaattgacagctacaactgttgtagaggatgttgagaatgtggataatgctactgacgagcctcatgaaaagcctcacaatcaagttacagaggatgtacgtggtgattcatatggttttctaggcggatccctagatacatcagtgttgatgccatatgttgttcatgtggcaaccaaattgtgggcggagaggaaggtgaagaaatttggaaggcttgcacctgagattgaaggcatagtagttgttgcaagattaaattctctgattagaattcttattgttgataatcttaagtcaaaagagaatattgtggtggaaggggaggctgtaggggtggtttgtgaggatgaagtcaataagggaaaggtggttgatgggcaacctagtgaatcaggatgggctcatgaacaattggttcatgtttctgttaagcctaaggataggtcaaattattggtgtttttcagctatctatggtgctcctaaattgactcaaaggaaagcatttgatgcaatcctacccccaagggtattggatagaagaatccaagagcattgggctagagatactaaagaaggccctagggttctcatgaacctcacgggacttttcaagtattttggcataggggtgagcttagctattatagggggaagcttctcaaggaagtttctcaaggaagtttctaaaggaagattctcaaggaagtttctcaaggag

SEQ ID NO: 102311 - DNA, 554 bp, Glycine max
  Peptide Sequence Number=SeqID_219089
atggctggcaagattcaactctggctactcttgaaggatccaaacatgaccaacatagtaggtcttctagccccagctatggctttggctttgccattggctattgctgttgtcgtcgcccgtcaaaaagtcgggtgcatgatgacacaatcactctacgatgcctctctcagcatctttctcttcctacgaggggccttcatcgaggaggaaggagggttgcgcctagcaacgtatgatgtttgcgtcatggagtttgagggtattgaggttgaggactgtgtaagtgcaagcgacaatgaggattgtgttggagaggatagaaagttcataatagatttgggcaccacaggaggaaaaagattcactaacctcgaagacgggagaagaagaggccgtaactgggaggaagaagaagaggccgcaaccgaaagtgtagagaagtcacaggagaagaataggcaatgcggaaatgaagcgaggaagaagaattctcagaagaagaagtcgtttctctcggaggaagaagaagaagcggtttctggaaatgaaca

SEQ ID NO: 102312 - DNA, 252 bp, Glycine max
  Peptide Sequence Number=SeqID_219090
atgatagggaggtggctagtctggaatcttgtacatggccaaactatctcaacaccctcttcagacgataaggcctcacttagtcctacatttggtgaagccaaagaaaatggtttgttgtgcgaagggcctcacacccctgtgctccttatgtggacactagatgagaacatccctctgagagatggttgtagaggtacgacaatgcagctactccccatgtgtacttatggcaagcatccaggttcctga

SEQ ID NO: 102313 - DNA, 249 bp, Glycine max
  Peptide Sequence Number=SeqID_219091
atggcggagtcacaacaacatatcattcccttaggcgatgttatgccacttgtgggtcctttggcttgcacctctaattatctgccttggttttacaaggtttcccacccctatgtcgttccactggaggagggacaaccaccacgtggtcttcttctagagacaaagcctaagccattccccatgactcaggctctgataccaaagcagacaaatcgtatattagaaataaagctggtagttgcttga

SEQ ID NO: 102314 - DNA, 303 bp, Glycine max
  Peptide Sequence Number=SeqID_219092
atggaaaaaggaggttatctaatttatggcactgctcatatgcattcaggtgttgtaaatgcaactttatatggacaggatggaaggactttatgtacatcaacaccaaaatatggaacaggaaaagaggctggaaatgagaaaggttatctcattggaatgtctgtttgttatccacaaccgggttcaatcaagattcatgatggtgaaattttgactctagaatctagatataaaaatgagtttcgtactggagctatgggacatttctacatctatttggcagaggaactaccacaatga

SEQ ID NO: 102315 - DNA, 528 bp, Glycine max
  Peptide Sequence Number=SeqID_219093
atggagttgtgttttcattgtacattgtacgatggaatcgtgattccattgtgggcgaggcgtggagctttgggtatgtggaacacgagactgggattaaggccattaagaagggagttgggggagaataacgatggtcgtgaaggcgccaccggtgatgatgttttttggttacgagcctggatcgaaggtggtagctttcttagatttgaagttagcgtcgacttagcttatgctaacaacaacaatatgcaaagtctgttattgactgacatggtagtgatgatgtggcaatctcggtctggtgtggctgctttggttgcgaaggaattaggtaatcttcaaggaagggtctttagatcaggaaggactttgtcaattgctcaaattaacttcttggagatgggtcaaagcaaggtcgaaaggattcacgacttccttctacaaatgaagcgtccatccttctttgtgtttgtaacgtggcatggccatggtggtcatgggtgtgcatatattgccatgctatag

SEQ ID NO: 102316 - DNA, 510 bp, Glycine max
  Peptide Sequence Number=SeqID_219094
atggcttctgttgtttctcagtcctttcctaactccattgttgagaagcttaatgattcaagctatctccattggagacaacatgttgagcctgtgatcaagtcgcacaagttgcaatgttttgtgatcaaaggatttgtttatgagctcgctggtgttggagtgttggttcgtcatgaagagtacacctatgcgcttcttgaaggatttccttccgattatgcgcctgttgtctctgttattgagagcgagaagcatacgtcttccattgtcaaaattaggacactactctacggttatgagattcgccttgttcgttacaagggatattcaaaccctaatttgtacaaatctactaattctgatggttttcgtggttcgtatggtcgcggaggtagtaactgtggtggtttcagtgatcgtggtggcattaatggtggcactggtcacagtggtggtgtctgcagcaaaggtcacggtggtagcaagtttcccaactttcaatgctag

SEQ ID NO: 102317 - DNA, 414 bp, Glycine max
  Peptide Sequence Number=SeqID_219095
atgcaggcgattccggctccatgcccgcaagtattttccgctatggccgaagaatttatgaatggctttgttcatcaaaacggcatcgctgtcataacccacaatcccctaaaggcgattccggctccacgcccgcaagttgctgaggacgagtttttaccgcaacacattcacctcaagcgattccgactccatgcccgcaagttgctgaggacgagtttttaccgcaacacattcacctcagtatttttcgctatggccgaagaatttgtgaatggctttgttcatcaaaacggcatcgctgtcataacccataatccccccaaagaaaatcttcccatattgcatatgggaggagaatatctgttaatttcagacaagttctcacaagtttccctgattgtcaggttataa

SEQ ID NO: 102318 - DNA, 273 bp, Glycine max
  Peptide Sequence Number=SeqID_219096
atgtttggtggtatgcgggaaaaagagagggttttgggaggagaaaggggaaaaacgaaaatgaggagaagaggaggcatcatcggtgttaaaactgacctaacatcgttatttatacctaggttgtgtataaataaaacttgcaaatggagagtcatatccacccaatatttcataccgcttttgaagaaggttgtctcaacaggtgctccagtacaaccattacctccaatgttatcatctaaactggaattggagactgtcctggcctag

SEQ ID NO: 102319 - DNA, 352 bp, Glycine max
  Peptide Sequence Number=SeqID_219097
atgatgagccaaaacaaccagcttagcaccatcgacaacgtgtccttgccgacgaggagggagttcaatgtgatctatcacaacgctgtggcgctcagtggagaggatggtggtgttggagggggaatacggtgcgggggagtagatcgagatgacgccagattgggagttgcgggtgaggttcacggagccgaagttgtcggggcacgaccaatggtcggaccaggagaggaactggaggaggacgtggtagtgaaggatgttgacaagggtggccatggagaggtgttgacgatagaggtggtcgttaatggtgaggtaggcgttagggacgataagaatggagagcaag

SEQ ID NO: 102320 - DNA, 591 bp, Glycine max
  Peptide Sequence Number=SeqID_219098
atgagggttactcttgatggtgtccactttaagagaataggtgctttggagaatggcatgctttccaatagttttacagaagatgaaataaaacaagtagtgtggggttgtaatgggggccagagcccagcacttggtggccacttgacaaccggtcatagagatgagaaacaaattgtcatcgtggaagaggaagaatctttcttttggtgtgagaaagtccgacatgagtttaatgcccataaaggtttaagacaagatgatcctcttgctcctttcttattccttctggttgccaagggcttaagtggtttggtgagggaggcgaaagaaaaagatttactttcaggcgttgaggcggataccatgttcttcattaaacctaatgttcaggatgtaaccactttgaaggtgattcttcggttttttgagttggcgtcgggattgaaagttaacttatttaagagtaatttggtgggcattcacttggataattcagaagttcttcattttgcggtcattttgaattgtaaaacggtgaatgtccctttcacgtattggggattgtcggtgggagtagatgctaagaag

SEQ ID NO: 102321 - DNA, 666 bp, Glycine max
  Peptide Sequence Number=SeqID_219099
atggagcgcggttgggagaaccgcgggtcaactgctgcgttgaccactctcttcgggaaacggatgatatccggtcattggaacgtgaccgatgtctgcaacgggctgttaggcggcttcgccgccataacagccggctgctccgtcgttgagccatgggcagccatcgtgtgtggttttgtcgcttcagtggttctgatagcgtgcaacaaattagcagagaaggttaagttcgatgatcctttggaagcggcgcagttacacggtgggtgtggcgcgtggggggtgatattcacggcgctgttcgcgaaaaaggagtatgtgagccaggtttatggggaggggagggcgcacgggttgttcatgaggggtggagggaagttgctggcggcgcacgtgattcagattttggttattgttgggtgggtgagtgcgaccatgggacccttgttttgggggttgaataaattgaaattgttgaggatttcttccgaggatgagcttgcggggatggatcttacccgtcatggaggatttgcttatgcttatgaggatgatgagtcgcacaagcatgggattcagctgaggaagatgctggaaattgaagattctgctggaagatgcgaacactttgatgttgaactctgtaattttccttatggctaa

SEQ ID NO: 102322 - DNA, 312 bp, Glycine max
  Peptide Sequence Number=SeqID_219100
atgacaaccgtgatggtggtggtgataatagtgatgctagtggaatggtgctggtgtgacaatgacaatgataacgacgatggaggcgacagaatgatggtggtagcagagataaaatggtggtggtgtcaacgacaacaacagtggggtgaaataatggtagcagcggtgacaacgacgatagaggcaatgaaatggtggtggcaactgtggaagcaatatcttccaagcaacaatggtgatggtgacgatgacagtggtgtcgtgacagtggaagcaaagtgcaatggtggtggtggaagtaatggttaa

SEQ ID NO: 102323 - DNA, 618 bp, Glycine max
  Peptide Sequence Number=SeqID_219101
aagcacggatctacggaagatttctcaagccttccttacatttgcacattgcttaattgctccttatggacttactatggaatcataaaggctagagagtacctcgtggctactgtcgatggctttggcattgtggtggagacaatctatgttattctatttctcatatatgctccaaaagggataaggggtagaactctcattttggctgtgattttggatgtggcaatttcggcagtagcagtagttactactcaattagcattgcaaagagaagctcatggtggtgttgttggtgttatgggagcaggcttaaacattgttatgtatttctcacctctctctgccatgggccctctttatgttgcaatgtttaaggcaattggaatcatctttgcagtcatcatgggaattggctttcttggtggctctatctatcttggaagtgtgcttggagcagccatagcggttattggtttttatgctgttatttgggggaaaagccaagagcaagcaaaggaagagtgtgaagtctatgatgactcggaatcatactcgccgttgtccctcttttggagaacaagagaatggaggaataaaatcatagcaatcatttaa

SEQ ID NO: 102324 - DNA, 261 bp, Glycine max
  Peptide Sequence Number=SeqID_219102
atggctagtacctggtcatttagagccttcaccagctctccagcattcccttcagctgccactgattacgctagagaccttcttagagcaggtcgcttggccaggggtccagcttctctctattggagggggggggctgacacctctggcgctagagatgatgctgagggtagtgacatagatgccagtgctgatgatgattatgttgcatacatccctgccgccctgggagcttgggatccttggcctactcaagactaa

SEQ ID NO: 102325 - DNA, 597 bp, Glycine max
  Peptide Sequence Number=SeqID_219103
tacgttcatgatgaatcagaaactttatctgatattgatgatgaagaagttgatttgtacattcatgatgaggaggggaagcatatcaagaagatactgtgggaaacagcaaatagggagtatcttggtgcagccaaggaaacagctgcagcagctagcaagaaagcttttgaggcaaaatttgaaaactgttcggaggatatactagcggcaagagagcttgctgcatcttctactgaagctgtggcaaaatccaaaaaggcagccaaggaagcagctgcagcagctaacaagaaagcttttgaggcaaaatttgaaaactgttcggaggatatactagcggcaagagagcttgctgcatcttctactgaagttgtggcaaaatccagaaaggttagaggtgttcatgttagaggttatggtgttcatgggatgttgatgcgtgattggctggattgttgctgggtgggtgcttgggtgacttggcctgttagagctgatggtatgtttgatcagcacggttcagcccaatccactgttaggtgggtggtttgtaactgtccagaacagacgagtagaaaaggaactcaaaagtga

SEQ ID NO: 102326 - DNA, 315 bp, Glycine max
  Peptide Sequence Number=SeqID_219104
atggggacaggtcggggagtcggggtcgaagattggggaaacaatacccgtccccgcctcgccccattgccatgtctaatatggaaatctcttcaaaactcacgcattaggatacatactcatgtcatgaatgaagcaaagggaatagttcctggctaccccgaatccatgaggaagatactagggactaacattgctgaggttcatggtgccatgcataaacgaattagagggtcactattatctctcattggtccaattgcagtaaaggatcgtcttttgccagaagttgatgagttcatgagatcaccttga

SEQ ID NO: 102327 - DNA, 348 bp, Glycine max
  Peptide Sequence Number=SeqID_219105
atgttatggatgaagaaattcttaaatgagttaggacatgatcaagacgattatatggtgttggatgaaaagaaactaaaattagagaaaatccatatagacttaaattggtctgatatgatgaccaagacaataccaaccaagaaggttgaagactattgtcaaggtcctagtatagtggtgcacaccaattatgtcgtaagggggagatttgttggaaattcctccataattaagaagtcacacccctctcctataaatagggaggcttgcgaggagttggagcatcccatctcatcctatcgaaaagagaagcaaagcaagagtgatagtgagagagagttctag

SEQ ID NO: 102328 - DNA, 321 bp, Glycine max
  Peptide Sequence Number=SeqID_219106
atgtctgaggaacggatcggctgggatgactacaagaatatgagcctaactcgtgcggtgatacttgaaaccatgagattggttagtgttgttgctagagtgatgaggagggccactaatgatatagaatcaaatggttttatgattcccaagggatggagagtttacttttacacaaaggagactaactttgacccgttcctctatgaagaaccttttacttttaatccatggagatggctggagaagaaaggcttgaagtctcataatcacaacatgttgtttggagcaggaggcagggtgtgtcctggaaaggaatga

SEQ ID NO: 102329 - DNA, 246 bp, Glycine max
  Peptide Sequence Number=SeqID_219107
atgggggcgcttagcgcaagtgtaagagaaaaaaaagtacaagcctcaggaatatggtggcttagcatgaagtcgtgtgctaagcctatgcaccaatacttcaaaaggcactggggcttagcgcgaaggtgcgtactaagtgacatagctccatgtggagcttataggccttggatcttcgtcatcaacggagtcctttgcttctcgaagatgaatgaaagcagaatggagaagaaagaaagatga

SEQ ID NO: 102330 - DNA, 228 bp, Glycine max
  Peptide Sequence Number=SeqID_219108
atggcctcgaagaagcgtcatgctaggcccagtcgacctcaagggaggaacacgcatgggattcctcccggtttatatttgaggttgcctggctcccctatcaggacaatgttcatctccggaacattcttccggagaggaacgtggagctcccgcccacattatatgattaattctatgaagagctgcaaaggaggtagtggcacagacgactcacctttctgctaa

SEQ ID NO: 102331 - DNA, 2001 bp, Glycine max
  Peptide Sequence Number=SeqID_219109
atgctcacctcgaggcaatccttgtacatctcttctccttctccttcttcttcattgttttgtatcattctcctccaacttacatttctctatggccttgccttctctgcaaatcatgaagcctcaacactcttcacatggctccgtagttcttcttctgcatcaccaccaccaccccctcctttctccaactggaacctccttgatccaaatccatgcaactggacatccataacatgctcctcactaggccttgtcacagaaattaccatacaatccatccctctagagcttcctataccctccaacctctcttcatttcactctctccaaaagcttgttatttctgatgccaatctcactggagccatcccttcagacattggtgattgttcttccctcactgttattgacctcagctccaacaaccttgttggctctattcctgccagcattggcaagctccacaaccttcagaacttgtccttgaactctaaccagctctctggaaaaatccctgtggagttaagcaactgcattggcctaaaaaatcttctcctttttgataatcagataagtgggactattccacctgagctgggaaagttttcacaacttgagtctctaagagcaggagggaacaaagatattgttgggaagattcctgaagagattggagaatgcggcaatttgactgtgttggggttggcagataccagaatatctggttctttgcctgcttctttggggagacttaaaaggcttcagacactgtccatctatactactatgctgtctggtgagattccacccgagttaggtaactgttctgagcttgttgacttgttcttatatgaaaatagcctatcagggtctattccatctgagcttggtaggctcaagaagctggaacagttgtttttgtggcagaatggtcttgttggggctattccagaagagattggtaactgtacaagcttgagaaaaattgatttctctttgaattctctgtctgggactatacctgtgcctttggggggtcttttggagcttgaggagtttatgattagtaataacaatgtgtctggttcaatcccttccagtctttcaaatgctaaaaaccttcagcagttgcaagttgacacaaaccagctctcagggttgattccaccagagcttgggcagttgtcaagcctcatggtgttctttgcttggcagaaccagcttgagggaagcattccctcctctttggggaactgtagtaaccttcaagcactcgacttgtcgcgaaacacgctcaccggtagtattcctgttagcctattccagctccaaaacctcacaaaactacttctgattgccaatgacatatctggtttcataccaaatgaaataggcagttgcagctctctgataaggttgaggcttggaaacaacaggattactggtagcattcccaagacaatagggaaccttaagagcttgaactttttagacctctccgggaaccgcctctctgggcccgtgcctgatgagattggaagctgcactgaactgcaaatgatagatttcagctgcaacaacttagaaggtcctttgcctaattctttgtcttcactatctgcagttcaggtattggatgcatcttccaacaagttttcaggtcctctactggcgagtttgggccatcttgtttctctgagtaagcttatccttagcaataacttattttctggacctattcctgcatcattgagcctatgtttaaatctccaactgcttgatcttagtagcaacaagctcagtggaagcataccagccgaactcggccgcattgagactctagaaattgctcttaatcttagttgcaattcactcagtggaataatcccagctcagatgtttgctcttaacaagctttccatattggacatctcacacaaccaattggaaggagatttgcaacctcttgcagagttagacaaccttgtctccctcaat

SEQ ID NO: 102332 - DNA, 420 bp, Glycine max
  Peptide Sequence Number=SeqID_219110
cgtgagagagaggctgagggagagagttctagcaaagtcaaggagatagagaacggttttcccataaaggaagaaaaattggaaggagaaggggttaagcgtggctcgcttaacgcaccaaggatgatttcctttggtcttctccctcaaaatttatttgaatttcaaatttttttacacatagaacttgcgcttagcgcgagcgtgcttgttaagtctaattcgggaaattccaaacccaagaaggttttgggcttagcgacattagatgtcgtgcttactgaattaaatggtggaagttgtagaggtgcacaatggcttagcgtgtcagttacgctttgcatgctggtacgctatgcccaattcaaaagaatttcagacaaagaagaatttaggcttagcgcaagtggtcgaccttaa

SEQ ID NO: 102333 - DNA, 177 bp, Glycine max
  Peptide Sequence Number=SeqID_219111
atgactagagtaatcaaacttctagtcatcaacaagggtaccctcaaaagtgtagaggatgacaaggatggtggaattggtgccagggatgctctggtggctctggaacgtgatgttcgatgtgccacagcggaggaggatggacccttgcgcttcttgaatgattctgccatttga

SEQ ID NO: 102334 - DNA, 327 bp, Glycine max
  Peptide Sequence Number=SeqID_219112
tgctaaaagtggtagttgcgctcagctcaccatttgggctcagcgcgcatccatcgctaagcgcagcttcagcacacttagagcaactgaagaatctggcaaagcatcaacatcaaggtcgcacgctaagtgcgaaatcagtgcgctaagtgcagcggttgtcttcagccaggctcaacgcatgattggcactaagctcaaatccacttactcacgcgaagcagggcacataactttttacaacaattccagagcacaccaaattgcctatttcgagaaaagagctctggaggcagcaagaggagcagcttttacagagagacctag

SEQ ID NO: 102335 - DNA, 279 bp, Glycine max
  Peptide Sequence Number=SeqID_219113
atgcgtctaccggggaaggagagtctgctgatgaaatcccccataaccataaatgagattttggatgttagcatttcgtttctaaatgaccatttagaggaaacaccgggttcgacaaaaatagaagaaatccactcaaagtgtatcaatctcgcacagggtaaggtttatggtgagtcaggattttggctcaaggcttgtagaatggctagacatgatacatgtcagggtttggtttggttcaaggataaaaagggatgccccacattatttccatga

SEQ ID NO: 102336 - DNA, 155 bp, Glycine max
  Peptide Sequence Number=SeqID_219114
atgggaattttacggaagcattacgggtgtcccggaagccctggaatcccatttttcaacaaaacgggggctttcgaagaagttacgaaaactcacggattgcgaaaaacacctcctttcgatttccgtcacattacggaattttcacggatcac

SEQ ID NO: 102337 - DNA, 167 bp, Glycine max
  Peptide Sequence Number=SeqID_219115
atggcggtgcgtctgttgcccgctaccggccatccccaggctgggtccactgggtgtcttgcgggcgcgatccctgcaaacaatagatggtatcagaaatcaattgaaccatatgtatacttacctatgtcacgatggcatgacctcgctgggggaacgggcaccct

SEQ ID NO: 102338 - DNA, 894 bp, Glycine max
  Peptide Sequence Number=SeqID_219116
atccaccagacgaggttgagacagttggtgaccccagttttcaaattcatcatttgtcttataatgctttaaaaggctcatcaggtcttggaataatgaagtgcagattgggagtgcagattctactagatagtgggagttcagataacttcctccagcctagactagctcaatgcctgaagttacctgtagaaccaattcctaatttgcaggttttggttggaaatggaaatgccttgactgctgaaggattaattcaagacttggaggtgaaaatccaaggtcatacactgaagctaccagtttacctacttccagtttctggtgctgatctagtgcttggggctgcatggttggcaacaattgggcctgatctttctgattatagtactctgacattgaagttttacttggtctttgatgtgccatcagctgacatgctcaaggaagggattattgcccctagcagaagccctttttcacctccaatcattcttgtcaagaagaaggatggcacttggagattttgtacagattacagggccttgaatgccatcacaatcaaagatagctttcctattcccactgttgatgaactaattgatgaactacatggggcagtatatttctcaaagcttgatttgagatttgctttcaggacacatcaagggcattatgaatggcttgtcatgccatttgggctcactaatgcccctgctacatttcagtctctcatgaatgagatcaattacttgggccacacagtatcaggcaagggagtaacaatggatcaagaaaaggttcaagcagtcctgaattggccatatcctataaatctgaagcaattgagaggcttcctccgtctgactggatactacagcaaacttatcaaag

SEQ ID NO: 102339 - DNA, 273 bp, Glycine max
  Peptide Sequence Number=SeqID_219117
atgccattgcctagcactgttcatgcatcctccaccaacgagcctggagccccacgaagcgttgttcatatgtcctccacctacgagttgggagccatgcgtactgattgcttagtgcaattctccatcctcgccttttttccggagccccatgaatgtcattgcctagcgctgttcatgcaccctccaccaacgagtctagagccccaagaaggtattgcgtaccactattcgccaattctccattctccactttttttcggagccccatga

SEQ ID NO: 102340 - DNA, 326 bp, Glycine max
  Peptide Sequence Number=SeqID_219118
atgggtgataaaggtgcagagacaaattctgcgccctttgtcattcataaacgggcgatcgtgtccggtggcatgcagagacaaattatggtcattctgcgtcttgtatcaaccgagaggaacaaattcgacaatatcaggatgatgtctcgttggcagggaggttcactggctgaagggtgtttcgctcgaacgaaattagtgtcttatccttacttcccttttatctccaataacagacaagtcacgaggggcaattgtcataccctaatttcgtctggggaccatccgttgttgggatacgaccctcgtttgaccacttcgag

SEQ ID NO: 102341 - DNA, 654 bp, Glycine max
  Peptide Sequence Number=SeqID_219119
atgttccacctgcaattaagcgagttgacgatcacgttggatgatgtggtgtcactcctacaccttcccatcactggcgcactgcatatgttcgagccgcttgttacttcagatgcgattggtctactgacgaagcttcttgagctcagtcatgaggaggctacatttgagacccgacaggctggtgggcctcatgtccggttgggggacctggcccaggcagggggattcgcctggggagtggctgcattagtccacatgtacgaccatctgaacgacgcatcacaggcctctacacggcagctgggcggttatattacacttctccagtgctggatatacgagcactttcctacagtgcatacattcgtcgttcatgatgcttatgatgaggggagcccacgggcctgcaggtggcttacgagtaaggctcatatgacggggatcaagggagccccgtatcggagacgtttggatgccctgactgtgactgacgtgtgctggatgccctatggtgagcaccggggagtcagggcctttgacttgatatcgtcgtacaccggccagctcagatggggtcagattgtggtgtacgttcgacctgagcgggttcttcaacagtttggctaccttcagacgaaccctccgccgccg

SEQ ID NO: 102342 - DNA, 318 bp, Glycine max
  Peptide Sequence Number=SeqID_219120
atggtggatgaagaagaaggagaaaagcaacccacagaaagtgagaaaaatctgacctttgaaatgctaaaatcctgcctcggtttgcgtgccgtttctctggttccagttcctcgcgtttctctgcgtccgtcggggccagttttcgaagaaatttccaagatgtcacacatggcatattatctcggcatcgaagtaaaacaagaagacaaaggaattttcatcacccaagaaggctatgccaaagaagtccttaagaagttcaagatggatgacgccaatccagttggcaccccgatggaatgtggaacaagttga

SEQ ID NO: 102343 - DNA, 420 bp, Glycine max
  Peptide Sequence Number=SeqID_219121
atggatccgaaaaagctttccacgaaaaggtctaggagagacgccatggcggaagggtccagtgccgcccccgagtttgatagccactgtttcccgagcgccgagcaccagcagtgctttcaggctgcagacgcaccaccaccacctcatcaggccgatcccactggatcactaggcatggagcgttatctacagcacttggttcggcagcaggcggccaaccaccgggggcagggtttcgctccttttgcatgccctactccagagcagtttggggctgaggtcgcatggcccggagatttgcccgaggcccaggcaggggaggagcccacaggatcccccgatgaggcagaggaggcccgtatggatgaagaaatgacggacttgcttggtttcttgggaggaagcggagccacgtga

SEQ ID NO: 102344 - DNA, 312 bp, Glycine max
  Peptide Sequence Number=SeqID_219122
atgaagtcaggtgacatgtggggttaccttatggttatctgcacctttcgtcaaccaggggcaaacaagcccgttgacgggcagagactaacatcgtcttctgcactttttgtcggcctgacccgtgaagtcaggttttactctcgttgtccgaaaacattaaagcctaacgacgggcgagattcttctctgctgggcagggacgatcgagtgcaatggcatagggaagtgtcgtggttgtccaactttgtcgcttccgagacactgaactttgttgacgtttctgatgcctcttcttttctttctaaatga

SEQ ID NO: 102345 - DNA, 912 bp, Glycine max
  Peptide Sequence Number=SeqID_219123
atgacaactagtgatggtggtggtggttgtttgctccccggtgatagctatccagattggttaaccttcaacagcgaaggttcatccctgacttttgaaatccctcaagtgaatgggcgtaacttgaagaaaatgatgtgccatgtccattattcttccccggaaaatataacttcagatggtttgaaaaatttgttggtgataaatcacacaaaggccatcattcaactttataagagaaatgcattagtctcctttgaagatgaggagtggcagggggtactatcaaaaatagagcctggaaacaaagtgcaaattgttgttgtcttctggagcaaattaactgtttacaagacaacaatttatctcatatatgaaccaatgaatgaaaaaatagagcattcccgtgcactaaataagaatgtaatggattctagtggtgaagaaaatgaatgtgttgttgggaccatctctcttcaagtagaatccatatataagccaacaaatgacataatggagcattgtcatgcatcaaataagaatgcaattgtttccagcagtgatgaaaatgaatgtgttgttgggaccatctctcttcaagtagaatccatatataagccaacaaatgacataatggagcattgtcatgcatcaaataagaatgcaattgtttccagcagtgatgaaaatgcatgtgttgtcaggccgttctctcctcaacacgtacgcagtgatgtggcggggatgaacatggtttccaaattaagggaaagattgtttatgctagattcttggttccttcaacctgacttcctcgacatggatattattggcatctctggtaatgcctttttcactttacttggtgcccctgattgtttgttaattagcaaacttggattgacaccatag

SEQ ID NO: 102346 - DNA, 144 bp, Glycine max
  Peptide Sequence Number=SeqID_219124
atgggtgcaagggattcatcattcatgaacaagacgcaagttagtgaattatggcttagcaagctgggcgcactgatcgcgagaagggacaaacgactcgctgggcgagcttgtggcgcgctaagtacgcatatctttggctga

SEQ ID NO: 102347 - DNA, 312 bp, Glycine max
  Peptide Sequence Number=SeqID_219125
atggtaattgttagggctaggggacctgatacttctactccctcttcttttgctcctcctgctccagctccaccaccagcagcaccctccggtacctccgctcaaagcttagacgctatggtgtcgatgctgcagagccttcaccagggcttatgcctggtgatgcaaagcattcataacttggctcagcatcggcccatcatcagcacggaggatttcatggcccaggtggcctggccaggagtccagtcttctcctttggggggagatgttggacaagtggcctcagatatcttaagaagggggggttga

SEQ ID NO: 102348 - DNA, 225 bp, Glycine max
  Peptide Sequence Number=SeqID_219126
atggctcctcttgttctctctccagcttccttgtcagggcttcgaattttccactcatcaccactaaacccaaaaaaagaaccaacatcaatcaaaggattgtctagtagaccagcaagtagtacaatgcacgttccataccattgctctaagcaactcataacagatgatgcaaggcttaacttagcaaatgaccacaaatccctgaatgccatccatgaataa

SEQ ID NO: 102349 - DNA, 243 bp, Glycine max
  Peptide Sequence Number=SeqID_219127
atgggtgaaggcaactcttcatcgtccatgctggcaagctattcgtgctccgggatactacttgtttgtgtggatgtgaaatctacaggcaagtgcaccgagttgtcaaatatttcggtgttctatgctgaaggctcaagtactaaacaccgatgtctcattactgcactccgtgtccagacatacggtaacctaatcctgctctatcaagttctaaggagacaatacatctttcaatgctaa

SEQ ID NO: 102350 - DNA, 249 bp, Glycine max
  Peptide Sequence Number=SeqID_219128
atgattggatcaggtagtccaggaaatgatgctttaataggggaggttgctaaggaagctcgggaccgtgctgctgacatgggtgtttacaatgaggagttagtgtacagcagaaaatgtgtgtcattagaatacaggccatcgattgttgatgaagacttagaatcaattccactgcccatcccatcacttccaatctcctctagagaatgcaggaggagtgatacgacaccttatgcttcaaagaag

SEQ ID NO: 102351 - DNA, 2430 bp, Glycine max
  Peptide Sequence Number=SeqID_219129
atggatgaacctaatggagaacagacgaatgaaagtgaggctatcaaaactattgttgaaaatgttaagcgtttgttagacaagacagagttgttcgttgctgataatccagtcggcgtagaaccacgagtccaggaaatgattgaactattaggccaaaaacaatcaaacgatgttctactactcgggatgtgggggatgggaggcattggtaaaacaactattgaaaaagccatttacaataagattggccgcaattttgagggaaaaagcttcctcgcacatattagggaaatttgggagcaagatgctggtcaagtatatctacaagaacaacttctatttgatatcgaaaaagaaacaaacacaaagatacgtaatgttgaatcaggaaaagttatgttaaaagaacgacttcgccataaaaaggtacttcttatacttgatgatgtaaataaattgcatcaattgaatgttttgtgtggaagtcgtgaatggtttggttcagggagtagaataatcatcacaactagagatatgcatatacttagagggagaagagttgacaaagtgttcagaatgaaaggactggatgaagatgaatctattgagctttttagttggcatgcatttaagcaagcaagtccaagagaagattttattgaactttctagaaatttagttgcttattctgcgggattgccactagctcttgaagtccttaggtcctatttgtttgatatggaggtaacagagtggaagaatgtattggagaaactcaagaaaattcctaatgatgaagtacaagagaaattaaaaataagctatgatggtttaactgatgatacagagaaaggaatattccttgatatagcttgtttctttatcggaatggaccggaatgatgttatacatatcttaaatggttgtgggctttgtgcagaaaatggaatacgtgtcttggtagaaagaagccttgtaactgtagattataagaacaagcttggaatgcatgatttgctgcgagacatgggaagagaaatcattcgttcagaaacaccaatggagcttgaggagcgtagtaggttatgttttcatgaagatgcacttgatgtattatcaaaagaaactggaacaaaagctattgagggtctggctttgaagttaccaagaaataatacaaaatgtttgagcactaaagcttttaaggagatgaaaaaactcaggttgcttcaacttgctggtgtacaactggttggagatttcaagtatctttccaaagatcttagatggctttgttggcatggatttcctttagcatgcataccaacaaacctttatcaaggaagtctagtttccattgagctacaaaacagcaatgttaatcttttgtggaaagaagcccaggtaatggagaagttgaaaattcttaatctcagtcattctcattatttaactcagactccagacttttcaaatttgcctaatcttgaaaagctattactcgtagattgtccaaggttgtccgagatttcctataccattggacatctcaataaagttcttctattaaattttcaaaattgtattagccttcgtaagcttccaagaagtatctataagttgaaatctcttaaagcactcattctttcaggatgtttaaagattgacaagttagaagaggatttggaacaaatggagtctttgacaacccttattgcggataagactgcaataacaagagtgccattttcaatagttagatcaaaaagaattggatatatctctttgtgcggctatgaaggattctcacgtgatgtgtttccttcaatcatttggtcttggatgtcaccaacaaatagtctctcatcccgcgttcaaacatttctagatgtgtcatctctcgtttctttagacgtgccaaatagtagttccaatcatctatcatatatttctaaggaccttccactgcttcaaagtctttgtatagagtgtggctcagaacttcaactttctctagatgctgcaaatattttggatgctttatatgccacaaattttgaagaattagaatcaactgcagccacatcgcaaatgcataatatgaatgttttaacattaattgaatgcaacaatcaaaatatgacaactagtgatggtggtggtggttgtttgctccccggtgatagctatccagattggttaaccttcaacatcgaaggttcatccctgacttttgaaatccctcaagtgaatgggcgtaacttgaagaaaatgatgtgccatgtccattattcttccccggaaaatataacttcagatggtttgaaacatttgttggtgataaatcacacaaaggccatcattcaactttataagagaaatgcattagtctcctttgaagatgaggagtggcagggggtactataa

SEQ ID NO: 102352 - DNA, 558 bp, Glycine max
  Peptide Sequence Number=SeqID_219130
atggctcgtgaaggggagactgttgttacctctggattgcatccaacagagaagagacacattgatgataggttgatgaagagggggacaaggagggaccaagggtctattacaaacaatcaaaaaaggaaatggtgggcactgctgaccagccccgccaagaatcttgagaaccttaagctggaactgccattggcttgggaacccatgggcagtgagagctcttcgtttgaagcattttggcttgatgatgtggaggaaggtgagttggaggagcttttaaggcttgaggaggtcctttggaagcagaggttgaaggtggagtggttgatgtatgtggataggaacacaactttctttaatagaaaaatatcccaccgaaagcaagtcaataccataaagaagattcaggatgatgatggaaatgtgtataggaatgtagaggacattggtgaggtattaacaaagtatttctctgatctttttacctcatctccacctcatgacatgacagaaattgcaagccttgtggaggggagaaattatggagagatgtga

SEQ ID NO: 102353 - DNA, 2259 bp, Glycine max
  Peptide Sequence Number=SeqID_219131
atggcttccaatagtcattttccctcaaatcttccaattctaaccggcaagaacttcaacagatggagtgtgcaaatgaaagccttgcttggatttcaagatttgatcgatgtgattgagaatggaatagaaattccaaaagaaggagcctcagattcacagaagaatgaattcaaggatatgaagaagaaagactgcaaagccttgatgatcttgcatcaatgtgtcgatgattctcactttgagaaaatcgcaaatgctaaatccgcaaaggaagcatgggacattctgaacaaggcttatgcaggagctgataagatcaagaaagttcttgcaaattcaatcactagttgtggtgatacaattactaatctgacgttagttgagaaagttctgagaaccctgaatccaagattcgatcacattgtggttgcaattgaggaatcaaaggatttggaatcattatctgttgatgaattacaaggatcacttgaggcacatgaacaaagattgcaagaaagagcaaatgataaggctacagaacaagccctgcaagcacaccatcagtcaagaaatggtggttctgataatcgcagaggcaagaaaggaagagggagattccagaacacaagaggtagaggaggttactccaaagataaaggtaaacctcaacctgatcaaagaagtggagataactgcagtaaaagaagtggtggttctagtactcgtggaagaggaggcaaaaagaaatgggataaaagaaatgttgaatgcttcaattgtggaaaaaaaggtcactatgcagaagaatgctggtatagggagaaaaatgttgttgatgatgcacaattagccacaggagctgtttctgacactgaactagtgttgttgatggtcacaacaaagactggagctgatgcagaagatcaatggtacttggacacaggatgttcaacacatatgactggtcacaaggactggtttgttagccttgatgagtcagtaaatcacaaggtcagatttgcagatgacaacactataagagttgaaggtcatggcaaggttgtgattaaaagaaaggatggtatagtgtcatacattgaggatgtgctctatgttccaaacatgagatgcaatcttctgagtcttggccaactacttgaaaagaaatacagaatggtgatggaggacaaagaaatgaagatctatgacaaggacagaaggttgatcatcaaagctccattaaacaggaatagaacttttaaggcacttgaatttcaaggatttaagtcaactgcacagaatggctcaaggaatacctcagctgagatagatgacagaaaattgcagagaatgcctggagtgcaagcaaccaaggaatgcatttcagaaatttgtaccaataaagtcaacacagaaattggaggtatcactcacgagttcactccaccttatacaccacaacacaatggtgctgctgaaagaagaaacaggactatcctgaatatggtgaggagcatgttgaagactaagaagctacctcatttcctatggagtgaagcagctgcaacagcagtctatatacttaacaaataccctaccaagagactgaaaggagtgacacctgaagaagcctggactagtactaaaccaaaagtgaataaactcagaatttttggttcactttgttataagcatgtccctgagcagctaaggcagaaactggatgataaaggtgaacaaatggtccttataggctatcatgcaactggaggttacaagctacttgatccaaggtcaaagcaggtctctgtgagcagagatgtgatatttgatgaactaaaggaatatgagtggaaggaggaccctataaacaatacaaccaagattctggtacattcattcattccagaagaattgagtgacactactgatgaactgcctacaaggaacactgaaggaggaaccaggaggtctcaaagggttatgcaaccctcacaaatgttgaaagattatgaagtcatgaaagacagccaaatcacagatgaaggtgatattgtacactttgccctatatgcagatgttgaacctatgagtttcgaagaagccttgaagaatgacaagtgggtcaatgctatgaaagaggagttgaaatcaattgagacaaatcatacttggaagctaatggagttacccaaacttaaaagacctattgctgtaaaatgggtttttaaagtgaagagaaatcctgctagtgaa

SEQ ID NO: 102354 - DNA, 291 bp, Glycine max
  Peptide Sequence Number=SeqID_219132
tctttctttgacgttgttgttagcagttttgagtctggttaatgtcaaggccaaatatgggtggagtgacaaaagcttcacttcacttcttcagtaccagaagattcatgcatgccctaatgattgcatattatacaaaaatgagtctgaagaaatgcacaattgccccaggtgtgggatatcacggtacaaagtgaaggatgatgatgagtgtagcagtgatgaaaacaccaagaaagggccccccagcaaagatgtcatggcatcttccgatcattccaaggttcaagc

SEQ ID NO: 102355 - DNA, 201 bp, Glycine max
  Peptide Sequence Number=SeqID_219133
atgtgcgctaagcgcacgtgcacgaacaaggccacctatttaagcctaaaatcagatttgcaaagggagtttggagttgttcttgaagaagcctctacatgcacgagaatctggccctggcttgaagtttttgcatgtttaggaagttctagagagagaaagagatgcgagttcaaagcggaagccgttctgagaacttga

SEQ ID NO: 102356 - DNA, 939 bp, Glycine max
  Peptide Sequence Number=SeqID_219134
ggtgaaggtcaaggtattggacccagcagtcctcagggatcgagtcaaagaagttcatctgaagaacacttttccgatgaagaggccatacaagaggctgaagctggaggttcagacattttcccagcgtcttcgacatctaagctttccgctagcatagggatcgcagaggatacattcattcaaatgcaagacgaagaccctgctgcagcccttcgactcctgctgaacaccagtcaagccaacacctcaagtgaaaagaatcctggtgcttcgtcctcatctgatgctgatataacctctacagtacgccaagattgcctgcttttgaagttatcaatggaatacgcacgggcagacgtacttaaatccattgaagagaacccttctgctgcttttgggcacctgaactttttgaagaaattgcataacccccttacttctgatgagattctgggcaaagttatacaaatcgagtccattatcgatcaatttgcaaatactgtgcagaaaaaacgcgaaaatggcgccagactcgatgcccagaaacaggcacatatccttctgctcgagaaagcccgagcggctcaacgtgaagtcgagcgtctcaccaaagaagcgaaagaaggatcttctgagatcaaagcctgtgatgataacatctcctcctgggaggcaactattacaaatttgctgtctcacgtcgatgatctaaggcagaaaattgtaacagagcaggccaagcgcaaagaactccaggagaaggccgctgattcgattcagaaacttgttgctgaaaaagggagggaaggcttaaaggccttcagtgcatctcaagcggtagcagatgaggcgagagctatggagagtgctgaccaggttttgagcaaagagatggccaccttgaagaagctatatgaggatttgatcatgacttag

SEQ ID NO: 102357 - DNA, 711 bp, Glycine max
  Peptide Sequence Number=SeqID_219135
ctttgtcacagctttgagggcaatgctggtgcactcagaaattttgaggtccttgatttcttacgagctaaaggagcttcaaaggatccaacaagagttattgccaaagtagcgcagtttgaatacaaggtttatgattatttggttgacactgttgcctccactactaaaaaacttgttttttacgacgcacattctaaggcgaaccgccatcctattctttcttttataatactaaccctagcttcatgccacacctcaacttctctcttccacctcgcatatcaacaatcttcctcttctcctcaccttcacctttgtttccccttcttcccctcgtcactcctctccttcttcctccctctccccccaagctcccttcctccttcgcctccgcctccaccgctccctttcctttcctctcctttcccttcaaacgaatgtttcttcatgtcggactcagccaacaagttgcaaatggtgcgttgcccagagtgtcaaaatcttcttctcaaactcactgattactctgtctatcaatgtggtggctgtggtgccgttcttcgagcgaagcataaaggttatgtgagtggtagcatgttggatgaggggaagaacgggtggtttttggcggttgatggaagttttttctttttaaaaactgccgttcatggaagttttagtaacttccatgtaacttccaaccgttga

SEQ ID NO: 102358 - DNA, 927 bp, Glycine max
  Peptide Sequence Number=SeqID_219136
atgttgatccgcatgttcttgtccaaccggcattttatctccgcgcttctggcgctcgccatcggcctttggctgccgggctccgtgctggccaggcccgatttggaacgcaagatcggcactaccgtagccgatagcgattctgcggattatcgtttcagcgatctgcgcttcacctccgccgatggccaacggcattaccgtgtgcgcatcgcccagccgcgtcgggcgcctgcgcctgacggctatccaacggtttatttcctcgacggcaatgcggtgctgatggagttgaacgccgccttactggccaaattggcagcggcgaagcggccgccggtgctggtgatgatcggttatgacaatgatctgcgcatcgatgccgccggccgcgcctacgactatacgctccctctgccggcaggcatgaagaaagcgccgcgggccggcgggggcgcggatgcgttcctgcaattgattgaaactcggatcaaaccggcgatcgccgccaaactggcggtcgatccgcagcggcaaacgctgtggggccactcctacggcgggctcttcgttctgcacacgctgttcacccatcccgccgccttccagcgctacatcgccgtggaaccctcgctgtggtggggtaacggcatgatcctgcaagaagcgcagcagatgacggaacgacgtgcggtgccggcgacaaggctgcaactgtgggttggcctggcggaacgcgatcgcgcggctccgcccggcgtgaagagccccactctgccggcagatgcaacgcatttgctggccgaacagctggcgcagctcggcggtctcaccgtcggctatcgggagtggcccgccttagggcacggcgccatgctgggcgcggccatcgagccggcgctgagcagcgtcatcgcagaagactga

SEQ ID NO: 102359 - DNA, 393 bp, Glycine max
  Peptide Sequence Number=SeqID_219137
atgttaaaacgaaaggatgtacctcaatcgataagtggcagagacgaactcgacaaagatgaactccacaatgtgcttgcagtgacggcaggttcagattgctctatgcattctaaagctgaagcactagaacatataaagaaaagagatacaggccatcaaagtgtgtcattggagaataagacaggagattcaactgtgctgaagataggagattcggctgaagttgtgataaaacaagacatgaagggaagaaagcataaatatgggtttaacaacaataaacatgagaagccagagaacataagggtggtggatgatgaaactggtgacaaacatcagttggatgaagtcctaaggatgccatctacatgtgtatttctcaagatgtag

SEQ ID NO: 102360 - DNA, 105 bp, Glycine max
  Peptide Sequence Number=SeqID_219138
ggggccctataccccgggttcatgaggaatttaaggagtggaggtgaatctatgatcatgcctaggtctcccgacttgcatgataatagtgaaaaccgcgtctag

SEQ ID NO: 102361 - DNA, 369 bp, Glycine max
  Peptide Sequence Number=SeqID_219139
ggtggacccttgggtactagtaccctcacttttagaggtctacacgtcctcgccatcagagggctacacgcccttgccttcagagggctacacgttctcacctttagagggttgcacgtcctcgccttcagagggctgcacaccctctcctttagtgggctggacgtcctcaccttcaaaggtagtttccttttgtcagttcctgggccaccccctgatattggagggcaaccaactgtgcgagcacaaccaaagagggaggctatcacgcagctactatacatatcggggcaagatttcacccgtgccactgcaaagagacgagtgtggatcatgcgcgccaacatgaccactcttacacagatatag

SEQ ID NO: 102362 - DNA, 319 bp, Glycine max
  Peptide Sequence Number=SeqID_219140
gaagaagtacggttacggaatcttgctggaaattgaggtggcttttgacttttctattgtgattttctgttatcatgggatcagctttgttgtgttgctgcaaaggatcctaatcttcctaacagaactggtggatgaaagtttgcatagagatgttgtgtgttcgccatcatggagctttcaatgggatagccgggggcgtgttgctgatgaaattgagaatccttcatatcacacatcccatgtggacagtagaaattcccctgttgatgaggcattggttgcaaatctgatgaccccctcttctggtaaatgctaa

SEQ ID NO: 102363 - DNA, 300 bp, Glycine max
  Peptide Sequence Number=SeqID_219141
atggcaacacccgtggaggttatagagatctcatcttctcctgcttcaccgaccttatctttgtcaccacctacgtcagatgcacctacagaggcttcttgggatctcattgagcatgtagtggaaaccacgaagtttactaaaagggaaaatgcatgcttattcataatagattttagggtgccaaaacccccttctcctcttatcggttacacctctttcgactttgtgaagttgtcatgcctcctctggcgatctcgccgcaactacacctctggtagtcgctgctttctcacgtaa

SEQ ID NO: 102364 - DNA, 1134 bp, Glycine max
  Peptide Sequence Number=SeqID_219142
atgattgctatggggataactgctgtgatcaaagcaagaagaaccattagagatgatgattcggaattggggaactcgtggccgtggcaatgcatacctttccagaagctaaacttttcagtgaatcaagtactgagatgtttaattgacagaaacataattgggaaggggtgttctggtgttgtttataaagctgcaatggataatggtgaagtcattgctgtgaagaaattgtggcccacaacaattgatgaaggagaggcatttaaggaagaaaaaaatggagttcgtgactctttctcgactgaggtcaagacccttggctcaatccgtcataagaacattgtcagattcttggggtgctgttggaacagaaaaacaagactgcttatttttgattacatgccgaatggaagtttaagtagtctacttcatgagaggactggaaactctttggaatggaaacttaggtacagaatcttgttaggcgctgcagaaggccttgcttatctgcatcatgactgtgtccctcctatagttcacagagatatcaaagccaataacatcctcattggtcttgaatttgaaccttacattgctgactttggcttggctaaacttgtcgatgatggtgatttcggtcgttcctccaatacagttgctggctcctatggatatattgctccagaatatggctatatgatgaagatcacagacaagagtgatgtttatagctatggcatagttctattagaagtcttgacaggtaagcaaccaattgatccaaccataccagatggtctacatgttgttgattgggtgagacagaaaaaggctcttgaagtgcttgatcctagcctactctctagaccagaatcagaactagaggaaatgatgcaggcattgggaatagccttgttgtgtgtgaactcatccccagatgaaaggccaactatgagagatatcgtggcgatgctcaaggagataaagcatgaaagggaggagtatggaaagtttgatgtgcttctaaaagggcctcctgcgaatggtgcatgttggaataaaagcattggtggagttctgccaacatcttcatcagtaccagtcatgcaaactttgaacacaaagcaataa

SEQ ID NO: 102365 - DNA, 186 bp, Glycine max
  Peptide Sequence Number=SeqID_219143
atgatagatggagaggaaagtgtttcgactttcttggtgtatggtatggtcatggctagaggtggtggaggggtcgtcggacgtggtgtacgtgtcgttggtggtaaaggcatcactagaagtggtggaggcatagctagtgatgtggagagggaaggaagaagaataagaaagcgagagttttga

SEQ ID NO: 102366 - DNA, 1374 bp, Glycine max
  Peptide Sequence Number=SeqID_219144
atggctacgcttgccgattcttttctcgccgaccttgatgaactatctgataacgaggctgaaattcccgaggataacgatgtggatgccgcagacatggaagaggatgtcgatggcgaccttgccgacctagaaaacctcaactatgatgacttggacagtgtttccaagttgcagaaaacccagaggtacactgatattatccagaaagtggaagaggcacttcataaaaaggagtctgaggtcttgtttcaggtggtggatatagaagatgatcctgaataccagctgatagtggattgcaatgcactgtcagttgacatagaaaatgaaattgttattattcacaactttattcgggacaagtatcgtttgaaatttccggagcttgagtcgctggtgcatcacccgattgattatgcgcgtgttgttaagaagataggaaatgaaatggatctcactcttgtggatttagaagggcttttaccctcggctattattatggttgtctctgttacagcatcaactacaactggcaagcctcttccagaagaagtgcttagcaagacagttgaggcctgcgatcgagctcttgatcttgactcagcaaagaagaaagttcttgatttcgttgagagtaggatgggctacattgcacccaatctttctgctatagttgggagtgctgttgcagccaaactcatggggacagctggtggtctagcatctcttgcaaagatgcctgcttgtaatgttcagcttcttggtgccaagaaaaagaatcttgctgggttctccacagcaacatctcaatttcgtgtaggttaccttgagcaaacagaaatatttcagactactcctccttctctaaggatgcgagcatgccgactcctggctgcaaagtctacacttgcagcacgagtagattctatacgcggggatccatctggaaaaactggaagggctttcaaggacgagatccacaaaaaaattgagaagtggcaggagcccccccctgctaagcaaccaaaaccacttccagttcctgattctgagcctaaaaagaagagaggtggtcgtcgtcttaggaagatgaaggaaaggtatgcaataacagacatgaggaagttagccaataggatgcaatttggagtcccagaagagagttcattaggagatggtctgggtgagggctatggaatgcttggtcaggctggcagtggcaagcttcgtgtgtctgttggtcaaagcaaacttgcagcaaaagttgctaaaaaatttaaggaaaagaattatggtagtagtggtgctacctctggtttgacatcaagtcttgcattcacaccaattttctcctgctctttaggaccataa

SEQ ID NO: 102367 - DNA, 252 bp, Glycine max
  Peptide Sequence Number=SeqID_219145
atggataaggtggaggagtttaatagagaaagggagttgcttacgaaacttctcttgcaagaggaagcattttggaaacaaccatctaaggtgatagatataaattggctggagaatgagcagagtagaaggatagaacacaagaggacatttttcacgtgtagtgttaactctggatgttgggaatgcatacaccttaagcatgtgatcgaacaattcattccaactgtagaatctaacattgccctctag

SEQ ID NO: 102368 - DNA, 909 bp, Glycine max
  Peptide Sequence Number=SeqID_219146
atggttttattaaaagttgtcaaaagaagttggaagcttgggggagtaggattcagagtaggtttagggatggcattaagaggtttatttgctgatgggaatggaaaccatggtgttgttattgataaggttagaagtataattactactgatgacaatttgaagttggtgaggcccttcatgaaggaagaactcaaggaggccactttgctgatactaccagatggatttaatctgggattttatcacaggttttggggcatgtgtggggaggatgtttttcaggcgtgttgtatgtggcttgcagagggtgcgttcccttcatcagttaatgatactaccattgctatcatattgaaatttgataatcctagagtgttggctaagagattgaagaatgtgttggataaatgtgtctctgaggagcaatctgcttttgtatctggatctattaatgataatgttttggttgtgtctgaaattctgcatgctatgaaatgtaaaaggagaggaaaacaaggggatgttgctttaaagattgatattagcaaagcttatgataggattgactgggactatgtgaaagctatgcttagcaaactgggttttcacactgactttgttggatggattatgctttgtgtctcatcagtgatagttttctcttctaaaatacatcaaagagaagctatggcagtgaagcgaatcctggatgactatgttgttgcttttgggcgagtcatcaatctgcaaatatctgaggtaactttcagtaagaatgtggaccataatatgaagaaaagggtgaaatctactttgggagtgagtgaaagtaatggaggagggaagtatctgggtttttcagcttgtgtagggaggagtaaaaaggccatatttaattttttttaa

SEQ ID NO: 102369 - DNA, 1425 bp, Glycine max
  Peptide Sequence Number=SeqID_219147
atggaaactagtgaatggcatatcgagcgaagatctagcttcggctctgaatcccccttagcaagagaggcaggaaatgtgcctgaaactgggtcactctctattgtggtgcttggtgcttctggtgatcttgctaagaagaagacatttcctgcacttttccacctatacctgcagggattcttaccaccagatgaagttcatatttttggctatgcaaggacaaaaatctctgatgatgaattgagaaaccggttgcgcggctatcttgttccaaagaaaggtgcttccccccaacagttggaggatgtagagaagtttttacagctgatcaaatatgtaagcggctcttatgattctgaggatggcttccgcctgttggataaagagatttcagagcatgaatatttgaaaaacagtgttgagggtttatctcggaggcttttctatcttgctcttccaccttcagtatatccatcagtttgcaagatgatcaagacttgttgcatgaataaatctgatcttggtggatggacacgtgttgttgttgagaaaccttttggtaaggatctagaatctgcagaggaactcagtactgagattggaaagttgtttgaggaaccacagatttatcgtattgatcactacttgggaaaggaactagtgcagaacttgttggtacttcgctttgcaaatcggtttttcttgccactttggaaccgcgacaacattgacaacgtacaggttctttgcttggttgctatggaaaaaccagtttctctcaggcctgagcacattcgggatgagaaagtgaaggttcttgaatcagtgctccctattaatgatgatgaggttgttcttggacaatatgaaggctataaagatgacccaaccgtacctgatgagtctaacaccccaacatttgcaactgttgttctgcgaatacacaatgaaagatgggaaggtgttcctttcatactaaaagcagggaaggcactaaattctagaaaggcagagataagggttcaattcaaggatgtccctgtctatgtgaggagaaataaagggaaaggttgtagatatgtgagcaaaggggtcaagcaacctggactggagatgtctacggttcaaagtgagcttgacttgtcatatggacaacggtatcaaggagtaaccattcctgaggcttatgaacgcctaattcttgacacaattagaggtgatcagcaacattttgttcgcagagatgagttgaaggcatcctggcagatcttcaccccacttctgcacagaattgatgaaggggaattcaagccactcccctacaaaccaggaagcagaggtcctgcagaagcagatcagttacttgaaaaagctggctatgttcaaacacacggctacatatggatccctcctaccttgtag

SEQ ID NO: 102370 - DNA, 438 bp, Glycine max
  Peptide Sequence Number=SeqID_219148
atgattgactttcaaattgaaagtggattttcttgtcttattgtccctgtgtccgttatttatgaatccttatttcaattacggattgaaatatttgacctgacatacttagtggttgctaaggatccttctggaaaggatatcaatgcacttgagcagcacattaagaatctcctttgtccatccactccattttttttcaacaccctttatgacccttacagagaaggtgctgatttcgtccgtggatacccttttagtcttcgtgagggtgcccccactgctgtttctcatggcctctggctcaatatacctgattatgatgctccaacacagcttgtcaaacccctcgagaggaacaccaggtatgtcgatgctgttcttaccattcccaaaggaaccttgttccccatgtgtggtatgactctggcatcgatc

SEQ ID NO: 102371 - DNA, 783 bp, Glycine max
  Peptide Sequence Number=SeqID_219149
atgccgggttttagggcgaaaattaggattggaattttgattattgttgtcgtagggatttgtctcgctgctttgtatggcttgttgaagcctatttcgaatggatgtattatgacctacatgtatccgacttacattcctatttcgtcatcggagagcatttcgccggtgaagtatggcttgtacttgtaccatgaggggtggaaaaagatagattataaggagcatcttaagaagcttagtggtgtgcccgtgcttttcatcccaggcaatggtggcagcttcaaacaggcaaggtcctctttcttcttgttcagatttagtcgaagttggtttgcttttatggtgcgatcattggcagcagaatctgatcgggcatatcagaatggcccccttgagcctacattttaccaagaagcttccctaagacctgaagaaggaggtgtagatataaatttatctggtttccaattacccagccagtacaccagcaggttggactggtttgctgttgatcttgaaggtgaacattctgccatggatggtgcgattcttgaagagcacactgaatatgttgtatatgctatacacaagattttggaccaatataaagtgtcttatgacgctcgaacaagagaaggtgctgcagtttctgggagtttgccaaaaagtgtgatattagttggtcattcaatgggaggttttgttgctagggctgctgttatccaccctcgtcttaggaaatcagcagttgaactgttctacactttcaaccccacatca

SEQ ID NO: 102372 - DNA, 607 bp, Glycine max
  Peptide Sequence Number=SeqID_219150
atcacctcccgtggcattgcagccttcattgggccattactttgcacgtgtaaattcagaatggatagaaggatataaggttcaaaccactaacacagggcgttatgtgtctgatccagtactctctcatgttgtagttgtatctatttctggtgcatataatgattatcaggtacggtcaaaattaacatcacttgataatattgtgcccccaacccatggcttcatgatcagtagtacagccatgaaaaatgtgtggttgtctatggaacatcaggctattttatggtgtaatcaattggttgtccaagtatcacacacacttcttagtttgatagattccagaactggccaaccattgccagatactcaaaagagacttgcagtttttgcaagaatgttgcgtagtggaatatcacataatttcgactggatgatgcagttaccctcttgtaaacggttactaaacattcctgtccagaatacaaaagatgtcactgctgttgaagcatttgctaataatataatgttaaattatgctttatgggcacagaagatagcttttccattatttccatgtgttttcttctgtaacaagtcatcttaa

SEQ ID NO: 102373 - DNA, 229 bp, Glycine max
  Peptide Sequence Number=SeqID_219151
tgctttgaaaggacttgatgatactctacaacctaaatccaaggctgctgctaggtggattgttgttaagctgctcccatcgggatggatcaagttgttctatgggcaaggaagttgctctatgggaaatttcgccattaagttaggtgttaatactgtgtttgaagctgagatgttaggagctatcaatgcagtggaaatagcttgcaatatgaattggaataattga

SEQ ID NO: 102374 - DNA, 273 bp, Glycine max
  Peptide Sequence Number=SeqID_219152
atggcctacctaagagaagggcactttcacttgttgattgactatcatctccccttgctcattaagccattgaagtttctaaggctttggatggggagtgatagtgatgcaatcctccctaggaagggactagtcactagagccatgagcaagaggctccaagaggattgggctagagctgctgaagaaggccctagggttctcatgaacctcaggggtagatttctgagcccatgggccaacgttgggtccaattatctttgtacatattag

SEQ ID NO: 102375 - DNA, 2154 bp, Glycine max
  Peptide Sequence Number=SeqID_219153
atggcttgtaagggttcaaatggaaaaagtcattttgtgcttgtgaccaatcttgagccatgttctggaattagacttcatttgtggcctgaaaaggggaaatctactacaagtatacctctcaatgatagggttgttgaagtaacatcaaagatgatgcacattccctcaggtccagcaccacggcagcttgaacctggcagtcagactgagcaagctccaccatctgctgtattttggttgggtcctgaagatatgcatggcttcagatttcttactgtctcagttgcacctcgtccgactatttcaggaagacccccgccagcagcatccatggcagttggacagttctttaacccagaggaaggaaatcaagagctatctccatggtttatgctgcaatctacctattctcagaaggatttggttttggaggaagctcatcctctagctgtcaaactatcatttgccatcagtttgggtcttctacctgttactttgtctttgaaaactgtcagctgtggaattagaaactctggacttcccgaagaggaagccggagaccttgaaagtagtagtttcatggcatcaagggagtatgtgggttttgtcgtaactcaaccccacaaactggcttgttggatgagtgagacccctaaagaggctgctaacaaggtttgggcttatgaagcacaaaacttctcttgtttgaagtgttgccgtgccaaacacgtttctgaaaggctttgcaaattgcgctgtttcccacctgttgcacttgcttgggatgatacatctggtcttcatgtatatccaaatttgaacagtgagacaattgttgttgattcctccccagctcattggagttcaacccagcaatctgaaaaaaccgttgttcttttgctggttgacccacattgttcttataagagtagcatttcaatttctgttagtgctgctgcaagtaggcttctactgttgtatagtccaaagatagttggtttctctattgctgttgttttctttgctctaatgcggcaagcatgttcatgggatcttgatctgcggataccatcaatgctgactgctgtcgaatccaatttgacactaatatcacatttctttcccctagccattctacccattttcttttccttattcctttcattgttgatgtctcagccacttcctccattcgccagcttcatcagcatctctctaatttgttatatctttgcaaacggattcatagctattctaattttgatttctcacttggtattctttgtggctgctgttacacatattttcatcaagacaaggtggcaaatgtgggaacggaatgttagctttttttttcttcgttggtttgttaatcgttcgtctagcttcttttctctaaaggtggttagggttctaagagcaaatccagtaattgttacggcagttactgcaatggtcttgggaagcttggttcatccatcctttggtctccttatacttctcttctctcattttctctgttgtcacaacgcattatgcagcagtttcctgacagcatcttgttgcaaccacgaacagaataatgaaaattttgattgtaactgtgaagactatgtggggtctgaaaggctgaagttcaaatttgatggtagtttcaagcggactttcccttcagaagacaattcctccagcagtccagattcatcaaaaagttttggtgagacacaattagatttatttcaccatcgccatggcttgttgatattgcatcttgttgcaacgatgatgtttgccccatccgttgtagcttggatccagaggttggcgttgggtgagagcctcccgtggctcctggattcagtgctttgcatcggcgtcattcttcatggcatctgcaactcgaagcccgaattcaattccttcttcttgtcctatactgggatccccatccgcaatgttaggctatattttatctatctcatagctggatactggtcctatttttctggtctcactttggctccctacagagcgttttatgttatgggtgctgtggggggcatttccttcgctttaaggatgttgtgtagacggaacggggaaaagaaagaggttacttatagcagccgaaagcattctcacaggcactga

SEQ ID NO: 102376 - DNA, 267 bp, Glycine max
  Peptide Sequence Number=SeqID_219154
atgatacgcggaggtgccttacggttattcgcacccttttgtcatccagaggcggcgggcccgatgacaagcagagaccaaatttggtcattctgcacccttgtatcatccagaggcggcgggcccgatgatacgcggagatacccaacggttattcgcacccttttgctatctgaacgacaagtcatggtcacccgcgactctcgtcaaccgagaggagcgaaattagtgtcataccctaattttcgtccggggacctttgcttga

SEQ ID NO: 102377 - DNA, 379 bp, Glycine max
  misc_feature (12)..(12): n is a, c, g, or t
  Peptide Sequence Number=SeqID_219155
ttggactttggnttggttcgatcggtccgcctccggtgtgcaccggtcggctcgtcccttctgccggcgatgcgctcctgtccttaactggccgggtcgtgcctccggtgctgattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 102378 - DNA, 240 bp, Glycine max
  Peptide Sequence Number=SeqID_219156
atggcagaagagaaggcaatgcctcctcgttcttcgttttcgatttgcttccaaggccaatccggagaccagtaccggacagcccaagccccagagttcagcagtcaagtttgtagcaactccaattctagctgcataacctcgaagccagacgccctatcttcctcgatcccactcatagctactgattttagatgcggaaccagagcagagctagagagtctcagccttggtgaatga

SEQ ID NO: 102379 - DNA, 351 bp, Glycine max
  Peptide Sequence Number=SeqID_219157
atggagagagaaatgataaccatgatagtagacatgttgccagtgttctactatgagaagatggtgggttatatgccctctaatttcacatatttggtgtttgcgggtgagaggattgaggtgggcttgagaaggggaaagttagattatgccgctttcgcaagcacaagaaataggaggttcgaagcaggtggagccaaggagaaggagggagacacccatgctgtaacttcaactcccacatggcctaaatcccaacaaacccctcataaccccactaaccaatattccccgctgatcgaggccgtacccaaatcaaataaacatgaaaatgcaataactaggaagtga

SEQ ID NO: 102380 - DNA, 174 bp, Glycine max
  Peptide Sequence Number=SeqID_219158
gtgaaaaataggctaagttatgaagtgccaaaagcgacagttgagcttagctcagtagttgggctaagcgtgcatccaccgctaagtgcagcttcagtgcgcttagcgcaacagaagaatctggtagggcatcaatatcaaggctgcgcgctaagcgtgagatcagtgcgctaa

SEQ ID NO: 102381 - DNA, 376 bp, Glycine max
  Peptide Sequence Number=SeqID_219159
tcatctttgtggtatttgctggaatgacaaatttcactgtcactttcattatcatacagggaggaggttctttgaggagttggatagagatggggatggccaagtcttttggttggaagcagttcttatcattaatggaacagaaggagccaacaattcttcgtgcatatacttctctatgtctaagcaagtctgggacactgaagaagagtgaaatattggaatcactaaagaatgcaggactccctgcaaatgaagacaatgctgttgctatgatgcgatttctgaaagcagacacagaagaatctatttcatatggacatttccgcaatttcatgcttctgcttccctctgatcgtcttcaagaagatcccag

SEQ ID NO: 102382 - DNA, 465 bp, Glycine max
  Peptide Sequence Number=SeqID_219160
atgtggtccttattggaccaaagcaatgtcaaatctataggacctcctccaaacggggctctactacctattgctgctattgtcaagccaactcaacatcacgacatggtgatgcagtcacaagtcattgcctctttgcctgcgcttttaagacataggcaatatgcttcattcctagtcggtggcattgacaatgaacaaggagacgccattgtgcatcgatgcgaccaccatgagcggattgattcagtacaaatgatagtggagaagaggccaaaggtgaagtcaccggaatattgttccacatttgatttgccaccttttgaagattatgatgctactgttaggatcaaagttcaacggttgctatacataaagatggtgatgttctcaacgtttaacaatggaattgttgatgaggaaattgttgaatcaagcttctcaaacacatatgtagaatactga

SEQ ID NO: 102383 - DNA, 237 bp, Glycine max
  Peptide Sequence Number=SeqID_219161
atggataggatagggcttaagatcatgtatgatgcatggaacatgtctgtgattaatggtgtaatcaacgcctttatcaggagatggcacaatgagatctccttattccaccttccaattgaagagatggaaggagagccaccacatagtcttgtatgtattctaccacaacctcagccacaacctagtgctagtcagataccagattatgtatcaggtgttgtttactcttgttag

SEQ ID NO: 102384 - DNA, 216 bp, Glycine max
  Peptide Sequence Number=SeqID_219162
atgtttaaccctagcacacaagactgtgtcgtcaccaccctccattgtgccattgaatcacctctattcactggcgttgcacctcaccaccaacaagtggcggtgcacgacattttgataatggaggttaggtcaccaacatttgggctaatgattatggaggataaggcggtgcaatcggtttggtgtttggaggtgtgggtggtggccgtttga

SEQ ID NO: 102385 - DNA, 1224 bp, Glycine max
  Peptide Sequence Number=SeqID_219163
atgttaggagttcatggaacaaaacgagaggtgctgagcatggagcaacatttgccacaagaattggtatcaaacatcctctcaaggttgccagcaaaagacttggttaaatgcaaacgcgtttgcaagtcatggttcgatctcataactgattatcactttgtcaccaatcactatgttgcttacaacaatctcatgcattaccaaagccaagaggagcaactcttggtcattggaagaccctttgtttctgcactaaaaactcacatttctcttctttcttgcaacaccaatgatccccaaaaaaaccatatttcttcttcttctcttttgaaccttccttgtgaatataacaactctgagcacaagtactggtctgaaatctcgggtccttgcaatggcatatacttcctagagggaaaccctaatgtcttgatgaacccttcattgggacagttcaaggctttgcctaaaccccatttgagtgcttcacaaggcacttattctctcactgaatattctggttttggctttgaccccaaaaccaatgattacaaagttgttgtcattagggacatttggttgaaggagacagatgagagaaaactcgggcattggacagctgagttgtatagccttaactcaaattcttggagaaaacttgatgatgcttctctcccacttccaattgaaatttggggttcttctaaggtttatacttatgtcaacaattgttgtcactggtggggctatgatgttgatgaatctggtgcgaaagaagatgctgttctagcgtttgacatggttaatgaatccttcaggaagatcaaggtgccaagaatacgtggttcttcaaaagaagaatttgcaactctcgcacccttgaaggaatcttctacaattgctgtggttgtttaccctttaaggggacaagagaagtcctttgacgtgtgggtaatgaaagactattggaacgaagggtcttgggttaagcaatacactgttgaacccatagaaacaatttacaagtttgtggggttttatggaagcaatcaatttccttggagcagtagcggtaatgatggattagtggggtgtgattatgaacctgagtcggaaaaaataaaggatcttcagtatggccatggagagagtgatgattctgctgcggtaaaggatactaaagagatcaaagttgaaattattaaaggtcatcgcatataa

SEQ ID NO: 102386 - DNA, 1197 bp, Glycine max
  Peptide Sequence Number=SeqID_219164
atggagaacaaaagaatggtggcgaatgaagaacagaggcgcagccccagaaaccagaaggtcccattaactgattccaatggccaaaacatggcaaccctttttagcccaaggttcaaatccgcggctgctatggctggttgggatgaagaggcactgttattggctagcctcatcgttgaagacacgccagatagagatcccaagcacaagaagcgctatgttttgcactccaaaaccccaccaaactcatcaaggaaacgtagagctcagaggagtccacaagctccaatccctgtagtacttgatcttgatgcagaagaaactcccaaaatagatagtgggagaaagaagaaagaaaagaaagcttgtgttgagaatgagggaaagaaagcgtgtgttgagaatgagggaagcaaagtaggagagggtggtaatgaatcgaaagagaagaacccaggtgacgcttcatctagttcttctcttccctgcattgataaactaagggatgagctttcctgtgctatttgtttggaaatatgctttgagccaagtaccactccttgtggtcacagcttctgtagaaaatgtctacgatctgctgcagacaagtgtggcaaaaagtgcccaaaatgcaggcaattaatcagcaatggaagatcatgcactgtgaacacagttctctggaacacaatccagctcctgtttccacaagaagttgaagcaagaaaagaagctagtgccttgaatagtcgccaacaagctcaaaacctgagtccagagtcagcattttttgcttacctaaggaacgacacacaacctttaagggtggcatcaagcagaagcacgaattcaatgaggagtgggacaacagcaacaacaacaacaacaacaacatcaacacaggaaaatgaggatgctgcattggctagaatgttgcagagagaaattgatgagcaaagaagcctaggaacgactcgaactcggttggcgagattgagggcaagaagaggaggaagaggggtttctactagccaacatgaggatgcagctttagctctaaggatgcagagagaagagttcatgcaaacttatagagggagcagccaggaacagtctagcaggctaacctcaacatcattagctagagaaaatttgagggctatggcatctagagccatgaacagaagaaggtga

SEQ ID NO: 102387 - DNA, 374 bp, Glycine max
  Peptide Sequence Number=SeqID_219165
atgaattctgcaccctttatcattcaagagcaacaagctgagtggataaacgcgcatagacaaattatgcaccctttatcattcaggaacaacaagttgggtggtaaacgcgcagagacagattttgcgccctttatcattcaggagcagcgagtcgagtggaacaacaagttgggtggtaaacgcgcagagacgaattctgcgccctttatcattcaggagcagcgagtcgagtggaacaacaagttgggtggtaaacgcatagagatgaattctgcaccctttatcattcaggagcagcgagtcaagtggaacaacaagttgggtggtaaacgcgcagacacagattctgcgccctttgtcattcagggaca

SEQ ID NO: 102388 - DNA, 217 bp, Glycine max
  Peptide Sequence Number=SeqID_219166
atgaatgagcatgatttagaagaagaagatgaggagaaagtgcaacaacgggaacaatgcttacaaacacacactcaacaagaagataatttccaagttaacacatgttctcatcaactgactatcaaagaagaaaggcatgaagatcatgagggttcaatcattctaagacaactctatttgccatttgctagttgtgttttcgacatgggtaaag

SEQ ID NO: 102389 - DNA, 563 bp, Glycine max
  Peptide Sequence Number=SeqID_219167
ggctacatgcctcgccttcagagggctacacgccctcaccttcagaggactacacatcctcacctttagaggactacacatcctcaccatcagaggactacatgtcctcaccttcagggggctacacgccctcaccttgagaggactacacgtcctcacctttagagggttgcatgtccttgcctttagagggctgcacaccctcttttttagtgggttgcacgccctcgcttttagagggttggacgccctcgccttcaaaggttcagttcctgggccaccccctgatcctggaggagggccaactatgcgagcacaactagagaaggaggctatcgggtcgcgcccacaagacacccagtggacccggagaagtccaacagggccctgggtttctagctcgggttacgggcctctgtcagtcctacagggtgctcgtcccccccaggatcgcgcctgcaagacacctagtggacccggagaagtccaacagggtcttggggtttctagctctgattacgggcctttgtcagttctacgaagcgtctgtcgcccccaacaag

SEQ ID NO: 102390 - DNA, 565 bp, Glycine max
  Peptide Sequence Number=SeqID_219168
taaacaaggttatgacagagtcactgctgttgttgtttatgatgctaatggtgcacttgagaatcctatcactcaaaatgatgagattaaagaatatctagattgcagatatatttctccgtgtgaagctacttggagaatttttggttttccaatacatgctagaaaacctgttgtggagagattacattttcatctgtcagggcaacacagtgttctttatgaagacgatgatgatatagatgatatcctatcaaagccaagcatttcaaattcaaaattcttagcttggatgaatagcaacaaatgtttttcagaagatagatcatggaacctcagaaagaaaggcaatacaattggcaggctaatatgggttccaccaaccactggtgaattattttatctaagaatgatgcttactacatgcaaaggacctacttcatttgaggatattagaacagttgaaaatgttctataccctacatatagggaagcatgctttgcaatgggttttttgcaagatgacagagaatttgtggaagcaatcaaagaagctaaggactag

SEQ ID NO: 102391 - DNA, 228 bp, Glycine max
  Peptide Sequence Number=SeqID_219169
atgacttcaggagagcagttttactttggctggagaagatgccaaattatagtaagagagagagatagagagggagagagggagagaggaagtgatgatgatgacgataacgatgatcactttggtggtggaggtgatagtggtcatagtgacaacaatgatagtggtcatgataatgattgcgttggtggttatggttgtgatggtcatgatgatatgatattctag

SEQ ID NO: 102392 - DNA, 876 bp, Glycine max
  Peptide Sequence Number=SeqID_219170
atgaagaaaacaagtgggagtcaccaccaacgtttattcaaggaaaatgttagaaaaaccaaaagaggtctgcaaattttgaaaagaagagttcgggagttgtttacgcatagggaaggaaaaaaccatttggtgcaggggaagctcgcccaagcgagccagttgcttaggcttgaaggtatcaactcgcccaggcgagctggttgcttaaggttgaagttttcccatggcccaggtgagccagatgctggcctgggcaagtttagtcgtacgaatataactatactatcaattttctcggcttacccatacgtacgcattcatgagggttcgattttcattggaaacaaatatccaaaccgagctcgtcgatggagctggagaaacaagcacattcatgaggacagttttgttacacctctccatccgtggcagattgctattcaaagatgcaagaagtatttcaatatgtcaagtcaaagtgcaggggtctctatgagtgttaccatggagatccagttaaaggagtggctgatatgggatcatgatggaagatggatatatgggtttcaaaaatacatagggaggtcttcaacttttgtggctgaattgtggggagtctttcagggccttaagttggccattttgaagggattcactagaattttgttgcaggtggattctaaagcggtaattttggctattagaagtggtaatgaagggagtgcttcggggtggagactaattcaagctatccagaagtttatcagaatggttaatcagtttcagattaatcacatgtacaaggaaactaataggtgtgtggacaagctagcgaaccatgattgtagcctggatgcatatggggagacttga

SEQ ID NO: 102393 - DNA, 897 bp, Glycine max
  Peptide Sequence Number=SeqID_219171
atggtgtggattaggttccctggtttgaacctatttttctatgatgagagtatcctcatggcgttagccgcagtggttgagaacccagttcgagtggactccaatactctggatgtccgaagaggatgctttgctagagtttgtgttgaagtggacttcaataagcctgtcgcagagaaggtggttgggtcttcgaagggtatctctggcgaggcaccaaggattccagtgcaacctccgtctcaagggggtacgtcctccggccagacatcggctgcaactcctcagggagtcccccctacttcctcgtctattacaaatagcattaatgctcattcaatggccaatcatgacaaaaccatcgtaaccgcaaatcaacaattatctaaggagaacgttactcaaccaggggaaccagttaatggggaatggttagtggtgaggaggaaaaatcataagaatcaagttgagaagaaacaaaaagattttgtttttaaaggtttgcagggatttttttttaatttatttaagaatcaaatacagtcagccaatcaagaggcttatctctccaatcatgggcatgtgattgctaaccttgatgcaaataatgaaaagaaaattttgcctgaggttatttccaaaagtaagcatccgagaaaagacattgatacccctattgttcagatgttgaaaaatgcttccttggccaagcaaaaggtttggaagaagtgtcatgtgggtatggcagtggcgattgtgggaccttccacttcaaaaagtccaaatgtgaataatgtagatcatgaagggaccttagcgatggatatccaacagccatccttgggcaatgttgaggagttaaacacgcagaaggagttcattgataatgctatgtaa

SEQ ID NO: 102394 - DNA, 930 bp, Glycine max
  Peptide Sequence Number=SeqID_219172
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacgggagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 102395 - DNA, 1140 bp, Glycine max
  Peptide Sequence Number=SeqID_219173
atggttcttcaaaacaacaacctattgcctaaaacccctgctgacagagaaggaaatagacacttttcctatagagaacaatgtgaagaagaccttaccaggtatatggacattctcactgtgaaacttggcaaaggaagcagtgaggaagaaacccttcacacccttttcaatgatcaagcttgtgattctatatccgtctcccaagaccttgttcaccggttgctctggcgatacaaggatgattggaagtctgcattggggtgggtagatgctgtgaggatatttgatgacttgcaagctcttgggttggagaaaaacacgaaatccatgaacttgttgcttgctaccctgtgcaaagagaaatttgtggagcaagcctgcaaaattttcttggagttgcagcagcatattgctccaaatgctcacacgtttaacatattcattcgtggatggtgcaaaatctgccatgtggacaaggcacattggacgatccaagagatgaaaggatccggttttcacccttgtgttataagttattccaccatcattcagtgttactgtcaagaagggaatttcagcagggtgtatgagcttcttgatgacatgcaggcccaagggtgctctgcaaatgtgataacttatactactatcatgtgggcactaggaaaggctgaaaagtttgtggaagctttgaaagtacccaagagaatgaggtcttctggatgtaggcctgatacacttttcttcaattcattgatacataaattggggagagcaggtagattagatgatgttgcctatgtattcaaggtgaaaatgcctaaggctggtgtttccccaaatacatctacctataattcattgatttctatgttttgttatcatgcacaagaaaagagagctacagaaaggaaggagatggaaaatttaggctattgtaagcctgatgctcagacttataacccattgatcaagtcttgctttagaagtgaaaaaatagatggtgtgttgaatgagatattaaatgacatgattaataaacagcatctcagtctagatctttcaacccatacactgctaattcactggctttgtagggtagatgcaattgggcgttctctctatttgaggagatga

SEQ ID NO: 102396 - DNA, 228 bp, Glycine max
  Peptide Sequence Number=SeqID_219174
atgaagctaaacgatttcgattcaagaagtagttctgtagaagtggatattaaaaagcaaatggtgatgaaagaagttgaagaaatgatagaggaagtgcaaaatgagttgaagaatgtgtcttatcttgaaagtggacttcgacacgaagccattaattggttgacagaaaatcctaataagttagcaattctaaaatctcttccattggatgaaaatgaggaataa

SEQ ID NO: 102397 - DNA, 390 bp, Glycine max
  Peptide Sequence Number=SeqID_219175
atgaagctttgcttctacaatcaactcatcgaaacctcagaagaagaaactggggaagtatcttcagaggaaaatctcaaccaaatccagcaggatgatcaaacatcatccttggaagaagaagatacccaagcgattaacactttgacaaaagagcatgatcttttgtttgaagcaataaattccataccagaccctcaggaaaagaaggttttcttgaataaacttaagaaatctttgaaaaacaaacctaaaccaaaagaatttattaccaacaacaaatttgatgttagtaatatcaccaaaagattagaaaacacgtctgtcaaaccaaccagtatccaagatctccaaacagagattaacaaccttaaacaagaaattaaataa

SEQ ID NO: 102398 - DNA, 414 bp, Glycine max
  Peptide Sequence Number=SeqID_219176
atggtgagcctgatggatagaaacatccttggctctctattccttaaaatccactttcatggcctagacatgaaagagggtaaaactccaacaaccttgatttacagaatccagtataaggctaatgtttatctcccgagaactataaaatgggataaggtaactcttcctaaaaaatgggttatggataaggctacaccttcaatccccagacctgcccctaccatagagcaaattaaacaggataattctggtaagatcaaagatggtgagttaatccaatcggaattacctcccacaactcagtaccaattgccaaaggtcaaggacaacagtgataaacctgtcatggccacaccttttaaaacaaaggatgtcaatgaagaaataaccccgaaggatattaaaagctaa

SEQ ID NO: 102399 - DNA, 288 bp, Glycine max
  Peptide Sequence Number=SeqID_219177
atggggaaagggaggttacggtggcaccttccggaagatccttttagggttcttccggaacttccggaagaaggtgttccggaagatttccggaagaagggttcttccggaagtactgaaaggtcttccagaagaactggtcttccggaaatcttccggaatatctcttccgaaaactttcccgaagaagggttcttccggatgacctttcagtgcttccggaagcactttccggaagaacaacttcttccggaaagtttccggaagaactacttcttccggaattga

SEQ ID NO: 102400 - DNA, 282 bp, Glycine max
  Peptide Sequence Number=SeqID_219178
atgtttctatgttctatgatgtctcctggactgctaaaccctgatgtctcgtgcatgtttagcctaatcctagccaagcgtcatcctcagatccctcttgttggactaaacttgaccataactgcattaagacatatataccaacaactagcgccagtcatgctcgctcagcctggaggttcaagcggtgcgcttagcaaattgattctcactgagcgcatcatgacaattcatctgcttccaggatcttctacgcgcttagccatgaactgctgcgcttag

SEQ ID NO: 102401 - DNA, 393 bp, Glycine max
  Peptide Sequence Number=SeqID_219179
atggaggaggttgagcaagctaatagagtagttgttgaaagctgccacagggttctgagtttgttgtctcagccaagggatcaggttcaacataggaatttaatggtggaaaccggtgaaactgtggtgaggttcaagaaggttgtttccatgcttcacaatggtttgggtcatgcaagagtgaggaaacttaaaaaccctcaaatcccctcttcccaccaaagcatcttcttagacaaccccaattgcaaaaccttaaccaacaacaacaacaacaaccatcacttaaaaaaatctatactttccccaaatcaactaacatcaataatttcaattgttcaaagagaatctggtggtggaggggacctcgggggtgttgccatgcctgcatag

SEQ ID NO: 102402 - DNA, 399 bp, Glycine max
  Peptide Sequence Number=SeqID_219180
atgagtatgcacatattcaatgaaacaactaagatttgtgcttggatcgcattcgaaaactcgcacacaactgcactagtctccagactcacttccttaaggtttgatggcactatctatgtagatattactgagttccacaccaaccttgtgccataccccagggtccacttcatcatttctttgtatacttcagttatctctaccaccaaggcctaccatgagcagttgtcgattttagagatcacgaatgccatgttcgagcccccgagcatgatggccaagtgtgaccccagacacggcaagtacatgggttgctacttgatgtaccgtagtgatgatgttcctaaggatgtcaatgccattgttgccaccatcaagattgagaggattgtttag

SEQ ID NO: 102403 - DNA, 312 bp, Glycine max
  Peptide Sequence Number=SeqID_219181
atgcccatatcaattaaaggcttgatggctacttgtacatatcctatgtgtaggaacatacagggtgtcctaggggatttctggaatactccagtcatccatatttcgatttatctcttcgaagtggaccttcccatcgaagagattatgttttggggcgaccacatgggtctgacaatattcctacttccccatcaggctatgataccagagatcaggcagaagggatcaaacgaacaaataggaagtagtgtatatgcctatatgttcttggtagaagtaggaacagtgggggcaagatatgcgggttag

SEQ ID NO: 102404 - DNA, 510 bp, Glycine max
  Peptide Sequence Number=SeqID_219182
atgaacacttgtgcatcactagtccttctaaaaccacaaagaggagagacaactttgtttatcactgatatgacaaaggccaatgtttctctcccaagaaccataaaatgggatgaagtaactctccctgaaaaatgggtcatggacaaggccacactgtcaatcccccgacccgctccaaccatagaacaaattaaacaagacaactccggaaaggtagaaatagcctttaacaggagaaattctttctcatcaaggatagaagcctttaggtctgagtatgagtcagcaagaaggtctttcttagtgagaacccgtttaattccaataggattaatcagatctgagtcacacaaccagttccttactgtaagcctccaaggattagataccacttctagtatacctagaagaacatacaaccaagaacaagaggatgaccaaaagtcgatccaatctccaactcactcctcaatgcatgaaccttatgatgttatcttaaacctttag

SEQ ID NO: 102405 - DNA, 353 bp, Glycine max
  Peptide Sequence Number=SeqID_219183
tcactcctagtaaggcgatccgaccgccgatcacccgtgccttcattgaaaagtattgctcgcctaggcaggcacagggtgatgcatcgcaggccacagatgcaccgccaccacctcatcaggctaatcctgctggatcattaggcatggggcagtatctacaacacttggttcgccaacaggaggccaaccactgggggcagtttagggctgaggtcgcatggcccggagattggctcgaggcccaggcaggggaggctcctgcaggagctcccggcgatgtagaggaggcccgcatggacgaggagatgatgaacttgctcgatttcttgggaggaagcggagctacgtga

SEQ ID NO: 102406 - DNA, 807 bp, Glycine max
  Peptide Sequence Number=SeqID_219184
gatggacccttgggtactagtaccctcacctttagaggactatacgtcctcgtcatcagagggttgcacgccctcaccttcagaggactacacgtcctcgccttcagagggctgcacgccttcacctttaaaggactacatgtcctcaccatcataggattacaagtcctcaccatcagaggattacatgtcctcgccttcagaggactacacgtccttgccattagagggctacacgccttcaccttccaaggactgcacgccctcaccttcagaggaccaaacatcctcatcttcagaggactacacgtcctcgtcttcagaggactacacgtcctcgccttcagagggctacacgctctcgccttcagagggctacacgctctcgcctttagagggctacacgctctcgccttcagaggactacacatcctccatttcagaggactacacgtcctcgcctttagagggctacacactctcgccttcagggccagtagtttccctttatcagttctttttcctgggccactccctgatattggaggagggccaactatgcaaggacaaccagagagcgaggctatcacgggtcgcgccccacaagacacccagtggacccgaagaagtccaacagggccctggggtttccagctcggggatcgcacccacaagacaactagtggacacggagaagtccaacagggtcttggtgtttctagctctgattacgggcctttggcgagacgccacagcagcctggggatggctgacagcgggcaaaaggcacaccaccaccacctctag

SEQ ID NO: 102407 - DNA, 648 bp, Glycine max
  Peptide Sequence Number=SeqID_219185
atgtggggtcgtgtgcgtactgtatctccttcatggggtggtggtcgtgtgccggtgtgcgttgccttcgcggggtcgtgcaggtgcggggtcatcgctgctgggtgcggggtcgtcgccgctggtcgttgctgggtgcggggtggtgcgtgcgggttgtgctgctgtgttctgtgctgtgtgttctcccgctgtgcttttgcacttcaatttcaggttgttgagcatggtctaggtcatctgcctttcaccgaaaagcaagtggttactcccacagatttatgctttgtgaactgcaacatgtctgggaaagaagtgacagatcgacagtgggtcacaaatggaggatctgtttataccggtgttgatttctgcaaaaaattgtgtggtgtttcaattgttcgaagtggtgagagcatggaaaatgcacttcgtgcatgttgcaaaggtattaaaattggtaaaattttgattcaccgggatggagacaatggaaaacaggctcctgagggaatccactgcgtgtgtaaaaggtttccatcattgaagattgtcacgtctgagattgacattgaaataaacgaagagtatcgtgttatcccaggattgggggaatttggtgatcgatactttggtaccgatgattga

SEQ ID NO: 102408 - DNA, 141 bp, Glycine max
  Peptide Sequence Number=SeqID_219186
atggctacagctaggtgggtactcaagcatccagtttatggcattgtgatactaaggcttgggatttacacaagacgacgttcctataggaaaaccctacaaggttccggaatttcaacaaacattattgacaataacgaa

SEQ ID NO: 102409 - DNA, 330 bp, Glycine max
  Peptide Sequence Number=SeqID_219187
atggaagcgttatctccgaaacaaaaggaaatacggcaattgcagcacgatctgctgcaaacattattcgcgcagtcgccccgtaagtgccctatcggcgggttgccgccacagcagcaatggctatcgacgcggcaactggccaatgccgtcaacgtcggtgtttaccgggcgcggcggctattgttggatcttgtctcccggaaaaaagtgattgtgacggacggctctatcaacaactcattgaggtggtatcccaccgcgttgctgaacggtgataacgacggcatctccaacagcgatgcccctcactcccctttaacggaataa

SEQ ID NO: 102410 - DNA, 336 bp, Glycine max
  Peptide Sequence Number=SeqID_219188
atgtataagtatattcaaaacattcttgctacctacaaccgcctgcatatcttgaacacaaacagatatatgcacgctcaagtaatttcatgtcacacactcatgggaaaggcagaaatattttcactactcattcacattttgaaaattcatttcatgccatatgttcctattttgagaagcattttcgcgccatttttggcacacgtttatattggcaaagcacttggctacctactcaacacccacatgcttatttcgtcccttgttacctactctacatcatctaggtgcaaagaaccatcaaggtgcagccttcatcaaatgcaggactaa

SEQ ID NO: 102411 - DNA, 129 bp, Glycine max
  Peptide Sequence Number=SeqID_219189
atggcgggacatgataaaaagtttgtaacctatccccgggggaagaagtccatcacattggccatgttgtcatcatcctatgctccatcttcatctccgagggtccctgcgggtcctgcccttgtctga

SEQ ID NO: 102412 - DNA, 213 bp, Glycine max
  Peptide Sequence Number=SeqID_219190
atgaacaaggctggcaaaggtgtggtgtcttatgctggagtgggccaagaatcccaggttccctgcgctgctgtgacgtctgccacgtcttcactggtgtcttatgctggagttagtgaatttttgcttagtgagagtgggcgcgttgcgcgcaaaaagagacaatgtcttcactgggtgggctggctgagtgttgggcgtgcagatctctga

SEQ ID NO: 102413 - DNA, 207 bp, Glycine max
  Peptide Sequence Number=SeqID_219191
atgcccaaggggaatttcatagccaagtgtggagtagatactatggctcctaaagcttttaaagagggacgaccgagaagtaattggtggcatcttgggagccttaagtgtagagaccatgttgacatgattgggcaatttgaagatgtctcttgtgagccgatactattgcacctcctccagcaaatccccctacaattgtgttga

SEQ ID NO: 102414 - DNA, 225 bp, Glycine max
  Peptide Sequence Number=SeqID_219192
atgccttttggcctcatgctcactgccagtgttctgatatggcagaaacgaaacttcactgcattcgatttaactggatgtaaagggaaagccactaatcatcttgattgggacgaggaagagggactagtcactagagccatgagcaagaggtttcaaaaagatttggctagaactattgaagaaggttctaaggttgtcatgaacctcaggatagatttctga

SEQ ID NO: 102415 - DNA, 522 bp, Glycine max
  Peptide Sequence Number=SeqID_219193
atgagcaatcattcagatgagaaggagcagtgtcaaaagaagaggaaatccaccatatgtgaagcctccaactttaggacatcaaggagaagattctgcagcaacaaaaatgaagaggagatgaacaagggagtttcaacaacactgaagctttatgatgacccttggaagatcaagaagacgctaaccgatagcgatttgggaatcctaagtagactctcgctggctacagatttggtgaagaagcaaattttgcctatgttgggtgcagatcatgcaagagctgcagaaactgaagaagggaccccagttagagtttgggacatggacaccaaatccatgcaccagctcgttctaaagcgatggtcttcttccaagagctatgttcttattgcaaagtggaaccaagatttcgtgagaagaagagacctcaagaaaggggatgagatcggatttcattgggatccatataattgcgttttcaatttctgtgtccttaaacgagctatgccagagaattaa

SEQ ID NO: 102416 - DNA, 147 bp, Glycine max
  Peptide Sequence Number=SeqID_219194
atggttggtgggttgattggccggtgtggctcaaacatatcgaggatcaaaaatgagtttggagcaatgattaagacacctcagaacccatcttcactgctcactcaccactgcccactcccaccatcacatttatatattgtttag

SEQ ID NO: 102417 - DNA, 1035 bp, Glycine max
  Peptide Sequence Number=SeqID_219195
atggagttggatgcgatcaagagtgaattatcccaaattcatacgcaacagtcaactcctccaagaccgtctaaccctgacgtatttgttgcacgtgttagcacgaaagagagttgtgctgaagcttctaataatgttgttgggggaaaggtctttggagtaggtggcacgatacacactattgcttatggagatgatgtactaagggtgtgtgttgacactgtatacgatggtgaagccattgtccggttacccacttcagagattcagtatgtcagggacgccgtgaactcattcattggatggcccagacatctagtgaaacctttatcttatgattcagaccttaatgtgcggaagccagttgaacatagtagtgatgcaaagcttgcaggtgaatccgatccattgggagagttgatgaagatattgttttatgtgtaccagaatccagtggaagtgtcgtgggaggcgagccaatttggacttcctgatattggggcaaaattttacatcacacatgcagatctagcggaaataatatcaggtgacaagtgtttaaacatagcgatactacagttgtggaccatatctatgaatgagtgcggtagaagcaaagctgaccagtcactgtatggtttgctggagactcaatctatacaaaatgctaaggaaagatgtctacaatgccaacaatacattgaaacatgggtcaaggaatcacaaaggcagttgtatttaggagcttacttgcatcaggcacattggcaactatttgttctccacctaagggaaaacacggtcgtttggttttgttctctgaggaagaagcctgatattagcatcaaaggcgcaattaacagtgcaatgaagacaataaccagttcttttgaaggcatgtctaatcaaggtgcacctcggtgggttgaacccaagtggttttctgatggctcatcgttagacgtggaggtcatcacaacaattcgacagaaatgggcaacttactttttatcttttaggaaaagcagttgctaa

SEQ ID NO: 102418 - DNA, 426 bp, Glycine max
  Peptide Sequence Number=SeqID_219196
atggataaacgtacagggagaccaaaaatatggttatatcgagacaaagaaactaatgaaccaaaaggagatgctaccataacatatgaggatccacatgctgctgtagctgctgttgaatggtttaacaacaattggttgtgtctgaaaaaaagcaattgctccaatgtgaactttgcttttcgtggtgcttgtaatcgctgtggaattgttcgtcctactggtgcttctggaattttaggggttggtggccgtggcaagggacgtgctgcacaagaatcagggggcattagccggccagctggtggaggaatctttggtcccaatgattggccttgtccaatgtgtgggaatatcaattgggcaaagcggactaaatgcaatatctgcaatacaaataagcctggcataatgagggtggtgtaa

SEQ ID NO: 102419 - DNA, 207 bp, Glycine max
  Peptide Sequence Number=SeqID_219197
atgaagatcatcacattgttagcatcatttgttcttattctctttgccttgagctcacaaccactacttggagcagctgaagcctcacctgagcaagtgattgacacatcagggaagcattgcttgcccctaaggtttataccttttaaccctaaaataggtgttattcatgtctctactaacctcaacatcatgttccactactag

SEQ ID NO: 102420 - DNA, 216 bp, Glycine max
  Peptide Sequence Number=SeqID_219198
atggttggagcattctcacaaaacatcgtgaccctgactggtctccctatgatcttacttagtgagagtgacctgacaaacccatggtctggtgtgtcttgttatgtactcctaagcgccccagagtggtttttcactgacatgatgaataggtggatgactatgaagaacctcatgctagaggacacgggaacacaatgctctgataggatgtga

SEQ ID NO: 102421 - DNA, 255 bp, Glycine max
  Peptide Sequence Number=SeqID_219199
atggggggtgaacttagtaattggggtgcgcttagaaatcttcctcaagaagcctctaggcggcaagcacctccctttttccctataaataggggaggggggcttttcgaaatattttggaccccttggctatgcatgtcagttgttttgggtgaaaaaatgtgttttcgtgaagaaaatccaagccgaggtgcttccgtaagcgattctgtggaaatttttcatcgttctttaccgttcttcagtcttcaacca

SEQ ID NO: 102422 - DNA, 309 bp, Glycine max
  Peptide Sequence Number=SeqID_219200
atggagatgcagcgaaagacaaaggagaagagcccaatctacttggagtctgctacccaatgcccttgtgggataagattgcatcaaaaaagagcaagagtgagtgtgctagagagaaaaaagaaagaagcatctccagctgaagggagagaagtactatatcccttggtaccttctaggaaggacaaaaaaagaaatctggcacattttcttgacatcttcaagaagctagagatcatcatgcccttcggagaggccttacaacaaatgccactttactctaaatttctaaaggatatgctaacctga

SEQ ID NO: 102423 - DNA, 327 bp, Glycine max
  Peptide Sequence Number=SeqID_219201
atgaatgcgcttagcaggacagggcaacacttagcaagttcatctggaaatccaaatcaaggtgtagaaaaatgtagggaaggaggagatgctgaagagagtggggagagagtgggtctcactaagccaggtggctcacttagcgtaatcctcataaatgcaattcaggaaaggtttgcacgcttagcgagtggctacgctaagcccaattcgaaagaattgaaatccagagaattttttaggcttagcatagagcacgcgcttagcgagaccactacagctaatgatcaagggttaaggtacttagcgcaagcacaactcgcttag

SEQ ID NO: 102424 - DNA, 1152 bp, Glycine max
  Peptide Sequence Number=SeqID_219202
atggctgatcctcagaaaacggctcctggcgagagaaacatcgagcaggcaattacatctcttaagaaaggctcatatctgctgaagtacgggcgaagagggaagccgaagttctgcccatttaggctttccaatgacgagtctctactcttatggtactctggcaaggaagagaaacagcttaagctcagtacggtttcaaggatcattcctgggcagcgaactgcaacatttcagcggtatccacggcctgaaaaggaatatcagtcattttctcttatatacaatgataggtccttggatttgatatgtaaggataaagatgaagctgaaatctggtttgttggtcttaaggcattagttactcgaggtaacaactgcaagtggagattggaatcaagaactgatgacagtttgtattatgatagtccaaattctggcacacgaagatccactccatcattctctgaccctggagatgctggcggaggtgcttttgatttgcaaaatagatgggtaaaggctttctctgaaataatttcttacactgcagctagtaagagttccagccaagctgaatcacttgcaaattcctctttatcctctgggtctgtggataactcaagcaatcgaaattctgcatctgaggcatttcgagttagtttatctagtgctgtaagttcctccagccagggttcttatcatgaagattttgattccataggtgatgtttttatttggggagaaggtatcgccgatggaattcttggtggtggtgtacatagagttggagccttatctagttctgagatggatgcattccttcccaaggcactagaatcaaagttagttctagatgttcatagtattggttgtggctacagacatgctgttatagttaccaagcagggagatatatttagttggggagaggagtcaggaggtaggcttggacatggtgttgaaatggatgtttttcacccgaagctcattgacactcttggtggcgtgaatatcgagttagtagcatgtggagaatatcatacgtgcgctgttacttattctggggatctttatacatggggtgatggtacgcacaattctggcatgcttgggcatggaaatgaagtcagtcactggattcccaagaaa

SEQ ID NO: 102425 - DNA, 435 bp, Glycine max
  Peptide Sequence Number=SeqID_219203
atgtgtttctccaatagtaataattatgctgctaatttcaggcttcccatttggccttttgccaagttgatattcagttgctggttggttctgcctcacttcaatggggctgcagttgtttataggaattacatcagaccattctatatgaacccgcaaatcccaattcctcaaggctctcaaatctggtattttccacaaaagaagtccttattcaatcagccagatgatgttctaagtgctgctgagagatacatggaagagcatggtacagaagcctttgaaagacttataagcaaggactcatctcaaaaggacatgagttcaaatctcattgtccatgctgaaactttattggtggataataatgacagacaagctagagcaaggaggaatggaaattacatgatctttgatgatgactatagatattga

SEQ ID NO: 102426 - DNA, 603 bp, Glycine max
  Peptide Sequence Number=SeqID_219204
atgaaaacccttttttcaaatcaacgaagcgaagcgaagctaagctcaatcgcctaccccatagctcaacgtcactaccgtagaagagaaattcgcctccggttcaccactttcagcaccaaagaaaccctagaaaacacgttccgccgccgaaacctcggaattccagggattctccctagcggagagggctcgacggtgccaatgtggggggaaacacgacggcgccggaactgcggccaaggaatccgagtaggacgcgaaaaacctaaccgtttggggagaagttggggtcgttggaaccgcggcgaagggaattcgaagaacgaaaaggggatgctcgaattcttgattttgaaaattttggtgaacacgcgagcgaaagggagcaacggaaatctggggatggggatggctggttttgtcgttttctggagctctgggggacaaatgagtccaatttcgggatttcaaacgacatgcctcgctggtgtcgctctcttcggggaattttatcctgtgtgctgcggactacggggtgcaccgtactccgagctcgttccctcacacgataatttcacggtggatttcgcggaccaatag

SEQ ID NO: 102427 - DNA, 2463 bp, Glycine max
  Peptide Sequence Number=SeqID_219205
atgggggatttatacctgatatgcaaggataaagatgacgctgaaatctggtttcctggtcttaaggcaatagttactcgaggtaacaaccgcaagtggagatttgaatcaagaactgacgatagtctgtattctgatagtccaaaatctggcacacgaagatccactccgtccattgcaccattctctgaccctggggatgctggtggaggttttattgacttgcaaaatagatggataaaggctttctctgaaataatttcttactctgcagctagcaagagttccagtcaagctgaatcacttgcaaattcctctttatcctctgggtctgtggataactcaagcaatcgaaattctgcatctgaggcatttcgagttagtttatctagtgctgtaagttcctccagccagggttcttatcatgaagattttgattccctaggtgatgtttttatttggggagaagggatcgccgatggaattcttggtggtggtgtacatagagttggagccttatctagttctgagatggatgcattccttcccaaggcattggaatcaaagttagttctagatgttcatagtattggttgtggctacagacatgctgttctagttaccaagcagggagagatatttagttggggagaggagtcaggaggtaggcttggacatggtgtagaaatggatgtttttcaccctaagctcattgacaccctcggtggcatgaatattgagttagtagcatgtggagaatatcatacttgtgctgttacttattctggggatctttatacatggggtgatggtgctcacaattctggcatgcttgggcatggaaatgaagtcagtcactggattcccaagaaagtaggtggtaacttggagggcttacgtgtattatatgtgtcctgtggaccttggcacacagctattgttacatcagctgggcagttgttcacatttggtgatggaacttttggtgccttaggacatggagatcttagtagcgcaaatattcctcgggaagtagaaaatttgaaagggttgagaacaaccagggttgcctgtggtgtttggcacactgctgcagttgttgaggtggtaaatgaatctgtggaatcttctacacgctcatctaatggaagactgttcacctggggtgatggagataaaagccaacttggacatgctgatagggaacctagactagttcctgagtgtgtaaatgcattgagtactgaaaacatttgccgagtggcttgtggccacagtcttacaattgctttgacaacgtcaggacttgtatatacaatgggaagtacagcacatggacaacttggctgtcctgcatctgatgggaaagtccctacacgtgttggagataaaattgctgatagttttgtagaagatattgcctgtggttcatatcatgttgcagtcctgacttccaaggcagaggtttacacatggggaaagggtttgaatgggcaattaggtcatggagacagtgatcacaggaataaacctgcacttgttgagttcttaaaagataaacaagtgaaaagtgttttttgtggttcaaactttactgctgttgtatgtcttcataaatggataccaagtgttgatcattctacttgtgttggatgtcgcaatccatttaatttcagaagaaaacgtcataattgttacaactgtggacttgtgttttgcaaatcatgcaccagcaagaagtctataaaagcttcccttgctcccagttccaacaagccgtatcgagtctgtgatgactgttatcttaaacttaagaaagctgccgctgaatcagtaccctcggtgcaaactcctagcttgagaagtgtaagtttgcaagacaatagaatcactaaagtacagggaacactattaaggcttgcatcttttggctctattattcaaacagaaagtagtcaatcaaagcttccagattcacaagatagccatcttttcccagctttaaatggaaaaccactgatgaggggttttgctccttcaaaatcatcaaattctctttctattgattccaagaaacacctttcagtttctgagccttctgcaagaatatcttgtcaatcaacatcatcagtttcatcaaagtcaagtccaagacaatcttatgaagatataaatgaccatttaaagcacagaaatgatattttaagtcaagaagttataagtttaaggacacaggttgaagaccttactcacaagtcaaaaagtttagaggctgaacttgagagaacatcaaagcaattgaaggaagtgactgcagtagctgcagatgaagctggaaagtgtaaatcagcaaaagagatcataaagtcattgactgcacagataggcccgccatggacacacacagagaagaccactagaagcaccaagaagggggaggggcctgccatggcggtgccataa

SEQ ID NO: 102428 - DNA, 165 bp, Glycine max
  Peptide Sequence Number=SeqID_219206
atggcgatgactgctcaaagcgcatcttcatgggagcaagtagcaaaagtaccatccaagaacatgattttgccgtcaatggaaaccgatggtttaagtcacattcttcctaaacctaagtcttcaagctctggtccaaattctctgattttggggaagcactaa

SEQ ID NO: 102429 - DNA, 366 bp, Glycine max
  Peptide Sequence Number=SeqID_219207
atgaagaagattctaggcctacaagctccaatggagcttacatcacttccctccaagtcacctattgctgctcatttgctcccacaaactaaagttcgagatcatcacaaacaccaaccgcacggtacaaaaattgcaatggaaacttccccccatggtaatcaacccgagtctcatggaaattccaaaccgagtctcatggaagttccaaaccgagtgacatgcccccaagtacaaaaaatacactttcaacatcggttatttagaacattctacatcggttctaaaaccgatgttgaaagtgacgatgttgaatgtatgaatgttaacatcggttttggagaaccgatgttaacatacatatga

SEQ ID NO: 102430 - DNA, 345 bp, Glycine max
  Peptide Sequence Number=SeqID_219208
atgaagaacgaacgaagaacggatgaagaacgacggaaaatcttcacggatttgctcacggaaatgtctcgaaagcgttacgaaagcacctcggcttggattttcttcacagaaataattttttcactcaaaacagctgaaatgcatagccaaggggaatcattacgaaagtcccggaagccattttttaacaaaacgggggaggtggttgccgcccagaactttatggattgggcaacaatgcttgttttgacttccggaatgttgcgagactttacaaattacacaacgatggatgttaaacattttgaggtggtcaagcgaaggtcgcatgccaacaaataa

SEQ ID NO: 102431 - DNA, 1125 bp, Glycine max
  Peptide Sequence Number=SeqID_219209
atgaaagaacaacaaaaacaacagatatttcaaagaagcacaagtgcatgcaccgccacaacaagaaacagccgaagaatcctcccttcaaacctaacccacttccgctccttcgaatccgatgatgtctccgacaaactcctcgtgcggcgaggatcctcgccttcggtctcaaacttgtaccaacagcagcaacagcaacaccacgcaccaaagctaacgcaacaaaacaagatatcatcactcatacgctcgttcttgaacatcttcacgttcccaacgatgatcccaacatgcaagtggctcactattccttcgcagctctccgtgactccttccctcggcaggaaggtcaccggaaccctctttgggcaccgccgcggacacatctcttttgctgtgcagctccacccccgcgccgagcccgtcctcctcctggagctagcaatgtccacctcctcgctcgtcaaggagatgtcctctagcctcgtgcgcatcgcactcgagtgccagaaagtgtctgtcaccgctgctgttgcacacaacaacagcggtggtggcagacgcaggctctttcaggagcctgcctggaccatgtattgcaacgggaggaactgcggctacgccgtgtcccgcacgtgtggggacctcgacttgcacgtgctgagcacagtgcagagcgtgtcggtcggcgccggagtgatccctctcctggaggatggaaaagggggtggcagtggcaacggcgggtcggagggcgagttgatgtacatgagggcgaggttcgagcgagtcgtggggagccgtgactcggaggcgttttacatgttgaatcctgatggtatagcgtttgttggtgaagcagtaaattacttcctcaccggtgtggaagtgatttttacctgttatagcagcttgaacccatcgaaggtgaaaagaaatgcttatatggaaaggggaaagatgggatgctggcgacagcgggaaagagaggaaatgggaaacaaagtccaccgcaagtcaagtagccacggtggaggaggtgacgtcgtggtcgttgtggtaggagttatcgatgataggagagcgtcagagttgaggactgaggaggagtcatcgttgtag

SEQ ID NO: 102432 - DNA, 486 bp, Glycine max
  Peptide Sequence Number=SeqID_219210
atggaaacgacagagcctagtgaatccaacacatatgttgacatagaggcgatatatgaatgccttgaaactgagtgtggagttagccaagaagatgtaatcttgtatgggcaatcaattggaagtggaccaacactgcacttggctactaagtttccaaggttgagaggtgtggttcttcacagtggcactttttctggtcttcaagtgctctaccatgttcatgtgcaagcagttctatcaatccttttggctacatttgttggctttggtgtggtgatgagtgaaagttctattcttgtggagttttttagatggaggagaagagtgcaggctctacaagagcaacaacatggtctgcaactgatgccacaagtagcacaaaatcctcgaactccaaacatgttgcgtctaggtttagggtcaggtccttccaaccacaatcaacctgtggtgcaaagtcgtcagaactcaaatcagagctaa

SEQ ID NO: 102433 - DNA, 249 bp, Glycine max
  Peptide Sequence Number=SeqID_219211
atggttacccgcacctttcgtcaaccgggggcaaacgagccctttgacgcgcagagactaacatcgtctcctgcgccttttgttgtcctgacccgtgaagtcaggttttcactctcatcatttggaaacattcaagcccaacgacgcgcgagattcttctctgctgggcagggacgatcaagtgcaatggcgaagggaagtgtcgtggttgttcaaccttgtcgttttcaagacgctgaagtttgttga

SEQ ID NO: 102434 - DNA, 1008 bp, Glycine max
  Peptide Sequence Number=SeqID_219212
atgaaggttgatatggaggccatgaatgagcagatgacaacgatgatggaagtgatgatgagcatgagaaagatgatggaggccaaccctactacaactgttattgccagtattgctattgagaaggacccaattcacctgcccagcttcaatcaagagagtcatccagtctcagaagtttatccaggatataccactaaagggcatgcattttttggtgttatcgtgccaaacgctttgggggaccctcagtatcgaccaccatcacaacccttacattttgtgatgggaggaggacctcctactatagttgagaaggaaaaatttgttaatctagagcaggggctaagggccattgaaggaggaggaaattatggctttgctgacatgtcagaattgtgcttggtactcgatgtggttattcctctgaagttcaaggtgtcagactttgataaatacaagaggaccacttgctcaaagaatcagttgaagatgtattgtaggaagatgggagcatatgcgaaagatgaaaaattgttgatgcatttctttcaggaaagcctggctggggcagctattatctggtatactaacctggaatcttctcgggtctgctcttggaaggatctaatggatgccttcattagctacaaaacatgtgcaagagagataatgaatcattcaaagaatacactcaaaggtagagagatctggcagctcaagtggtacccccccatgacggagagagagatgataaccatgataatggacacattgttaatgttctactatgagaagatggtaggttacatgtcttcaaattttgcagatctagtgtttgctggtgagagaattgaagcaagtatgaggaaaggaaaatttaattatgttgcttttgtgaatcctggtaatgggggacctcgggaggagtggcgaaaggaaggagagagagccacatgttgtggctgcagttcctgcatggacaaactttccactagcccctgttag

SEQ ID NO: 102435 - DNA, 1440 bp, Glycine max
  Peptide Sequence Number=SeqID_219213
atgaagcagtggataataagcatggttgattatcacgaatgtttcagagtgtttgacaatcccaatgtcgctgtgcacttcaatacagaggcagtggaccttgtaagcaacaccaaaggacagatgtctggcattttagtaagaaagattgatactggggaggaatatgtgcttgaggcaaaagggctgttttatggcataggccattcgccaaataccgaactgttgaaaggccaagtcgaattagaccactctggctatgtacaagttcaggagggtactgcaaaaacttcagttgaaggtgtatttgctgctggagatgtgcaggaccatgaatggaggcaagctataactgctgctggatctggatgcgttgcagctttatcagttgagagatatcttgtgagcaatgatcttcttatagagttccatcagggtgatgctgaaccaatatcaatagcgttgttgaacaaatcccctacctttcctctcccatgtataatcattagacctggactctctcccttccaaaacaatcaacaccctccaatttctcttccaaactgccttcccaaaactgaagaggttaagaaggaactaacagacagggatgtacacgagggctttgacattacacttacaaagcataaggggcagtatgctcttcgaaaattgtatcatgacagtccaaggcttatatgcgtattatatacatcaccaacatgtggtccctgtaggactctgaagccaatccttagtaagaagagaaagaagaaagaactactaagaacaccaataagataccttaaaagatgtctaagaacacaaacccaaaccaaaaaaggtgaagtagttgctttggatgcctccatgtcactcttccttacacataacattcgcatgaaaatcaagccatggacctccgcggcaaggttagtagcgacaaaggacacgcgtggcgtgacggggaggcgtggacgcacgagacgtgagggggaggtgcagacgcgcgaggcaagagtgggagggacctcgtgcggcgtgaggggagggaccttgtggtgcagcgttagggaaggacctcgtggcagaggttggacgagaccagagggagggcgatgctgcggcgcaaccagagagggcgatgacaatgaaggaggtggcggtgccgcggcacgtcggaggttggagcaaagggcggtggcggtgctgtggcgtggcggagttggtgaggaggaggtggggaaggtgattgatgaatttgatcagaatgtacattttgttgaaattgatatagaggaagatccagaaatagcagaagcagctggaataatgggtactccatgtgtgcagtattttaaaaacaaggagatgctcaagactgtctcaggagtcaaaatgaagagagaatacagagaatttattgaagcaaacaaatag

SEQ ID NO: 102436 - DNA, 240 bp, Glycine max
  Peptide Sequence Number=SeqID_219214
atggaggtgacgccatcatggtggtgctacagtgaagaaacgaatagggggtgggcacaatggtggtgttgccatggttgttgcgatgaggaaaagaagagggagtctggcgcagtggtcgtgacaccatggtggtgccacgatgaagaaaagaagatggggtgtggcacgatggtggtgctgccatggtggtgtcgcgatgaagaaaagagaaagagaatgagggaagtggggaagtga

SEQ ID NO: 102437 - DNA, 237 bp, Glycine max
  Peptide Sequence Number=SeqID_219215
atgttgggtcctcttactgagatacttgatgcaattaaaaataggataagagtttacatcaagtactcagcagaattccccaacaatggatttagccttccatcacaaggaagcaccttttacaagcaggagaaggggtttgagagcaattcacagatacacaatggggaggatgtctcctccacctctaaggaccgaaaaatcgctaaaaaacctagaatctacctaaaagctaag

SEQ ID NO: 102438 - DNA, 794 bp, Glycine max
  Peptide Sequence Number=SeqID_219216
atggcgcttgacttgaccgttctatcttttaactgctcaagacacaattatgaaaccactgcagaaactcttgagttcatccttgctcagggacgagcaaaggttaagcttgggggagcttggggttatcaggacatacagaagaaaggcccacacgtcggaagccacgggaacgaacgggaaggcgaacaggcccgggggcagggcgcccgcccaccccccttgggcgcccgcccaggagttgtggtcaaacacgtccaactttgcggaccaagctccaccgacctaaaggatcaaggaaaaccggagagagaagaggagagcggaggaggagccggatctgtcggatcttcctcaacattgtacttttgcagcaacaggggcttgaccgccggcgacggtgtcttgagtttcgtcggtggtttctaccgccccgtcgatgtggagcattccctagagaaatccggcagttcggacgcttgttgccgtgctcctgcgtcgcgtgggaggaccattggtcgctctacgtacgtctgggcatttggacatattgtcctggcaagcgatgccacggcgttgttcagaccgaacgatagcgctcttcttggggcgaacaacccgtgcgggagtagcgtcgtggaggacgagagcgcgcaaggcgcgccatctcccaacgttgtcgcgcgatcctcgtggcgtcgagccgtcatacccgcggtttcggcgcgcagggctgtcggctcctgcgtcaccacccgcctggcacgaactgccgatcgtgaggaggcaaagga

SEQ ID NO: 102439 - DNA, 168 bp, Glycine max
  Peptide Sequence Number=SeqID_219217
atggataagagcttgaaggtaggagaagatgagtgtagggagagggagagaaggggcacgaaatttatgcctcaaatgagcctaatcctgatcaagcatcatccgcagattcctcttgttggactaaactcggccaggatcgcattaagacaaacatacaacaactag

SEQ ID NO: 102440 - DNA, 342 bp, Glycine max
  Peptide Sequence Number=SeqID_219218
atggagaccgcgggtaatagccctggtgaaggacttaaaagagaaaagtctctggctctcagtagtcagaagagcaagaaggtttcattgtccagagaactagtcttaagaagttcatccaaagcacttaaagttgatgattcatctgatgatgaatttgaagaagactcagatgaagatgatttcgccttcatttctcacaaaatctgcaagatatggagaaacaaaggtcttatgagcacgtggaaagacctgaatgaaaccttgtctcatgaagatgatgaagaagccatcatatgtctgatggcggatacaacttctaaggggtctgaatcagactag

SEQ ID NO: 102441 - DNA, 258 bp, Glycine max
  Peptide Sequence Number=SeqID_219219
atgttgaccggtcttagtcctcaaataatttttccgtttcaattttcatcctcaccatttgtgactccgttaagatgggtcatacacgatgaagaagcgaagtccaatgaggaagagtccataattgtggttgtaggtgtgggcgagggtatgggtgtagggaagagaccatgggaagaaatcataaggatcacgggtgcatgtgaccctattgttagggagaggagacaagggttggaatttggagaggagaattaa

SEQ ID NO: 102442 - DNA, 225 bp, Glycine max
  Peptide Sequence Number=SeqID_219220
atgatgtgtaagaaagcaaatatatgggccaacattctgaacaagagtgttattcataaagcaggttccaaaataaccttgtctgacatccacaagctcgtgatatttcacttgatggagaacctcccttttgaccttcctcacattatatacatcaacatactgaggaatctaaaaggcgtaggtggcctaaacaacatctactatgcagcccttatcaactag

SEQ ID NO: 102443 - DNA, 432 bp, Glycine max
  Peptide Sequence Number=SeqID_219221
atgacctcagtcccacaaaggttgaaaggcctaagtaagactgatgaagatgatgaacgtttgattcaagtggctttgcaaaaaaggaaagtagccgctctagttgcccttacaccaaagagggcaaagaaagtccaactagtctctgaaccccgggcgtttgtcatcccctctgctattccaagacacattaagacgagggtgaccaaggccaacctgaagattggtgataaagaatgggcagtttcctttactggaaacaaggaggattcaacctctcaatcatcagatatgacccctactcaagcatggtgccgcatgaagaagttgaaggataaaaataactctcaaagcagcatctcttgggatttgttcgcaaaacatagaagggacccttcacaagaagtggaacctccaaagatagagttttag

SEQ ID NO: 102444 - DNA, 786 bp, Glycine max
  Peptide Sequence Number=SeqID_219222
atgtacttgcaagatcaagctccaacatacccttatggtgtgcacatctcaaggtacattgatatcaagttggttgctgatagagtgtgcctacatctaccaatttgggatgttgcaaagaagaagggatttaaggtttattacaatgaagagattcccacaaggaaaatgaagattgtgtggatggactctcaaaaagcctccatttctggctatgatggaagtgacaatgttgagcatcatagagtcagtcaggttgaagaagttgatgctgctgttgagaaaaagattactgcctccgtcgaggctgaagcatctacaaaagttatgaatgacaccatgatacatgggatcatcatttattttacaaagactggtgtcatggacaaaaatcttgaggcatccaatgcgccagtggctgatgaagttgaacaccatattcaagaccttacatccaagcagtctacaacttcaaatgaggctacttctcgagataagggcaaacatgatgttgttattatttattctaccagtttcggccccactcctctcaactttgcacaaccagccactgtcgctcatgatcaagtacaagatatgattggccaagccatggagactttcgccgaatgccaacggcaagagaataaacaacctcagtttgttgttacacctacacatgtacctcaaccaccacctatacctgcatctcttgacccttcaccaacaaccttggcttcgataccaccacttccttcatcggcaccaccaccagttcaacattga

SEQ ID NO: 102445 - DNA, 213 bp, Glycine max
  Peptide Sequence Number=SeqID_219223
atgtggctttcaatttttcttcttctctgttttcaaggtcttgcgagatgtggaaagagttgcagactaaggtggctgaattacctaaggccaaacctcaaaagaggaaactacaccaaggaagaggaggaaactattatcaagctgcaccgacatctgggtaataggtgcgaaaatcttttcccagctagaattatcgctacacaagcttga

SEQ ID NO: 102446 - DNA, 743 bp, Glycine max
  Peptide Sequence Number=SeqID_219224
atggcagacaacacacgcatgaaggagcttacaggggatgtcaaaaggatcctggagacgatggaaaaccgcaataaagaatatgctgctcggtttgagaccttagaaacaacactggagatgacactcaaggataaaactagagatcccgggagtatatcactggctatgaacaatcacccttttaaggttgtgccctggtaccaaatgatgactcgtgaaaattcattcacaacatggattgcttttacgcgagccttagagacagaatttggcccatcaccgtgtgaatgtcctagatctcagttgtttaaactcactcaaattggttcagttcagtcatattacgtgcagttcacgtctttagctaatcgagtacaaggaattacacaagaagctctattggattgctttgtaggaggattaaaacctaatatcagaatggatgtcattgcacaatcacctacatcacttctcagaacagtttcgttggccaaactctatgaagagaaatatacacctaaactcaaacctttttcttcgagtttttcttccaaaacacaaacctcaaacacaaactcaaacctaaacacaaaccaaaatagccctcaatccctaaaatccacaagcttacccccactattacccacaccatacatcaaacctatcaatgttaagaaaatgacatcgacagaaatgcagttgagaagggaaaggggcctaagctttacttgtgatgacaa

SEQ ID NO: 102447 - DNA, 258 bp, Glycine max
  Peptide Sequence Number=SeqID_219225
atgaagcaaaggtaccatttcaatgttgctaatgagcgactatctcaacacattgagaagggatatgaggataggttatttatcaacaatgtagcttctggtttcacgacacaagttatggaacttgatttcttgtgtcctagtgaaggcactcattataggtggaacaatggttaccgcattacttcaactactgctacatgggaccaagatgtttttgttcgtcatcttctgccacattcaattgttctctcttaa

SEQ ID NO: 102448 - DNA, 1491 bp, Glycine max
  Peptide Sequence Number=SeqID_219226
atgaagcagcagccatcgcttcttctgggttcttgcaaagctgagttagaatcaccatctgcagcgaaaagcccttcacgaacggtatgtgagtgcaatatttgcggcaaggttttcagcagcggtaaggctttggggggtcacagaagatcgcactttcagaagcaccagaagaagataaaagtccgtttcactaatcactcatcaaaacaagctggtgataccagcaacaatattaagagggctaggaattgtgattatgatactgttgatgatggaaaacgcgtttgttgcatttgcaagaaggaattccccacaaagaatgctttgtttggtcacatgcgatctcaccctgagaggtcatggaggggtgtgtctcctcccactcattttcccaataagaactcttcgtcttcttcttctctctcttcttctttctctttttcttcccataattctgattctatggagaaaaacatggaaggggatcgtgatgattatgatgaatgtgttggtgttggagctgtttgtgatggtgggggtaatagggctattgatctttcaactgttacttgccccagttggcttaagactgatgtgagaggaagaaagtgtattggggcttatgaggctgctgaaacccttgcttacttaagtgtttactctaagtacttttgtggtgagtctaatggggtttctccgaagaaagatgaagtgcggccgaagagtgctccacctctaatcaagcttggcaaaaggaagattaattttagtggatcgtcttcaagtaagaagcatgaggtgaaaaagataaaattttatctgaagggtgaattgaaaatcggaaagagaaatgacgcggatggtgaagatgatgatgatgaggatgagaagttgaataggtgcaagggtttatctgaatctgaggtggaagatgaggagggtttcgacaatgtgatcactgaggtggttgctcccgataggatgcaagatgacgttgatgaaaggaaggggaagagggtggtggatcataaagggaagaacattaagaaactggtgctgaaatctatggcaaaagagaaagagaatgagaaagttggtggctacaaatgtggtgtttgtgggaagattttctcaacttttcaaggcttaggaagacacatatcagtccacaaggggaagaacaacaacgctgtaataatcatggacgagtccaaccacagccattccaaagctcttggtgataaagaaaacaactcttctagctctagtaacacgcacaaggtagacgaggcttcaatgaatgaagcaccattgcctactacaatgaatgatgcaccattgccagcagatgagagaaaagtgaatgacgaaacatccgaaacgccaccattactaccattgccggcacacgaggcatgtcaatcttcttcaggtgttaagaaattggactttgatctgaatgaattgccttgtgctatggaggattaa

SEQ ID NO: 102449 - DNA, 525 bp, Glycine max
  Peptide Sequence Number=SeqID_219227
atgaacaacaaatttgttagagcagaaaggtttaccagcattggagtagtttgtatcctagattggccaaaggaaacaatgcttctacagtttgtatccattgaagtagatacccaacaactcatcaacgcagaagtgtataaatggcaacaaacaggtgttcggataatatatagacacgagcttaaaagtacaacctacaacacagggaatcttaaattagcaatgaaatgtgattatgttaaggattatgagtttgtggcaatatttgatactgatttccagccaacaccggatttcttaaagaagacagtgccttatttcaagaaactacttttcataagaagaaatcacaatgggatcagaaacgtgcttcagagagaagtgagcacaaagaggaaccatgaagacatgaagcttacctccaacccaacagcgacaatggcagcgagacaggcaatgagaatagcgagactggcagtcacgaaaggaagttgcgatgaagacgatgaacagcaagactag

SEQ ID NO: 102450 - DNA, 1509 bp, Glycine max
  Peptide Sequence Number=SeqID_219228
atggatcaaaaagataagcatgcggtttcagatcatcatgggtgggttaaatcttgcaagaaagagaagatgaagcagcaacgatcgcttcttctgggttcttgccaagctgagttagaatcaccatctgcagcgaaaagcccttcacgaacggtacgtgagtgcaatatttgcggcaaggttttcagcagcggtaaggctttggggggtcacagaagatcgcactttcagaagcaccagaagaaggtaaaagtccgtttcactaatcactcatcaaaagaagctggtgataccagcaacaatattaatagggctagcaattgtgattatgatgctgatgatgacggaaaacgcgtttgttgcatttgcaagaaggaattccccacaaagaatgctttgtttggtcacatgcgatctcaccctgagaggtcatggaggggtgtgtctcctcccactcattttcccaataagaactcttcgtcttcttcttctctctcttcttctttctctttttcttcccataattctgattctatggagaaaaacatggaagaggatcgtgatgattatgatgaatgtgttggtgttggagctgtttgtgatggtgggggtaatagggctattgatctttcaacttttacttgccccagttggcttaagactgatgtgagaggaagaaagtgtattggggcttatgaggctgctgaaacccttgcttacttaagtgtttactctaagtacttttgtggtgagtctaatggggtttctccgaagaaagatgaagtgcggccgaagagtgctccacctctaatcaagcttggcaaaaggaagattaattttagtggatcgtcttcaagtaagaagcatgaggtgaaaaagataaaattttatctgaagggtgaattgaaaatcggaaagagaaatgacgcggatggtgaagatgatgatgatgaggatgagaagttgaataggtgcaagggtttatctgaatctgaggtggaagatgaggagggtttcgacaatgtgatcactgaggtggttgctcccgataggatgcaagatgacgttgatgaaaggaaggggaagagggtggtggatcataaagggaagaacattaagaaactggtgctgaaatctatggcaaaagagaaagagaatgagaaagttggtggctacaaatgtggtgcttgtgggaagattttctcaacttttcaaggcttaggaggacacagatcagtccacaaggggaagaacaacaacactgtaataatcatggacgagtccaaccacaaccactccgaagctcttggtgatcaagaaaacaactcttccagctctagtaacatgcacaaggtggatgaagcaccgttgccaaccgacgagacaagagtgaatgaagaaataccagaaacaccaccattgctggcagacgaggcatgtcaatcttcttcaggtgttaagaaattggactttgatctgaatgaattgccttgtgctatggaggattga

SEQ ID NO: 102451 - DNA, 543 bp, Glycine max
  Peptide Sequence Number=SeqID_219229
gctgaatatgatatccctggagcatctgacattaggacaaaacagaaaatacttcagactatgggggagcaatggagacagtttaagtctgatttgacgtcaaaatggacacttgcagtcgacaaggatagtgtggatgacactgcaaaaaatacggcattagcaaggagaaatgggcccaattttgttagagccgtagagacccctcgtgggaggatgtgcggaaaaaaccataggccatcaagaagcaaaacactgccccccaccactgaggccgtgattgaccctccatctcccatcagacgacacgtgaagtggaagatgggctgcaccaagaaaactggtcagatgacgtctgagacagcaaaggaaatcgctgagaagattgatgttctgactgctaccattgggcgatcagaataccctggtcgtgtgcgtgctactggagtcgatgtgaccatcaagcaatactttggatcggctccatggacctcccacacttcttcctccatggctcccaaagaactagagcagctgacttaa

SEQ ID NO: 102452 - DNA, 177 bp, Glycine max
  Peptide Sequence Number=SeqID_219230
atgtatatgcatcgtcacgcatgcattgcatttggtctcatcattttgtcatggaaacaaagagggtctgaaaggaagagtggggccggaacaagttccgaggggcattgtggggaagcaatagcgagcttaaactccgtagggccaagagagaccaatcgagagtcgaaggcatga

SEQ ID NO: 102453 - DNA, 651 bp, Glycine max
  Peptide Sequence Number=SeqID_219231
atgtcggaacttgtcattatcattgcagatgatcatccactttttcgcggtgccctgaaacaggccgtatccggcctcgacggacaccagaccatcattgaagccggtgatttcgaggctgccagacgcgcagccgcagcccgtaacgatgcggatctgatgctgcttgaccttgccatgccaggggtcagcgggttttcgggcctcatggcgctgcgcgcagagttttccagcctgccgatcgtcatcgtatcggcgacggatgacgcgacgaccgtccgccgctcaatcgaactcggcgcttccggtttcatttcaaaatcctccggcatcgatgacatccgtgatggcatccgcgcggttctggaaggcgacctgtgggtaccggccggccatcacggcgaaaaggagcacgatccggatgtcgccgatctcatcggcaggctgcgaacgctgacgccgcagcagagccgtgttctcggcatgctggcagaaggcctgctgaacaagcagatcgcctatgagctcaatgtctcggaggcgacgatcaaggcacatgtctccgcgatcctgttgaagctcaaggtggacagccgcacgcaggcggtcatccagctcgccaagatcaacacatcggctcttgtggcgtaa

SEQ ID NO: 102454 - DNA, 747 bp, Glycine max
  Peptide Sequence Number=SeqID_219232
atgattcgtgaccttggacaagagtctttccagcaagcacatgccccggtctatgaaggattgcagagtgattcaaagaagtctttgtatacggggtgcaagaattccttaactctgttgtctgcggtgttaagtctggttaatgtgaaggccaggtatgagtggagtgacaaaagtttcacctcattgcttgaggtagtgcacaatctgctcccagatgacaacacgttgcctataccctattataaggcgaaaaagatactgtatcccatgggtatggaatatcagaagattcatgcttgccccaatgattgcatactgtacaggcatgaattcgaagaaatgtccaaatgccatatttgtgggacttcacggtacaaagtgaaggatgaagaggaaagcaattatgatgaaaactcaaagaagggcccgccagcgaaggttttgtggtatcttccaatcattccaaggtttaagcatctttttgctaacaaggatgacgaaaaagaccttacatggcatgcaaatggaaggatttctgatgcactggtccatcatccggctgattgcttacagtggaagaaaactgatggtttgtatccagatttcaggaaagagccaagaaatcttagacttggactcaccagtgatggaatgaatccatatggcaccttaagcactcaacacagttcatggccagttctgctagcccaagacagccagaaaatgacattgatgtttatctaa

SEQ ID NO: 102455 - DNA, 795 bp, Glycine max
  Peptide Sequence Number=SeqID_219233
atgcctttagcatgcggagaaaggttagccaatgctggatatgcagtgtttggagtcgactatgaaggacatggacgttctggaggtgttcgttgtctcataactaagtttgacaatgttgttaatgattgtgaagactttttcaagtcagtttgcgagctccaagattacaaggggaagcctaggttcttatacggggattcaatgggaggatcagtgtgcttactattgcataaaagggacccttcattttgggacggtactattcttgttgcacccatgtgtaagatatcggacaaattgatgaagccaattcccatagttataaacatgttaacaaaatttgaagatatcgtaccaaagtggaaaatagttcccacaaagaatatcattgactctgccttcaaagaccgtggcaaaagagaagcgataagaaataacaaattgatataccaagacaagcccaggctaaaaacagcaatggaaatgatgagaactagcatgagtcttgaagagagtctacatgaggttacaattccatttttagtgttacaaggagagaaagatacagtgacagacccagaaataagcatggcattatatgatcaagctagtagtgtagacaagacaatcaaattatatcgtggaatgtgtcacggcgtagcaactggggagagtgatgaaaacattgcaattgtgtttgcagacatcatagcttggttagacgagcgcgctagcaaggaaaaatttgattcctttatatcaaatgaaaatgacgatggcattatgaaatag

SEQ ID NO: 102456 - DNA, 462 bp, Glycine max
  Peptide Sequence Number=SeqID_219234
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttcttttccccgctga

SEQ ID NO: 102457 - DNA, 183 bp, Glycine max
  Peptide Sequence Number=SeqID_219235
atggagaaaggagtggttacggtggcgtcttccggaagaactgcgaaggcttcttccagaacttccggaagaagtagttcttccagaaaattttcggaagaagggttcttccggatgccctttgaatattccggaagaacttttcggaagagccacttcttccggaaagtgtatgtttgttaa

SEQ ID NO: 102458 - DNA, 291 bp, Glycine max
  Peptide Sequence Number=SeqID_219236
atgggggattcatccctcaccatggggtctgttattatggggaagccgccagcaggaagagtgataccaaggtcccgccagcagcagaggcgacaagcactggtgccgccattcttcttggcgatacatgctgactgggcattgatgctgccagcaataaaagcgacacacccatctcgccagtgccaacggcgagatgctccacgtaggggtctcgccagtgctttttgcgagattgcttcctgtgcagctggggtgtggaaggcatgcgagattggttcctgttcatga

SEQ ID NO: 102459 - DNA, 159 bp, Glycine max
  Peptide Sequence Number=SeqID_219237
atggagatggttggggagaacaccttgctagatcaaaaatctcatcatagatgccgtcgcaggaagcatgattgtagaatggttgatgcattaagaacttttcaatctgagtcatacagatttcataggaaacagttgaaaaaatatcttaaaacataa

SEQ ID NO: 102460 - DNA, 1372 bp, Glycine max
  Peptide Sequence Number=SeqID_219238
tgctatgaagaacagatacttggcacatgctcaacaccatcctccatttcatgactctgcacttccaaagagaaagttggataagagttgcacagttaaatccccaagccaatatgccatggatgccatcatatcaaaaggaaaatcttcaaataaaccactagttgttgttggttgtttccctcaaggaagtcgagatttgaaagacctcgaacggatcagcataattggagtccagcaaatcaatcgtgtttttgaaattgtagagaagactttaaaaggtcatgaagtgcgccttttgacctgtcagaaattggcaacacttgagcttcaaaaggtaaggaagaacgagtttgttgagattcttcctattaatgttggttgtttaggtgcttgcacttattgcaagacaaagcatgttcggggtcacctaagaagttacacaattgatagccttattgggtgtgtaaaatctatgatatccgaaggggttagagctttgttgtggaaagttgtctactctgagcactcagatcctaagtcactgtgggttgctaccttggatccaaatggtgcaatcactttttatgatctcaacaaaaggagggctccaaaccctgaggcggttaaggtaccacaagacccttgtggcattcctcagtctagtgatctttattgtggttgcttctttgaaaactgtgatgctggacatggcaacaaaaagggaaggaatgacacggtgctagtagttgtcatatttgttctcacagttctgattatagttggtcttataacaggattctggtactactacaagaggaagacgaatgttgctaagtatcctcaagataacttggacgaagatgataatttcttggacagactttctgggatgactgcacattttacttttgctgctttttgtagagcaactgaggatttttccagaaacattgcagaaggagggtttggctcggtgtatctaggtgtgcttgaagatggcactcaattggctgtaaaaaaattggaaggtgttggacaaggtgcaaaagagtttaaagcggaagtgtccatagttggaagtattcatcatagaacactgattctggatttccaaactgttactgtgaatgccgtccttgcccatccaactttggttgagtggcttgtgttctcttctgctggtccttgggaaaattgggatcatttgtgcactatttataaccttgaggacgatgttgctttcgatgcgggtaatattgttatgaccgagcccattagtgttgagcccaacattacccttactaaagaacagactgcaacttctgagaatactagatccaagaggatcatttcaatagctaagaaatga

SEQ ID NO: 102461 - DNA, 543 bp, Glycine max
  Peptide Sequence Number=SeqID_219239
atggaacccctgcaatatggagactatcccatttccatgaagacaaatgcaggcgtaattcactacaccaatctcaatgtctcagacaattctgacgcccttaagaaccaactgagagatttcactgcagacatggcggcaaatatctgtcaacggacagcaagtaattcgtcactgcaagacgtgacaagggtgaaatacttgcatggatatattggtagcgtgcttgatgccttaagtgatcttgagaagggacttactcaaagaattaatcaaaccagaacatacactgacacagatggatcaaatataaaggggtattttgcatggtctttcctggatttgttcgagttgctagatggatacaagtcgagctttggcctatactacgttgatagggatgatccagagttgaagagatacccaaagctctctgcaaaatggtacaaccggtttttgaagggtagaaggacctctatagttggaactattgaacttgagaaggatccatcacttgtttttgtttcccaattatttgagtag

SEQ ID NO: 102462 - DNA, 840 bp, Glycine max
  Peptide Sequence Number=SeqID_219240
cctttcatcacacggggttttagtgaccccaacgcgagggtacttcgaggagtccgtaaggcatgggatgcggtccaaaggaaggacaaagagcttaggggaaacggtaatgggatcatcaaccgctatcgtaagtggctgagattccacacacaaggtttggattggctcccaaagtttagggttgtggcagaggaagaggccgaagctctggaagagagtgaggaggtacaagccctaaaggcggagcttgagaaagcccaagcagtcaaggagaagttcaagtcaacaaccatcaaagtccgaaaggagtatgatgaactgaaagacatcaacttggccaccgtcaaagccttggagcaggaaaccaaaagggcccggaagaaagaacacgaccgaaacaagttccgaggagctttatggggcagcaacaaagagcctaagctccgaagagacgaaagggatcagtcgcgagttgaaggcatgatcttgaaggacgggttaaaggcttgtcttaggtccaaaagaagtttgacccagcagttaagcgagatggaagggaacatgttggccatcattgataaatacagagaagagttgaacctagaagcagctcatgagcataggctagtggatgagtacgccaaggtattcgtggaaaaggaagcatgggggaggcggaatggagaaaggaagaaagagaggagacgccacttcaaggagaagatgagtctagaagaagctcaccaccataggaggtcatggataaaagcttggaggcagaaggagatgaatgaagggagagggagagaagagcacgaaattttgtgctctaaatga

SEQ ID NO: 102463 - DNA, 654 bp, Glycine max
  Peptide Sequence Number=SeqID_219241
atggccacaatgatggaggccatgacgagcatgaaaaagatactggaagccaatgcggttatagttgccgctaccagcactgtcgctaaggcgaacccaatgcccccatctggcctcaagcaaatgtatcatccaacctcagatatggtaggcaaagatttgggaagtacggatgaccccatgatgtgcaaattcaaaacaagcatgccttcccgccatatggcttgcctcccaatgtggcgtacactcccaatgaggatgtcaataactctgctcccatactcattgagagccaacaaccccaaaacagatcatgcacatgtctctcaacccatgggggaggcacatgaaattccccaccacaatctagccgacttcgagccttgcctcggatatgccactgaagggcaagcagttggtggtatacccatgccaaacactttgaagggccctcagtttcgcccacaaccacaacccttgcattttgcggtggtaagagcccctcctgctatgcctgaaaagggaaaggtgaatcatctaaaggaaaggctcagggccattgaaggaggtgaagattatgcctttgctaacctagaagagttgttcctaatacccaaacatggtcattcccaagttcaaggtgccggactttga

SEQ ID NO: 102464 - DNA, 1029 bp, Glycine max
  Peptide Sequence Number=SeqID_219242
atggcggttccaaaggattcattctctaccgaaaccgaaagccaagttggggactttgtaaccttcatcgggctacacacccgcactttcagaggactacacgtccatgcctttagagggctacacgttctcatgttcatagggctacacgccctcgcctacagaggactacacgtccttgcctgtagagggctacatgccctcgccatcatagggctacatgccctcgccttcagaggactacacgtcgtcacctttagagggttggacgccctcgccttcagaggtctgcacgtcattgccttcagagggctacacgtccaatccatcagaggactacacatcctcacctttagaggactacacgtcctcaccttcagagggctacacttaatcgctttaagaggactacacgtcctcacctttagaggactgcacgcccttggcttcaaagggcttcacgccctcacctttagaggactacacatcctcgccttcagagggctacatagggctgcacgccttcgccttcaaggactatgcgtcctcaccttcatagggctacacaccctcacgttcataggtctacacgtcattggctttagagggctacacgcgctcgcctttagaggacaagggctacacgtcctcgcctatagaggactacacgtcctcccctttagagggctacacgtcctcgcattcagagcacaacacgtcctcgccttcagaggactacacgtcctcgccttcaaagggctacatgtcctcacctttagaggactacaagtcttggcctttagaggactacacatcctcaccttcagagggctacatgccctcaccttcagagcactacacatccttgctttcaaatggctacatgccctctccttcagaggactacacgggactacacgtcctcgccttcagaggactactcgtcatcaccttcagagggttgcacgccctcgccttcatagggctacacgccctctccttcagatgactacacgtcctcgcctttag

SEQ ID NO: 102465 - DNA, 689 bp, Glycine max
  Peptide Sequence Number=SeqID_219243
tcaccttcagaggactacacatcctcaccttcaaagggctgcacgccctcgccttcatagggctacacaccctcgcctttagagggctacacgtcctcatcatcaggggactacacatcctcgccatcagaggactacacatcctcgccttcagagggttgcacgacctcaccttcaaagggctacacgtcctcgccttcagaagactacgcgtccttaccttcaaagggctgcacgccctcgccttcataggtctacacctccttgccttaagagcgctacacgccctcgccttcataaggctacacaccttcgccttcagaggactacacatcctcgccttcagagggctacacgccctcgccttcagaggactacgcgtcctcacctttatagggctacgcgtcctcgccttcagaggactgcgcgtccttgcctttagagggctacacgtccacccctttagaggactacacgtcctccccttgagagggctacacgccctcactttcagagggctacacgccctcgccttcagaggactacgcgtcctagccttcaggggactacatgtcctcgcattcaaagtgctacacgtcctcaccttcaggggactacacgtcctcgccttcagaggagatcttcttgatgttgtatcttgtattcttggttcatttgtcttgaattaa

SEQ ID NO: 102466 - DNA, 441 bp, Glycine max
  Peptide Sequence Number=SeqID_219244
atggctccagatagaatgcagctacaaaacatgtgcaagaaagagcatgaatctttcaaagaatatgcccaaaggtggagggatctagcagctcaagtagcgcccccaatgatggtgagggagatgataacaatcatagttgacacattaccagggttctactacgagaagttggtgggttacacaccttcaagctttgatgatttagttttcgccaatgaaagaatcaaagtgggtctgaaaagaggcaaatttgatcatcttgctttgacaaataaaaagcctatggcaaatagagaggatgagaaggaggaaggaacccatgctgtgactgtcgttcctacatggccaaatttcccaccagctcaacaatgtctttacccagccaatatcaacccttcttattacccaccacccaatcaaccacaaaggtcaccctaa

SEQ ID NO: 102467 - DNA, 876 bp, Glycine max
  Peptide Sequence Number=SeqID_219245
atgggtgaaatagaggaagggcaagagcggaggaaggctgacatgcaggccatgaaagagaaaatggccacaatgatggaggccatgatgagcattaagaggataatggaagtcaatgcggctgcagttgctgctaccagcgccattgttgaggtggacccgactcccccatctagccttaaccaaataaatcatttaacctcggatgtggtaggtcaggaaggcaaagaattgggaagtataggcgacccccattttgtgcaagttcagaacacgcatgctttcccaccatatggcttgcctccgaactatacaacaccgaatgttgcgcacactcccaatgagaatgtcaataactccactaccatactcgttgagagccgacaacctcaatctaatcacgcacatgtctctcaacccatgggggagacacatgagataccccaccacaatctagccgacttcgagccttgcattggatgcgccacagaggggcaagcaattggtggtgtacctttgtcaaacactttggagggccctcgattttgcccacaaccacaacccttgtattttgcggtaggaagagtccctcctgctatggctgaaaatggaaagttggatcagatagaggaaaggctaagggccgttgaaggaggtgaagattatgcctttgctgacatggaagatttgtgcctagtacccgacatggtcattcctctgaagttcaaggtaccagacttcgataaatacaaggggacaacttgccccaagaatcacctaaaggtgtactgtaggaaaaagggagcatatgcgaaagatgaaaaattattgatgcatttcttccaagaaagtcttactggggcagccgacacctga

SEQ ID NO: 102468 - DNA, 228 bp, Glycine max
  Peptide Sequence Number=SeqID_219246
atggagggtggcataggtcacatactaagcatcactctcaaagaagagaaaaggatagaaggcctcaagagcttccaagagtatgccctctattggtggacttcccttgttagggaaagaaggattcatggggatcctcctatagagtatttgaatgatcttaagagtgctcttagaaaaagacacattctctcttactatgaaagggagcttatggacaagctctaa

SEQ ID NO: 102469 - DNA, 252 bp, Glycine max
  Peptide Sequence Number=SeqID_219247
atgaagaaaaagaataccgaaagtagacgagatgaagatgaaaacatacaaagcaagaatggacccctaaggggtgttgaacccattcccctcagcctccaatgtccatttatagaaaaaatgggggaggaggttgctgcccagctcacccaggcgagttggaggcttcctccagaagcaacatgctcgcccaggcgagctggttgcttcctgttgaaacttcctgatgggactagatgggcccagtgctga

SEQ ID NO: 102470 - DNA, 891 bp, Glycine max
  Peptide Sequence Number=SeqID_219248
atggttaatggctcgacttcttatggacgtgggggcaattcagtgaataataggaagaatgaccctaaagactactcaaagaaaggggtgcaaaatgctcgaggaggaaaaaacccacaaggggccaaaggaggggaattgcgcatcggggtgaagtcgagctttaagaagcataaccaaccagtgattaagcacaaagaacaaattggaaatgaattgattccaaaggttaatagtactggaggaatggaaaataaaaatgtgacaaaaccttatgatgagagtttacatcttttgaaattccatgaattaaggaataatcatatgaatgtgcctatgataccggtgcatatggatgaagatgccatcaaatttgtcaatggatataagcagaaaatggtgaaaggaggtgctgcaaatacactagtcaatggtaacgatgagaacaatggccttttgaagggcatgtacgatacttctaaggaatatgagacttccttaatgttcttgttagagactcattcctataaagattcaacaaataggattattcctaagctaggattcaataaccacttcatacaggatggtcaagcgcattggtatctcactgtggtgtatggaagtcctaaattccaatatctcaaagttttatgggaggctctgattaatattgcaggttcgatcagaggaggttggtcagtcattggaggttttaatactatccaccagcctcatgatcgtagtggaggtactgccaaaccgtcttggagagccagtcatcatagcagaaagatgcactaccgcactaccatcttcaagcctaacgataggaagaaggagctgcaaccagaattgcaaccaaactcaaggaagagacccaagaggaag

SEQ ID NO: 102471 - DNA, 474 bp, Glycine max
  Peptide Sequence Number=SeqID_219249
atgcctcagacagagttattggaagagccctgtggagagaagataatcgtgattcaaaagatgttgcccaagcagcaaaggcccacaacatctgcacgtaggcaacgagaaggtgtcgttgttgctgaggatgctcctcacatggatgacgcagttgaagaggttttccaacatgctgaagaagctggtgttgatgcccagggttttccaggtggatcgcgtgacacattagtgttggctgcctatgttgatcatgaacgtcctgaattgaagctatcctcccatggaaggaaggttcaaaaatttgagaggcctactattgagattgaaaggtggcataaggaaacaagcaatttccatcttctagtaggagaggtcaccaacactgcttcatttgcccatcataggcacattccacaacttcgacacttttcatgtcgacgaagcagtgttgatgttagtggagttacttga

SEQ ID NO: 102472 - DNA, 213 bp, Glycine max
  Peptide Sequence Number=SeqID_219250
atgttggtaaagggacgttttaagtaccagcccaaccaagtaagagctttgggtatgattgctggtggcactggcatcaccccaatgtttcaagtatgtgttacaagagctatattagaaaaccaacaggacaaaaccaacataaatttgatatatgccaatgtcacatttgatgacattcttttgaagatgctaagcactttggttgagtag

SEQ ID NO: 102473 - DNA, 120 bp, Glycine max
  Peptide Sequence Number=SeqID_219251
aactatgttgggcacatggtggaatgcacaaaagatatgtttcaatcactacaagatgcattagagggtggccaaactgaggtagagattggagagtgcttcattgaatctcaagagtga

SEQ ID NO: 102474 - DNA, 261 bp, Glycine max
  Peptide Sequence Number=SeqID_219252
atggctgttaaacattttgaggtggtcaagcgaaagtcgcatgccaacaaaaaatggtcctcggacaaaattaggtgttgtaattacttttcgttaaatataggcaagtttggtggaagtgctgattttgagccggtcgctaagccaattctctggcttagcgacgtagtagttcatggcttagcgtatagaagatcctggaagtggatgagttgtcatgatgcgctcagcgagaatcaattagctaagtgcaccgcttga

SEQ ID NO: 102475 - DNA, 525 bp, Glycine max
  Peptide Sequence Number=SeqID_219253
atgtatgtcgggatagagagtgtcacagttagtggtatcagagctacattggggagtagctacattggcatacctgggattcctcacctgccacttcctcgttctcactttcaccaatacagtcgagcgtggggcatgtgggagcaacctgtggagcctttgggcgaggttgtgccacctgagtctccatgggcctacactttcgactacctagcttcgtattacaagcattcacatccatatatgatttcgtcagaggagggaggggcaccatgttgccttgtacgtgaaccacaaactcagcctgatgatcagatgccaaattatgtgcctagtgcaaactacccttgtgaggatcaattccatatgattataaggactatgcaaagattgttggatctgagagttgtattaggggggcacaaacaatcgttaactcatacaacaagagttggtgatggtacacgaacgctcaacctcgagttgcaactctcagggataaaaacagaggaggaaggtcaatag

SEQ ID NO: 102476 - DNA, 429 bp, Glycine max
  Peptide Sequence Number=SeqID_219254
atggaaaatatcatggggattagacttgtgactagatattgcgtctctttgcacgacctagagttacaggatttgactgaagatgataataactcacttaccttcaactattttaaggatccagaagacttaaagaaatgtgttgaaggcatgataatcgtcatagatatgataaactcaaaagcattctcaaagttctgctaccacaacatgtcggtccaagatctaatagacttgatgttgaatttaccagttaacttgaggcctaaacatgctaatatttccttctctttagaacagtattgcatagacattgtgctaacaatttatcattaccatgggggatgccaatctggtaaagctgtggatcataattataaggtgattggtattgaagctttgagggtaattgatgcatcattacactaa

SEQ ID NO: 102477 - DNA, 297 bp, Glycine max
  Peptide Sequence Number=SeqID_219255
atgtacgtgggagcagtggctgtggtaaggaagctcggttcggctgaggagaaagccgatggtttcaaagtgttttctgaagtgtcgttattggtaatcgattacaaacatctggaaatcgattacaagattcaaaattcaaatttcaaaatcctttttgaaaagcccatttgcaatctgtctctgatttacactctttatttcgcatctccctttgttgtcgaagacgaagatggagagagtggaagatcaaaagaacaaagcaagggtcctagggttcgtgaccaaatcaaatga

SEQ ID NO: 102478 - DNA, 213 bp, Glycine max
  Peptide Sequence Number=SeqID_219256
atgcatgcagggaagaaagaaattgtcagccccattggcgagtttgggcttgcatcgacacatggcgcgaagtgcagtggtctcgccactcatattggcgatttgaccatgcaggggactagggcatcagcttttccaaattttggcagtgcttttttagggttcagaggcagctttttcagaccatggggatatagccagggctactggtga

SEQ ID NO: 102479 - DNA, 249 bp, Glycine max
  Peptide Sequence Number=SeqID_219257
atggacaatggagtcattttaaatgaaaagcatagttttactgagagtaggattagtagggatccaacaagccaacctaaggacactttgtgtgacaatgaaagttccatgactaggtccaaggctaggagggtaaagcatgttttgcaaggccttataatggagatcaactatgctcaaggtgaactagagcttacaccacattgggtcagttttctacaagtggaggaagatttaagaacaacttga

SEQ ID NO: 102480 - DNA, 333 bp, Glycine max
  Peptide Sequence Number=SeqID_219258
atggtcgatgaaatgcttcacgccattgacgtcgcgggtgaagccgcgcacgcggtaatccacggtcacgatatccgactccagctggtggatgagataattcagcgccttcaggggcgaaatcacgccgcaggtcgagacttcaatgtcggcgcggaagatgtgactcttgtcgaggtgcgcgaccaccgaactgggcagcgggccgggatgctcggaattatcgatatcctgcggattgatcggctcctcgctgaccagaatcgtcacgctggcaccctgcggctcataatcctggcgtgcgatattcagcacgttagcaccgatgattga

SEQ ID NO: 102481 - DNA, 207 bp, Glycine max
  Peptide Sequence Number=SeqID_219259
atgggcccagtacctgctcgtacatgcccgggtggctggtcacctactggtcggccacgtggcgtaggcaacgctctaacctttgtagatgagctgaggtggacccttaaggtggtggcggtgcatttgttgcctgctgctggccgtccccaggctgcggtggtgcctcgcactacgcctgcccgggggcgcagtacttctcgatga

SEQ ID NO: 102482 - DNA, 720 bp, Glycine max
  Peptide Sequence Number=SeqID_219260
atggaaagcctggtgttagaggataagttaaaggcttgtcagaggtcaaagagaagtttgatggaacagctaagcaaaatagaagagaatatgttaataatcattgatcaatataaggagaagattgaaagggaagcgatagatagggtgatagagttattgcacggggaagccatgaaatggatgaatatattcgctctcactctgaatgagagtcaagagctgccaaggttgttagccagagccaaggcagtggctgacacatactcggcttccgacgaagtccacgcgacttatcattgtcatgcattcacatttatccagttgttgcattactcattgcattctgtttttagcagtcattgtcatcataaaaaagtaaccatagtaaccaaaaagaatgtatgcgctttacggcacccttaccgaacctgtgccaaggctaaaatcatgagcaagatagaggaagttcaggaacagttgaaggctgacatggatgccatgaaagaacaaacgactaccatgatggagaccattatgagcatgaggaaaatgatggaggtcaacacggatgcagttgccgctacaagtgctgccattgaggtagacgcgactaacccatctggtgtgaatcaagtaagtcatccagtcctgaacatggtaggtcaggggggcaaagtattaggaagtacgggtggcccccattttgcgcaggtctag

SEQ ID NO: 102483 - DNA, 466 bp, Glycine max
  Peptide Sequence Number=SeqID_219261
atggcatttggaaccatggcaactcgcccaaagcataagaaaaagctggttaaagatgcaagacttgttgacttagcagacaagacatctgaagaaattcatgaagacgttgttctggaatctcttaagacattgtctactgaagaagttcaaaggcaaagttcagagaaagacaccatgatgcacatagatggtgagctagtgcttgaagttacaaagatggaagttgttgttgttcctaaagatatggatcatgcagaaagggaaactcttgaagaggtcatgctccaatttgttattgaagcatccttgaataatacttgttgtgccaatagtggccttgagaaacttagcctccaagaactccttactcctttaggtagtccaatttttccttatcctattgatctttcatcagattttgattcttctagtgatgagttttttaggaagcttgatgaagaag

SEQ ID NO: 102484 - DNA, 360 bp, Glycine max
  Peptide Sequence Number=SeqID_219262
atggacacattaccagtgttttactatgagaagatggtgggttacatgccttcaagctttgcagatctggtatttgcgggcgaaaggatcgaagtgggcctaagaaagggcaaattcgattacaccgcatcaacaagtgctgaaaataggaggactggaacaggtggggcaaagaaaaaggagggagatgcccatgccgtaaccacaacacccacacaaccaaattcccaacaaacccctcaagatcccatgtaccaatatccttcacaccaacataattactcggccaacatcgggtctcccccccgcccgacgcctgtccgaacaagcatgcccaatgaatcacaaagacctccttaa

SEQ ID NO: 102485 - DNA, 207 bp, Glycine max
  Peptide Sequence Number=SeqID_219263
atggagagggtctctatgtgccacattagcaaagctttgttagcacggggtggatgcatgagaatcagatcaaacaatgagtcctgtgaaagtagtgataccgaggacttggatgttgattttgggcaactagtaaatcaagccgaggaggaagaaaatgaggattgggggcttccctcaaatttgaggagaatgatggagcaataa

SEQ ID NO: 102486 - DNA, 513 bp, Glycine max
  Peptide Sequence Number=SeqID_219264
atgaaaataaagaaaagaacaaaagaaaggaaagaaggattcccgatcaaagatcgagaggaagtaaaaagggaaaagaagcaattctcgatcaatgaaagaaagaggatagaaagtctccaaaagccagattgccactcagaatcattcttgactggcaatatcccaccccacatgaacaaagaggaaaagaccgaaacacccagcacccagaatcattctcgatcaatcctattggtccgtgatcgtatgtttgatctaagagaggaccctcaaggcaatcctccattctcatccttttccggagccactctggagctgttattccatgattgcctaagagaggaccctcaaggcaatcctccattctcatccttttccgaagccacggctgttcatgtgttctccacttttgagtctggagctgagtttcatgattgcctaagtgcggaccctcaaggcaatcctccatactccacctttgttcggagcaccatgaatgtcattgcctag

SEQ ID NO: 102487 - DNA, 462 bp, Glycine max
  Peptide Sequence Number=SeqID_219265
atgaaaccacacgccacgggtaaggcttggggtcctggcactgctggtgcagtgtatactggtagaagttgtcgctcaactgcacctagcctctatggtttgccgtctgctggtcaaccaaatgttgcatgtatgcgtgcatctggagctccatcctctagatgtgagccgagatggattctactgatggtggctgatatgaaggtggatgagctttgtcggcgagatcggtatctcgtagaactggcaaaggcctgtgatcaatgctggaaatcccagtgccctgttggacttctttgggtccactggatgtctcggaggtgcaatacctacaaactagtaggtggcatccgagataagttgtgctacatgaacattgatctgagtcaggatagaatagaccaactggcatttaggcaatgggagataagaattatggtcactggggaggatgttgcttag

SEQ ID NO: 102488 - DNA, 678 bp, Glycine max
  Peptide Sequence Number=SeqID_219266
atgggggaaaggtttatgttcctcgacctaaacccagttgaaggaggaataattgcctttggaggcatgggcaaagggaagatcattggtatagaggatgaagttagaaagtatgaagatattcttcctcagattggtgaatcatctgatttgcaacctcagacaaaggattggaaaaataagatggatgaacaaggtaaggcggtaaggaacaaatctaggttagtagctcaaggctataaccatcaagaagctcgtaaaaacataaagctttttcaaatagatgttaaaagagttttcttaaatggatttattgaagaggaagtgtatgtcaaacaacctcctgctactagtgaatctatatgcaaggatttctttgatttgatgaaaaataagtttgaaatgagcatgatgggagaacttaagttctttttgggacttcagatcaagcaaaacaacaaagactatgtcaatgacaaggatgggttctacatgtacaaggttatggtgggagagaagatgaatctgcctaaagtcatcttctattactggatgcaagtcttcaggataaagggttatcccaagagcataatccaaggatggaatttttttcaagaaggagggaatgatggagggctatccaaagagcataaggacctaaaagcacttcatcagtag

SEQ ID NO: 102489 - DNA, 501 bp, Glycine max
  Peptide Sequence Number=SeqID_219267
atgtctcttgcaactctttttggaaagcttcatgaacatgaaatggaacttatgagactccatcaacatgaaaaaaatgacaaaaagaataaaggaattgcactcaaagcctcatcatcttctattcaagaagaaagtgacaaagaggacttgaataaaatacaagaagatgatgatttcagattttttatgaagagattcaataattttttgagaaacaaaagaaatcaaagaaaatcaaacatcaatccaaagaagaaaggagaagattcctcattggccccaaaatgctatgaatgcgatcaacctgagcacatgagatttgattgtcttgtctttaagagaagaatggaaaaatccgacaaaagaaatgtcaaagaaaagaaagaaaagaaagcacacatcacttggaaagataatgacatggataattcaagtgatttagaaaatgaaatcataaatctgggtctcatggccaaagactatgaaagcgaagaagag

SEQ ID NO: 102490 - DNA, 654 bp, Glycine max
  Peptide Sequence Number=SeqID_219268
atgaagtataatgaagggtcaactgttgttttaacaacacatccttatgaaggtaatccagaggagttagagaactctaacagtgatgtcagtcctgcatttcataggctttacatttgtgtgaaggccttcataggtttggacagctgttttctgaaagggccatttgggggagagattttagctgcagttggaagggacccaaatgaccagatgttgccaatagcttatgctgtggtcgagggtgagaataccaactcctggaaatgggttatggaacttctaatcaaaaacttgggaggtacagaaaaatttctaaaatctacttctacgcatctctcaaagattttgtctgaggcacatgctgccaaagcagcatacactcgtgcttatgaggatgcaatgaagaagatgagaaaggaaaacgaagaagccttcgaatatttatggaaaactttccctgcacgttattggagaaagaagcatatgaagcatgctactagtacattatccatccgactgatggggaacatttgggacattactgaattccctgatgtgcaaccacctcccccgaagaagatgcttggtcaacctaaaaatcaggaaggaaggaagctggagagacatctagtagcagtgcaaataggatga

SEQ ID NO: 102491 - DNA, 1833 bp, Glycine max
  Peptide Sequence Number=SeqID_219269
atggatgaattcctttctagcatttggaactctgatgataacaaccaagttaacccaccactaccctcccttgatgaagctgcaaaggggttttcaacgagtgaggcctttcaagtttcaaacgatgacgaggaccaccataacgcaagtagctcaacagtccagcacgatagcgatgacgacgatcactacgacgcgagtagctcagtaagagtcattttcggggtttttgtaaacccgtggactcggagcagactcgcgagtttaccaaacctcgtccgagtctacgcaaaatcggacgagtttactccgtttaacaaccatggtaggagctttgatgaccatctcgaccacctcaaatgcgttctgcaaacccttcaaaagggtcagttcttcgtcaagctgtctaaatgtgctttcggacagaggcacattgactatttgggccatatcgtttccattaaagaagtagagccagacccaagtaaaatacaggctatgacggattggctgccaccaaatttcgtcaaatccttacgaggcttcctcagactcactgggttttaccagcgtttcatcaagcactatgcgcagatggcaaacgcctttgataagctcaaggaagctatgatgaaatctcctattctggcattattggattttggtgccctttctattctggagactgatgcctcaggcacgggcatgggagcagttttgagtcaatctggccatccaattgcttatttcagagttaatgactcaggcgatcaagacatcggagcaacactattatctatagccaaactcctcggatttgactacaccatacagtataaatcaggcctaagcaatgttgttgtcacgtcggattggccaagacccttagccgcctacaacagagttttgtctggccaaacatgcaaaaagacgttcaactctacatcaggtcttgctccgactgccagcacactaaatgttgctactgtcattctcgcagtagtggacaacttctcgaagggtgcacattttggtatgttacccacacacttcactgctcatcgtgttgcacatttattcattaacatgagtgatgaccagacagaggtcttgaacaggatactggaacaatacttgagagcttttgtgcacaatcaaccctctcaatggggaaagttcctcagtcttgccgaatggtgttataatatcacgacgcattcctcaactaagctgacatcttacgaggtcacttatggtaaacccccaccaagtgttcctaattacatgtctggttcctcccatgtggatgttgtcgattttatgcaggtttcacgacaagaaactttcaggtttcttaaaaagaaattaaagcacgctcaggctagtatgaagaaaattgttgatgctcaccataaggatgtcatattcgttgtgggcgtttgggtctatgtgaagttaagaccttatcgacagtcgtctatttcagacaacaatgacttgaattgcaaccagaggactctacttgggaagactggattgacttgcaagatacttatcaccttgaggacaaggtgtttctccaagggccaagggatgataacaatctgcaccagaatgattgtgaccataggcccaatcgtacgggtaggaagcctcaagggtgggaggactatgtccattaggctgtgcccattagtgagtggtgctgttaggagcactgtgtcatttgtgtctaaggcagtggactgtactacctatttaagcatgaatgatcatggaataaggacaggaaaattcacctttaaattctatttcccttctttgcttctggag

SEQ ID NO: 102492 - DNA, 780 bp, Glycine max
  Peptide Sequence Number=SeqID_219270
atggatgaaagaccggaaaagatcgctcattgttgcttggaaggtcaagggggcattacagagcccaaatggcatgatgttgtactcgtagtggcgttagaaccaggtggcgtgatggaggtcgtccaagagctcgtcaatggtgggaattgggaacctatctttaatgatgacggcgttgagtgcacgatagtccacacggaaacaccacgttccatccttcttcttgaccaagagcacatgggaagaatacgggctacgactcgaccttatatggttacaaagaagcatctcttcaacttggatttcaattccgtgcttttgaaaatagggatacctatatggtttaacgtgaactgggaggtagggaggtgggctgttggaatagggttgaataagactgaagggggttctggagggcttgcagtatggtatccttccctgcaatggaggccgaaggaggaatgtgaagttgaagccttggatattgacgaaaattgctttgcacaccctatcgcaacagaattcactaccatttcccatcataacacgaagacgcttaacgggctaggccttcaagcggagacagcgggccaggcggtcatggatgaagttgtgggtactacccccatcaaccaaaatgatgacctatgtgccgttaatgtagctgttgacgcgaagcgagtggagtcctcaaaaagcatggggactaagtttggtggaacgaggtcatttggggcaacatcgtcagaagcaatcaagaggaagaacttagcctga

SEQ ID NO: 102493 - DNA, 471 bp, Glycine max
  Peptide Sequence Number=SeqID_219271
atggccgataatacacgcttagaagaagccatcaccatttttactcaaactcagagctccctccattccaaattaaacgatgttatctctcgcttcaccatccttgaatctcgttctcctgacagaccactttcgcttccaccaccgagaaggaaactcgacgtcccttggtttgatggcgctaacgcgatgtcttggatcttcaagatttcacaactttttgactatcacggcaccccgatagcggcagccttggcgaaactccaggaagacaagctcaatgatgctcgtcgtccttcgcgatttcgccctcttgctactccgttagcgataacccctatcgcttcagctctgtcggtgccgcctcccctgctcccggctcctcctcagattgttttcaagaagctcaccacggcagaaatggcagctcgctgtgaaaaaggcttgtgctataattgtgacgcgctatag

SEQ ID NO: 102494 - DNA, 612 bp, Glycine max
  Peptide Sequence Number=SeqID_219272
atgatgttggccctcgcacttggcaagttccctgatagtctatgcaagaaaccccctagcagcatggacgagctacgtgagcgagccaaagggtacattcttattggtcatactaggaccttgccctttttccatgtgggggatggatatactaggaccattggcaaaagccccaggatagctcaagcttacgaacaattcctatcgaggctagatgtcaagcacctcacaacttttgtcgaacacccccagaccaatggtcaggcagaggcagcaaaaagggttatccttaaagccctacgcacaagactcgacaagtccaaaggtatatggaaggacaaactccctagcatactttgtgtttatcattgttcaccccaaacaacaactaacgaaacttcttttcgccttacatacgagacaaacgccatgatccctgtcgaagtagggaaatcgccgacaaggaggttgtttttccaggaacagaataatgaagaaaacacgagggttgaactagagacaaaagatgaagtccaaaagatggtcagaatcaaggaagaggccactaagcttcaagcatcaagaagatacaataccaaggttcagccttga

SEQ ID NO: 102495 - DNA, 684 bp, Glycine max
  Peptide Sequence Number=SeqID_219273
gccgtcaggcagcctgggtttttcgctaaaggtcttgacttgggactttttgacccatttaaggatgtgaaggatggtgaactgcttgatgaggaagacattgctactggggaggaagatgctggcgaagaagaagatgatggggctaatgaaatagggaacaagataatatttgatcatctctggtttaatctcaacctggttaaaggtcttgctaatcaacttggcataccaagggcaggccttgggtttgacgagccttggaaattcttcgaggctcaccaagggcagaccttgggctcactaaaggcggaacttgggtttgacgagcctttggagattcttcgaggctcaccaagggtagaccttaggtttgacgagccttggagatttgtcgaggctcaccaagagcggaccttaggtttgatgaggccttggagattcgtcagggctcatcaagggtggaccttcggtttgacgagccttggagattcatcaaggatcaccgagggctcaccaagggcggaccatgggtttgacaagttcttggagattcgtcagggctcaccaagggcagacgatgggtttgacaagccttggagattcgtcaaggctcaccaagggcagaccttgggtttgacgagccttggagattcatcgacgcttaccaagggcaaaccttga

SEQ ID NO: 102496 - DNA, 636 bp, Glycine max
  Peptide Sequence Number=SeqID_219274
atgaagcatctcaatctcgattttcagctcattactaatgaaaatggtaaaaggaagttgaagattgatgcttggtttggttctcggaaaacatctgtcgccattcgcaccgccctaagccacgtcgagaatctgatcaccgacgttaccaagggctaccgttacaagatgaggttcgtgtatgctcactttccaatcgacgctagcattggcaacaacaagtttattgaaattgtgttattaggtttagttattgatttggtgaaggatgagttgattttggatggaaatgacattgagcttgtttctaggtcttgcactctcattaatcagcattacctgcatcagagagtaaaaaaattgacttggagtgtgtccataatgtcaaaggctgaggttgaggaccaaactataacatggttaactcctcattcactacaacaggttgtatctgatgattttgacatcactaccatgctaaactttctgcaattgtatgagcttgtaggccttggatcttcttcatcaatggcagtggaatggagaaggaagaaagatgattggagatgccacttcaaggagaagatgggtcaagaacaagctcaccaccataggaagccatggataagagcttga

SEQ ID NO: 102497 - DNA, 369 bp, Glycine max
  Peptide Sequence Number=SeqID_219275
atgtgggcaattcgctgtctgcgaccttgtgagaagtccactgaacgttatgtaatgttcccacaaagaatttgcaatggagagcatcattgccaccactcattatcatataagcatggtgggatctttgggacccaggaaatggggataattggcctcattcctcacctcctcaacaaaagatcattgcaattgtcggtcttcaatgagaaattcctagtaagtgcgagtcatcaactcgtgttgactatgtctctgccctttgtacacatcacccgtcattcctaccgattgaatggtccaatgaagtgtttggattgtagcgacgtaggctattcgttgctcgcaacattgttagaagtccactga

SEQ ID NO: 102498 - DNA, 300 bp, Glycine max
  Peptide Sequence Number=SeqID_219276
atgtccaacagaaagaaagataaagacaaaagctccataatttactatgaatgcaaaaagcccggacacttcaaatataatcttcacaaactgttaagatactgtagaagttccttagacaaatctagaaatggatacgatgggaaagtatatgttcatgataaggacaccattctccattatttttgtggtaagactggacacacgacatctaggtgtagagatcgacctaagaagggtacaccaccaatacttgatggaagcttgcttgtggagcttctatggaggctggatctttga

SEQ ID NO: 102499 - DNA, 471 bp, Glycine max
  Peptide Sequence Number=SeqID_219277
atgttattgtcatcatttgcatttgagcaccctcgacaccatccgcatctccctctcctagatttccactcccctgccaaaccatcatcccttcgacacccaacgctgcttcatcaccttcgcccacctcctcttcctctctcactccccgtcgagctctctaaggtcatcaagaccatctccatcttcaacaacaacaacaagatattcatcctcattagcttcacgggttgcaagctttgcaagcatgcttacccacatgtccaactctactcacaccccttctccttctggttcctcacccccaaacccctttgtggaaggaatctaaaagcagtgtggagtggctctctagtagccatgctctgttgccatgtggcgatcacaaggagggcgggtgaagatgatgacgagggcatggggtgtggtggttctgggaagggtgtcgatgaagaaaggaagaacaaataa

SEQ ID NO: 102500 - DNA, 1629 bp, Glycine max
  Peptide Sequence Number=SeqID_219278
atggcctacaaattcctccaggtgacaagatttatgagtatatacttttccgtgggactgacatcaaggattttccaggttaaatcttctccacctgtccagctactccacaagtcaacaatgacccagctattaatcagtgggtctttgagtgatcctagctctcataccacacagcatggacttcccgggtcaaatttccaagggcccttgcctttgtatcaacctggagggaacataggatcgtggggagcttctccgtctgctcctaatgcaaatggtggtaggcttggtatgccaccaatgtattggcaaggatattatggtgccccaaatgggcttcctcaattacaccaacaatctttgcttcaaccaccacctggtttatcaatgccttcatctatgcagcagccaatgcagtatcccaacatcaccccctctttacctactgtatcttctaatttgcctgaattaccatcatctttacttcctgcgagtgctagtattcctagtataacatctgcttccttgcctccatctaatttgcctccagcaccttctgctttggctcctgctccatcagctttgcctcctgcaccgtccgctctatctccttcatcttctgctttatctcccgcaccttctgcaacacttgcttctgaaattttgccagtatcagtaacaaatgaggcacccattgtttcaacttcagcagccatgttagctgctaacttgccatcactgaccatttctggtccagatataaatgctatagtgccacccatctccagcaaaccgcatgcaatttcaggttcaagcttgccctatcaaactgtatcccagttttctcctgctgtcgtgggatcatcaacttctatccattcagaaacatcagcaccttctctcgtaatcccaggtcgattattgcagcctggaccaagtatagtttcttcagctcagccttcacaagcacctcataaggatgttgaagtggttcaggtatcttcgacatcatcatctgaaccatctgtgccagttcttgctgaaactcaaccaccaatattgccattgccagtaacttcacgacccagttacaggcccggtggagctcctatccaaactcatcatggctataattatagaggacgtggaagaggaaggggaactgggggtttgcgcccagtcacaaaattcacagaggattttgattttatggcaatgaatgagaagttcaaaaaggatgaagtatggggtcatcttggtaaaagtaagtctcattcaaaagaaaaagatggggaagaaaatgcctttgatgaagattaccaagatgaagacaatgacgatgtatcaaacattgaggtcaagcctctatataacaaggatgatttctttgactcgctctcttccaacatgcatggtaatgcttcacagaatggaaggactagatactctgaacaaatcaagattgatactgagacgtttggtgattttgtgaggcaccatggtggtcgcaggggccgtggccctggccgtgttggacgtacccgaggtggttattatggaagattaggagggtatggctataatggacgagggaggggacgtggcatgtccagtcagaatttgtag

SEQ ID NO: 102501 - DNA, 198 bp, Glycine max
  Peptide Sequence Number=SeqID_219279
atgatttctgctattccagcaggaaaagcatccgcaacggtcacaacactgagtgctttctattacaaaatgaaagggcagaacaatctctgtgggagagcagggaacaccattcatgacgctccaagcatgacagcgaaccacaacgcaacacgctacatggagcgaaccgcaaagcaacacactacaacgttttag

SEQ ID NO: 102502 - DNA, 240 bp, Glycine max
  Peptide Sequence Number=SeqID_219280
atgcaaggttctcaaagaaaccacgaaggaaggattggaggcttcgttctctaccgaatccttgagttgagttttgaagatttcgctttgattaaactgttcttcttcggtttaggggaagagaaggaggaagaagatggttgttttacactgctggacgtatttgaagcctgcaacacttgcctgggggagtttggcttgcctgggagagctgatccaactcaaatttttctgctttga

SEQ ID NO: 102503 - DNA, 222 bp, Glycine max
  Peptide Sequence Number=SeqID_219281
atgaaagaagtagccgagtcattgaaagaatttgttgaagtgactaagaagaagatggagaacaaaaaaaagatggagataaaagaagctcaagaagtggtacatgaagtggacatagagcaaattgattggttgaacaggaaaaatcccattaaatttgcgattataaaagctcttccattggatgtgaaagaggattacatcttatcttttatgccttga

SEQ ID NO: 102504 - DNA, 396 bp, Glycine max
  Peptide Sequence Number=SeqID_219282
atgggtgaagtagaggaggtgcaagagcagatgaagaccgacatggaggccatgaaagagcaaacggccacaatgatggaggccatgatgagcatgaagaagataatggaggtcaatgcagctgcaatagccgctaccagtaccatcgctgagatatgtaggtctggaaggcaaaaagttgggaggtacgggcgaccctcatttagtgcaaaaaacaagcatgccttcccaccatatggcttgcctcccaactatacaccacccaatgtggcgtacactcccaatgagaatgtcaataactctactcctatactcattgagagccaacaacctcaatctgatcatgcacatgtctttcgacccattggggagacacatgaaattccccactgttag

SEQ ID NO: 102505 - DNA, 303 bp, Glycine max
  Peptide Sequence Number=SeqID_219283
atggcttacagcaaaattctttttaacaaagcaattgagggattgagaaagtatatcactggttttccatgcaaacatgcatgttcttgtattacttatttaagagacaatgtggagaattattctgacaagtcatttacaactagaatatggatggtctcttactctgaaattattcatccaatgcctgatatagatgttaacaccagagatgattacccactaattgaccttcctcctttgaaaaggatgcctagcaggcctagcagtcttggagaaaaagcaatgttgagggaccgttag

SEQ ID NO: 102506 - DNA, 921 bp, Glycine max
  Peptide Sequence Number=SeqID_219284
atggcagaggtctccacagaggccattgcctccttcgcccaatattatgaccagactttgagaatttctaaaatagtcaaaatctcgacacatgaattggaccacggaaagcaagtcgaaaatggggtagttagggtacaaaggaaatgtttggaagcaaaggcaagagtcttggcaagtcaaggtgaatgggccccgctcatggacatcttagcacttttgatcttcggggtggtcctctttccaaatgtggatgggttggcggaccgggcaacgattgatgcttttctcgccttttacgaccgtaaggaaagcctgtttgtcgctatcttagccgatctatatgacacattcgaccgaagatgtgagatgaacaatgcaaggatcatttgctgtacaccggatctctacgtatggttggtttcacacttctttcaccaagagatgagacacgtttgcctgctagaaggccaccgctcatgcactgagaaaaaagaggcaaactgggaccgactcttagcaagcaaagaaggagcatctatcaattggttcccccgatggaaggaaggaagaaccgggattctcatttcgtgcgggaaatttccaaatgttcccttgatggggacgaggggttgcatcaattacaatcccgtcctcgctataagacaacttggttaccctatgagaggggcgccatcagaggaaggcctcataccttttattacacgaggtttcaatagcaccaacgcgggggtgcttcagcgggtccacaaggcatgggaaatgtcgcaaagaaaggacaaggaacttagggggagtagcaacgggcccatcggcggttaccataggtggttgaaagcctatgcacaagttctggattggctctcgagtttgaggaccactaaaggggatggagattga

SEQ ID NO: 102507 - DNA, 183 bp, Glycine max
  Peptide Sequence Number=SeqID_219285
atgagtacgccaagatatcagcagaaagggaagcaagggaaagggagtcaagaacttccccgattgctagccaaggccaaagcaatggcggacacctattctgcccccgaggagatccacggacttctcagctattgtcagcatatgatagacttaatggaccatatgattagaaaccgctag

SEQ ID NO: 102508 - DNA, 2961 bp, Glycine max
  Peptide Sequence Number=SeqID_219286
gaaaaaagaaaagaatttaaacaaggtggatcggtcttggcaaattctccaattgggcaaaaggagggaggaatcaaaggcgtaacccgcaacccaacccttccccttccctctaactccatcaccgcatcaccacaccagtcccctgcaccctcaaacaccagatccttccccccaatcccaacgatgaacgatttcgacggcctcttcacctccgatttcggcctcaaaccccagggcaaatccgcgccaatggctcctcaacccaagggatcttccaactccgcatctctcaacttcgatttcggatcgcgatctgcccgcgcctcctccaacttcgacgatctcctcgccggcgccggatccgacaatcgccgctccgattcccccttcgatttggattccatgtacggcggcccccctgctaggtccgccaactcgccgccgccgccggtctacgacaagccggtgtacgacgacgacattttcgacggcgtcccggggctgaagagcacctccaaggttaaattcgacgatgttttcgcgacgacggcagagagtggtggtggagccgccgcgttcgacgatcttctaggcggctttgggaaggaatcgaagagtttggatgggaagagatcggagaaggatgagaaaggtgtttccgattttgatgatttgcttgctggattcggacacagtaggtcatcatctggtggaagctgtcagagagagctgaaatttggtgttttttggctttttaatctgggaacgtcaatgagaaatgcgaaaatcgactgtgttgagccaaggaattccggaaagtttacagcgagttgcaaattctacaattttaagctttcatctattgtggagaaactctctggatttgctgatatgcacactcctgatatcggtttatcctcagaaccaactgccagtgcatctaaaacaatccccactgcagcagaagaccctttcaaagtatttgaatcagcttcagccccagtggattcatctgcaggccactttatgaacccgttggaagaaattagtaaatttagtagttctggaagcacaaaaaatgatagttcttcaacttcaaatggcaaagtatatgaagatattgatccttttgatggtcttggaaaatctgtaccagctttctcatcagagagaaatagcaggaagggtagcagttccccaaggttgaatacaagcacaagttggactggagataaagaaccagttgataaaatatctgggaggagtcctgagaggcacacacaaaacaagattcctgttgaaaatgatcaggaatttctacatgccccatttcacatgcctacctattcatctgattctgataaaccagttggccaaaggtctacttcccctccatataataatgtcgattttagacaaaccaatattcaggcagatatgtctccgaaatatgaagataacttggaagcaagcgaggatatatggctgacggtatcagagattcctctttttacacaaccaactactgctccaccaccttcaagaccccctcctccacgaccagtacatattcccaagtcaggaacaacttcaccagcttctaccaatgctagaaagaagactaatgaattttcttcttttcctggctctacccgattctctcagggacctaagtctgctcctgctgctggaagggtatccccttcatctcagtttgatgaacttgatgattttgcaatgggcagaagtcgtggtaatgataatgagagtgcaaatggtcttcctgatgaagaattagagatgaactctgctgctgcggctatgaaggaggccatggatagagctgaagccaagtttaggcatgcaaaggaagttagggagagagagtattcaaaggctgctaggagcaaagaagctgtgcaaatggaaaaagatgagagaactgtgctagaggagcaagaaaaccaggaaaggtttgaccgagaacggcagcaaaaggagaaggaaggaaaggagcagaggagacttatgaaagaaagggaggagaaagaaagagaacaacagcgactagagagggaaagggcaagacaggctgtagaaagagctactagagaagcacgtgaaagagcagctgctgaagcacggcaaagagctgagagggctgctgttgagaaagctaatgctgaagctcgaggacgtgctgaaagggctgcagtgcaaagggcacaagctgaagcccgagaaagggctgctgcagaggcgaaggaaagagctgaaaaagctgctgctgaggtgaaggatagggaaacacgggaaagagctacagctgcaagggctgaagtagaagcacgagttaaagcggaacgtgccgctgtagaaagggctgctgctgaggcccgagaaagggcagcagctgctgcaaggatgaaccaacaaaagaatgaaaatgatcttgaatccttctttggcatgggtgcacgagctagcagtgttccaaggcctcccagagctaactcttctgacaatgtatttgaatcccaatttcagtcagatgtaacaaggaaatctacaagtgcatctacaagtatgaagaaaacatcatcatccactaatattgttgatgatctttcctcaatttttggagctgctccaacatctggagagtttcaggaagttgaaggggaaactgaagaaaggcgacgagccaggttggagcgccaccagaggactaaggagcgtgctgcaaaagcattggctgagaagaatcagcgggacttacaaacccaaagagaacaagctgagagacatccagtttctttgactgatttgattacagctgctgctgttaaaaaagcctataggaaagctacgttgtgtatccatcctgataaagtgcagcagaagggtgccaatctacagcagaaatatgttgcagagaaggtgtttgatctactcaag

SEQ ID NO: 102509 - DNA, 1152 bp, Glycine max
  Peptide Sequence Number=SeqID_219287
atgcctgaaaacgcagccacaaccaaccttaaccaccttcaagtttttggcatcgaagatgatgtgccttcgcattcacagaataactccaaatgctatgatgatgatggccgtctcaaacgaactggaaatgtttggactgcaagctcgcacataataaccgcagtgataggatcaggggtgctgtcattagcttgggccatagctcagctaggttggattgctggtcctactgtcatgttcttattctctttggttaccttttatacttcatccttgttggctgattgttatcgtgccggtgaccccaattctggcaagagaaactacacttacatggacgcagttcgctccattcttggtggagccaatgttacgttgtgcggaatatttcagtacctgaatctattgggaattgtaataggatacacaattgccgcttctattagcatgatggcaattaaaaggtcaaactgtttccataaatctgggggcaaaaacccatgtcacatgtcaagcaacgtatacatgatcatttttggcgcaaccgaaattttcctttctcaaattcccgattttgatcaattatggtggctctcaacagttgctgcaataatgtctttcacctattccataattggtctctctcttggaattgccaaagttgcagaaacgggtaccttcaagggtggcctcactggaatcagcattggaccagtgtcagagacccaaaaaatctggaggacttcccaagctcttggtgatatagcctttgcctattcatatgctgtggttcttatagaaattcaggacacaataaaatctccaccgtctgaagcaaaaacaatgaagaaggccacattgataagtattgcagtgaccacaacattttacatgctctgtggctgcatggggtatgctgcttttggagatgctgcaccggggaatctgctaactggctttggcttctataacccatattggcttatagacattgcaaatgcagctatagttattcaccttgtgggagcataccaagtgttttcccaacccatctttgcctttgtggagaaagaggtaacacaaagatggccccacattgagagggagttcaagattccaattcctggtttctccccttacaaacttaag

SEQ ID NO: 102510 - DNA, 177 bp, Glycine max
  Peptide Sequence Number=SeqID_219288
atgacaaatattctcaaggcacatattctcgttgtcaagcatttgatcaagcacataaaagaacgaattgcagacactcagaattcggcttctctcaataatcaaattcacttgacaaatgaagaacattacgcaaatgcatacagatggattttaaaagagtttataagaatgtaa

SEQ ID NO: 102511 - DNA, 111 bp, Glycine max
  Peptide Sequence Number=SeqID_219289
atggctgacaagcatgtggtactagaacctaactggttagtcctaagtaagaaatatatacaaaggagagattcctatattgatagtcttctgaatgataaggttgactaa

SEQ ID NO: 102512 - DNA, 294 bp, Glycine max
  Peptide Sequence Number=SeqID_219290
atgccggctttcatctattcctgtacttcctctacccatcgtcctagatttggatctggtgcgatagggatgccttgggggcgtttagttatggcgtctttcctaaaaagaccaaataaagttataactagtcaagatctgagcgacaatataaactccctaacgactcctaattatatgggccatcaagtctatcatgtgctgacaatagcggaggagcccgcggatctcctcgggggcgaagtaggtgtctgccatagcttggcctttgccagcaatcggggaagtttttga

SEQ ID NO: 102513 - DNA, 249 bp, Glycine max
  Peptide Sequence Number=SeqID_219291
atgggtgtcaatggagaaagtacggacaaaagacagcgaaaggcaacccttgtcctcgagcctactaccgttgcagcatgggaactgcatgcccagttcgtaagcatgttcgtggatatacatttacattttcttgccatcatttcactttgctttaattacttccttgtgacatgcatacattatacacattgcatcattgctgtgagaggagggagaatcttaaattcagctgagaaaaacccttga

SEQ ID NO: 102514 - DNA, 165 bp, Glycine max
  Peptide Sequence Number=SeqID_219292
atggagcaaaaggagctagaaaacttagtgctcaagggtaaaaatgaaaaggtcaaaggagtttcgacaggggaatggatggaagctggccaaattgaaaaaagaaaaaaaaagaagcaagaggatagcaacttgattgaccaaaggggaagcaaaaaggtttga

SEQ ID NO: 102515 - DNA, 511 bp, Glycine max
  Peptide Sequence Number=SeqID_219293
gcctgtccaaatattgaagagcacaaaagctgatggatggtctgctatcagtgatgaggaagttgaatctattctgcctgccgcagcttatgcacttgccaagatacacatgcatcttgtttatagtgggtattgttatacagcacgtggtggtttttgctacacagaagaagacatatttgacttccacacaggcaaggatttttctgcctgccttttcactaaaattctatacttcatgagtgatgacggcaagggagtagatggcttgccaactgaaggtgtagaaattacatctttcgatcaggaaggtgcccgctacatgatttatacaccatctgatccacttctttttgttgctatgaagggtgagaacgggatgttatacattgctgatgatgatctacttgaggatcctgctgtcattgacgccatagatgaggagaccgaatttaatgccttggtggaagaagaagctgcacttatagaagcaatgatgcatgaaagataa

SEQ ID NO: 102516 - DNA, 267 bp, Glycine max
  Peptide Sequence Number=SeqID_219294
atgacctgtccacaacctcctagcatcaaccaagatgcatcgactagatcatgccttatcaagaaagcatcgcctcggtgtggaaagtggcctcacgtatttcttttgtcgactcttggcattgtcgttggaacaagtttcacattgattctcactgtcagtgcaattcaaactatttttgccgcacaactaaagaaggaacaagagcaaacacaaagccaagatattgaaacggctttaccttcaacctctcctcctccatcataa

SEQ ID NO: 102517 - DNA, 144 bp, Glycine max
  Peptide Sequence Number=SeqID_219295
atggccaccgggataattgggaagagagaaaaagtgggtccagtagagcagagactggtacacatggtgtcgactcgaaaaagacagagccgctacgataacagtcaacgattttaccaaaacagggagggggctgtgacgtga

SEQ ID NO: 102518 - DNA, 270 bp, Glycine max
  Peptide Sequence Number=SeqID_219296
atgtcagaagctgaaaaggtatactacaggtttaaccccatattcatgcttgctgagccattgatgctggcagtgactgagcagatccaagggttccttattttggaaggtcatattgcattgtggcaattttgtgtggagttaagaggactaattgcagttatagatatacttgtttgtacaatttttcccaggcaatttgatcttgtgccattcatccaaactaactttgaaccattccttctatttaagaaacataggatatgttag

SEQ ID NO: 102519 - DNA, 1521 bp, Glycine max
  Peptide Sequence Number=SeqID_219297
atgtcggtggttccttgcaattgcaaccacaccacagagaaagataaccttagtggtgaaagtgagagctttcacaagttttttgagtgctggatttctgagcaaaaacaacatctgaaggaccttttagctgctgaatcaacccagctaattagtgatgaggagcttcaggcactgaatgataaggtggttgagcattatgagtactactacaaggccaagtcaaggtgtgcaaagcaagatgtattggccatgctgtccccaacatggatgagttccttggaagaggcttttctttggattggtggatggagaccaagtatggcatttcacttgatatattcaaagtccggcttgcaattcgaggcccggctcgatgaagtcctccagggtctaagaacacatgatttgggggacctatcagcatcacaacttgctcagcttgatgagatgcaaaggaggactatcttggaggagagggagatcactgatttgatggcaaggcaccaggagacagtggctgatgcctcaatggtggagttgtctcatgtggtttctgagatgattagagccaatcaaagaggagaggttgatcagagtaaggaaatagagaacaaggttgaatcaactcttgtgcttaaggaggaaggtttggagaagattctgctgaaagctgatgagctaaggtttataacactcaaggatgttgttgatgttctgactccaaaacaggccattcatttcttgattgctgctgcagagctgcacctgaggctgcatgagtggggcaagaagatggatgcaagaaaatgcaatcaaggttttggtgaagaatcatatcagaaggaatatgaagtattgagggaaagaactgctagtggggatcttggtgctgcacaagtccaggcaaatgctggtgtggatcctgatgttgtgactgctatccggaggcaacggctaagtgagattgcactatggttttgtccttataataacagtcacaataacaacattagcagtgtggacacagtttcacagattgtttctgatcagcctttgaatattgttactgaagatgctgcccccgtacaaaatcatgcaaccaagtgggcagtgaagggtacaaggatcctgcttgctacggtgtttcttcatctgctagaccaaatactggttttacttaaagaagttgctttcatccttattcaatattctaccagcattctgtataatgatcgcctatatgggtcttatgccaccgcttatctgctactgagatgtggtaaagagaaagtcatggttttaaagttttcaagattccttttgagcctcgacaaacccattcggaaccctaaaggttcctccaagtatgcaattgtggagaggtttcactatacaatgcaatatgcgattgagggaatgtcttccgattcggtgtttcacgtgaagatgcttgcacatccccaaattcgtttggccgagttttcatcaagtgtcgcacgattcggagggtctgactga

SEQ ID NO: 102520 - DNA, 270 bp, Glycine max
  Peptide Sequence Number=SeqID_219298
atggttaggtttctgctggaagagagactaagtgaagatagatttggggtcaatacttcagtacctgaactcatgcaggacatttctggacagtgtttgccttcaatacttgcaagcctcactttattgcaatcaaagattgggtgcattcttctctggaattttgatgctaaaatgccaaatgtatgctggaacaccaatgaagccataaaagggaataaacgtatgaaagggttaagctactcttttgggcaagatcaatgtcagtaa

SEQ ID NO: 102521 - DNA, 141 bp, Glycine max
  Peptide Sequence Number=SeqID_219299
atggggatcactggtcgaatcacttgggacagcttgggacacggttcagcctatgaggacttgaaaagatcagaggggagtgattcaactggttttggtgcagtcctgtccaaatgggttgaaaagcatcctatgaattag

SEQ ID NO: 102522 - DNA, 1359 bp, Glycine max
  Peptide Sequence Number=SeqID_219300
atgaagatggggaaagttgtgatggtggttgcagtgatggtgttgttcaacatgttttattgttcagcttggtctggtggtaacaaacacaaaagtggaaggaactcgattctcccaggtgaagccatttcatcatggccgagtctattgaaccctgctggctcctctattgtgttccctctttatggaaacgtttatcctgttgggttctataatgttactctcaatattggtcagccagcaaggccttattttcttgacgtggacacgggtagtgatctcacatggctccaatgtgatgccccttgtacccattgctctgaggctaatcaccaatgtgaagtgccaaatcttgagagattgaaaagctcatccttgcttatgaatacaccccatccactccacaggcccagcaatgactttgttccctgcagggatcccctttgtgcatccttgcagcccactgaggactacaactgtgaacaccctgatcaatgtgactatgaaattaattatgcagatcagtactcaacctacggcgtgcttctcaatgatgtctaccttctcaactctagcaatggagtccaacttaaagttcggatggctctcggatgtggatatgatcaagtattttcaccttcttcttaccaccccttagatggactgcttggccttggaaggggaaaggccagcttgatatcccagttgaatagtcagggcttggtacgaaatgtgattggacactgtttaagttcacaaggaggagggtatatcttctttggaaatgcatatgattcagctcgagtgacttggactccaatttcatctgtagattccaaacattactcagcagggccagctgaacttgtttttggaggaaggaagactggggttggaagtctgactgctgtttttgacactgggagttcttacacttacttcaactctcatgcttaccaagcactactttcttggctgaataaggaattaagtggaaagcccttaaaagtagcacctgatgatcagactttatctctctgctggcatggtaaaagacctttcacaagcttacgcgaagtcaggaaatacttcaagcctgtggcacttagtttcaccaatggtggaagagttaaagctcaatttgagatccctcctgaagcttatctgataatatctaacctgggaaatgtttgtcttggcattctaaacggctttgaagtagggttggaggaactgaatctagttggagacatatccatgcaagacaaagtgatggtgtttgaaaatgagaaacagttgattggttggggacctgcagattgcagccgtgttccaaaatccggagatgtcagtatttga

SEQ ID NO: 102523 - DNA, 1854 bp, Glycine max
  Peptide Sequence Number=SeqID_219301
atggctagcatgaagctgggatccaaatctgaaatgttttacctctatggccaaagttggttgtgctcaactggacttccaagtgatgtcattattgaaattggtgacacatctttccatctccacaagtttccactgatatcaagaagcaaagtgctagaaagtatgatgaaagaaacatcaagtgaacatgagaagtctgttttggaacttcatgacctaccaggaggagccaaggccttttttcttgttgctaagttctgttatggtattaaaatggagttgactgcgtcaaatgtagttggtctcagatgtgcagctgagcacctgcaaatgactgagaactatggagaagggaacctgatcatgcaaacagaacatttccttaatcatgtgtttagttactggacagacactcttaaggctcttaaaacatgtgaagaggttttgccttttgctgaagagcttcacatcacttcacgaagcatacattctttggtgttgaaagttgcagatcaaagtttggttagttttcctgtctcctcatctcaaagtgtttctcagagttcagaggatgcagaagtgtggaatggaataagcctaacaccaaagacctcaggtgaagattggtggtttgaggatgtttcttctctcagtttgccattgtataaaaggttcgtgcaaggtgctagtgcaagacaaatgaagcctaagagaattgctgaatcccttgtttactatgcaaaaaagcatatccccttattgggaagtcaagcaacttctcagaatggaaactcgtcttctttaaagtcaactatttccaccccttctgaagcagatcaaaggaatcttattgaggaaatagtggagttgctgccaaatgaaaagggcatagcaccaaccaagtttttgctggggtgtctgagggcagcaatggccttatatgctagttcatcttgctgtgcaaacttggagaaaagaattggtgctcaattagatgaagcagacctggaagatcttttgattccaaatattggatactcaatggagactcttcatgatattgactgtgttcacaggatgcttgatcatttcatgattgtagagcatgatgttattgattctacatcaaacgatatagaggaagaaggacgcataattggaggttctcaacctcagagtccaatggcaaaagtggctaacctgatagattcctatttagctgaagtggcacctgatgtaaatgtgaagttaccaaaatttcaatcacttgctgctgtaattcctgattatgctaggaccctggacgatggcgtataccgtgccattgatatatatctcaagagtcatcaatggctgacagactcagagaaggaacaaatctgcaggctcatgaattgccagaagctgtcattggaagccagcacacatgcagctcaaaatgagaggttaccacttcgtgttgtggtccaagtgttgttctttgaacaactgaagcttcgcacgtctgttgccggctggttctttgcttctgacagtgttgagaactcacaaaacctgagtgcaaatcttgctctaataagaaacgatggcaacacaccacccaacccagttttggcctttgataacatgaaagagagagtggctgaacttgagaaggagtgcttgagcatgaagcaagatttggaaaaaatgatcaagtctaagggaagttggaacatgctccttaagaaattgggttgcaagcttgtgcctaaaccctctaatctcaaggtctccaagccatgcaggaagtccaaaatatcaccagcatccacaactccaatggaagaaaaggccatggaagtgaactaa

SEQ ID NO: 102524 - DNA, 504 bp, Glycine max
  Peptide Sequence Number=SeqID_219302
atggctattgccattctagccactcaatcattttgtgatttcaccacaagcatagcaagtgcggtagccatggagggagaaaaagggaaagtcactgagctgaggtttgaagctaacgttccaattctgtggtcaattatgactacagtccagagtaagggggcagcaatgggaactgccacaactgagaaagcattcaaaagatggggcaggagaaacccatttgtgagatatggccttcctatgatctccctcacagtccttggctcaataggcctttcccaactcttgcaaggcagcaaggatattgcaaaggtgaaagatgatcgggagtgggaaataattgaaacaagaaaagcgttatctaggacaggaccagtgaatgcatacaatccaaaaaagatttccttggaggatgagctaatggctttgcaacaaaaggtggacattaacaactatgagtacaagaaaattcctaaaccaaaagagggcaatcgagactag

SEQ ID NO: 102525 - DNA, 1604 bp, Glycine max
  Peptide Sequence Number=SeqID_219303
gcggagcgaagcaatggagcgcgctaattccgaattttcggagaagcaggggaatcggttcgtccgtgttctcaagttctctcaggaaacgattgcaattgcggtttttcgcttcgggagaaaatggcggcaatggaggtgttctggaggagatatctgaagccgaaaaggagcctacgaattttgcgtggccggataacaagaaacctagggtttgcatattaggcggtggatttgggggcttatatactgctttaaggttggaatcattggagtggcctgatgataaaaaaccacagattgttcttgtcgaccagtctgaacgttttgttttcaagccaatgttgtatgagcttctatctggagaagtggacgaatgggaaatagctcctcgtttctcagatttgctggcaaacactagtgtgcagtttttcaaagacagagtaaaagttttgaatccctctgatcattggggaatgaatggatccaaagcatctagttgtggaggaactgttcatcttgaaagtggtcttcttattgaatatgactggtacaatctgcactgtttaaccaggctggttcttgcgttgggagctgaagctaaactggatgttgtaccaggggcaatagaatttgcaattcctttctcaacgctagaagatgcacgtaaagtcaatgataaattaacaaaattagagagaaagacctttggtacggactttcaaattagtgtggctgttgttggttgtggctactctggagttgaattggctgcaacactggcagagcgattacaaaatagaggaattgtgagagctattaatgttgaaacaatgatttgcccaaatgccccacctggcaatagagaagttgcactaaaagttctttcatcaaggaaagtcgaacttttattgggttattttgtccgctgtattcggaggctcagtgatttagagtcttcagatcccctgacaggagtagatgaaaatagtactgaagtagtgcctgattttgagaaatatatattggagctacaacctgctgaaaggggaatgcaaagcaaaatcattgaagcagatctggtattgtggactgttggaaccaagcctcctcttcctcagctggaaccttcagatgaaccatttgtaattccacttaatgcccgaggacaagctgaaacagatgaaacacttcgtgtcaagggtcacccccggatatttgcccttggtgactcttctgcgttaagggattcaaatggaaggattcttccagccactgcacaggttgcatttcagcaagcagacttcactggttggaatttgtgggctgcaatcaatgggcgtccacttttaccatttaggtttcagaatctaggtgagatgatgaccctgggaagaaacgatgctgccatttctccgagttttattgatgggctgaccttagaaggttccattggtcatactgcgaggaagatagcttatttgatcaggttaccaacggatgaacataggcttaaagtggggattagctggcttacaaaatctgctattgattctgtgtcatcgctacaaagtaccttgtacaaggtcctttcgggctcttag

SEQ ID NO: 102526 - DNA, 1683 bp, Glycine max
  Peptide Sequence Number=SeqID_219304
atgggtttgttcagaagtaagggtgtgatttataggccagtgaaggatgttaacttaggtcctgatagcactgaattctatctccaagccaatgtcaaagctccccgcatgactggaatcctggtcaagattttcacttggttcttggagtctccaatacttggacccttgctattgtatatattgaagggaaacaatcttattcataaacttattacaaatgcagacttagaagagtcacccctctatgttccctcacatcattttgaaggtttgttattttccactaggttctttccatcagaccacaaagaacaagaagtcaaatgcttggattctgctttaactccagaagaacaagttcaacttgcaatagagtgcttacctacatcttcagaaaaagcacataatggaacaaactcttcgttctctcgttggaccataatggattattccagagcctacagctcgggagaaataacaccactcatggttgctgaacgatttattgccgctgttaatgaatcttcaaaacctccactccgaatgggattttttattcactacagtgctgatgatatactaagacaagcaaatgaatcaactcttcggtataaaaaaggggaacctatctctgtgctagatggagttcctgttgctatcaaggatgaaatggattgtttgccatatccaactacaggaggtacaaagtggttgcacagagaaaggccttgtacagatgatgcttgctgtgttaagcgtctgagattatgtggcgccatacttgttgggaagactaatatgcatgaacttggggttggaattagtggtatcaatccacattatggggctgctagaaacccatatgataccaataagatttcaggaggttcttctagtggatctgctactgtggtgtctgcaggattgtgccctgttgcccttggtgttgacgggggaggttctgtgagggtgcctgcatctctttgtggtgtagttggtctaaaaccaacttttggccgtgtacctcattccggagtccttcctctaaactggacagttgggatggttggaatactagccggcactgttgaggatgcattgatcacttatgcagccattagtggagaaatttcatcccatcagccctctaatatgcttaccaagataaatcttccactgctgcccttgacgaagtccatatgtgacatcaagttggcaaaatatgggaagtggtttgatgattgcagtgatgatgtcatattatgctgctcccgtgccttgaggaagcttcaggatcattatggttggaagacaattgatgtcactatcccagacatagaagcaatgcgcctagcacattacttaacaattggatcagagtgttccacttggtttgattcttttggagaaaaatattttgcagaatttggatgggacgcaagggttgcacttaacatctatggtgctttcagtggcaaggagtacattaaagctcagaaactgaggaatcgacagttgcagtttcacatgaaaatatttgctgaggcagatgtcattgtgtcaccaacaacaggtgtgactgcatactcgattcaagatgatgcactaaagactggtgaacttgactacgtaaatggaggaaacttcctaggacttcctgctgtgactgtaccggtatga

SEQ ID NO: 102527 - DNA, 177 bp, Glycine max
  Peptide Sequence Number=SeqID_219305
atggctcggaccagtctttcttctatatcaataccttttcttattctgctgataatagcctttactttctttgcacagctagctccagttagtgcagatctgcaaaagagaaaatttggtcccatgtcaagtccacctcctccacctaggctttctcctggacctggttcaggttga

SEQ ID NO: 102528 - DNA, 332 bp, Glycine max
  Peptide Sequence Number=SeqID_219306
cacgggctgctagtagatttgctgagtgccagaagaccattgcatctcttggacagcagttaaaatcccttgcaactttggaagactttctacttgattcagacaaccctatggagtcaacttgtcaagtcactaaaggtcaccaaaatggtggtgaacatttgaaactacatcatagtgatttgagcttgcccaaaaaagattctgagtcacccatttcgtttaactcaccaattaccaatgagaaaagcagtaatggctttgccatccttgacctattcctcttgcaattcgacaataagacagctggtagtagtacccccatgttcaag

SEQ ID NO: 102529 - DNA, 213 bp, Glycine max
  Peptide Sequence Number=SeqID_219307
gttggatacgataaattgggtttgcctattgggcttcagtttataggaaggccttgggctgaagcaacactgatccacttggcatttgcaacgcagcatgtcagaaggaagtatgcacaagcagtgtgtcatgtcttttcaagcgaaagcatagccatgttatggcaagtttcagtcatatcattcaaaagcaatagtgctgtagcagggtag

SEQ ID NO: 102530 - DNA, 1653 bp, Glycine max
  Peptide Sequence Number=SeqID_219308
atggtatatccaacccaagctggtttttctcctgaagtcacgtctaaggctgcaccgaatgaagaagttagtacccccaaaaaaagtaaagaagaagatacagatgtgaaaattattacagacaaattagctactgctctgctgacaattagtgcaaaagaagacttagtaaagcagcattctaaagttgcagaagaagctgtctcaggctgggagaaggctgaaaatgaagtgtcatctttaaaacaaaagcttgatgctgaaaggaagaagaactcaattctcgaagaccgagttggtcatcttgatggggcactcaaagagtgtatgaggcagcttcgacaagctagagaagtgcaagagcaaaagattgttgaggctgttgtgaatagttctcgtgactgggaatccaaaaaatctgaacttgagaggaaagttgctgaacttgaggctcaacttcaaacagttaaagcagatgctgctgcatcaattcgttttgatcttcaccagagactagaggctgtgcagaaagagaattcaagtcttaaacatgagctgcaatctcgactagaggaactagaatttaggatagtcgagagggatttgagatctcaagcagctgagacagctagcaagcaacatttggagagtgtcaagaaggttgctaagcttgaagctgagtgccgtagactgaaagccatgactcgcaaaacattttctgtcaatgatcacaggtctgtgactgcatcttcagtttatgctgagtccttcacagatagcatgtcagatagtggagataggttacttgcagttgaaagtgatatgcgtaaattaggtggctgggagatgaatgaatgtgagctaagccgtttcgattcatgttcatcttctttagttatggaacttgatcaattcaagaatgaaaagggtaacggaaaaaatcatgcggtcccttcaactgagatcaatctcatggatgatttccttgagatggaaaggcttgctgcattgccagatggtgaaagtggaagcagttttgttagggaaggagtggcatcagatcaatctaatgttggtcaggctacaatgaaagctgaaatagaagctatgattcaaaaggatgatgaattggagaagaagctggggaaaatggaagctgaaatggaagctatgattcaaaagaatgttgaattggagaagaagctgaagaaaatggaagcaggtaaagttgaggtagacatggttttaaccaagtaccaaatgcagcttgagacatcagagagtcagacaagggaagcagagttgaaggttgcagagtttcaaacccagttagctcttgcaaaaaaatcaaatcaagaagcatgtgaagaactaaaagcaacaaaagcaaagaaggcgatagttgagtctacactcaaacttactcaaactgaggttgaagaactgatttcacaaatccgttctttggaggaaaagattcagaaggagcgagctttgtctgctaagaattcaatcaaatggggaaaattggaggatgaactttcaaaaatgaagcacaaagttctagttcagcaagataccgagataaagcatagggaatgtgttaatctcgatttgaaagttaaaacaggtcagtttgctaacacttattag

SEQ ID NO: 102531 - DNA, 1608 bp, Glycine max
  Peptide Sequence Number=SeqID_219309
atgagtggtcacataacgagaaggaacagtgttccacacaaacgccctccctccttgtccaagaagctcgaaaacggaagccttagcgaacctcccagcaaggcttcttctccgccacctcaagagtttgatgggggagaaaggacagttaagaagcttcggttgtcgaaagccctcactatatctgaggtgacgacggtttctgaagcgtgccgtagaatggccgctcggcgtgtggatgctgttttgttgactgattcaaatgttttgctctctggaatcatgactgacaaggacattgctactagagttatagcggagggtttacggcccgagcagacaatggtgtcaaaagtaatgactcggagtcctatatttgtgacatctgatacgctagccttagaagctcttcagaagatggtccaaggtaaattcaggcacctccctgttgtggaaaatggtgaagtcattgccatactggatattaccagatgtctttatgatgccataactaggatggagaaggctgctgagcagggcagtgccattgctgctgcagttgaaggggtggaacgccaccgtggtagcaatgtatctgctagtgctttgatagaagcattgagggaacgcatgttcaagccttccctgtcaactctaatgggtgaaaatacaaaggttgctattgcatcacctgcggatcctgtctatgtagcagcaaggaagatgcgggacttgcgtgttaattcagctgttattgtgtccttgtcgggaaccaagattcagggtatactcacttcaaaggacatactaatgcgtgttgtggctcaaaatctttctcctgagttgactctcgtggaaaaggtaatgactccaaacccagattgtgcatcagtagatacaacgatactggattctctgcatatgatgcatgatgggaaattcttacatcttcctgtggtagacaaagatgggtatgtagtggcttgcatggatgttttgcagataactcatgctgcaatctccatggttgagagtagctctggagctgttaatgatgtggcaaatacaattatgcaaaaattttgggactcagcttttaatctagaaccaccggaagattctgatactcatagtgaaatttctgggctaatgacatcagatggggctgatacatcgaagtctgcatatcaatctgtaggttttggaaattcatttgccttcaaatttaaagatctcagtggccgtgtgcatcgattcaactgtggtactgaacatatagatgagctagtttctacaatcatgcagagacttgatgtgaatgatgtggaacgccctatgattttgtatgaggatgatgaaggtgataaaattgttcttgcaactgatagtgatcttgtttctgccgtcagctatgctacatctgcaggaatgaaggctttgaagttgcatttggattttgggagttcaacgaaagcaacaactccaaaatcttgtacagccactagacagaaaactagtgctttgtctatgcgctctagtatttttgcaagtgcaattgttataacaagcattggcatgctggtttacttaaagcgctccaaacagtga

SEQ ID NO: 102532 - DNA, 675 bp, Glycine max
  Peptide Sequence Number=SeqID_219310
atggacgccctcaatcagttcctgggatacccactagtattggaagagggccaggagtgggaatatggtcagagaaggaaccgggccgatggatttgacaaggaggccattgctcagctgctatgcataccaggtcaagattttgcccggaccgctgccgggagacgggtgcggatcatgcacaccaacatgactaccctgacccagacatggatgacattgctgctcagcaacatcctgcccagcgatcataattccgacctccctctgccgaagtgtatgccgcctactaggtacactctagacccaaataagtctaacagggccctgggttttccagcattgatcacgggtctctgccagtcgtttggggttcctgtcacacctaacaggcgtagggtggcgacccgcaggccccagacgcaccgtcaccaacctcatcaggctgatccaactgggtcatttgacacggagcggtatttacgacatttggttcgccagcaggcggccaaccacagggcgcacgtgcagacctatgactgtctctaccagcttagcctcagcctgcagagccaaggtttcactcattttccatgccctactccggatcagttcagggcagaggtcgcatggcccggagattggcctgaggtccaggcaggggaggcgtcgtag

SEQ ID NO: 102533 - DNA, 865 bp, Glycine max
  Peptide Sequence Number=SeqID_219311
atgggtgttcaggcccttgcgctggctggtggagcccaccaggcgctcatagaaggcgacgtcggcacgcaggccggcgatttcctcatcgcgctcggccagcgaggactgcacctcggtgttggcggcgcggctgatgcggtcggaggcttccagcgtggcctgcttctggcgcaattcggtcagctgcgcctgcaacgtctcggcacgcttctcggcagcctgcaggcgctggccctgggcgtcgcgcggcgtggccatccagcagccacccagcacggccagtaccaggctgagcagccagatgccgccgatcaccagcaggcggcgacggtcggccggtggttgtggtgcgccgggcaggcggacctgcacgcgcatgggaggacggttggtcatgggtggattccggggcatcgcgagggcgacaccggtacggcccctgtggcaaacgacgcgctagtgtatgacaggacgggcatgccatcgtcgatagtgtggtcccctgcacagttccgtcgccggagcatcgccatgaccgaagcccacctgttcgtgatcggcatcctgctggcctggctggccggcatccgcgtctacctcaccgtgttcggtgtcggcctggccggcctgctcggctgggtcgacctgccgccggccctgcaggccactgaatcgtggtgggtgctgggcacctcggcggcgctggcggtggccgaattcttcgccgacaagattcccggcgtcgactcggcgtgggatctggtgcagaccctggcacgtgtgccagcgggggctttcctcgccgccgccacgctgtcgccggatgggcagctgggcaccggtgcgcttgccgccggcgccg

SEQ ID NO: 102534 - DNA, 372 bp, Glycine max
  Peptide Sequence Number=SeqID_219312
atgaatctttctatccctttcagaattagaacaccagagttgaagagatgcactctaacctttgacttggttcctcacagaaggaaggtaacaaagagagatgccatcccaggattgagagggcgaagtgtaagcatagccaagatggttcccacagctgcggcaaaggagcttggttctttggcgcttggagttgaaaaagggtatccaagaaggccagtgaagttgttggatctgagtgaacctgctctcatccacagagaagaaggagatgatgcctctctttatggacttcgagtcaatcagagaacaagtgttgcggttgctggagttcaagttcagctcataaccacacgaactacagctgcataa

SEQ ID NO: 102535 - DNA, 264 bp, Glycine max
  Peptide Sequence Number=SeqID_219313
atgacgagtggtgttaaggtgagggaaaatggaagtacgtaccggggagggagtttgatgaataagacgggtgtgaaggtcttgaaggaagcgaagaaagaaagggttggaggagttgatcatgagaacctcggtggcagtgatgattcctttgacgtgttccaagatggaagaagggtgagacagcatgggatcgaggactctacggtcacgcgccggcaacccggttcgccgcgttatggagtgcttcccaacatcatctag

SEQ ID NO: 102536 - DNA, 2178 bp, Glycine max
  Peptide Sequence Number=SeqID_219314
atgatcaccacttgcagaacttcttcaaccaccaaccttggaggagctcaacctctttctctgcgcttcctatccaagccagctcctccgtttctatctctgagcctcttcttcccctcccactctactaacaatggcattgcggtttcctcaactcagtgcaaacccagaatccggtgtgacaaagaagtaggtaatggtaatagtaatggggtagaagaagaagcaaaagatgaagagggtgagcgtgaggtgcagtgtgaggttcaagtggtttcttggagggaaaggagagttaaggccgaaatttctgtcaatgctgacattgaatccgtttggaacgctctcactgattatgagcatctcgctgatttcattccaaatcttgtgtggagtgggaaaattccttgcccatatcctggacggatatggttagagcaaagaggatttcaaaggtcaatgtattggcacatagaagctcgtgttgtgttggatcttcaagaattcatcaattctgcatgggatcgagaacttcacttttccatggttgatggagactttaagaagtttgagggcaaatggtctgtcaaatctggaacaagatcttcatcgactaatttatcttatgaagttaatgttataccaagattcaacttcccagctattttcttagaaaggattatcagatcagatctccctgtgaacctccgagccttggcatatagagttgagaggaatatttctggaaatcagaaactttccctgccagaaaatcacttggataaaacttctagtgatatttatgagtcatctgcccaaaagataaatagtgctttgtgtgaaaacagagaatatttagtcagctcaattcctggtaccttgcccatgccttccagtgaggtgaacatcaataattggggtgcatttggaaaaacttgcagacttgacaggccttgtgtggtggatgaaattcatctccgtagatttgatggacttttggaaaatggaggtgttcatcgctgcgtttttgcaaccataacagttaaggcttctgttcgtgatgtatggaatgtaatgtcttcatatgagactcttcctgagatagttccaaatttagcaatcagtaagattttatcacgagataacaataaagttcgcattctccaggaagggtgtaagggcctgctttatatggtgcttcatgctcgtgttgtgctagacttgtgtgaatatctagaacaggagatcagctttgaacaggttgaaggggattttgactcgttccatggaaaatggacttttgagcaactaggaaatcatcacacactgctaaaatactccgtggagtcaaaaatgcgcaaagacactttcctttctgaagctatcatggaagaggtcatatatgaagatctcccatcaaatttgtgtgcaataagagactatattgagaataggacagcatcaaatatgttcgaagcatgtaagcagaatacagatttggggcaacaaactgttccatctggctttgaagatgatgacagctattgttcagcagaagacttgtttgattgcaatgctcaaagctcatctcaacaacgaccaagagttccaggtttacaaagggatattgaagtactaaaatctgaactcctgaaattcattgcagaacatggacaagaaggatttatgccaatgaggaagcaacttcgtttgcacggaagagtggatattgagaaggctataaatcgcatgggtggattcagaaagattgcaactataatgaacctctctctggcttacaaacaccgcaaaccaaagggttactgggacaatcttgaaaatttgcattatgagataagtagatttcaaaggagctggggaatggacccttcatttatgcctagcagaaggtcatttgaacgtgcagggcgctttgatatagcacgggcattggaaaagtggggtggacttcgtcaggtttctcgccttctgtccctcaaggtgaggcggcaacgaagcagacaagacaaccttgccaaggataagaaagttgatgatgatgtagcatcacctgatgtagatagtgagatcaagacaccatctagacccactgtttctcaagatccacaaaattggcttaccgaactaaaacagttggacataaattgggttgagtaa

SEQ ID NO: 102537 - DNA, 201 bp, Glycine max
  Peptide Sequence Number=SeqID_219315
atggctcaaaccaatctttgttctatatctgtaccttttcttattctattaatgatcgcctttaatttcagtgcacagattactccagttagtgcagatctgaaaatgagaaaattgggtctcatgccaagtccacctcctccaccccagcctggcaaaccacaacatcctcgtcatcctcctcggcaagatggtccctaa

SEQ ID NO: 102538 - DNA, 303 bp, Glycine max
  Peptide Sequence Number=SeqID_219316
atgggaagcggagtcagcattgttccggctgttggtggagactttgtagaggaagaagatgaggagtgttggctggttaccatgggaagcggagtcagtgtggttccggatgtgggtacggggcatgaaaatggagtcggcatgggaagccgagttgacatcggggcatctgtaggtggtgacttcatagaggaagaagatgggaagtgttggctagttactgggttaaactgcagcgagttcagcaatggtgacctcaaggcggtccaggttggatgtggaaggtgcagcttctgccattag

SEQ ID NO: 102539 - DNA, 411 bp, Glycine max
  Peptide Sequence Number=SeqID_219317
atggttgcatggtctatggagctatccgagtttggcttaaagttagagcccaatgttcctgtcaaagctcaatgcttggtcgatttcattacaaaacattctccctttcccaaacccgataataatgatggtggaaactggtggatgctctatgttgatggttcatgcaatcctaggggcaatggagcaagaattacactcaaagtactaggggacatctctcttgaacaatcatttaggcttagcgcgagattggcaccaagctcaaattcacttacttgcgctaagtgcgagaatgatgctaaatgcaacatcgagatcaggaaaccctttttaagcctgatttgcacagatttaaagggggagccaaggaataaccgtcagagtgtgaagagtgtgaatatcaaatag

SEQ ID NO: 102540 - DNA, 228 bp, Glycine max
  Peptide Sequence Number=SeqID_219318
atggctcggaccactctttcatctatatttgtacctttcctcattttgctcgtaattgccattactttctttgcagagcttactccagttagtgcagatctgaaaatgagaaaattgggttcacacccaagtccacctcctccacccttgcgtgccccgtctcggcatactcgtcctcctcgtcctcggcatcgtcatcctcctcctcatcctccagccatttcctaa

SEQ ID NO: 102541 - DNA, 785 bp, Glycine max
  Peptide Sequence Number=SeqID_219319
gtacaacagcctcaccgcgtactcctctccatcgttgctctgtttgtggtgtcgcagctcatttcctttgttctcagtttgcagcaaaggattgcaaatgtgtggctcaggctggttttggccatattcgacatcactggtctgaaagatgggttgatgtggatgaaaatcatgagatgtctgccttctgtttttactgtgacgagccatgtggtgttccgtttgttaaagcttctcctacctgggattgccgctggtgtcagcgcctcatccatgtgaaatgtcataacaaattgactagagattctggtgacttttgtgatttgggtcctttgaggcgaattatcctttctcctctttgtgtcaaacaagttgacgaagataaacaaggaggacgactaagttctattataacctcttctgttaatggccagattagaaagcggcgtaatcgcaataaaagtttaggtggttacaatgctaatggtaagtcagatggttcctcgattactgatgcaacattattggagtatgtgttgaatggtctccactggaataagttcggtgatgagaagctttttgatcttgtgaataatggtagagtattaggaaatggtttaactgctacgcctaatcaaatcaagaaatacacactggttggtttgccacaagatgcaagcccacttttggtcttcatcaatgccaggagtggtgggcagcttgggccttctcttcataggagattgaatatgctactaaatcctgttcagggtatgttattttaa

SEQ ID NO: 102542 - DNA, 114 bp, Glycine max
  Peptide Sequence Number=SeqID_219320
atgcctcaaccacatgggatcaacatggacttaagggagcactcaaaccgagtatctttactcccaaggcctagactccgaagaatccgtttgggcctcaccttcctgattcag

SEQ ID NO: 102543 - DNA, 579 bp, Glycine max
  Peptide Sequence Number=SeqID_219321
atgtttttgaataaattgcgatatgcaaaagaaggcgcaagggatattatggacagaacttgtgctgacttgccatggcaagtgtggcttgaagttgacgggagagacattgagattcctaaggattctgagggcttaattgtgctcaatattgggagctatatgggtggagtagatctttggcaaaatggttatgagcatgatgatgattttcgtctgcaatccatgcatgataaaatgctggaggtggtatgcgtatgtggtgcatggcacctaggaaaacttcaggttggactttcacaagcaagaaggcttgctcaaggtaaagccatcaagatacactgttccagtcctttcccagttcaaattgatggggaaccgtttatcatacaaccaggatacttggaaataacacatcgtgggcaggctttcatgtcgaggaggacttctgaagatgagcctaaaggacgagcatctgcaattatgacagaagtattactagatgcggagtgcaagggcattattaatgcatctcagaagaaagctcttcttcaagagatggccatcaatctttcataa

SEQ ID NO: 102544 - DNA, 209 bp, Glycine max
  Peptide Sequence Number=SeqID_219322
cctaattttggaacatctgaatgggtggctaaaaagcacacttagtgtgggtgttgtgttgagatgggttggtattgaggggaatgttggctggctcgaggcttttcacaaaggagaacttgagatgtttccttgcaaaggtgaggttgagaggaatgttgtctggctcgaggtcatggaggaagaggagagtactgagatcagtgaaa

SEQ ID NO: 102545 - DNA, 366 bp, Glycine max
  Peptide Sequence Number=SeqID_219323
atgaaagatccagagaactccagaagaaagaaaatccttaatcaccaactaataaccaaccaagaagatcaaataccaacccagatactgaaaaccaacagatttgtcaaaaccgaatcaaagggcttaaatagcccaagccaaatagtagtagcagcaacaaaaccgtctcttttaaaaagggaaagaaagaaagaaaaagagagagagagagagagagagagagagaagaagcaccttaacagtttaaccttatgcggttgcccagaagcacgtaaagccttagaaggggagtggaaagagaatgagaagaaaagtacaaatggggagggtggtggtgcagtggaatttttggtgtggcgttga

SEQ ID NO: 102546 - DNA, 753 bp, Glycine max
  Peptide Sequence Number=SeqID_219324
atgttattaattaaactgtttctgttggtgattttttccccgtggaaacttctgaaaagggattcgaacaggggtcctctcaaaatattgacgaggtggctcatattccttactatcttgcaagttggttgtgctatcaaagatcctgatgtagaaggtgaagctctgcttgatgttttgcatttcctcaatgattccaataagcaaataacggactgggacagttttttagtgagcccgtgcttcagttggtctcatgtcacttgtagaaacgggcatgtcatatccctggccttggcttcagttggattttctggaacactttctccctcaattaccaaattgaagtatttgtctagcttggaattacagaacaacaatctttcaggacccttgcctgattacatttccaacttgacagagcttcaatatctaaatcttgctgacaatagttttaatggttctataccagctaattggggtgaactaccgaatctaaagcatctggatctttcatctaatggtcttactggaacttttcagatacgcacctccagtgtggccctggctttgagcagtcttgcgcttctaaatctgaaaatccagcttcagcccacaaatcaaaattggcaaaaattgtacgttatgcaagttgtggtgcatttgcacttctgtgtcttggggctatctttacgtatcgacaccatcgaaagcactggcgaaaaagtgatgatgtctttgttgatgtttcag

SEQ ID NO: 102547 - DNA, 429 bp, Glycine max
  Peptide Sequence Number=SeqID_219325
atggatctcggagatgacgaactgaagctggccgagggcgatgtagcagcggtggacgagggtgtcgcgctcgagggagtcttcttgggagaggttggtgacgtcgccgctgttgatggcggcttggtacgccccgagatacaagttgttgcggaggttgaacaggtggtccggtgtagccattattatctattctctgattcagatcttgaaaattgcacaattcgcaaacacacgcagatacagtggaagaaagaaagagagagagagagaactcagaatcgcactcttattgtttcgcgttggaatccaaatcccaagaaaacctatttaccccttacatcatttcctcacacctccatttcccctcctccttctcttcccaccaagtcaccaacttttgttgccttcttctccctctccaattga

SEQ ID NO: 102548 - DNA, 1455 bp, Glycine max
  Peptide Sequence Number=SeqID_219326
atggctactcctccggtgaattcgttgccaatagcataccaagcatggacaagcctgggagtcccagattggttgaacaaaggagacaacgcatggcaaatggtgtcagccaccttggttgggattcaaagcatgccgggcctcgtcatcctctacggaagcatcgtcaaaaagaaatgggccgtcaactctgccttcatggccctctacgcttttgcggcggttatcatctgttgggtggcgtgggcctacaagatgtcgtttggggaggagctgctgccgttttggggcaaagccgggcccgcgttgggccagaggtttctgataaagcaggcgggcctgcccgccacgccgcattattttagaaacggtggtggtttggagacggcggagataacgccgttttatccgatgggtactatggtatggtttcagtgtgtttttgcggctattgcggttgttatattggctgggtcggtgctggctaggatgaacttcaaggcgtggatgatgtttgtgccgctttggcttactttctcttacaccattggggcgtttagcttgtggggtggagggttcttgttccactggggcgttatggactactctggtggttatgttattcatctctcttccgggattgctggcttcactgctgcttattgggtggggccaagatcgaagaaggacagagagagattcccgccaaacaatgtgttgctaacgttggcgggggcagggctactatggatgggatgggcaggtttcaacggcggagatccgtacgcggcaaacacggactcgtcgatggcggtgcttaacaccaacatttgcgccgccaccagcctcctcgtatggacgtggttggacgttattttcttcaagaaaccctcagttattggagccgttcagggcatgataactggccttgtttgcatcactcccggagctggtctggttcaaggatgggctgccatagtgatgggagttctttcaggcagtgtcccatggttcagcatgatggtattagggaaaaagctgaaattgtttcaaatggttgatgacacccttgctgtgttccacactcatgctgtggctggccttcttggaggcatactcactggcctatttgccgaacctcgtctgtgtgcactctttctacctgtcaccaactccaaaggaggagtctatggaggccctggtggagtccaaatccttaaacaaatcgtgggagctttgttcatcattgggtggaaccttgtggtcacttcaattatttgtgtggttattagtttcatagttccacttagaatgacagaggaagagcttctcattggagatgatgcggttcatggggaagaggcttatgctctgtggggtgatggagagaaacttagcatctacaaagatgataccactcaccatggagttgtgtctagtggtgccactcaagtg

SEQ ID NO: 102549 - DNA, 378 bp, Glycine max
  Peptide Sequence Number=SeqID_219327
atggcgttgttgcaaaaggataactttcactggcatgtcgaggcccaatcgactttcgacaaactcaaacaggccataactcatgcaccaatccttgcacttcctgatttcaacgcccgattcaccttagaaactgatgcatcaagtgtagctatgggtgtcgttctcatgcaacatggacacccactgaccttcttcagccaggcattctgcccccgcttacaacgtgcctccacatacgttagggaacttcacgccattaccacaattgtgcccaagtggcgccaatacttgttagggcacaagttcaccatcctcactgaccacaagagcttacgtgagctaatgaaccaggtcatccagacgtcggaacaatag

SEQ ID NO: 102550 - DNA, 622 bp, Glycine max
  Peptide Sequence Number=SeqID_219328
gagctgagaattgctatggatatgggcagtgctgtcttggcacattttctcttgaaggagaagctgcagaaaatgggcatgttggggtgtcttctgtgcattgtgggatcaactgttattgtgttgcatgcacccgaagagaaatctcttagttctgtacaagaaatatgggaattggccattcaacctgcattcctctcgtacactgcctcagcaattgccgtgacattgttcttggttttgtattgtgctccccgtcatggccagactaatattttggtttatactggaatatgctcgatagttgggtccttgacagtcatgagtgtaaaagcagttggcattgcgataaaacttacactggaaggtgcaaaccaggctttccactttcaggcatgggtttttgcaatggcattggataattttaacacagcagttgtttctccaatctattatgcattgttcacttcttttacaatattggccagcgcaatcatgtttaaggactattctggtcaaagtataagcagtattgcatcagagctatgtggtttcatcactattttatctggaacgactatattgcacagtacaagagagccagatcctccagtcgttgcag

SEQ ID NO: 102551 - DNA, 864 bp, Glycine max
  Peptide Sequence Number=SeqID_219329
atgggtagtgacgttcgtaattttgtttggcaatgcctcacatgccaacaaatcaaatacgaacccaaacgtccagcgggtctccttcaacccttaccaataccagcgtccccatggaaggatctctctttagattttatcacttgcctaccttcttcccaaggttacacaaccatacttgtcgtcatggatcgcttcaccaagggtgctcattttggggcgctcccatccacttatacggcaagcaaggttgcctccttattcataaatatggtctgcaaattacatgggttccctcgaagtttagttttagaccgtgaccctgtttttgtgggacgtttctggtgcgagctcttcaccatccaccttccctcactacttacataccggtcattgccaattaaagttgttgatcacttgctaaccgctcgccaggacctctcagcatccctacaagctcgctttagaaaggcacaacaaacaatgaaaactcaggccgactccaaatgccgtgacatttcttacaatgtcaaagatttggtctacgtgaaactccgaccttaccgccaaacttccttagcaggttccacctttcacaaattgtccaaacgttactacgggccctttcaaatcactgaacttatcggtaccgtagcttaccgcttggcacttccaccatcatccaaaatccacaatgtcttccattgttcaatcctcaaacctcaccatggaccacttcccaacaccatcgaccctttaccacctcgtgcgagtgataatcatccattgatcgagccaatggtcattctaacaatgaagtgggatactactcaagttcctccttcactactcgttcttgtttaa

SEQ ID NO: 102552 - DNA, 417 bp, Glycine max
  Peptide Sequence Number=SeqID_219330
atgcctcgtattcatgacgcgatcctgtattacaacggcaaatggaacatgccaccgcagaacaaatttgttggttgcgcgttcacaggaaaaaatcctaagaaatttcaaattccttcaacatgtaccatcgatgaactgaagaatttaatcaagcaagttgcacctaaagggattccccctcttggaattcacgaatcacaaacggtaagacgattgtttttccgccaaccagctcggtttgagtattcagatacggttataaaatatgaaataaatgagctgatcaccaacgaagaactgctgaaggtgttagtacaatctaactactggaaaaaatatggaccaatagaaattttagctgtatttactaaatatgttgaagacgaggtcagtgggacgtcgctaaagaactga

SEQ ID NO: 102553 - DNA, 681 bp, Glycine max
  Peptide Sequence Number=SeqID_219331
atggatcctaatgttaagcttcttccgggtcagggggagcctatggaagacctgggaagatatcgacaacttgtaggcacacttaattatctcattgtcaccataccagacatcacgtttgctgtcaatgtggttatgaaggataatgcgctaaatttcatggatattcaaaccagatcctactatgaatcagaggcgcaggatatcaagttcatgtgcaggaggaaaggtggaaatgggaaaagatctttgtcccatagtgagtggtgccaaactgttctgtctcaacctgatgtgatatcaatgtcatttgtaccaattacatctctacttggtggaataaatgggagtggatatttaactcatgccatgaatctctatttacgcttggtagagcatttctatcgacggtttgatgttattagagaacaagagtttgatattattagaggtgggaatttttcgattcgggaacaaacactaaatggagataaaccacaaattgaagaactgcatcaatttttggagttccagcttccaaggcaatgggcccctgtatttggtgagcttgcccttggtcctgaaaggaagccacaaaatgctgcttctttacagtttagtttcatgggtcccaagctctatgtaaacacaacaccggtaatgctacttgttttatgttga

SEQ ID NO: 102554 - DNA, 3507 bp, Glycine max
  Peptide Sequence Number=SeqID_219332
atggcgacggcggaggcagcttctactgggcttggtcccagatatgcacctgatgaccctacccttcctcaaccgtggaaggggttgattgatggcagcactggtcttttatactattggaatcctgaaaccaatgttacacaatacgaaaaaccgacgccacctgtgcctgcgcctgtggcttctgcgccgagcttggcgcctataccagcggctcatacaatgcagcctggcgggatgatgcagcagcacgggcagcagatgctgcaagtacaatcctcgcaacagcatcttgcccaacagcatggccaatcgatgctgccacagcagcagcagcagcagcagagtccccatatcgcacatgttactcagcagcagtcctctcagggtgcccaggcagcacagcagcagaaccatcacgggcagcaaatgatgcagcagcctcaaggacatcaagccaggcagccaatgatgcaaccgcaaggacagcaaatgcatcatcagatgccgccgcaggcgatccattcccagcattttgggcaaggaatgcctcaggatcagggctctcatattgtacaaccacaagcacatcaattcacttcccaaaacatgcattacatgtcgtatcagcaaaatgtgattacatccaggcaaccaaactcccagcacattcagccaaacatggtatcacccgggcaacctaactctcagcaggttcagcataacatgcatggtcagccctttgaaaaccaacaaactacatatccaaaggtagaggtagcggagtttaaaaatggaagccaggttggacattcgctgtctcattatccacaaaggagtgccttgcccgttcagaacaaccagaacaatcctgctgaagttggttctggtcaagtgcctaatgtaggtgtcaatgctggccaaccacagcaattcagggccttatctggcagtatgcaacagtcaccctctggatctgatttatattaccaacatggtcctaactttcatagccagatgagcccaggcatgatgcatggtcatccatccaatgtccaccctgctggccaaaagatgggtcacgaggataatttacatggtagagcagggaatgagtatgactataattctaccaaagatatgtcaacaatgggttgtcagcagccagatataactccaataccgattccaagaaatcagcaggatatgaggattggcaatgctccttttcaaaatgtaatgccaagtggaaatggaagtggtattgctgggaatgccgtgcctagcatgtttgttcctccaataggaggaccttcacctctctctactaacccttcaatgaggcctccttatatgggttcttcagatgctactgatctctcaccggctgaaatttactgtcagcaacatgaagttacagctacgggtgacaacattccacctcctttcatgacatttgacgctacagggttccctccagagatattgagagaggtaagtgcgatatctgctccagagcaggagcatatgtcgtacgctgcactgctaacctgctattggcacaattacacgtgcaactactatcctgatttttggagcctgcaaaagggatggatatattctgctggtttctcaagtccaacaccaatacaggctcaaacatggcctgttgcactacaaggtagagacatagtcgcaattgccaaaacaggctctgggaaaacattaggctacttaatgcctgccttcattcttcttagacagcgacgtaataattctctgaatggccccactgtcttggttttggctccaacacgtgaacttgcgacacagatccaagatgaggtcatcaaatttggccgatcatcgcgagtctcttgcacgtgcttatacggtggagcacctaaagcccttcaactaaaagagttagaccggggagcagacattgttgttgccacacctggtcggctcaacgatatacttgaaatgaagaaaattgacttgggcaagtttcactccttgtgcttgatgaggctgaccgaatgcttgacatgggttttgagcctcaaattcgttaacattggaaatgtggatgagcttgctgcaaataaagctataacacagtatgttgaagttgtcccacaaatggagaaacagaggcgtttggagcagattctcagatcccaagaacggggttctaaggttataatattttgttccacaaagaggttatgtgaccagcttgctcgtagtattggccggacttttggggctgctgcaattcatggcgacaagtctcaaggtgagagagactgggttttaggtcagttccggactgggaagtcaccaattctggttgcgactgatgttgcagcacgtgggcttgatattaaggatataagggtggtgatcaattatgatttccccactggaattgaggactatgtgcaccgtataggaagaactggaagggcgggtgctactggagtgtcatatacctttttctctgagcaggactggaaacatgcgggtgatttaatcaaagttttagagggtgctaatcagcacgtgcttccagagttaagacagatggctttgcgtgggccatcaaactttggaaaggatcgaggtgggatgagtcgatttgactctggtggtggtggtggtgggcgctgggatactggtggtcgtggtggctttggtggtcgtggaggtggcatgagggatggcagttttggtggacgtggcagtggctttgggggacgtggtggcggcattagggatggtggttttggtggacgtggcggtggctttggtggtcgtggtggcatgagggatggaggtagtgggcaaggtgggcgaggtgatttctttcctggtaggggcaacaggggtaggggatccggtggccctcgtgggggtcatgttggttggggtaggggtgaacgtggtatggatgatcggtacaacatggaggggcgtggacaaggtcgtggacgtggaagatttgacaatagaagagatgtttcttccaaaggtagaggcagaagtcatagtcgtagccctgaaagagtccgaacatgggactatagcaaaagtagcagcagaagtcgtagcagaagtagaagcaggagttggagcaggggccgtagtcgaagccgcagctggtctcgtggtcgtagtcgcagctatagccgtagtattagtccacgtcgtagtcgtagccgtagccgtggtcgaagttacagccgcagtcgtagccgcagccccagttatgataggcgtgataggtcagatcaacaacttcctgatcaaaaggatatcagggcgcatgaagtaggaacttcagatccaagaatgcttcccgtgtcttctggtcttggcacacaagggaattcgtttttgggaactgaacaagtggagcagcaacctattgttagtagcactgatccaggtaatccagaagctgtagcagaccttagtcatcaatcagtttctgatatttag

SEQ ID NO: 102555 - DNA, 993 bp, Glycine max
  Peptide Sequence Number=SeqID_219333
atggaagcagctgagcctgccaccgctcctcagttggccctcgccgacacagacatcaactgggacaggttggataaaacaaagttccacatgattggcgccattctcttcaccgttcaatcagcgctgctccatccaacggcggtggtgaagacgcgcatgcaagtggcggcggggtcgcgaggaatgtcggtgttcagtcacattctccggagcgatggcattccgggtatcttcagaggcttcggcacttccgccgtcggttcggtgcccggtaggatcctcgctctcacctctctcgaggtctccaaagacatcatcttgaaacacacgcaaggcactcacattccagaagcttcacgcgtcggcctcgccaacggggtcgccggcttggtctccaacttggtttcttgtgtctattttgtgcccttggacgtgatttgtcagaggttgatggtgcagggtcttccagggacaacgttttgtagagggccacttgatgttgttcgtaaagttgtggaggctgaggggtttcgaggcttgtataggggttttggattaacagctctaacccagtcacctgcttctgcactttggtggggttcatatgctgcagcacaacacctcatttggaggagtttgggctacaaagatgatacagggaacaaaccttcacatatggaaatggtgacagttcaggctactgctgggatggtggctggtgcttgttcctctgttatcactactcccatagatactgtaaaaacacgtcttcaggttatggacaactatggttctggaagaccatcagtactgaagacagcaaagactctccttaaggaagatggttggtggggattttacagggggtttggaccaagattcttaaacatgtcactttatggaacaaccatgattgttacttatgaactgataagtatgtctcctattgcttatttattttggcaccaatacttttttgagaatggttag

SEQ ID NO: 102556 - DNA, 1590 bp, Glycine max
  Peptide Sequence Number=SeqID_219334
atgattaatgaaggagccccagagtatttttgttatcagaacgtgtattaccctgctgccaccaattatgggtattactgtacaggatttgaaacacccggggaatgggaggaccaccataggatttttggtgtagatggtcccaatattcagttcatgggtgcacaaaatgaaagtttgccgtatgtatattataactatggatatgcacagtctccatacaatccatataatccttacattcctggtgctatgattggagctgatggctcacttggaggaggacaacattattataccctccccaattatcaaagtccagtttctgcacctggttatattccctctgttcaaccagacaatttttctgatagttctgcagattccttttttggagccagtgcttctgtcagtaaacctgatggaagaggtttgagacataagttcaattcagcttctggtaactttcctaggaattcttcaaattttttatcaaatcagacaagttccttggccagggtatcagaaaggccgagagcttatgatgggagtagatttctcaatttagctttgccggctgttcatcgggatagaaactcagctgctaaacttaggccaaagcttcacaatggcaaagtagtaccaaatggtggaaatgggagctctgatgtattgggtgagcaaaatcaaggccctagagttagtagatcaaaacatcagctgtctgtgaaagcctatacaaccatggcaggagatgctaatgaacaggggaacattgtcatatatcctgatcaatacaataaggaggacttttcccttgactatgaaaatgcaaagttttttgttataaaatcatacagtgaggatgatgtgcacaaaagcattaaatataatgtgtggtcatcaacacctcatggaaacaagctggagaatgcttatgaggatgcaaagaaaatagcagctgaaaagtctgaagtgtgccctattttcctatttttttctgttaatgcaagtgggcagttctgtggggtagcagagatggttggtacagttgattttaacaagaatatggacttttggcagcaagataaatggagtggaagctttcctttgaagtggcacatcataaaagatgtaccaaatccaaattttaggcacattacactggagaacaatgaaaataagccagtaactaatagcagagacacacaagagataatgtattggaaagacaattatgagaagaatttgaagcccaaggatgattctgatggcttcaaacagatttcagtttcaagccctgaccagattgttagtaattctgatgtcactggcatcaagcatgtggatgatgagaaagctgagaaaattgctgtggataaagaagatatttcttctatcttaaagattggttcagtcactattgcccccaaacaagttgaggctaagcactctgtcagcaatggtaataaagaacaaggtgatgctcttacggaaggctcaatgcaggttggcagtatcccacttgatgcaatggcattgcaaccgggaaaaggtgttctttctgttaaaagtgaatcacatcgttaa

SEQ ID NO: 102557 - DNA, 2196 bp, Glycine max
  Peptide Sequence Number=SeqID_219335
atgatttgcaaaattttgggattgactggcgttgacctcttctctccatcagatgtagttgagagaagaaatactcgaaaagtttgcatgtgtatacgctcattctccaaaaaatctagatctatgaatataaatgttccagattttgacattgtgacctgtatggtggccatgcccaaggatttggttggatgcaggcgtagaagcatagagctatcacacagcatccttgctgattcctccggtagctattacttacaaaagcatgaaagaagaaaatctagacagggttaccccattacagactccaccaaagattatgagacatattcagatcaatctgggaatacagaaaacaaacctctagtgcttcaatttgatgacttacatactgatgacttgtatgattattcatcagacataaacaacagcatagcctctccaatggttgaacatgtttatttgcccgaagagttagatcaattggacatccaaaaccaacggagaaatgaaatatttaatgatgactttgagttgctatgttcaatggaatcattgcaatatcattgctctgaggatatagagcatgattgtgagctgacttggtcatcatctcctaccagtggggatttacatgccgaccttattgatatgacatctcatttagatactggaatggaacaagtccaagaaagtagaagtattatggactttgattactttgagcatgtgtcgttaagcagtaatgcttctgtcattgtaactcctaagaatgacaaaacaccaggtaaaagggatgctagcttgctaacaaaagataggaaggacactgatctgtttaatgaagaaaatagtacaccaaatgtatatcaaagtgccagctctcatggttcaaatccaactccacagactgctgaaaatggtaaattatttgaaattggtgatgacaatgaggctctgctagtagcttgcatgaactgttattcaagggaagtgctgaacttgggagatcaagtcgatgcacagaacaattttaagaatattgagtctttcaaagtgcacagtgacaagaatggtcaatgggacaagataaaagaagaacatgaatctcaaggcatagtaaaatgtaaggacatgctgtatcaaatcatttctagcgcaggatattcttattctgtaaagaaatttgaggaaactgagactttgttatattcacctggttgttacttctgcaatactaattctctagatggaattgttcctcatagcaatgaagctagctcaacttcactgaaaatgtttctagcatatgaagagagagattctcaacttgatttggataatgctagttgctaccaatctcaggagtcactgtcctgtcagtcttatgatttacctgagtcttgtaaatgggatcagaaaggaaaatgtgctataacatcatataaagatgagaaaagttcgcatattttggaggatggatcgcgtgaggaaattacaccttgcaaacaaaaagcttctgaagtcttaatgtcaactgttgttaagttggacactgatggtaaagagctaagcattgactctctggctctggcctcaaatgctctagctgctgatgactgtgaaaaatgttccactcttggggatgaccctaatgatttcttcaaaggtgacacaactgaagacaatgaagagcaaggtcagagagtgctagatatgttaaccaatggagttgtagttcctgccaactgtgatgatgacataccaagtcctgaatcttgtataaactcaaaacttgaattgaatggtgatcatcaagcatgtcaatatgaaaaggatcctgtttatcgttcagaacatactcgtgtggtgcatcttaaaaaagaaataaaaccagaagatgagagggtgcacatatttgaaaatttagctggaacagaagaggaaggtaaagaaataccaaaagcaaaacctcaaaagaggctactgctaagatcagtattgggtggtgcagctgctgttggtttgttattcatgattatgcacctaaggaggaatggcggggaaaaagctccacaaccaagtatggcatctagtcataaaggcaaagagaagattcagaaaaaatctactcggaaagtaaagagaagtacaacgaagggggtttatcccgctgaaaggatcaagttaaagtga

SEQ ID NO: 102558 - DNA, 685 bp, Glycine max
  Peptide Sequence Number=SeqID_219336
atggaagagacatttgttccgtttcgtggaattaaaaatgatcttcaagggagattgatgtgttacaagcaagactggattggtggtctcacggcagggttcaggatattagcccctactacatatatattctttgcatcagcaattcctgttatttcatttggagaacagttggaaagagacacggatggagtacttactgcagtgcaaacattagcatctactgcgttgtgtggaattatacactctattattggaggccagcctttgctgattcttggagtagcagaaccaaccgtaattatgtatacatttatgtttaactttgcgaaaagtagaccagaattgggttcgaaactctttctagcatggactggatgggtatgcatgtggactgccatcttgttgttcctactggctatcttaggagcttgttccatcatcaacaggttcactcgcctagcgggggaactgtttggccttcttattgcaatgcttttcatgcaagaggctgttagaggactcatccatgagtttcacatacctgagagggcaaacctaacatcacccgagtttcaatcttcatggagatttggaaatggcatgttttctttggttctgtcctttggcctcctacatacagcattgagaagccgaaaagcaaggtcttggcgatatggatcag

SEQ ID NO: 102559 - DNA, 1194 bp, Glycine max
  Peptide Sequence Number=SeqID_219337
atggttctattgtggactgccgtttcttatattccagctggaagtattccaaaaggaatccctaggcgtctcttcagtccaaatccatggtcctctggtgcctttgaaaactggaccgacatgctgaatgtgccagttctctatattattggagcctttattccagcaacaatgattgctgtgctttattattttgaccatagtgtggcatctcagcttgctcagcagaaagagttcaacttaagaaagcccccttccttccattatgatttgcttctattgggattcatggttataatatgcggtctaattggaattcccccgtcaaatggtgtcattccacaatctccaatgcataccaaaagtttagctacattgaagcaccagttacttagaaaccggcttgttgcaacagcacgaagttctatgaaaaagctagaaagcttgggacaagtatatggaggtatgcaagatgcttactggaagatgcagacccctttagttcaccaggaaccttcctcgcagggacttaaagagttgaaagagtcaactattcaattggcatcaagcatggggagtataaatgctccagttgatgagtcagtatttgacattgagaaggaaattgatgacttattgcctgttgaggtcaaagaacagcgtgtgagcaacctgctgcaatctttgatggtaggaggatgtgttgcagcaatgcctttcctgaaaaagattccaacttctgtactctggggatattttgctttcatggccattgaaaacttacctggcaaccagttttgggaacggattttattaattttcactgctccaagcagaagatacaaagtcttggaggagtgccatgcaacttatgtggaaactgtaccattcaagacaattgcagtattcacagccttccagactgcttacttgcttgtttgttttggtatcacttgggttccaacagctggggttctattcccattgatgatcatgcttctggttcctgtgaggcaatacattctgcccaagttttttaaaggagcacaccttcaagatttagatgctgcagaatatgaagaagtacctgctttaccattcaacttagtgactgaaggggacttgagcaggacagcttcctttgcagatgatggagaggttttagatggaataattactcgaagccggggtgag

SEQ ID NO: 102560 - DNA, 435 bp, Glycine max
  Peptide Sequence Number=SeqID_219338
atgagtgaaatagagaaggtgcaagagcagatgaaggctgacatggaggccatgaaagagcaaatgaccccaatgatggaagccatgatgagtatgagaaggatgatggaggtcaatacgactacagttgttgccacaagtaccaaaagtggacccgactcacccacctggctttattcaagcggcccccattttgtgcaggctcaaaataagcattccttcccaccatatggcttgcctcccaactatacgccacccaatgttgcatacattcccaatgagaatgtcgacaactccacacccatgcccattgagagccaacaaccacaatttgatcatgcacatgtctctcaacccatgggggagacacatgaagtaccccgccacactgtagccgactttgagcctcacctcaaatatgccactgagggacag

SEQ ID NO: 102561 - DNA, 347 bp, Glycine max
  Peptide Sequence Number=SeqID_219339
atggcagatgtgcaggttctctcaggtttgtcctgtcagcagttcattaacggtcagcttatcgacggcgaaggccagcaggagtgcatcgtcaatccggccaacggcgagacgctgatcgtcctgaccgaagcctcttcggcgcaggtcggcagcgcggtgaaagccgcgcagcaggcgtttggtcactggtcgcgcaccacgccggcccagcgcgccgccctgttgctgcgcattgccgacgccatcgagcggcaggcgccgcagctggcgcagctggaagccctcaactgcggcaaaccgctgcatcaggcgctcaatgacgatctgccggcggcggtcgacgt

SEQ ID NO: 102562 - DNA, 321 bp, Glycine max
  Peptide Sequence Number=SeqID_219340
atggacgtgcacgcgcggcgcatctgggcgcgcgccgggctgaagccggagatcgccatgaagaccgcctcgaccgaggcggtgcgcagcctggtggcggcggggatgggggtctccatccagccggacatggcgtaccgcgcctggtcgctcgagggcaacatgatcgaggcgcgcaagctggacgatctgctggagccgctggacatcgggttggcgtggcggcgcggcagcgcgcggccggagctggtgacgccgttccttaccatcgcgcgcgagaacggcagcaaacacgccgccgggcttaagcattcgatttaa

SEQ ID NO: 102563 - DNA, 666 bp, Glycine max
  Peptide Sequence Number=SeqID_219341
atggagattctaaggcaagggaaagtggattttcataatgaaaattggaaaggcactacaagcactaaaggtatgcccattgtcacaaacattgaaaaagtaaaatcgaggcatgtgtgggattcaagagggagtagggagggtcagtgcactacgggggcaacatgtgggatgatgaatcatggaaaagggtgtaggggcgtacacggaggagagaaaaaattggggccttgggaagatccctttgttgttgtcacaatgctatttcggttaatacaactacatttgtggcggtcttcaccacatgatggtgataagcttggagtctacaaaagtacatgcgagcacaacaaaggcgatgcggtagtcattgtcgatttcttcctcccgagttgttgtgccatggttgcaaaacccattgggtggtgtgtgtacattgtggtttgcaatcaggtgcctatggatcttgttcatagggagaggcacaatgggataaaagggatagacgctaggatggatggtaaaacaagtatgactggttgtgatggaggaagtgtggatatgaaggttgctaatggtggggatttgttgggtagtgtgacagttgtggtgacagtgggagcaacaagtatggtggtggttgatagtgaagggagagtaacgtga

SEQ ID NO: 102564 - DNA, 228 bp, Glycine max
  Peptide Sequence Number=SeqID_219342
atggctctgaaaaagctttccgcgaagagatctaggagggacgccacgactaaagggaccagtgccgcccccgagtttgatagccaccgtttcaggagcgccgagcaccaacagcgctttaaggccatcaaaggatggtcattccacaaagagagacgcgtccagcttagggacgatgagtacacagattttcaggaagagatagctcaccgacattggacgtcgctg

SEQ ID NO: 102565 - DNA, 1484 bp, Glycine max
  Peptide Sequence Number=SeqID_219343
atgagagataatggttccttaacaaggagtagtgattatttgaagcgattgaatctataccgccagagggtttggatgtgtaaagtcactggaaaaactggcttgacatatgaagaggctttggtgtctgaacaacttgctaccgagaaagttcaacagtttcctaaagaattaatgactattgctttaaggattattcaatacagtatgctccctttgaaggatcttgctgattctattggtgagaaattgcaggaacagttgtttgtgggtgctgaactacattggaaaaaggatgatggagttcatccatgcaaaatattaaaagtcattcagaaaggagttgacacagtctcttatgaggtagcttggcttgacaaaaacaagaatataagagaacaagcagaagtcagtgcagaagatttggtgcataagaagccgctttttagtagaaatattttgaagtcttttattcgtgagtctacatatcggaatgccccttgggttttacatgatgaactggctaaaaatcatggaatatcaactgacattcctgaagagttaagaggaagggttttttacaaagatggacttttagtttgctccaagaaaaggaaacacgaggaatcacgggaggacaccgatacctgtaaaaagaagttggatggtgcacaagtcgatgattctgtccaagagaaagaaaatggtcaacccaaggatgcagcaatcaaataccccattgatgatctattggtgatccctagtccagatgatcctgttttcactgatcgtccttctccagcaaaaagcttcaatattccaatgagttgtgtaggggaactcttgatggtttgggattttcttagttcctttggtagactgttgcagctgagcccctactctctagaagattttgaaattgcaatctgtcataaggatagcaatgtggctctcgttgtggaatctcatgcagcactttttcgacttctcatcaaagatgacgatgaatactctttggctgtgaagaatcgaaaattgaagtctaagattacaacaaataattggacagaatatttatgtcattttctagagatgatcaatattcctgaactatggcaacataaaacaactataaaacggggacattatggccttgtagatgccagtgctaaattaagaatcttaggcgaattggtcaatcgggcccttgaaactgcaattttcaggggaaagttagatgagattattgaacagcgacaggcacttggggccactagaaggggagaagctttggaaaatggtagaaggagaagagaagaaaaggagcggttgaaagctgagtcggaaagcaatggatttgtggatgggtatcatctgaacggtgaaaatgtcctagcaaacaatagtatacaaaatggagatgtgggagagaaaagaattatagagatagaaccatctgggcaaaatgatccattgggcagaag

SEQ ID NO: 102566 - DNA, 276 bp, Glycine max
  Peptide Sequence Number=SeqID_219344
atgatcacttctttctcttcagaaggtaatgatgaggaggatcaccatgagcactggaatggatctatgagtagaagtcagtcaaaacatcctaatcaacaagcttcaccacttccgactaaacttccagctggagctcatataccctcttgtgcttgggctgaagagggtggatctgagtatcccagacacatgccaggagctgatcacaagcaacccaatcacaaggtagatcaattcagtagatttcctaatttgccattgaatcctagataa

SEQ ID NO: 102567 - DNA, 1227 bp, Glycine max
  Peptide Sequence Number=SeqID_219345
atggcagctctggtcaatgctgcaacaagtgagaaactggctgaaactgactggatgaaaaatattgaaatctgtgaattagttgctcatgatcaaaggcaagctagagatgttgttaaagctataaaaaagaggctgggtaacaagaacccaaacattcaactttatgctgtcgcgttgctggaaatgttgatgaacaatattggagatcgtgttcaccagcaggtgattgatacaggaattattcctattcttgtgaaaattgtgaagaaaaaatcagatttgcctgtaagggagcggatatttctcctattagatgccacacaaacatcccttggtggtgcttctggaaagtttccacagtattataatgcatattatgatttggtggtcatatggtatgggtatggtggtcagagtgctggggtgcagtttcctcaaagggatcaagtgacccaatcaaatcgtccccgttcacaacttaatgggattaacaatgtaccgaacagggagcaggtcccgcctagacatcagcaagcagagtcccaaactgttcctgaatctagcattattcaaaaggctagtaatgcattagaagttttaaaagaagtccttgatgctatcgatgcccaacatcctcaggctgcaagagatgaattcacccttgaccttgttgaacaatcttcatttcagaagcaaagggtaatgcatcttgtgatggcttctcgagatgagaggatagtttctcgagcaattgaattaaatgagcaacttcagaaagttcttgcaagacatgatagccttctttcgggcaggcccacaacaatagctaatcatttggagtgtgaagaagctgaggatgaggaggaagaaccagaacagttattccggagattacgcaaaggaaaggcttgtgcaaggcctgaagatgaagaaagagaacctgagtttcctcacttgtgttttctggaagagagactcaaccggccgttaataagaccactatctttggagccatctcgagaagctaatacttattctgcacctgctgtgattcctcctcacatggcaattccaccaccgccttcaaagcacattgagagggagagatattttcaggaaaataaaaaggacggtgctactttggctggccacttgagaggcctctccttacatagtcacaatggcagcagctctcacagtggaagctttgattttagtgattga

SEQ ID NO: 102568 - DNA, 207 bp, Glycine max
  Peptide Sequence Number=SeqID_219346
atggttccattcgagatacttggtagaaaacgcgatggaggtgtggagctacagagttgcgtaggacgaccgctatggagttgcgtgagacagatcaaatcaaacccgttgtctgtgttttttggcttacgatggttcagcatgatgagattgtggcggttgtcaaaagaatccttgttggccacgacgacgactaagttgttgtga

SEQ ID NO: 102569 - DNA, 438 bp, Glycine max
  Peptide Sequence Number=SeqID_219347
atggatgaagctaattccatctcctctccaatggttggtggctgcaagttaaccaaatcagggtatgagtctttttctgatcccactctatacagatctgttgtgggtgctttgcagtatgcaaccatcaccagaactgaaattagtttcttggccaacaaggtctacttcaagagcagcagtttctttggctcaaatctggcatcttggtggtctaagaagcaatctgtggttgctaggtccagcatagaagctgaatatcgtagtctggctttggctacagcagaggagaaagtcattgccaagcaccttcaagttgttcatgttccagctgttgatcaaagagcatatattctcacaaaggccctcactcctaattttactacatataggtccaagctcagagtggttgaaaagcattctgccaacccctcatga

SEQ ID NO: 102570 - DNA, 1465 bp, Glycine max
  Peptide Sequence Number=SeqID_219348
gctgttgccacaggcaatccgtacctctcaaaagatgtatcgctgctctggaggccatgtggagggttctactaacactaatcccttgaaaaattatgtagtgggcagaagtacttcaggatggtttgaaacccaacccttggtttctgagcaattactcaacaggcgcttgttgccagtggaagctttagtaactcccacagttcaagatttttctgatacacctcttattggtgatgataagattggagtgttattgttgaacctcggaggtccagagactttagaagatgtgcagccttttttgtttaaccttttcgctgacccagatattatacgacttccaaggttatttagctttcttcaaaagccattggcccaatttgtatctgttttaagagcaccaaagagcaaagaaggctatgcttcaattggtggtggatctcctcttagacgtataactgatgcacaggcacggcactttccgataatttattttccatatattactacagctgaagagttgaggaaatctctttggtcaaagaatgtcccagccaaagtgtatgttggcatgcgttactggcatccattcaccgaagaggctattgaacagcacacagtaattccttcatggtaccagcgtgaaggatacattaaggccatgacaaatttaattgaaaaggagctaagaggttttgactgccctgaggaggtcatgatattctttagtgcacatggggtgcctcttgcttatgtagaagaggctggtgatccatacaaggcagagatggaggaatgtgttgatttgatcatggaagaacttgaaaagagaaagataactaatgcatacacccttgcttatcagagtagagttggacctgtggaatggttaaaaccttatacagatgagacaataattgaacttggggaaaagggagtaaaaagtctgctggctgtaccaattagcgagcatattgaaactctagaagaaattgatgttgagtacaaagaattggctctaaactctggtatagaaaagtggggtcgtgttcctgctctaggaactgaacccactttcatttcagatttagcagatgctgtaattgagagtctcccttatgttggtgcaatggcggtttcaaaccttgaagctcgacagtctttggttccactgggcagtgtagaagagttattggcagcatatgactcgcaacgtagggagttgccgccaccagtaattgtgtgggaatggggatggaccaaaagtgctgaaacttggaatggaagagcagctatgcttgctgtgcttcttctgttgtttttagaagtcaccactggtgaagggtttctgcaccagtggggaatattgcccttgtttaggcaagattgtggaggtgtgagacatggtttgaagggtgcaaagaacgtggagagcgtttgtggatatgtgttggttcattga

SEQ ID NO: 102571 - DNA, 156 bp, Glycine max
  Peptide Sequence Number=SeqID_219349
atggcaataaaatacgcttttgggaagacatttgagttcatcgcatgtgcttgggatgtgggaagattgtctgaaattttgtgcgcaaactttgttcataaaatcaaggttttgaagcctccttgcagctccaatgcagatgattacttggggtag

SEQ ID NO: 102572 - DNA, 1086 bp, Glycine max
  Peptide Sequence Number=SeqID_219350
atggataagtatgaggctgtcaaggatttgggagctgggaattttggggtggctaggctcatgaggaacaaggagaccaaggagcttgttgccatgaaatacatcgagcgtggccaaaaggtggttttgacccccacccatttagccatagtgatggagtatgcggctggaggagagctctttgagaggatatgcaatgctggaaggttcagtgaagatgaggttgacagcttactcttagtattttctgctttatttcaccctcttgcttttagtgtcatgcctactgtagccatatctcatttatttttccatttgattgttcaggctagatatttctttcagcagctgatttctggtgtacattactgtcatgccatgcaaatatgtcacagagatttgaagctagaaaatacccttttagatggaagtcctgcaccccgtctgaaaatttgtgactttggttattccaagtcatcattgcttcattctcgaccaaaatcaactgttggaactccagcttatatagcaccagaggttctttccaggagggagtatgatggcaagttggctgatgtatggtcatgtggagtgactctttatgtcatgctggttggagcttacccctttgaggatcaggatgaccctaggaattttaggaaaacaattcagcgtataatggctgttcaatacaaaatccctgattatgttcacatatcccaagactgcagacacctcctttctcgtatatttgtagcaaatccattaaggagaatatctcttaaggaaattaagaaccacccatggtttttaaagaatcttccaagagagctaacagaatcagctcaagctgtctattaccagagaggcaatccaagcttttctgttcaaagtgtggaggagatcatgaaaattgtgggagaggcaagggaccctcctccagtatctaggcttgtcaaaggttttggctgggagggcaaagaagatgaaggggaagaagacgtggaggaagaggaggatgaagaagacgagtatgacaagagggtcaaagaggttcatgcaagtggagaatttcaaatcagttaa

SEQ ID NO: 102573 - DNA, 486 bp, Glycine max
  Peptide Sequence Number=SeqID_219351
atggaaaactgcatcttccactaccatcaccacacactcctcactctcccttcaatttctcacaaaccccacttcagattcttcacaagacctgatcttggtggtggtggtggtggtgttcgtgttgcttcttcttcttcttcttgtttgttattccataggcgaagaccctttatcagagcaagtgctggagcaagcccatgtgagtttagtagcctaaactctcctttggagccacgttccatggtggggaagttcctcattggtgttcttcagaaccaccctcagatgttccatcttgctgttggggaggagctgaagctcttggctgaggatcgtgatgcggcacatgctcgcatggtgcttggttctgcttctgatgaggccttgcttcacagagaccccaaaaaccctgacgatgcagccaaaattgcagtcgtggtttcatcgcgttccttgatattatacagcgaatgtaaggaatga

SEQ ID NO: 102574 - DNA, 294 bp, Glycine max
  Peptide Sequence Number=SeqID_219352
atgggaaaaaacattatagagaaaaagaaagaggcaaactgcttactctcttgggagcttagagtaataggttgggaagtaacttatggggcagaatttgtgccaagctcagaaggaagctacacagtaattgtccagaaggctagaaaggttgcttcatcagaagaaccagtgctttgcaacagttttaaggttggtgaacctgggaaagttgttctcaccattgacaacacaagctctaagaagaagaagctcttgtatcgcttgaagaccaagccttccccttctgactaa

SEQ ID NO: 102575 - DNA, 504 bp, Glycine max
  Peptide Sequence Number=SeqID_219353
atgcccggcttggatccccgtattgtggagcaccgtttgcctttgaagcccgaatgcccaccggtcaagcagaaactgagaagaactcaccctgatatggctctcaagatcaaagaggaagtacagaagcagatcgatgcaggttttcttgtcacatcagagtatcctccatggttagccaacatagtgcctgttccaaagagggacggcaaagtcaggatgtgcgttgactaccgagatttgaacaaggctagtccaaaagatgactttcctctacctcacatcgatgtattggttgacagcgctgcaaagtccaaggtcttctccttcatggacggtgccacttaccaaagaggcatgaccactctctttcatgacatgatgcacaaagagatagaagtgtacgtggatgatatgattgtcaagtcaggcactgaagaaagaacatgtcgagtacttgctgaagatgtttcgacggctgagaaagtaccaactttcgactga

SEQ ID NO: 102576 - DNA, 610 bp, Glycine max
  Peptide Sequence Number=SeqID_219354
cctcaacaccttcctggagacacttgtggtactggctaagggagaatccttacccgcttactccagatactgtaggatgcctactgatatcagagagattgaggatgctttgtgtatactaggccgagggtttgttttaaatgctgaaggccatcctgggaagatcctcaggaaagatctgacaactcttgctcaggtttggagtgttctctcatactccaacctggctccgacttcccacacctcggatttgactttagatagagctagaggggctgcttctgacagcctagtcttggaaaacttgagtccggtcattaacttggcctatatcaggaagaactgttggaaccctgttgatctgatagttactattagaggggctaggagagcgaaggcaaggccaattgaggctccttccacatctgcagctcctcctccagcaccacctctagactctatcccttctgctgaacagtttaatgaatgggtagccaggcccgggactcagcctccccttcacagggaggccgaaagtctcaccgctcaggtaccacaacagagggaggatgagtcatctgagacttccactccaaagcccctgatctga

SEQ ID NO: 102577 - DNA, 1542 bp, Glycine max
  Peptide Sequence Number=SeqID_219355
atgggtatcaaaagtgtgcgccaagcaacatccctaagcagtctagatctcgtccctaagaaaggtatcatgttgaagtatgtgttcaaggttaaacccttgaagaatattgcaaagaataaggcagaaaatgtcggaaaggaagatccactcacaactactccccttatggacgttgatcctatttatgacaaccacactaatgaaaagggagaaaccccaaaggatgttgagccaaccatcgtcaataacgttaccatggagaatgaggatgaaactaggattttggacttgggtagaccttacgacatcgtggtggtgcctaatgctagaggagcagggtgcaaggagtttctttctttgaccagagacctaaagtacaaatttaggtttcagattctaatcattcttgagcctcggattagtggggccagagctaagaaagtgggaagaaagttgggtttccctagttccttctgcgtcgaggatgatgggtttcgtatctctatctttaagtctggagatcatttcattcatgctaagatctcccagaagcacaatgctcttatttgggtgctttctattatgtatgaagcacttcaccagagtgataaagatgggatggagcggctaaggatggaatgtgtggatatgagccttgacaagggttactcaggaggccagattaagcttaggagtcatctttggaaagaataccaaaagatcctacacaagaaggatctcttttggtaccgaagagcttggatggtttggctcaagttcagtgatagaaactccaggttcttccatatctctcgtactaacagaaagaggaggaatgttatccaacatccaactcttgatgatggtaaagtgattcacgacctggaagaaatcaaagaggccattcaatgctacttttctactatgtttgaagatgatgacactcctactgactgggcttggaaaaggcttttccttagcttaatggaggatgaactcaatcttattcaatccatttcgatggatcatgaaatcaaagccataatttttagcatggggcctcttaaattgtcggggattgatagattaaccacacccacttcgtgctcatccccaagatcgatcatcttacttctatcaagcactataggcatattagtctatgcaatgtcatctataaggcagggcagggacaatgtcatccttcccaaaaggtttgtcactccatgtggggttctaagaaaaaggttgggctctcctagatcatccaaatgcagaatgatggagaatgaaagcccatcaagctcgcctttgaaggttattttagattgtctcaacacttatgcttctggtgttgggactaaggtcaattgtgataaaaccaaggtctttttaacaaaaggtgtcaaccactctattagttccaacattattcgtgctggaaactttatgatgttgccagatctagggaagtacctcgatattcctttgttgcatgatcgcaagaggaaatcccactaccaacacaccattctttga

SEQ ID NO: 102578 - DNA, 1002 bp, Glycine max
  Peptide Sequence Number=SeqID_219356
atgggaagaccaccttgctgtgataaaattgggattaagaaagggccttggactcctgaggaagacatcatcttggtctcttacattcaagaacatggacccggaaattggagatcggttcccagtaacacaggtttgatgagatgcagcaaaagctgcagactcagatggaccaactatctccgacctggtatcaaacgaggcaatttcaccgatcatgaagagaaaatgataatccacctccaagctcttttgggtaacagatgggctgctatagcttcctaccttccacaaaggacagacaatgacataaagaactattggaacacccatttgaagaagaagctgaagaagatgcaaattgggggtggtagtgatgatgataataatgatgacaaatcaaactcttctaacaattcacaaataaagggtcaatgggaaagaagacttcaaacagatatccacatggccaaacaagccttatgtgaggccctatctcttgacaaaccaacccaaattttcccagagaccaaattaccctccacttcttcacaccaccaccccacaacaacaacaacaccaaaccaaacaacatccttgtatgcatcaagcacagaaaacatagccagattgttggagaattggatgaagaaatcaccaaatatgacgaccacgacgacaacaacaatggagacaaaacccttcagcaataataacatggtaataaccacagggtctagttctagtgagggaacacaaagcacaatcacatgcacacaggagtatgcccttgactccttgtggagcttcaactctgaacgctcttctcaatctgaagaaaacaccaacttgggtgagagcaagccacagtaccaagagcctcaagagacacaagtccctctcatgttgctggagaattggctctttgatgatgctgcacctcaatgcaatgaagatctaatgaacatgtcactcgaggaaagtacagaagggttgttctaa

SEQ ID NO: 102579 - DNA, 198 bp, Glycine max
  Peptide Sequence Number=SeqID_219357
atggagaggaaaacatttgggtttttgttcttgctcctccttgtcttagcttctgagagcagaggcgaaagattgcttgacaaggaggcacgggagcgatggtttcatcggtggtcagtgccgaggccctcttcgcaaatgcttttgcagcaggccatgttgatcgaaattactactgccaaagaggccatgaaataa

SEQ ID NO: 102580 - DNA, 414 bp, Glycine max
  Peptide Sequence Number=SeqID_219358
atggcatattatgtccatgatgacaactcttggaatatagatgagctttgtcctctcttaccgtcttgggtcctttttgagctcatggcctaccttgtgcctctgtcttctaatggtaatgacttccctatttgggttgtaactcctgatggcctattttctgtcaaatatgcttactctatcttatccaaagcccctatcgacacttgcccttcttttgtttctcgcatttgggaatggaatgggccccgcataactaaatcgactaaaaggttcgggaaaactactaaaagaggcaattatttttgtaattaccaaatgggggtaaacttcaaattaatacccataaaagtaggggtgggaataggtcaggccagaccaggctttaaaaagtctgagcctagcttacgatga

SEQ ID NO: 102581 - DNA, 777 bp, Glycine max
  Peptide Sequence Number=SeqID_219359
atggaagaagggaataaaaagaataatgagagagaagagaattccctaaggaagagttctcaggctttgggtatgtacgagagtgctctgagattcgttatcagcaaccagctgaaacgaacacacataaggataaatcgcccgccacacctaccgctcagccaaatatcccttttggccccaaaggagcgaccttgcctccttaaggacgtttgttttggtgtcaacagaggagacctcaactcgtcctcgtttatgaaggaagacaccatgcttgaaaatgacattgaaaaggactttgttgaatataaggaactagagggagcattcaataaccctttgtgtcctactattagagtgacgaaagatgtgttgtctctctcatgtagtggaatggaggttttagagttagacaacgatttttgcttggtatgtttcactgactgggacgatgttaatgaacttcacaaagtcattgtttgggtgagaatccctggactatccttagaattctatgatcacaatattctaaggaaaatagggaataacttagggagaactatcagaatcgaccacaacacccttcacaaagctgaaggcggtgatgaagttgaatacgaggaactaaacatggtttgctttgcatgcggaaagtatggtgatagaaaagatcactgcttagagttctcccaaatcaaggaagcatctgtcaaagattcgcccatagccacttctggctcagcaccaacagctccctttgaccaacaagatacttaa

SEQ ID NO: 102582 - DNA, 159 bp, Glycine max
  Peptide Sequence Number=SeqID_219360
atggtggtgaactcaagagggagtttgaatcgtttgggcatgtgggatccattgaatataggagttgcttcacttgcaaaggtcgacaaggaaagatgcggcaatgtgcgcgtaatatgggaattgctttgtcatgtagacaattttgttcaaaattag

SEQ ID NO: 102583 - DNA, 894 bp, Glycine max
  Peptide Sequence Number=SeqID_219361
atggcatgcccggaatgggaggagggcgggttcaccaactttgcgggaacgcataaccaacccgactggactcgcaccgttggcttgaattacgtccgccccgattgggtaatccagatgcgcgagccctttggtttgcgttatctgctggccaaaaccgaagggcgccgctgggccgcgcgcttctggtggaaagtgggcaatctcgacagggaaatcgattgcagcgatggcggcgtgggcaagcggttgcgcagtggcctggtgggaggatacaagcttgttcgcaagggagcggccgccgcacgcaaactgtaccgcctgggcaggctgtgcctgcgggtgggatatcgactgatcaccgaaggacgcttgcgctccgggcgtaagccgacgatacccgccgccgtcgatgcgctgccgatcgccatcgaacccatgccgtcggtccctatcgacccggacatgcccaatgctctacgcgacatcgaggcgaccgcaccggcctatcgcgagtccgtcaggacattgatgagccgatacgatatcgtgcaagtctatggcgccggaggccggttgccgctcatcgcgggtacgcctttcctggcattcgagcatggcacgttgcgcagcctgccattcgagtcttcctatatgggtcagctcacgtacctgacctatacccgcgccaggcatgccttcatcaccaatgcggatgtcctgggatcggcgcagcgactggagctgcccagctacagtttcattccccaccccgtcaatgaagacagtctgcatgaaacgccggaatcgcaggcattgcgcgcttcgctttgtcgcgagctcgacacggatttcatcgtttttcatccatcgcgccagcactgggagccggag

SEQ ID NO: 102584 - DNA, 162 bp, Glycine max
  Peptide Sequence Number=SeqID_219362
atgggagagaaaaacaggttgattgtgtctaagagtgatgtgttgggtttgtgtccatacaagaatttctcaataaacgatgccatggtgaaaggggttgcaggtggactatgggttcagaagggttcggaaggacaatttaggatttacagtttattataa

SEQ ID NO: 102585 - DNA, 831 bp, Glycine max
  Peptide Sequence Number=SeqID_219363
atgcggctcgatttccgccgacggcaatcccgtggagccgtggttgcggaaactgttgaccagcttggccagggcctcggtccgcatggtgacagcgccgccctcacctgttgtgatcactttgcggggatggaacgagaaacagcccagatcgccgatggtgccgatcggcgttcccttgtaggtggtgccgatcgcacatgcggcatcttcgatgaccgccagattgtgcttacgggctatcgccatgatgggatccatgtcggcggccaggccgaacaggtggactgcgacgacggccttggtgcgcggcgtgatggcggcttcaaacgctgccggatccagattgaacgtgttcggattgacgtccgcgaaaaccgccttggcgcccacgtattccgcggcgttggccgaggtgatccaggtgaacgccggcacgatgacctcgtcccccggccccagtcccaaggccagcgtggccaggtgcaacgcggcggtacaagacgtcgtggccagcgcgtacggggcagcatggcgcttggcgagcagctcttcgaattgacgcgtcatcggaccttgcgtcacccagccgctggcgagacagcggcgcacactttcgatttcgctttcgtcgaacgagggggcagcgagttgcattatcttatctactccggatggcaaatgaagggtgcgtcggctcgcagcgatagcgtcgaacggaacacgtataggcatgaaagtgcgatacttacaattttaccctgcactggcggcgccatagtggaaaacgccacacgcaatcagccccgtgcggcgggattggcaccctga

SEQ ID NO: 102586 - DNA, 854 bp, Glycine max
  Peptide Sequence Number=SeqID_219364
atgctccccgcggcccattcccctgccatttccgatcacctcggcatatccgtcaccgaatcctccgaggccgatacgacggaactcgaggcttggctcagccaggttcccagtgccctgctatacgctggacaggaatttctcgacttcctcgtggcggcctgtggtggggtgtcgacaactctgatcgcgcggcgcggcgggcgcattgccggcgctttccggtatctcagcaaaaccgtgccaggaatcggaaccattatcaacagtctgccctggtacggcagccatggcgcatgcctgctggatacgcagcccgacccgcaggtgcgccgcgcgctactggccgcgttcggaaatcgcatcgctgccacccccgacgtcatcagcgccacggttatcctgacgccggtcgaggagtcctatcgccaggaatatatcgacgcgctccagccacgcgtgctggatccccgcaatggccagatcaccgcactaccgccagacggccccaacctgctgcatgacctggaattctgctttgcgcaaaaaacgcgcaacctggcgcgcaaggcatgcaagcagggttttgaagaaatcgtgagcgacgaagattgggcctggcaattcctgcatgatgtacatgtcgagaacatggccgccgtcggcggcaaggccaagccccgtgaacacttcgacgcattccgcgtccatctcgcaccgggccggcgccgcctttcggtagcgatgcttgaagggcagcccgccgccgccatgttgcttgccggcttcaatgacacaatcgagtacataacccctgttatcaaggtggagcaccgatcgcggcagcctctgtc

SEQ ID NO: 102587 - DNA, 122 bp, Glycine max
  Peptide Sequence Number=SeqID_219365
atgtcgaccttcgacaatctgggatacaacctgcgtctgtcggatatccaggcagcggtcggcattgcccagtttgcgaagctggagcatctgctggccgagcgtcgttcgcgggcaacgcg

SEQ ID NO: 102588 - DNA, 312 bp, Glycine max
  Peptide Sequence Number=SeqID_219366
atgtccattggatttaatgatgaaatatgtgcaatttcagaattagggtacaacaggaagaactttgacaaggacccagggcacagaatttcacagcataccacagtgcctattttgggaaaagagccctggaggcggcaaaaggagcagcttttgcagagatacctaggttttaacatgaatgaagcaaaattcaaacttagtcttacaagagggatctgcggattaagttttgattttaagtatcctgttacaataatgttgtttggtctaagtctagtccaacaagagggatctgaggacaaagcttag

SEQ ID NO: 102589 - DNA, 663 bp, Glycine max
  Peptide Sequence Number=SeqID_219367
atgacaccaacttgtgggcaaagcttactggcatacaaaagttcgagcagtaatcatctcagcatgattcagcatcatccgccttctatctgccaagagaaaaaggagaccaatgaatgttccaagtcatggcttctcatcaaatctcaatcaagcttgattccaaaaaaattctgtcacggtttgtggtcacaaacttcatcgtttcttgaattcttaattgaccctactattccttctaggtatcttacaaagcaaggttgtgatgctgatgtaattaatccagcttattcagattgggaacagcaagatttattgctgtttacatggtttctgtcaatgctgtcagagatggttcttcctagggttgttcattgtgtgcactcgtggcaggtttggcaagaaatccacaaattctttcactctcagatgagtgtgcacaatctcatcaatttcactgagttaaaatccattacaaaaagagagatcacacagttgcagaatctggcaaggattcaagctgtcgctgatatccttttgtccagagaagatactgtttctcattgtgaccacataaatgatattcttgaaggtctccctgaggaatacagtcctcttgcagcaattattcagtatcacactgaaccttgcgacattttgtaa

SEQ ID NO: 102590 - DNA, 258 bp, Glycine max
  Peptide Sequence Number=SeqID_219368
atgatgccttcccgcactggttttggcattcctcagtattgttcaggatgtgatagatcattctgtggagcttactggcatgctctaggggtaactgggaatggctcttaccctgtctgctcccaggatactttaagacctatcactgatagttgcattagacaaatggggaggacattgccggatgtgatatcagagtggatagcaaagtttgaaaacagagaaattggtaaagtgataaatttgccttccttgtaa

SEQ ID NO: 102591 - DNA, 414 bp, Glycine max
  Peptide Sequence Number=SeqID_219369
atggctagaagtttacccggaagaacagataacaagatcaagaactactggaaaagccacctcaagcgttacctcactgccctaggaatcgaccctgtaacccataaaccattcaaggacgccaccacaactccaccaactaataattctcaagtgtctatggtaaccaccacaagcaagaatggaactaacaacaccgatagcaatatcccccgcatctattattttaatgtctttctcaattcaaaggtgcaaattagcgctgatcatgattgttcagctgatggtgcagactcaaatggcagcagtggtgttaccatagaggaagcttctcctcaagtcaacttggagctttccattgctccaccctctcagcctgaagatgcttccatgaaagaaaccctgaatggttga

SEQ ID NO: 102592 - DNA, 546 bp, Glycine max
  Peptide Sequence Number=SeqID_219370
atggagtattggttggagagtgctaatttggatgagattcaccaggagactggggtgcaagacccttactggataccaccatcgacatttggggctggcggtgttcctactgagaatattgattatattggtgaactgaaaattcttaaaatagaaatggcccagatgaagaaagacatgcaagagctcatttccaagaagcaagaaaaaagtgaaatgtgtttgatggagctttacatattgacaggcatgcatgaaaacatgttgatttggaaaactaaagttgagcaacagctaatggaaataaccaataaattgagtgatgtgcggaaattgagagaagacaccactttaagttatcctccggtaagttgggaggattggctagaaagcaccaacatagacaatattcagggaaaagaacttgcgccttggtttgggaatcctgagctgcttaatgttccacaagaggttgtacttcaagatctgaactcatccctaccaactcagctgcacagtgtagaactgactaacatgaataggtaa

SEQ ID NO: 102593 - DNA, 204 bp, Glycine max
  Peptide Sequence Number=SeqID_219371
atggagaagaaactcattactgctagatcttcagttcatataggcgcagtccctgtagcagagatggaagcatcagctttgctagttgccatcaaatggatcgtcgataaagatctcagcaatgttatcttcgaaattgaccgcaagcacgtgcatgatttgctccattccatcaactatagggctcatcttgacttcttgtaa

SEQ ID NO: 102594 - DNA, 1803 bp, Glycine max
  Peptide Sequence Number=SeqID_219372
atgccgaagaacaagtgtccccgagaagcagttacagaatggacacgtggtagcggtgccacaatctgcttccacttttcaacaacacttgttcgctgtcatgttcttctgcttctcgtctttgttcactcttccagtgcaaacctaacaaacatgggaagtaaaaaccaatgtcaattatcagacaagaaaggttatgtttccagcctaggatgtttctttggactgcttgatgccaacttcttcgaggataaacagattgccgagggtgcaaatgagttcaatattccaatcataagagctaatcgaaaacttgtagcttctgagaatggggagctgcattatccctctcctttagtcttcaatgctgattggaactctcaaccaactcattttgaaaacaaaagcttcaactatccttccatctctgggatacaaagccctgaatctgaagaagatattgcctttatgagtgttcttgagttaggtgaactcatcaaaacaaaacaaattacttctctggagcttacacaaatattcttgcggagactgaaaaagtacaaccctactcttgaagctgtagtcacttatactgaagagttggcacacgagcaagcaaaagaagcagataagttgcttagccgtggagtctatctggggcctcttcatgggattccttatggattgaaggacataatatcagtgcccaaatacaaaacgacctggggatcaaaatcattcaaaaatcaagttattgacgtagaagcttgggtctataaaaggttgaagtccgctggggcagttcttgttgcaaagcttgtttctggatcattggcatatgatgatatttggtttggtggtagaactaggaacccatggaatattgaggaattttctactgggtcatctgctggacctgcagcaagcacctcagcaggtatggttccatttgcattcggtacagaaacagctggatccataacttttcctgcagctcgatgtggagtgacagcgttgcgcccaacttttggtactattggtcgaagtggtgtaatgagcatttcagaaagcttggataagcttggtcctttctgtagatctgcaactgattgtgctattattcttgatattgttcggggaaaagatcttgatgatccctcatcaaaacatagctctctggatgatccattcctggttgacattacaaagttgactgttggatatcttgatgatgctgaaatggaggttgttcatgttcttgattcaaaaggtgtcaagatggtccctttcaaactgaattacacagtggattccgttcaaggtatcttaaatttcacaatggatgttgacatgctggcccactttgatgagtggcaacgctcaggcaaggataatgtgtatgaagctcaagatcagtggcccactgaactacgccgtgctcgcttaattccagccgtggactatgtacaggcacaaagagcacggggaaggctaataaaggaaataagagagtccttcagcgtggatgcattcattggcaatgcaactgactgggagaaagtttgcctaggaaatcttgttggcttaccagtcatagtagtgccaacaggacttaaaaatatctctgatccaccacctggtggcactagaagaagaacgacaattcccacgggcatttatgctccccctaaccgtgatcacattgctctggcgttggcaatggcttaccaagaggtcaccaatcaccataaacagcgccctcctatcaacgatctcgggccaaatgataagcttcctagctga

SEQ ID NO: 102595 - DNA, 381 bp, Glycine max
  Peptide Sequence Number=SeqID_219373
atggagggtcttctgcctctggtttacaaagcaatcaagaaacgcaagactcgcaggcaataccagtgtctttcttcaggggctgctctaagctacaacatgaacgtggctgagttctaccctcaaactcatgatcatggccatggctataattacatgcaggagccttcaacttcaatgcaaaaagtggttgatcatgatgatgatgatacagaaaacattggttatctgcgatacaattctgttagagaattctctaatgggttctcttcgcctcatcaacaaagaacctgtgccgctgactcacccgattcgaagcaactcgtcagttttggtgtttggatgagttacaagatagattcgtataaattgcagatttag

SEQ ID NO: 102596 - DNA, 1629 bp, Glycine max
  Peptide Sequence Number=SeqID_219374
atgtccggggcaggccaagccatagacatggagcacgtggggttttcgaaagcgaaagccgatcatggccgtggcaagaaaacgggtccggtttcgatggatcacgtgcttcttgcactgcgcgagaccaaggaggagagggatcttcgaattcggagcctcttcaatttcttcgatgctgcgaataatgggtacttggactatgctcacattgaggccggtttgtctgcactgcagattccccctgagtataagtatgcaaaggagcttttcaaggtgtgtgatgctgatagggacggaaggatcgattaccgcgactttaggcggtacatggatgacaaggagttggagctttaccgcatatttcaggctattgatgtggagcacaatggctgcattctccctgaagagctctgggatgcacttgtcaaggctggtaggtattctggtactactactttgttcattgtgttttgtgcctcgtggcttgtgttgttgttttctatctgttctcttcatcctttctgtgcttatggtgatgtaaggattgaaattgacgaggaagagcttgctcgctttgtggagcatgttgacaaggataataatggaattatcacttttgaagagtggagagattttcttctactttatcctcatgaagcaactattgaaaacatatatcatcattgggagagggtgtgccttgttgacattggagaacaagctgttattcccgaaggcatcagcaagcatgtgcacaggagcagatattttattgcaggggggatagcaggagctgcttctcgtacagcaactgctccacttgatcgtctaaaggtggtcttacaagttcagactggacgagcttctattatgccggcagtgatgaagatatggaaacaagatggcttattagggtttttccgaggtaatggattgaatgttgtgaaggtagctccagagagtgccatcaagttttatgcttatgaaatgctgaaaaatgtaattggagatgctcaagatggcaagtcagatattggtactgcaggaagactttttgcaggtggtatggctggtgcagttgcacagatggctatctatccaatggatcttgtcaaaactaggctacagacttgtgcttctgatggtggaagggttcctaagcttgtcacacttacaaaggatatatgggtccatgagggacctcgggctttctacagagggcttgttccatctcttcttggtatgattccttatgcagggattgatctcactgcatatgacaccttgaaagatctatccaagagatatattctttatgacagtgatcccggtcctctagtacaactcggatgtgggacagtttcaggtgctcttggagctacttgtgtctatccgctgcaggttattcgtacaagcattaccatgattctcagactgcaggcacaacctgccaatagtactagtgcttacaagggaatgtctgatgtattctggaaaactctcaaggatgaaggctttagaggtttctacaaggggctcattcctaatctcctcaaagttgtgccagctgcaagcattacttatatggtttacgaaagtatgaagaagagtctagatcttgactag

SEQ ID NO: 102597 - DNA, 555 bp, Glycine max
  Peptide Sequence Number=SeqID_219375
atggagaagccaccaatctatggtgcagcatcagattgcaaaccactaaccacctttgttcagacaaactcagatgcattcagggaagtagtacaacgtttaacaggtccctcggaagcaagtgcagcaaaagaaggagatgcaaaaaaggttgcaactatgaaaaggacaacctcaaaactccatgagagaaggaaatacatgaagccaaaagttgagattgttaaacccacttttaattataaaacaggtgcatgtttgtcaccctctaagtcaagaagttctagctttcctccaagccctggatcagggagttcaagccttcttccaagccccaccaccccttcaacattgttctctctgttgaaaattttggaagatgaaaagaaacaagagtcagtgatgcctgaagtgaacaaagaagaagaagagaaagctatcaaagagaggagattttatttgcatccatctccaagggctaaaccaggctacactgagccagaattgcttaatttgtttcctctggcatctcctaatgcaagtgagaaagtataa

SEQ ID NO: 102598 - DNA, 153 bp, Glycine max
  Peptide Sequence Number=SeqID_219376
atggagcatttgaattgtggagaaccgaaagatgctaactttggcctcagatctgcaaagcggtttcgtgggtggtttttccagggaggtattgtggaaaccgaatcagaatatttaagaggggagagaggttcctcatattatgaattgtga

SEQ ID NO: 102599 - DNA, 672 bp, Glycine max
  Peptide Sequence Number=SeqID_219377
atggggcacaaagaaaaatctaaagagcgaaaagagaagagattgcaagagatatctcttctgaggaccattccatatgctgatcaccagaggttgctttttctagctatttaccctctcatacatcataggtggtggtctaaggaaacaattgccgtggttactggaggaaacagaggaattgggttcgagatctctagacaacttgctgatcatggagtaacggtaatactaacatcaagagatgctagtgttggtgttgaatcaatcaaggtcttgcaagagggtggtcttcaggacgtggcatgtcatcaacttgatattctagatacttcttccatcaaccaattctgtgagtggttgaaggaaaattatggtggcttagacattctggtaaataacgccggagttaatttcaattttgggtctgataattccgttgaaaattcgaaattggttattgaaacaaattattatggcaccaaacgtatgattaaagccatgattccattgatgaagtcttcctctgctggcggacgcattgtaaatgtgagctcgcgtttaggtcgactaaacgggaagcgaaatcaaacaacgttaatccaatatccattcactgggaatacactaagcatgttttttcgcataaatattcgtgttttggaatgttaa

SEQ ID NO: 102600 - DNA, 1743 bp, Glycine max
  Peptide Sequence Number=SeqID_219378
atgccaagtcaacttaaagttcacttagctatcagccctttcgttttgcttcacacaacagccggcgatcgccttcggatctctgagaaaaggaattcaaaaagagggtgtgagagacctttcactatggcagacattggtgattcttcttccaaagggaaaaatgtattggaatctcttccaaaaattgagcaattaactcaaggtgttgctgatgttaacatagagtcaggacaagatgatggtgaatgggtggtatatgcaaagaagtccaagaatagagcccgaagcacaactgttaaaccatggagtcctccggttcataattctagacccactggaaatacaaagatggctcacaagccagttactcggaatgatggaggagttggaagggcttctgggagtggaaatccttggcagtcccaaaatgctaacttcaagagacctgctggcagaggaaatggaaggccacagttaactgcaagtgaatctgaaagcagcaataatgtgacttctaatccagtcattcgacctcccctcgagcatgggtggaattggcaatctatatctggctccaagcagtccaagagtgttgatgatagcctggtgaagggtgaaattacagaagagtcccctatgaagaatgatagtgttgatgatgaaggggatgaagaggaagggtttgatgctatggaagatacggatgatgatctaatgagtgatgattatgattctgatactagtcaaaagagccacgagactcgtaagaagagcaaatggtttaaggatttctttgagaacttggatggcctatctatcgaaaagatcaatgaaccggaaaggcagtggcactgtacagcttgtcgaggtggtcccggtgctattgattggtacagaggactgcagcctctgattactcatgccaaaacaaaggggtcaaaaagggtgaagatccatagggagtttgctgagcttttggaagaggaactgcgcaaaaggggctctgcagtaattccacctggggaagtatttggtaagtggaaaggtttaaaagatgaggagaaagatcatgaaatagtttggcctccgatggttgtcattcagaatacaaggcttgaacaggatgaaaatgataagtggctaggtatgggtaaccaggagcttcttaattattttagcgcatatgatgctgtgaaagctcgacacgcttatggcccccagggtcatcgggggttgagcgttttgatatttgaagcatcagctataggttatcttgaggctgagcgtctacacaagcactttgcagaacaaggaactgaccgagatgcttggtttagtcaccaccgtagattatttctccctggtggccggcgacagctctatggatacatggcaataaaagaagacctggactttttcaacagacattgccaaggtaaatctagactcaaatatgacatgagatcataccaggagatggttgtaaaccaacttcggcaaatgaatgaggacaaccagctgcttatttatttgaaggacagggatgccaaaaaacaaaaacaaacaaaagctcttgaagaatctttgggtatagtgactgagaagctgcgaaggacaatggaagaaaatcgcattgtgaggttgagaactaaaatgcaacatgaagagaacaaggaagagctgttgatagatgagttttggatgtgcttcggaatgaattgtttcattgaaaggtgttag

SEQ ID NO: 102601 - DNA, 462 bp, Glycine max
  Peptide Sequence Number=SeqID_219379
atggcagaggctccttatcattgctattatattctgcagccatcagatattggaccaatgcttatgaggctcctagcaggggcagaagaaatcctacgagttcctgacaatcaattagttgattcatcaatcaacaaggaaattgagagctcggttcaagcctgtttgctaaagccttcgtcagaggtgatcggtaaagcagaagcagccaccggtgtcatagtggatgaggaaactttggcattggatattacggatcaagacgacaaaaccacggcctgtattacagaagaatggaagcaattggttgtaagcgaagaccccaagttgtactctccctcttgtatgcccaaagccaagttgggtcaatcgagtgtatcaccacgagatggtaataggcagttagacagggaaacttcaaggattttggagacattagaggttcaaatgaaagttgcatga

SEQ ID NO: 102602 - DNA, 988 bp, Glycine max
  Peptide Sequence Number=SeqID_219380
cctagtcgctgccgagtgcacgtgcgatgaagaagaccaagagcgagacaaatcaaaagctttaaggtacaaaatagcagctttaatatcaatactagttgctagtgcaatcggggtgtgtattccacttcttggcaaagttatacccgccttgagccctgagaagaacatattcttcatcattaaggcctttgccgcaggtgtgatattggcgaccggttttattcatatcctacccgatgctttcgagaaccttacttcgccgtgtttgaataagtatccatgggatgctttccccttcactggctttgtggcaatgtgcactgccatggggactctcatggttgagacttacgccacggcttattttaaaaaacatcatcactcacaagtccagacaacatacgtggaaaaggaggaatcaggggatgtgcatcttcacacacatgcaacacatggtcatgcacacggccatcttccctctcatgatcatcaatcatcggcacttcttcgtcatagggtcatatcacaggtgttggagctaggaattattgttcattctatcatcattggaatttctatgggagcttcagaaagtcctaaaacaataaggccactggtagctgcattgacttttcatcaattttttgaaggcatgggacttggaagttgtataattcaggcaaatttccagaggttatctattacaataatgggattgttcttcgcattaactactccagtggggattggaattggcatagggataactaatgtttacgatgaaaacagtccaactgccctaattgtggaaggaatcttcaatgcagcatcagctggaatcttaatttatatggcacttgtagatcttcttgcagctgattttatgaatccaagaatgcaaaaaagtggtagcctccgattaggagccaatctctctcttctacttggagctggatgtatgtctcttctggctaaatgggcttaa

SEQ ID NO: 102603 - DNA, 447 bp, Glycine max
  Peptide Sequence Number=SeqID_219381
atggcaaagaagctttctgagagacctgatggtgaaaagatttatatcaattcctattgccccggttgggtgaaaaccgctctcacaggttatgcaggaagtgtttcagttgaggatggtgctgattctggtgtctggctttcccttattcctgatcaagctattacgggcaaattgagaatgatagattaccaaaacaattcctcaatgtcaccacatacacaagtgattattcactccttggaagtcttacttacccgtttggtttggggtggcgggaagtggaggaaagaaagccatggtagcttacccgctaaaagcagaaagcagagaaaggttccttcctcttcaattgaattcataactaaggctattatattgaagcaagcagcgaggcttcctcgaactcgatttggtgctcggaaaatgggtagaggacaacattaa

SEQ ID NO: 102604 - DNA, 246 bp, Glycine max
  Peptide Sequence Number=SeqID_219382
atggaagacactgtgaaaggaagtattgtgtataaagttgtcgtcacggaaaagaatattgatgcgacactggaggtcataggggaaccgggacacgacggcatacaccatcacacccagatcatagcattcagtcaacgatgcaagcatgacttagaccctccacgtcgaaaaggatccgtgagggcagagtggcaaattcaagaacgggatttcgggaactttgagatggaagagaggatgaag

SEQ ID NO: 102605 - DNA, 207 bp, Glycine max
  Peptide Sequence Number=SeqID_219383
atgaaaggtgatgcagaaaaagcttggaacattggaaatggttttggaagaatgaaaggagaagaaatggcatttttcctaagctacttggactttaaggctcaaaacacacaagtgagcaatgctctcgggaacggaaatgccccgcacactttagacatcttcgcaaagatcccaacgggcagatcatggacaagtgtctcgtga

SEQ ID NO: 102606 - DNA, 303 bp, Glycine max
  Peptide Sequence Number=SeqID_219384
atggaggagccagtcgagtataggaatcaagtacaggcagatgttgtttcaaccgaaaaagacaatggtaaacctaacttcaacaaagcccaagatgatgggaagaggggtcggctgccacaagaaccccattacgcctattcatccaaaaaccacaatcattcaagcctcataacccttgtaaacaagagtcaagcagggggaagggtcgagaatacacaagtcatttatataggcacagaagctgaagtcgatcaaaagaaagagagtacaagcccctcaaccaaccaagacatgtcataa

SEQ ID NO: 102607 - DNA, 255 bp, Glycine max
  Peptide Sequence Number=SeqID_219385
atgcaacatgttcaaaatctatataccactggtgagtgttataaggaagtcaattgtggtcggcagaagaaggtgaaggttgagaagtcacaggggaaagtagttgtgagaggtttcttgtcaatggggcttcacttggaagaaggaaaggaacatgggttcttctcagcaggaacagagagagagacagatttgaatattgagggaccaacaaacacagcgtggattggctttgaagaaacaaatacagtgtag

SEQ ID NO: 102608 - DNA, 876 bp, Glycine max
  Peptide Sequence Number=SeqID_219386
atgcactatgtggaggtcaggacagaggccgaagaagtggaagagctggagctcaatccgagaactaacgatggcaatcgagtgaagccacttgaagaaacatccaccttccaactcaaccctaagcaagaagttgccaagttgatggctgctcagttcatcagagaaattgactataccacttggctatccaacgtggtcatggtgaagaaaccaaacgaaaaatggaggatgtgtacagactacacgcacctgagtagagcatgctcaaaggtcgtgtacccactctcgaacattgaacgcctagtcgatggaacaaccaaacacaaattgttaagttttctagatgcgtattatggctacaaccagataaagatggacccaatggacaagaagcagaagacatttattactgaatctgcaaactactacaaaatgaaacctagaagtctatgtggatggcatggtagtcgagtctatgtggataacataaggttgaacctcgagaagtgcatctttgagggaacgctggcaacaccatatgtcttgtcaaagccaaacaccaacaaaaggttgattgtctatctttcggtttcgaatgaagccatatgtgcaatgctagtacaggaagaaggtgggaatgctcgagctcaggtgctagctgattttatcaatgaacttcatcctccacaaccacatttggagcaagaatggtggacaatgcatgaggacgactcttccaaccaacatgggagtggagctatggtcgggtacgaggccttcttagaaagattgagacttgccaaagaggatcctcaactcctgaagtactattatgcatttgaggggctcaaagaagagttcgaggaagttcag

SEQ ID NO: 102609 - DNA, 243 bp, Glycine max
  Peptide Sequence Number=SeqID_219387
atggttaggattttagaagattgcaccgtgaatgagaaggccttcagaatggtaaattcagagatgaaggaaaacatggtgtctctagatagatttcccgacaaagagacacccccaaaaatcaagtttgcaagacaaaaagaaataatgtccagtaaggaaaagatagacaagtcaacttggatcaaagtaggaaacaaagaccaaagcttcatggcaaaggggcaactccaaaagagatga

SEQ ID NO: 102610 - DNA, 849 bp, Glycine max
  Peptide Sequence Number=SeqID_219388
atggctccattactgttactccaaaatggtcaagtgactaaatcaaacagagcatacactctgagggagttcccggagagatttgcaaaagatggacccttgggtactagtaccctcaccttcagaggactacatgtcctcaccatcagaggattacaagtcctcgccatcagaggactacacgtcctcgccttcagagggtcatgtaccttcaccttcagaggattacaagtcctcgccattagaagactacacgtcctcgccatcagagggctgcacgccctcaccttcagaggactacacgtcctcgcctttaaagggtcatgtaccttcaccatcagaggattacaagtcctcgccatcagagggctgtacgccctcaccttcagaggactacacgtcttcacctttagagggtcatgtaccttcaccttcagaggactacatgtcctcgccttcagaggactacatgtcctcgccttcagaggactacatgtcctcgccttcagagggccgcatgccctcgccttcaaaggactacacgtcctcgccttcacagggtcatgtaccttcaccttcagaggactacgcgtcctcgccatcaaagggtcatgtaccttcaccttcgtagggctacacgccctcacatcagaggactacatgtcccccattttcaaagggagacacgccctcacctttaggggactacacgtccttgccatcataggactacactgcctcaccttcaaaaggcgacaggtcctgaacttcagagggctgcacgccctcgcctttagagggctacgcatcctcactttcagtgggctccatatccacaccttaagataa

SEQ ID NO: 102611 - DNA, 864 bp, Glycine max
  Peptide Sequence Number=SeqID_219389
atgttaacaggcgacaggctgatgttcccttatatctctcatctgctcgcagcgatgctgctgggcgcaattatcggcgcggaaagacaatggcgccagcgtatggcggggcttcgtaccaatgcactggttgcgacgggcgcggccgtgtttattctaagttccctctcgacgtcacccgatagcccggggcgcatcgcagcgcagatcgtctccggcataggttttcttggcgcaggcgttattatgcgtgagggaatgaatatccggggtcttaataccgccgcgacgctgtggtgttcggccggaattggcgtgctatgcggattaggtcaattctggaatgccggtatggccagcgtgattattctgtgcgccaacattctgcttcgcgaagctgcgcagcggattaatcaactgcccgtgctccatgaaggcgaaaaatgctatgtccttaaaatcacctgtaatgacgagcatgaagatgcggtgcggcagaatattgtcaatatggcgaaagagttgacgttaagcctgaaagccatttattgcgatacagcgcaagaaggaggtaaaaccgaaatacgggccgaggtgatgacccgtgaggaataccggaaattactcgagctaattatgggtaatattggcgggaataaaattatggcttccaaatgggcagtgacgcggagagaatcatacagaagcgctgattctggccagacttttcatcatcttcgtcgtaaggctaagctgctcgctgcccataagttgggacaattcctgcttagcggattgccataccggaatgacctgttcaagcagacgccagccttcccccgtcaacatgagtcgttttcctga

SEQ ID NO: 102612 - DNA, 837 bp, Glycine max
  Peptide Sequence Number=SeqID_219390
caccacctcgcgctcgaactgcaacgggccgtcgaccacggcattcgggccgatgatcacgcgtggcttgcggctggcggtcagcgagacgctgaagttcggcttgcgcacgtgcacaccgcccttgacctgcgaaccgatgcccacggtgatgtcaccgttgacggtttccacgtcgttgccgacgcggctttcgaccagcccgatgccaccgttcacggtttcaacgccgccttcgatctggctgccgcgatcgctgaagatgctgccgttgacggtgctgacgttgccatgggcgatcacgtcgcggcccaggcgcacaccgccgttgaccgtttcgatcttgccggtgcgcgcgcgatcggcgaccttcaccccgccgttgacggtgtcgatgctgccggtctcgacgccttcgccgacgcggatgccgccgttgacggtgtccagcttgccgtagcgctggccgggttcggcgctgatgctgccgttgaccttgctgatgttctcctgggcgcagaccggtccggtggccagcagtacgcccaacagcagcggaatggagagagctttcatggggacctcgatggatgtgcggctggcaggccgcgtgcggagatgtcaccattccccggtatcccccgcaactgcctgaagtcactggaaagcccttgcgcaacaacgtcttcccatcacgccgacatcacatcgccgctgcccgcggcgggcgctgcctgctgttggggctggccttggcactggcgttgccgttgccgggtgccgcgcagaccacgcgcgagaccgagcgcaagctgcagaaactgcgcagtgagctga

SEQ ID NO: 102613 - DNA, 374 bp, Glycine max
  Peptide Sequence Number=SeqID_219391
aaacaactccagtaatagaaaacaatgttcaaactattgttgatgacattgttcaagaacaagacaacgatgaggttcttcctcaaatacctatacaacaacctcaacaacctcaagaagtgcccttaaggagatttgatagagacaggagaaaacatgaggatgacattggtttaacaaaggatgtttcgattaacttctgtcaagccatgtgtagttctaactctcaaaactggatcaatgccatgaaggatgagatgaaatctatgcaagacaatgaggtttggtatctcatcaaattgcctgaaagtgtgaaacctattggttgcaaatggatatttaaaaccaaaagggattcaaaggacaatgtctaa

SEQ ID NO: 102614 - DNA, 216 bp, Glycine max
  Peptide Sequence Number=SeqID_219392
atgaccgatgacaagtccgaacttattgaccttgtgttgagggaaggttttcaagataagcacattgtacttaaaaaagaacccaaggttaaggatcttgaacagagtaagaaaatcactgccaaacctcctaaagacctcctaaaggaatggagaacacaaagagatctctccttggacaacatcataggtgaaatatctttggttatgcaataa

SEQ ID NO: 102615 - DNA, 303 bp, Glycine max
  Peptide Sequence Number=SeqID_219393
atgttcgcaacccaattccgagaattctcaccgttgggaatttcgatattatgtctgagcttagagggaaacccttcgcattgtagccttttattttcccgcagaaacccaaaactatctcgaaattcaattgatcacactttcaccgttgggattttggagataatattcgtagaggggaaaaaggaatcacatgaagacaatacaagtggaggtttcaatctcttctccgtctctctgacgtttgagaattctatcggagcagtcggaggaataactgaaggaatcttagggaaccgctag

SEQ ID NO: 102616 - DNA, 237 bp, Glycine max
  Peptide Sequence Number=SeqID_219394
atgcttcaaagcttcaaatgtcggcaatggaggacgacgcgcgcggagaagaagacctggacgcggggtgaagactgttggacgcgtggagctctggtcgcggaagaagaagaactcaaaggtgaagaagctttgggtcgcggaagaaaactctataacgattctctccaaaaggatgcaaagctaggggagattggagagtggaatggtgagaggtgggtttggtgtttggcttga

SEQ ID NO: 102617 - DNA, 310 bp, Glycine max
  Peptide Sequence Number=SeqID_219395
atggggttgttcttagctttaactactccaatggggattggaattggcatagggatcactaatgtttatgatgaaaatagtccaactgcccttattgtggaaggaatcttcaatgcagcatcggctgagatcttaatctacgtggcacggatagatcttcttgcagcagattttaaaaatccaagaatgaaaaaaactgctactaacaagaatttcctttgtcctagtgcagttagcaagggtcctaggatgtccattcctcaaacaatgaaaggtcgtggggagacaataggatgcaacctttcagccg

SEQ ID NO: 102618 - DNA, 198 bp, Glycine max
  Peptide Sequence Number=SeqID_219396
atgggtgccaagtacctcgaagtggtcaaacaaggatcgcatcccaacaacggatggtccccggacgaaaataggaccaataatatattgagactctcgaaattgaacaacggaagctctcgtgaaattcaaatggtgataacttttcactcggatgtccgattcaggcgcataatatatccagatgctcaaaattaa

SEQ ID NO: 102619 - DNA, 288 bp, Glycine max
  Peptide Sequence Number=SeqID_219397
atgacgaacaaggccaaaggaaaaggcaaggaggtcgccggaaaaggttctgccggcaagcgtaagggcgccttcgacgatgacaagaccggtggcgaccgaaagagaaacaagcgaggatggacatgccagataagggccagagtagcaggtcacgtgtcgtccctcaagaggaaatgttggcccgaaacaaactgttttgagttttggaccttccgttgcaggccgtgttcgaatgcactggtgtctcctgttattttttttggattcgttgacgtgcaaacatga

SEQ ID NO: 102620 - DNA, 186 bp, Glycine max
  Peptide Sequence Number=SeqID_219398
atgggatcgaagggtggcatcgcgggcagagaagagaggggtgagtggtggtggtcgcgcagttgtggtggtttaggaaggaggtggtgggagagaggaagagcaaggaggaggcctaagcccaattacaaagtaactctccgggggagaagaacacacacaaaatcagcccaatacaggcagtag

SEQ ID NO: 102621 - DNA, 417 bp, Glycine max
  Peptide Sequence Number=SeqID_219399
atgcagaacattgaacggccatatactttgatagaggaggaaccacagttgagaaaatctaaccctgttgcaagggcaaatgtttctacggtgtctttaacattaaatattatttgttcaccttatgctcattcatcaactttagggccttggaaaaagaagtgtttgagtgaaattggggttgtcacacagtgcattgcccctgtcaagatcactgatcaataccttactaatgtacttcttaaaatcaattctaagcttggaggaataaattctctgttgacaatagagcattctgggcatcttcccctgattaaggataccccaacaatgattttggggatggatgtctctcacaatttgcctggtcgattagatagtccatcaatagcattgatcaattttaagggcatttga

SEQ ID NO: 102622 - DNA, 423 bp, Glycine max
  Peptide Sequence Number=SeqID_219400
atgaaggcttatagtgacaatgaagaccagtgtgatgctcgttggagatgtgtcgcatgtcgtatgcgtgaacttaacgtgttagggccctacatgcgacaatattttgagttagttgtgcatgtggacgacatggcagcgggggaaaagactagtgtgacactaaccgaagatgtgtcatgtatcgagaagaagaagcacgacaaggaggttgtcgaaggatgggtcgcatggaaaacatttccacgcgatgatccgatgcaagcacacgagtgtcacacgctagagtgtggcgacgtgtggagcaatacacaatggggagtgctctcagcagttgtgatactgttcaagcaacaaatgggcggtcaccaggaaacgcattgggaaaggagaaagggtcactataagatgggcaacaaatag

SEQ ID NO: 102623 - DNA, 441 bp, Glycine max
  Peptide Sequence Number=SeqID_219401
atgtcgtacattgaaattggttgctggttcagaagttcatcatgtatgcttggtagactcacccttagattaagggatgacagagtagtgtttaacttgtctaatactttgaaacaaccatcctcatttgcttcttgtagttacattgagtctgttgatatatcagatgcattgatggagggtttacatgaaactgaggaggacaaactgttgcgggttctcaggggcaacaaggaagcctttgggtggaacattcatgacataaaggttgtcaagggagagaatgctaagtccactttcaagatgaatgcgtataaattcaaggtgtattatgagggattccaacagtacaacggtcgtgatcatttggccgtaacccaggcagttagcgtaggtgtcgagtacggccgtggtgactttaccacgatcatagtcggttag

SEQ ID NO: 102624 - DNA, 279 bp, Glycine max
  Peptide Sequence Number=SeqID_219402
atgtgggatttaatacaagtcacacatgaaggaacaccaaaatgtcttggaaatatttttgaagaagaagacatcaatgtcaaggtgttgaaatacctcaacaaaacatggcagccaaaggtcacaactatttctgaatcaaatgaccttgcaactatgacacatgctgaattgtttgggaagctgaggggatatgaaatggacttgacaagaatggttgaagaagaagctatagataagaagaacagaggtttggcattgatgactagcattccataa

SEQ ID NO: 102625 - DNA, 471 bp, Glycine max
  Peptide Sequence Number=SeqID_219403
atggaggccatgaaaaagcaaatggccacaatgatggaggccatgatgagtatgagaaaaatgatggaggtcatcatggctacagtcgttgtcgcaagtactgccacagaagtggacccgactcacccatctggcctcaatcaaaaaagtgaagcgttaggaagtacgggtggcccccattttgtgcaagttcagaacaaacattccttcccaccatatggcttgcctcccaactatacaccacccaatgttgcacacactcccaatgagaatgtcaacaactttgcacccaagcctattgagagccaacaaccccaatctgattatgcacatgtctctcaacccatggaggagacacatgaagcatccctagaccataatctagctgacttcgaacctcaccttggatatgccactgaggggcaagcaattggtggtgtacctctgccaaacactttggagggcccttag

SEQ ID NO: 102626 - DNA, 189 bp, Glycine max
  Peptide Sequence Number=SeqID_219404
atgctatcaagatcttgcttggggctattgaatttggtatcggtggatgattaccaaacgctgggtggtcgcgttccgcggctggtgacgacggcggccggagacgtgccggagttgtatatcgacggcatggagaatccgggatcggacgacgccgtttcgccggcgcggcgcgagcggaggatcgtg

SEQ ID NO: 102627 - DNA, 1749 bp, Glycine max
  Peptide Sequence Number=SeqID_219405
atgctggggctggattacgagtccaagaggggttacattgggttggattactacggtcgcaccgtgacggttaagatcctccccgcggggattcacatggggctcttggagtcggtgttgtctttgccgcagacggcgttaagggtgaaggaattgaagaaggagtatgaaggaaaggttgtgatattgggagtggatgacatggacttgttcaaaggtattagtttaaagttcttagctttggggaagcttctggaagtggatgaaagcttaaggggtcgtgtggtgttggttcagattctgaacgcggcgaggagcagagggaaggacattcaggacgtgaagaacgagagcgaggccattgccagagagatcaatgagaaatattcacaaccggggtaccagcctattgtttacatcaatggaccaatctccacgcaggagaaggctgcgtattacgctgtttctgagtgctgcgttgtgaatgcggtgagggatgggatgaatttggtgccttatgagtacactgtttgcaggcaggggagttttgctttggacaaggcgcttggcgttgaaggtgaggataagaaaacccttaagcagagcgttatcatcgtgtctgagttcatagggtgttccccttcgctcagtggagccatcagggtgaatccgtggaacattgatgaagtcgctgaggccatgaattcggctgtcacaatgtcggaggcagagaagcatttgcgccacgagaagcattacaagtacataagctctcatgatgtggcttactgggcaaggagttttgatcaggatttagatagagcttgtagggagcattactctaagaggtattggggtgttggattgggcttggggttcagaattgttgctttggatcctacctttaggaagctctctgtggatcacattgcctctgcatatagagatacacacagtcgattgatccttttggactacgatggcaccatgatgccgcaggcgacaatcaagactccgagcaaggaagttattactgtcttgaattatttatgcagtgatcctgaaaacatggtgttcattgtgagcggcagggataaggattgcttgagcaagtggttttctccatgtgagaaattgggtctctctgctgagcacggttacttcactaggtggaccaaggattctccttgggagacttgcggattgacgaccgattttgaatggaaaatgattgcagaacctgtgatggcgctttatactgaagcaactgatggttccttcattgaacataaagaaagtgcaatggtttggcaccatcaagaagcagatccttattttggatcatgccaagcaaaagagcttcttgatcacctggagagtgtgcttgccaatgagccagtaggggttataaggggacaacatatagttgaagttaaacctcagggtgtgagcaagggtaaagtggtggaagaccttatctcaatcatgcgaagtaaggggaagtcaccagattttctactgtgcataggagatgatcgctcagatgaagatatgtttgaaagcattgctctttcagtatctaatccagctctttccaccataatatcaaaagtgtttgcatgcactgttggacaaaaaccaagtatggccgaatactatttggatgatactagcgaagtaatcaagttacttgaaggacttgcaactgcagcaggaccttctgcgtccataatttatcaggatttgtga

SEQ ID NO: 102628 - DNA, 588 bp, Glycine max
  Peptide Sequence Number=SeqID_219406
atgggaggtttatgccaagacccatttgaaaaattacagaaacctataactgggaagagcatttcaattatgaaggaatgcgttcttagcaaaaagagggacgaaatcccaccaagaagagaaacaccccaacaaagcgcccaagtgatcacgaaaaataccgccactccccgaatgaccaggacccaatcaacccgcttgatgagggaaggcttaggaggatggacattcacagcaaaggacttcaatagggtgaattccagaatagagtgtcccaagtggcccttagagagcgttccaacaagagaggtattgataatgagagcaagaatgacatggtgggcttggcctctccactttctgtttagaacattaaggaccgaaaatcaagaggagaaatctacagggcagtacaacttctgttgcagccttgaaacaaagtcacagttaagaaagaggacgcttaagcttatcatcagttggcatcttatgagaagaagcctccaaagtaagaaagactttgagggatcagattttttttgcccaatgaacatccccaagaggcttcagatggggaagtcaagttga

SEQ ID NO: 102629 - DNA, 333 bp, Glycine max
  Peptide Sequence Number=SeqID_219407
atggactttgatcttctactttatagaagattacaaaagcttagcataattgaagcagctctcactctagcgggcgtctccttccctgaccctcactccaccgcaaggcccacgacatcactttctcttccctggcttgcgtgcaaccttcttaccccggctaacactacgtcgtatttcccttaccctggtcaaacattgcgcgaggaggtcacttcctcctccttgactcgcatccgttgcccctctctatgcgtcacaccttactcttgcatgtcgtgcctcccaccgtgtcacgcctctttcttacttgagattgtaccaaacaactaa

SEQ ID NO: 102630 - DNA, 1068 bp, Glycine max
  Peptide Sequence Number=SeqID_219408
atggtgaattccgttttggtgcagacttatttcaaccccgatgaacactggcaaggccccgagatcgcgcatcgcatcgcttttggtggaaacaaggtatccgaagctacttgcaccccatcatcttcgttccgctttataggctccttgccttactgcatcttgataccccatggcttatgggctccacggctactgcagtctgtattctctgcagttggtgatttatacttgtacaagcttgctgcggttctctttggtgattctgttgcaaaatggacatggggcttagctgtggcagcggtggcttgtgctatccgaccaacaagtgcaatcacatggctgtatgttggcctgcttgagcttttcaaggcacatgacagattcaaattcatttttttggaggtggctcctattgggtatgtttttggaggctcactctttcaggatcctggtgcttggacttacctgcttattagatcgtttcatgtatggcacatggattctagagattattatggaactcacaagtggcactggtacttcactcagggatttccagtcatgatcttctctcacttaccattttgtatagctggtatcatttattccaaacaatggaagttttctggccttcttgcatgggttttgggtttctacagtttattaggccacaaggaattcaggtttgccttgccagttcttcccatagctctgatgttttctggttattctttggctgtgatagaagatcccggacccgaggatgccatgaaccaccttgctagggaagctcttcatgggaaagtgaaaagcattctattcctaacgccttgccatgccactccctactattcgatgctgcatcataacctgccaatgcaatttctcgattgcacaccaagtgaagagaaaggagttcctgatgagtctgaccgtttcttgatggaccctattccttttgtgtctgaatatgcaaaaaacaagtctctgcccagccacgttgttttatttgattctgaagaacaaaaattgaagaaccttttaatttcacttgattataaagag

SEQ ID NO: 102631 - DNA, 750 bp, Glycine max
  Peptide Sequence Number=SeqID_219409
atgaagtttctgagcctggtggggaattcttttggatgttctgcatctggtgagcgcttagtttctgcagccagagatggggatgttcaagaagccaaggccttattggaatataaccctcgtcttgcaaggtattccactttcggagttcgcaattcccctttgcattattctgcagctcatggccaccatgagatagtgtatctgttacttgagtccggagttgatatcaatctcaggaattatcgcggtcagactgcattgatgcaagcttgtcaacatggtcactgggaggtggttcagaccctgatccataaagctgattacctaaatggaggtactgcccttcacttggctgctttgaatggccatacccggtgcattcggctcatcctcgctgactatatacctagcgtccctaacttttggaatgcattacagacaggtgatcataaatcaatctcagaatttgatcaaagtggtctctgcgaggtgattaacagaactgctgatggaggcatcactgctctgcatatggcagcattaaatgggcatgttgaaagtgtacagttactcttggacttgggagcttctgtgtccgaggttactgtggaggatggaactaccattgacttaattggttctggaagcactccactccattatgctgcatgtggtggaaatcaacaatgttgtcaactgttgattgccaagggtgccaatctgactgctgagaatgcaaatgggtag

SEQ ID NO: 102632 - DNA, 537 bp, Glycine max
  Peptide Sequence Number=SeqID_219410
atgaagaaagtcagaactctagtaaggtttgcaatttctgcgaaaagaggctacccaacggtgacaataaatatctgcacgtggccttatgatcgtctgaaactggaaccagaacaccttgccaagtggttcctcacgtttctgcccacagtgcaaggcactaaggaggggctaacatctgctcccaagcaaaggctggggttcattctgaatgaggggaacccttggcagctaatggagcgaaatgatcttgaaggggaagaatttttggatccacgggaagttggtttgcaaaatggggtggtcatgtcactggaatcccctaatacctcacttgaacatgtgcaaaatgttagggacaagtttgatgtcctttgcatttccttgtgtagtggtcttgcgtctggaagcttcacaaatgagactatgccgtgcctgcagagagggcatgcaattgaacctgggggtcctgttgtggttgttgaagtagagtttgtagaacaaagatacaaggcacattgtgtgcagaactcgtga

SEQ ID NO: 102633 - DNA, 255 bp, Glycine max
  Peptide Sequence Number=SeqID_219411
atgcttccttttgatcttcgggcacgttacggaacttcacgtattgtgcaacaatgggtgccaagtacctcaaagcggtcaagcaaaggttacatgccatcagcaatgcgagcttcactcgctaagctcccaacacttagtgaaatttttgctcagtttagtgccgttaagcgcagcctacccttggctaagtgcaaatccatgcagctaaccttaggtttagcgggctccttgccagctaagacaactttgtag

SEQ ID NO: 102634 - DNA, 303 bp, Glycine max
  Peptide Sequence Number=SeqID_219412
atggatgctgttgctcctgtatcgtttaccgccaatgaaaacgtttcaactcccattgaagttcaacccacagctacatcccacacagcacattccagcgatcatactcggcctcgctggttacagtggataccctaccttgatgagtttctaagcagcatgaaagctttaggctcaacaattctcaagccagctaagaaagctgccctcattaagaaaatcatggatgaaaatccaaaacctatgcaattttcggaagtgaattctcaggatttggaaaaatcgatcgatcgctatcactga

SEQ ID NO: 102635 - DNA, 567 bp, Glycine max
  Peptide Sequence Number=SeqID_219413
atgacagcaattactgaagtaaaacagccgaactttttaatgatgaagagggtatggatggccatcgcacttccgattgtcattttctacttctcaggtattcagggtttggttcagcttgccatcgtatgggttttcgcaagcatcatgcttttgatgtttgcttataaaaaattccgcattaagaagtggaatgccagcactagggatcattttggcgagcaagacgggatgtggagtcatgaatttggttccacttccatgaagctcgaccagcacaagggactgattcatcttaaggaagagaataaacaaaagacctatccattctctgcggtcaaggagtggcgatacaatttgtctactacgagacaaagaacaggtcttgataaggaactggatcgcacccacgatttcagagagtcaggtttttacatcgctgtagacgatgtgcagtatcctgagtggagaattatgttcttcccgcagcagggcgacttcaattcgcaggaaggtatccgcgatactgagcttcagctcaataggtggatgcatgttttcgacaag

SEQ ID NO: 102636 - DNA, 513 bp, Glycine max
  Peptide Sequence Number=SeqID_219414
atgtcgcatttgcctaaaacgttgctgattccattcaggatcaaagcgcgtagcggggcttttctggcacgctgcgtttttatcccgaatggagttgaggatgaaccggatcaagattgttctaccgtttctgcaagacgctttgcgccgcggattcgggtggttaagagcgatgagctatcaacggcgacgctgtgccgtcagtgcgaggatgcgccctgcgcgaacgtctgcccggaaggggcaatacgccatgaaggcgacgtctggcgagtcgatcaacgcctgtgcattggttgtaaaagctgtatggtggcgtgcccttatggggcgatgacggtgatgttgaccgacgaaggcgtgcaggcgctgaagtgcgatctgtgcgcgcactggcaaacggggccggcgtgcgtagcggcctgtccgactcaggcgctgcgctgtattgagcccgccgagctggaaagattaagcgccgagcgccgccgttgggcggcgcaggcaatgtaa

SEQ ID NO: 102637 - DNA, 1563 bp, Glycine max
  Peptide Sequence Number=SeqID_219415
atgggttttaggagtgatgtttttgtgtctccaccagaacagccaccatattttctctcagagcctaccccacctttcccaccaactgttcgatctgatagtttcagtttcaacgatagggccttgaaggttagtccaagcatccttctgatcatcataattctggccattgttttcttcatttctggtttgctgcaccttctggttagattcctgtggagaccccaaactagagagcctgatgaattggacaatgtcactgctctccaaggccaattgcagcaactcttccacctccatgatgctggggttgaccagtccttcattgacaccctccctgtgttcctctacaaggccatcataggactcaagaagtacccctttgactgtgccgtttgtttgtgtgagtttgagcctgaggacaagctcaggttgctgccaaaatgtagccacgcttttcacatggagtgtattgacacctggctcttgtctcactctacttgtcctctttgtagagccaccttgctccctgaattctctgcaagcaacgcatgttctcctattgttcttgtccttgaatctgggagtagtgagagctccagggagattgttcctgaaagagagcctgctgctgctgctgttggaaggactagttcggttatcaccgcaaattctcgccttggttgccgtggagatagtgaatttggatcaacccgtgtggatttgaaatcaggtgagttgtttagtgaaattcctgatccaacagtgcaaaatggtgtggaaaaggttgttactgttaagctggggaagttcagaagtgtggatggtggaggtggaggtggagatggaggtggggaagggactagtagtatcaacaatgtggatgctagaaggtgtttttctatgggttcttttgcttatgttatggatgagagttcttcattgcaagtacctataagaactccaatcaagaagcaatcaagtaagaagaagtctggtttgcctttgacaccagggcacaggcctgcaatgtcagaatgtgactgtgaatccagaagggatttcaagtttgcagggtttgatgcaacaactatagttgaggatgatgctgctagtactggggctacaactgcaagcacaacttgtaatgggaacagtgctgctgccatcggaaggagcagaaaggagagtttttctatatcaaagatttggcttagggggaagaaggataagccaaatgctggggcagattcatctagaagggctgtttcgtttcgattcccggtgaaatctagtgttgttgctgctgcttctggtagtgctgatgatgatgatttgaagggcaagaattgcaagtttgatacaaggagtactatgtctgagatggatattggaaagtgggagaatggaagagggactgagttcgattatgatgaagaaaaccagagttgttatagtatggattcttctcaagctagggcgccatcttttgctagaaggactttgctttggctcacaggaggaagacagaataaggttgttcactctgcttccaacctctag

SEQ ID NO: 102638 - DNA, 150 bp, Glycine max
  Peptide Sequence Number=SeqID_219416
atgtcacccattacccatttctcttcttcaaatgcatttcgttatagtgcgttgactgttatgcagcagggaagctggggtaaggctccttatagaagtcaactagcaggactagcgttcactgttgcagatttttggttcacaggttag

SEQ ID NO: 102639 - DNA, 189 bp, Glycine max
  Peptide Sequence Number=SeqID_219417
atggtagcttcttcaggaaaggaaggttcaaaagatgatgtggtcatggttgatcctgtggaagccaagcgattggctgccatacaaatggaaagaattaaagcaaaagagaaattcaagagaagacatcaaattgaggcaattaacggagcatgggcaatatacatatatggtgtcactcaacattaa

SEQ ID NO: 102640 - DNA, 1479 bp, Glycine max
  Peptide Sequence Number=SeqID_219418
atggttcctcagtcgaatactgaagacagagtcacagagtttgaaccgagctccgtttgcttagacaaaaaggtgcagagcttcatggaagagtcgctgaactcggtttttggtcaagggagggttgcagaaaatcaaaccatgaaggtagaagctcatggtgaagatggttccaaattcgcattgggaagcaatgaaaaaccagtgtttggacgaggttgcggattcggcaaccacgactgcacagtgtcttgttgccacgtgcccttcgaactcgaccattcagactcagaggatgctaatgttgtttcatttgaagtcatgaaggagaaccccttttgggtgtacgacagagaagcgcttcggctctttagaaagttcgacaaaggtcacttgcaattcagacacattttattgggtaatgttgatgtcttaatggccgcacacttgggtgttatttttatgccacaaggtctggggcatttccttggtattgacacattttaccctggaggctacttaaagggcttggaaagaagaaaggaaataattgatcaccaatctgcctggaggagagttgtttgccttgctatcaattccggtattagcactccaggttatttcagggataggattttgttcctgactgtattgcagtcaccgaatatggagcaactaaggacggatatttggggctcaaactctaattgttttgatgatgtgtggacactctccgtggtggatcagcttatgtgtagaataccaggttgcaagtttcttgtggtgtcaaggcctaaattccaaacggtgttgagttatgaaatggaattgctgattgaagaggatgccctgtctttgttctgtcaccatgcttttggacagaaatcaattcctttagctgctaatgagaattcggtcaagcaggttgtgactgaatgtggaaggcttcccttggctcttaaggtgattggagcttctttgcgagatcaaactgagatgttttggttgagtgttaaaaataggctatctcagggacaaagtattggggaatcccatgaaatcaatctgattgacagaatggcaattagtatcaattaccttccagagaagatcaaggagtgctacttagacctgtgctgttttcctaaggataagaaaatccctctggatgttctcatcaatatgtgggtggaaatccatggtattcctgaaacagaagcttatgccattatctcagttactcaacatgatgaactgagagacctggcccttaatttgagaaaccatgagagcattgatgaacgccgactattagttatgccaaaaaaagagaatggaatgcctaaagagtggttgagatacaggcagaagccatttgaggctcagattgtttcaattcacacaggtgaaatgaaggaaatggactggtgtaatttggaatttccaaaggctgaagtgttgaccataactacaccttga

SEQ ID NO: 102641 - DNA, 576 bp, Glycine max
  Peptide Sequence Number=SeqID_219419
atgatggtggcccgtgtgatgttaaggcatggctatgagcccggaatgggcttgggaaagaataatgacagcatggccaacttagtggacatcaaggaaaaccgcggaaagtttaggctaggctataagcccacacggacggatgtgagaagaagcatcgtagaaaggaggagtaggggcgcgggcccgcaactaaggccacaagcgagggaggtccctccttgcgatatcagtaaaagcttcatgagtgtgggcttgagacatgaagagcaagtcactgtgatatacgacgaggtccctcaagaactttcagactggtgcggccatgccttcctgattttcaattgggaaactggaaagtcatggaacgacccaaagtttccatggtgggcacaatgtaatgctttagttttaaccctacagctgggcctaggctttagggttctctccttgttaagatccgttgaagagtcctatgcaggtactaatatcgaggaccctgtcgtcgattttgaacgagaagcgaataggcttgagtttgaagaagacaaaggtatggaattccccctaagctag

SEQ ID NO: 102642 - DNA, 117 bp, Glycine max
  Peptide Sequence Number=SeqID_219420
atggggagagttaacctagggttaaatgtgagaatggtagtgatgacttgtgggaaggcttgggctgagcaaatgagaaaaatgagtgacaaaggtgaaagcatgagccatttctag

SEQ ID NO: 102643 - DNA, 591 bp, Glycine max
  Peptide Sequence Number=SeqID_219421
atgcaagggttgcaacgggcggtgttgaggggctcccatagcattgggctaaggcatgccactaaacgctggtccctcaacagcatatatagggtatggtttgaattcacccagagtgtgatctcggggctcctcacgggcctcccccataggttaagcaaagggtgcatgccccaactagggttgctggccttcaaggagaacgagaagggagtggttcgcgttcgcgttctcgttaggcacgtgcactgcattgggtggtgtatagttaggtggcaagccgtacggcgggaaagaattcttactttgcaccatatggggaccgcccgtgctacccaacacttcccctacctaacctaccccgtttgggactggacgacttgcttggtttatgccggatgggtgggttggatccgcctcagcaatggcattggtggtggcaactgcggccgcattttcctccatcatccgtcttatactcaacatggcctccataatggaggtcatttggtccttcatggcctccatgggttccgcaaagcgcgttcgctcttcttgggtattgtgtttacttttgactacgactgctaa

SEQ ID NO: 102644 - DNA, 289 bp, Glycine max
  Peptide Sequence Number=SeqID_219422
tcctacagggtgcccattccccccagcaagttcatattgttctgacatagggatcgtgcccgcaagacacccagtggacccggagaagtccaacagggtcctggggtttccggctcttattacgagcctctgtcagttttacggagtgcctatcacccccaacaaggcaatagacgcaccgccaccacctctagagttcacctcagctcatccacaaaaagtccgtgaccgacaagtcatcaggcgtccagctcaagatgttaaagaagctctactaggaggcaaccta

SEQ ID NO: 102645 - DNA, 144 bp, Glycine max
  Peptide Sequence Number=SeqID_219423
atggctcaaaattccacagcacaccatagtgcctatttcgggaaaaaagctctggaggcagcaagaggagaaacttttgcagagatacctaggtttttgttcaatgcttcttcaatgcttaatgtttttatgcttttggtctga

SEQ ID NO: 102646 - DNA, 510 bp, Glycine max
  Peptide Sequence Number=SeqID_219424
atgttggactgggtccttgttgcaaatgaggttgttaaggagatgaagagggaaaaaaaggaggtcatttttaaggtggatttcgaggatgcttatgactctattgattggaatttccttttgttacatgatgaggcggatggggaattttctatgcataaaggccttaggcaaggtgaccctcttgcaactttcttgtttctcttggtggcgaaaagaatatcagggttgatgaggcaagcttccaaatctaaaaatttccaagggttggttgttgggaaggataaggtggaggtgtctgtgcttcaatttgcggatgacattcttttctttggggaagtgtctccaaataatgttatgtgtattaaagccatcttggtgtgcttcgaactagctttcgggttgaagccttattgggaaaatggaggtggaaaatttatttcaatcaagattgcttgggatataagggacttggtcaaggtttgtggggaggttgatggggagggttga

SEQ ID NO: 102647 - DNA, 312 bp, Glycine max
  Peptide Sequence Number=SeqID_219425
atggatcgggaggataggcttattgggaaatatcagcctccaatggctcatacttggttaaggaagttgtgtgaacaatgggtttcccattatgatccaaagcaaaattttctgcaacataattgccactggttgggaataagggtgacaaaagcttggaaggtagtgtggagcaccattgtttggtcattgtggcacttgtgtaaaagcgtgatcttcgatgacaagctcttggactttgatggggttgtggaggatatcagatttagggcttgggcatggatcaaggcaaagtggattcttgtattatga

SEQ ID NO: 102648 - DNA, 240 bp, Glycine max
  Peptide Sequence Number=SeqID_219426
atgaaaatcaaattcgaaaacagttctgggaggggggagctgtttcaaaatgttcaagacccctttggctatgcatttcggctattttgggcaaaaaacacgttttcgcgaagaaaaatcaagtcgaagtacttccgtaacgcttccgtaagcgattctgtggaaattcttcatcgttcttcgtcgttcttcaccgttcttcatccgttcttcgttcgttcttcgttcttcaacgggtaa

SEQ ID NO: 102649 - DNA, 414 bp, Glycine max
  Peptide Sequence Number=SeqID_219427
tggttgaaggctcgaatgcaagggataacttggctcccaaagaaaaaaagtccaagtggggaagaagctgaagtccccgaggaaagcgaaaaagtgcaagccttgaaagcagagcttgaaagaatgagagtggtcaaggaaaagctaaagacatcagtcaccacgattaggaaagagtgtgacaagctaggggatgtcaacatgactacggccgaagccaacaacgagctcaagcttcaaagggctgaaagggacaagtcaagggtggaaagtatgatattaaaggataaattgaaggcttgtcaaaggtcgaagagaagtttgaccgaacagctaagtagaatagaagaaaatatgttgacagtcattggccagtataaagagaagctagacctagctgctagccatggatag

SEQ ID NO: 102650 - DNA, 336 bp, Glycine max
  Peptide Sequence Number=SeqID_219428
atgggggagacacataaagtaccctaccacaatctagccaacttcgagccttgcctcggatacgccactgaggggcaagcagctggtgggagagtccctcctgctatggtggaaaaagggaaattggatcatatagaagaaaggttgaaggccattgaaggaggcatagatcatgcttttgctgacatggcagagttgtgcctagtgcctgacgtcgtcatccctccgaagttcaaggtgccaaatttcgataaatgcaaggggactacttgccccaataatcacctgaagatgtactgtaggaaaatgggaggatatgcaaaagatgaaaattga

SEQ ID NO: 102651 - DNA, 582 bp, Glycine max
  Peptide Sequence Number=SeqID_219429
atgggaatctgccatggaaaacccattgaaacccaacaaagtcaaagagagaccaacaccccatcagaattcccaagtgaactccaaactcccacaaaaacccccaaatcctcatcaaaattcccattctacagcccaagcccccttcccagctggttcaaaaactccccttcctcaaactcaaaccctagcagcgtcagctcaacacccttgcggatcttcaagcgccccttccctccgccctctccggccaagcacattcgcgcgctgctcgcccgccgccacggttccgtcaagccgaacgaagcctccataccggaggccagcgagtgtgagctcggcctcgacaagagctttggctttgctaagcagttttcggctcattatgagctcagtgacgaagtcggccgggggcattttgggtatacctgctccgctaaaggcaagaaaggggcgttcaagggcttaaatgttgctgtcaaagtcattcctaaagccaaggttccattgctggcttggcttgaaaatggagtcgcaattgaaagtacacctcgagtcatgattggaggaggtatcatttag

SEQ ID NO: 102652 - DNA, 1653 bp, Glycine max
  Peptide Sequence Number=SeqID_219430
atggtaaagaaagaaataactgatatgctgtgcctacaagagaccaaggtggagcaaatggacaaatctatttgccaagcactgtggggtgatttggagaggaagacaagggatcatgactttatttatttagaaggcatgtgggttcctgatgggcaaaagatgtccatagtcaacatatattctccatgcgatgtggctcagaagaggaatttgtgggagcaaatcaggcagttgagaaattcaagctttggaggtaatgtggaggaattcagtgattggattgctgagcttgattttgaagatgtgccttgtgtgggcagaaaattcacgtggtacaagccaaatgggacggcaaaaagtacggttctgaattgctggtttcaagataaatcattcaaaaaggttgtacaagaatgctgggcagcagatcacataaggggttggggtggatttgtgcttaaagaaaaactaaaggcaatcaaggcaaggttgaaagtttggaataaggaacaattcggtgatatgcagaagaagatacaacgtattgagagggagctaaacaagttggaaagtgaaggtgatgaaagactgctatcggatgatgagttgttgactcggaaaaaactgcagttatggataactgctcaatcacatgaatctttactaaggcagaaggcaaggggcatgcttgttgatggtgcttggattgctgaacctggaatggtgaaagaggggatacgcttgttcttcaaaaacagatttgaggagttctttgccaatggagtgttcctaaaagggagcaatgcttcatttctagcactcattcctaaggtgcatgatccacaaaaccgtaatgattttaggcttatctccttagtagggtgcatatacaaaattgtggccaaggtactagcaaggaggatgaaggagttcatgaagcaaagaggtgaaacaaaccgtgcttggtgtttaaagttcatttcgaaaaggcctatgattcaattttctaggatttcagagaggtggaaggaggatgccgctatgtttctaaattgcagtctactagctataccttttctctacttgggtatcccgattgggacaaacccaaggcgttctgagaggaagtttgcttgggtaaaatgggactcagtgtgcctaccaaaggagaaaggaggggataaagtggaatcttgggtgtggagcatgggtgcgattctggaggatgggtggaaggatgatggtgtaccacttatgttgaaatacttcagactgcaaccactttttgatgctgagattgatttggcatccaagttcttggaagaagtggatggtatcatcatttatcttgatcgtgtagacaactggacttggaagggagattcaagtggtgtatacactgtggggaatgcgtatacgatgcttatgggcgactatacagatgaaaatcaggatggagcttttagtgtgctgtggaaatctgccattatggtgggaagctttgtcttggataaacatattggtagcattttcccaatgtccgagataacatttcctttcgcatgcgcatggaaagacatttggtgtttggttccagcgatgacaatgctggtggatatccttgacatggaatatttggcagcattgtaa

SEQ ID NO: 102653 - DNA, 1239 bp, Glycine max
  Peptide Sequence Number=SeqID_219431
atgagtgaaaaggagctatggtatgagtttaagaaatggggggatgtgcgtagggtgttcattgcaagaactaggaacaggattggcaagagatatggcttcgtgagattcaagggggtgggcgatgtgaggagacttgaaagacaattggataacctgatagtaagggggttgaaactacacgttaacataccaaagcacggaagagtgaggatgttaaggggagaaacaaacgcaaatgtcaagtacaggattggggcaacaaagcatggggtaaagtccgaacttaatgcgtgcgagcccaatgggaacaagctcttactcgtcagtgcatctgaacatacttgcagagaaatggacatgactcagagaagtggtgcgttgatcaacggggaggaatacacagtatacatggtcgaagaaacctgctacaaccccgacagatgcaaatggtggacaggaagctcgataggagtgtcaattgaactaagctccgatgacagcaaagtcgggaccccatggttggatgacgaagtcatattggaaaatgaatcactagcggcgcttagcgtaatgttggctgacggcgatgagcaggtgaggggtgaggatgcgagacagcaaaccagcggtcaaaactcctgccatggaccactgggtaataaccttaggttactgacacgaagtcagaacctagttgcattggaaggtacaagcggaccaaccgtagcagacaaaagcaaaattggggaggtcacaaggggacaaagtgaggctgatggagcggaagcgggagtcaatcgaagcttcacccaacaaagaaggtttggggaaaagtacacagaaggggtgacaattactactatatcgaaggagaaagaagacaaaaatgggaaaaattggaagcagtcagatgcagtgaacggggtgaagaacaacaacgaaagtgggcctttaatgggccatactaaaaacaccaacactggtataaatgaaggggctgatggtaatatggaagtgacagaatgggaagaacaagataagggacaacatgaaccatgtgctctaccagatagcaaatataatgaaacctgtaatcagataaaagaagtaacatcatattgggtcatggctcaggatttgggagtaacatgtggggaaagagaggaatcattgatcactacgatgattaatctggaggaaagggataagatcgaggctgataagatggggaaatag

SEQ ID NO: 102654 - DNA, 2638 bp, Glycine max
  Peptide Sequence Number=SeqID_219432
tcgtgttgccaattttacgactgatgaggttgagaccatgctcttggagcatgaatatcgcattgacagggccaaaaagcgttccctagtttcagttaatctcagtgaaggaaattttagggctaatgattcctctcaaccttcaaattccaattcgcaaggctgttttgctgatgttcaatgccaggtgtgtcacaaatgggagcatgattccagtgcatctcaccatgtcaccaatatgttccaaaacattcagcagttaactccttttgaaggtcctgaccagattactattggttatgctcaaggacttaacatcaattcctcaagtaacgctaaggaaatacttcttcaagggttggtgggacatgatggtctctaccaatttcctgccttacaatctttggtgcctcggacttctcagtctcttagcacttctgattctgttgttcccattgtagatacagcttcctacccttcacctagtttctcaatgacctggcaattctgcacgaattactatgccccgcacccatcaccaaaatggggtagtggaaaggaagcatcgacatatagtggaacttggtctaccttattctctcaagctaacatgcctcttaattattgtgatcatgccttcacttcaagtgactatcttatcaaccagcttccctcttcttccatcaaccatgagtttaacctggcaatgtacactcaatgtgtactcgtgccaaatctggcattgttaaaccaagaatcaatccaaaatgatttctcacccatcctgaacccaaccaaatctgctctttcaaatccagcatggtttgctgctgtgaaggctgaggttaaggaaaatcctgatgggacagtcaataaatacaaagccaggcttgttgccaagggcttccaccagcagcttgggtatgactacaatgaaaccttttcccctgtcattaaacttgtcacagtcaggttaattctctctcttgccctcacatataaatggcctctacaacagctggatgatgtcaacaatgctttcctcaatggaactcttcaagaggaagtattcatgactcagcctccaggctttgactcctccaacaaacagcttgtgttgaacaaagccctttatggcttaaaacaggctcccagagcttggtttgacaaacttaaagccactcttttccagtttaaattctcctccagctggtgtgatccctctctgtttgtctattctgagcaaaattctgttgtttacatcctagtctatgttgatgatatcatcatcactggaaacaattccaatcttattcagtcacttaattttcttttcacttctaaggatgacaagtccacgctgaaggccattgattttgggttgtctgactatgtaaagccagatgagaggttgaatgatattgtgggaagtgcttattatgtagctccagaagttttgcatagatcttatgggacagaggcagatatgtggagcattggtgtaattgcttatattcttttatgcggaagccgtcccttttgggcccggacagaatctggtatatttcgggctgtactgaaggcagatccaagttttgatgaggctccttggccttctttatcggttgatgccaaagattttgtaaagaggttgttgaataaggattatcgtaaaagattgactgcggctcaggcactaagtcatccatggctggtgaatcatcatgatgatatgaggatacctttggatatgataatccacaagcttgttaaagcttacatttgctcgtcttcgttgcgcaaatctgctttacggggcagaaaaatcaggcaggggacccgtgaaagcgttagtgtaacagaacatcggtcaagtaagccatgctatgcaaaaacatcaacagtgccgctgaacctgtctttgcttctctgttcattcaatcacaaagacttaatcctcatgacagagaagcttaagggtaaagttcccttgaggttgttgaaggccaagtgcaaaacgtgcaagccagagataatattgaagaaatccgggagggagggagcctatgatgatttgcaagttttgagcttgagtcttaacaaactcactggtccagttccagcttctttgttgggtcttttgtggctcaaagttgtgaatttgaccagtaacttgtttcacgggccaatgtctgtgtttgctcattgggtcgaggtggataatgcccctggttgcaataatttttgcttgcctagtctcggtgattgtgatcccagaatggagcttctgctttccgtggctcttgcaaagacattaacagtagctcagctagcttatctcagagatcaatttactctgttagggccaaacaaaagtggattaatttctatgcagaactttaagacggctgttttgaggagctctacagatgcctcaaaggattcacgggtcttagattatgtcagtatggttagttctatccaatataggaaattagattttgaggagttttgtgctgctgctataagtgtgcaccaactcgagggaatggagacctgggagcaacatgcaaggcatgcctatgagctttttaaaaaggaaggaaatagaccaattatgattgaagaacttgcctcg

SEQ ID NO: 102655 - DNA, 189 bp, Glycine max
  Peptide Sequence Number=SeqID_219433
atggggcgatatgctagactcaaagtgaagattgagaggcattatgaagtgactttcctactgaagtgtaagacatgctatcaacatggactctgcatgaagaaaggacgtgcatttaatgcaagcattaattgctccaacgacctcaagactttagacgaagaacagagtaaagaatccatccactaa

SEQ ID NO: 102656 - DNA, 258 bp, Glycine max
  Peptide Sequence Number=SeqID_219434
atgtgggagatctttattcttaacacacccctcgtgcctaagacaatatcaagaatgtcaagtttgcaggtgttcatataccacaaggcttttcccatgccagcattatctttcaaattttacagtagtgaccctctttctggtaatgaagaggatgattctgcacagttcatcacttctgtttgttggcgcggtcagtcgtccaccttagttgctgcaaattccacaggaaatgtcaaaattctggagatgacttaa

SEQ ID NO: 102657 - DNA, 643 bp, Glycine max
  Peptide Sequence Number=SeqID_219435
atggagtacaagttgagaatgtccaaagacaaagccgtcaacatttcttgcaatatggtcaagttcggtcgcagtttaggctgcaatgatgtcaagtttagtgctcaagatactagaatgttggatagggagtttctttatgaaattcttggagaagttattaaggtcggggccaccatgctcaacatacctgacactgttggtgtgcgtgctggtgcaaggcaattggaagtgacaattaatgggcttggtgaaagggctggaaatgcctccctagaagagcctttcttcttctcatttcttcctcgagcctcttcgtttctttctttcgctggtggccctttcttcctccttcctcattcttctgcgagcccctttgcttctccaacgcaaggtggttgttcttcttccgtgcaagctgttgcatctccctccttcaagtgcgcttcttcttccattctcccgcgaggtgttgctcttttgttcttcatcgagatgatccgtaggttgtgtttatgttgtgttctaggtgatccgcaaatagggcagatgatccgtaggttgtgtttatgttgtgttgaacttgcggatcacgttgatccgcaagaagaaaatgttgatccacgtgcttcatacggatcaa

SEQ ID NO: 102658 - DNA, 399 bp, Glycine max
  Peptide Sequence Number=SeqID_219436
atgaaggcattgaactcttggatcagcccattgattgttccagaattggcaatttggtatagattcccacaactctatacactctgttatccaatccctgccaatccaattataaaatttacttcgaaggaagtcatttttggaagtaaaaatagagccattacttataaccaaggtttttcaaaaaaggtcgaggacagagatgaatttgagggtggagtagacggaatcgacatcgttggagtagaaggaggagttgacggcggcgatgatgcaggtgaagaaggtctcgttgagtttcctcatgttctcgatggtgcgaggaaccttcttcttcagaggcaacagaaaaacatgaagaatcgtcaccgatatgtagccaatagccttcttctctag

SEQ ID NO: 102659 - DNA, 2136 bp, Glycine max
  Peptide Sequence Number=SeqID_219437
atgggtgatattagcttgaggctatggttggataaacctgaacgatcagtgaatgtctttgaatgcttgcacatattcagggaaatagtagaaattgttcatgcggctcattctcaaggaattgttgttcataatgtgaggccctcctgctttgtcatgtcagctttcaaccatgtctggcttatcgagtcagcaacttgttcacattctggatcagatacattagaagaggctgttgagatcaaaactccaacacctacctctatccatgatatgcatcagcggagatgtttaggaagtgaagattttgtgcctgtcaagacttcaacagcttctttgacagactccagttgcatgttgtcaagtgtggtgtttctggcacctgcatcatcagttgatgacacagaagaaaataaaatgaaaaacaggagaaaggatgaggaagttgcaggaaagaagcaatcatttccaacaaaacaggtactgcagatggagacaagttggtatactagtcctgaagaggttgctggtacttctttgccttcctgtgcttcagacgtttaccagttgggagttcttctttttgagctattttgtccactcatctcaagagaagaaaagagaagaaccatgtccagcctaagacatagagttcttcctccacagttacttttaaagtggcctaaagaagcttcattttgcttgtggttattacatcctgagcctaatagtcgtccaacaataggggagttgttgcagagtgagtttcttaatgaaccaagagatgatatagaaaagtgtgaagcagtggtagaaattggagaaaggatagatgaccaggagttgttgctagaattcctttcgttaattcaacagaaaaaaggggaagctgctgagaagttacaacatactatctcatttttgtgttcagatattgaagaagcgactaagcagaaaactgtatttaaagagatgacaagcactgaactagggagtgatgattgttcaacatcaagtttcccatccattactgttgttgggaatgaggattctgcttgtctagggaccagaaaacgggtcagaactattccgtgtgttgatgacactgacactgaaggatgtgaatgtgatagtaacatggttgatgatcagaaaaatgacacgagtattctttcaaaaactccacggtttttgaataatttaaagaaactagagtcagcatactttttgacacgatgcaaatctgcctattcctcacggaaacttgtggttcaagattcacctattgatattactgatgaaaaagggtctgttgttgtggctgaaaggaattgtgccaataaagtagaattaaaagaaatgtccagggagggcaaaagtctttggacaaatcctttccttgagggtttgtgcaagtacctatcgttcagtaagttgaaggttaaggctgatcttaaacaaggggatcttttgcagtcttccaacctggtatgctcactcagctttgatcgcgatgcagaattttttgctactgcgggagtaaataagaagattaaagtttttgaatgtaacacaaccataaatgagtatcgtgatatccactatccagtagtggagatggttagccggtcaacattgagtagtacatgttggaatacttacatcaagagtcaaattgcttcgagtaactttgaaggtgttgtacagttatgggatgtgacaagaagtcaagtgcagtctgaaatgaaggagcatgaacgaaggggagttagtgttggtaccatcaaaacaaaggcaaatgtgtgttgtgttcagtttccccttgattttgctcatttccttgcatttggttcagcagatcaccagatatattactatgatcttcgcaacctgaaagtgcctctttgtgcaatggttggacatgataagacagtgagctacatcaagtttgtagacaccatgagcctagtctctgcatccacagataacacattgaagctttgggatttgtccatgtgtgcttctcgagttatagactcaccaattcaatcattcactggtcataagaatgttaaggaatatagattatggcactttgttggtatgttgaccaaaacattgtttagaatgacataa

SEQ ID NO: 102660 - DNA, 162 bp, Glycine max
  Peptide Sequence Number=SeqID_219438
atggactatgcgggtttgacccacgggttacccgcaacccgcattagatttgatttgtgtgaccttgatccaattatattaggaaaaggagatgaagatgtggagatggagaaggctcaagctacttcaaatatggaatcacttgttgttggagatgtttaa

SEQ ID NO: 102661 - DNA, 243 bp, Glycine max
  Peptide Sequence Number=SeqID_219439
atggatcacagaaaggaaaaagaaaacaatgcatacaagtggaagatttttgtcaattatggcgctgatagctccaaaatatggaaaaacaacattggccctcaaaaaagatcaaaattttctcatttggttccaaatgttcaccagatatatggagagagaaagagggagagaggtattgtgaccatagaagtatgttctgtttctactagaccaagctataccaaactctctggtttctag

SEQ ID NO: 102662 - DNA, 807 bp, Glycine max
  Peptide Sequence Number=SeqID_219440
atgactagcactgaactagggagtgatgattgttcaacatcaagtttcccatccattactgttattgagaatgaggattctgcttgtctagggaccagaaaacgagttagaacaattccctgtgttgatgacactgaaggatgtgaacgtgatagtaacatgggtgatgatcagaaaaatgacatgagtattctttcaaaaactccacggaaacttgtggttcaagattcatctattgatactactgatgaaagagggtctgttgttgcggctgaaaggagttgtgccaaaaaagtagcattaaaagagaagaagttcagggaggacaaaagtccttggacaaatcctttccttgatggtttgtgcaagtacctatctttcagtaagtttaaggttaaggctgatcttaaacaaggggatcttttgcagtcttccaacctggtatgcttactcagctttgatcgcgatgcagaattttttgctactgcaggagtaaataagaagattaaagtttttgaatgtaacacaaccatatatgaggatcgtgatatccactatccagtagtggagatggttagccaatcaacattgagtagtacatgttggaatacttatttcaagagtcaaattgcttcaagtaactttgaaggtgttgtagagggagttagtgttggtaccatcaaaacaaagtcaaatgtgtgttgtgttcagtttccccttgattttgctcatttccttgcatttcgttcagcagatcatcagatatattactatgatcttcgcaatctgaaagtgcctcttgtataa

SEQ ID NO: 102663 - DNA, 750 bp, Glycine max
  Peptide Sequence Number=SeqID_219441
atggagggtaccgttttcctttcaataaacgttggtggcgacttcgcacattttcctcctttggaagacgcacccgtgagcctcacctcgctcacccgcaaaaggcttagatggaaatttgattatgtcgtttctttgtgtcacaatgatttcacggagattttggatgcgtatgagaggggagataggttctacttgtacaccaaacgcggaccttcctccgaagccttgcatttgggacacttgattcccttcatgttcactaaatttgggaaaacacagcttgctcacactctctgtgtttccactcaggtcatcagcggtcacttgggatgggtgagatctgttgcagttgatcccagtaacattagttggttattttgctcgagttgttcctttggacagttatgggacttggcaagtggagtattgaaactcacattaatagtccacattgaacaagttagaggtcttgctgttagcaacagacatacttacatgttctctgctggtgaccataaacaaaatccccaagttgttacgggttctcatgacactaccatcaagatttgggaccttagatatggtaatttatggctttatttttcctatcttcttgcttgcctatgtagtgattatatgcataacctgacacatgttgcattcattttcattcaggcagcaactcgttacctctccgataagatcacaactcaaatcgattccaacaaagtcttctacaaatattag

SEQ ID NO: 102664 - DNA, 390 bp, Glycine max
  Peptide Sequence Number=SeqID_219442
atggaagcaaacacaacacacataataccaccaccagtttttgatggtgaggagtacgacctatgggctgcaaggatgactactcatcttaaagcactagatctttgggaactgatagaagaagactatgcagtttggccactgcctgaaaatcctacgagcatgaaggagacagcaactatcaaaagttatgttgacaaaccattgagcattgcaaacaaggtacgtctcctcggtaagaattttcctgacaaaaggatagtgcaaaaaataattgttactagactccgagagaaatgcacttcttattgcagtgaaaaacatcgacaccaaacagctcttctagtcctagactcgagagaaatgctcaaaaaggtgcccagcaattaa

SEQ ID NO: 102665 - DNA, 714 bp, Glycine max
  Peptide Sequence Number=SeqID_219443
atggtccttcgccttgtagaaatgaacaaagacctcgtccgagtcaaagggagggaaggcttcactccgctgcatttggcaagtcaagaaaataaaactgaggttttggataagttcctcaaggcttgtccagattccgttgaagatgtgactgctagaagtgagactgcactacatattgcagtgaaacatggacactatgagacacttcaagtcctatttcggtggctcatgagaaattcccgaaaagattctcataagttcataagaacaatgttggactggaaggatcaaaaaggcaataccgttttgcacgttgcagcactcaacgatcacatagaggcagtgtcattattgttaactatggttgatttagatgccaagaatttagaaggcaaaacagcatcagacattgcaagcagcgagcatatgaggagcatattaatcagggaccctgggtttagatggcatatgacagaggaggaaagcaacacatatttggtagttgttgctcttattgcgaccgccatttatcaagtagccctgagtccccctggtggattatatccatctaatggtctggaagaacaaaactgccttccaggttcgtgtgagtgccacttcacgttcgatttgcaatggctggaggttgaagacgaagatgtgcgtgttttgtttactgtcttggaattgctaatctacattgtaaactaa

SEQ ID NO: 102666 - DNA, 267 bp, Glycine max
  Peptide Sequence Number=SeqID_219444
atggctagtttactctatgatgtccacgactttgatctctacaaaatccctagcgattcagatatgaaattgctcctcctccaaatgacgtccagttgggctgttaaatcaattatcactgccttgcaagcgaacgggtctccatacgttaaggatttgctgaaactatacgatttgggggcaagcttttcttgtttattggatgcaacattggatttagaactcatggaaactgttggtaatttgtacggtactgcaaatctttag

SEQ ID NO: 102667 - DNA, 387 bp, Glycine max
  Peptide Sequence Number=SeqID_219445
atgaagggaatcaagtgtcccaaatgcaaggcttcggaggaagattacaggctaaagatatataagctaaagatatggctaaagataaatctaatagatataacaactataaaactgaagataagtctaatagctaaagatataattaaagataaatctaatagatataacaactatataaaatcaaaatatattatcatatcttctaacacattgtcgcaacctacccttttgcgggtgagcgaggcgaggctcacgggtgcgtcttccaacggaggaaaatgcgcagagtcgccaccaacgtttattgaaaggaaaacgttagaaaaaccaaaggaaaccggtcatcaagaatattccagattcgggagttatctttatgtttga

SEQ ID NO: 102668 - DNA, 243 bp, Glycine max
  Peptide Sequence Number=SeqID_219446
atggagaggaagaagactcaatatttcatacttcatccttttggatatgagtcttttatccttagtatcaaagatcagggagttgctacgtgcacccagcattattgctggggcacccagcaaacagtgaagtggcgaaactgcccttcagcaattattcttccggaagaaggttcttccggaaaagttccggaaataatttttccggaaagtttccggaagaatcttcttccggaagattaa

SEQ ID NO: 102669 - DNA, 267 bp, Glycine max
  Peptide Sequence Number=SeqID_219447
atgggtttgagaaaagttaagagtgagatggttaaaacttcaagaaagcttagaattgaaatggttagtggttgctgccaaattttgacagcagataggctgtcttgcggaagttcatatgttaagaaacctcttattggagaattgaagggaacacagagagattccgtcatgatcaagtatccggcttggattggtcatcactatccaccaccacctgcgacaagttcacccccattggcattgcttgccactatctgccgctga

SEQ ID NO: 102670 - DNA, 324 bp, Glycine max
  Peptide Sequence Number=SeqID_219448
atgatgcggcaatcaaaggttaatgacccgacaagcaatctgccggtcattacagaccatacagtgagcaccatgactcgaataatcaaacttccagtcatcaacaacagtgccctcaaaaggaacaccttgaatggagtagatgatcatggagatgacaaggaaggagcaactggtgttgtgggtgcttcagatggtccgtggcgtcgatggccagcagtggtggtggtggtggaagagcccttttgctttttcatcgattcagccattggaggaagtttttgcagatttcaatcaatggaatcaaaagaggatagaaaatga

SEQ ID NO: 102671 - DNA, 826 bp, Glycine max
  Peptide Sequence Number=SeqID_219449
atgacattcaaagggccaaggaaggccatgggtaagagatctgaggctccccttacttcaacagcaccagatacttctgctccttctttaccagatccttctacagctccttccattactgttccatcttcttctactgcagctcccttatcagctccatcagttccagctcctcttataggaccttcctcattcacctctgagacattatttgctatgctacagagcctgcacagaggccagatcatcatcatacataggttgcagagctctagccaacaaccatctatgagtatggaggagttccttacacaggtggcttggccaggagtccagccttctccttctagagggggtgaggcctccgcagcccatgagtttgtgccagatgtagaggatgagcctgttcctcctaagccatttatctttgagacaaatccagtcactcaggaggaagcaacagctcatgatcctatttctccaattcatatctctccagcacccatttcagaggacaccggccatggagccagggcagcccatttttcaggattgtttgtgaatgacttgaatgagcaaatgtatgaattgaatggattggaatgtttagattttgctctaatcaagcttgcagccattagaagagaagagaaagaacatgtgattagatgtatgactgaaaatgctagtcagtttgtcagattgattgtgaaggaatgcattgaccgtatcccagtgagcgtgatgatgaaggccatgtttgattgtgatagccacttagccaaaaagctgaccacgtgcttgaatgatttatcccttgcaccca

SEQ ID NO: 102672 - DNA, 1103 bp, Glycine max
  Peptide Sequence Number=SeqID_219450
atgggaaaaggttggtttttgagattggttatggtgattggtgtgatgggttggtgttggtggtgtgtggaagggcttggagtgaattgggggactcaagccacacaccagttgaaggcagacacagtggttgagatgctgaaggacaatgggatccaaaaggtgaaactgtttgatgcagatgagtctagcatgagtgctctatctggctctggcattgaagtcatggttgccattcccaataaccagcttgctgagatgaatgactatgatcgtgccttgcagtgggtcaagaagaatgtcactcgttacaacttcaggggtggaattaacatcaagtatgtagcagttgggaacgagccatttttaaaatcctacaatggttcattcttgaacatcaccctccctgcattacagaacattcaaaatgccctcaatgacgcaggcctaggggactccataaaggccacagtgcccttaaatgctgatgtgtatgagtctccaccaaacaaccctgtgccgtcagcaggaatatttaggccagatataagtgacctaatgacccaaatagtgcaatttttggcaaagaacaatgcaccattcacagtaaacatttaccctttcttgagcctctatgggaatgataatttcccctttgactatgccttctttgatggtgtggccaatcccataaatgataatggggtttcatacacaaatgtttttgatgcaaattttgataccttggtctctgccctcgaaaaagtaggatatgggaacatgccaattttggtaggagaggtggggtggcccacagatggtgacaaaaatgctaatgtaggcaatgcatttaggttctataatgggcttttaccgaggcttgcaataaacaaagggaccccacttaggcctggatttattgaagtttacctatttgggctcattgatgaggatgccaagaccattgccccagggaactttgagagacattggggcatttttgggtatgatgggaagcccaagtttccaatggacctttctggaaaaggccaaaacaagctactagttggtgcacaaaatgtgcactatcttgagccaaactg

SEQ ID NO: 102673 - DNA, 264 bp, Glycine max
  Peptide Sequence Number=SeqID_219451
atggaaacttattcaacatatctgtgctgttctctttacacaagacatttttccttctttggaaggaaacatctttctaagaatcttctagacaataggctcatcttcaagatagttatattcaaaggtgaagtcggtcttgattctttgacacctgagaataatcaaatcaaggcacagataactcaggacaaccagaaatgccgtgtcgaataccaacaaaatcaaccatttcatggacagaaccagaaaagggaaaactag

SEQ ID NO: 102674 - DNA, 639 bp, Glycine max
  Peptide Sequence Number=SeqID_219452
atgctactctccaagccaatattcttcagctacaagcctttcacatgtccaaaaatcaatggcacagtgcattttgttggacatataaccaatcttcaaacaagttataagaccactatagctcttattttcataaccaatggctccaatgctcctgtcaccacaaactttgcaccctgcaatgcaataacattcactaccccatcacccgaggataatgcaaacaatggaaacaatgctaacaaccccaccaagaatgaggttcctgatgaaacttctaaggggaagagcttctggggtgctgttggtttgatcattggtattgttgtgggtcctggaatgctggctttgccatctttgactattaaatttggtccatttccttcaacaatcataatacttgcctcatggctctatttcatttcctcaatcattattgttgctgaacttcgctttgattcaatgggagaacatggggttgaagaggtgagcttcacaagccttgcaacaaagacattgggaagtggttttggtgcatttgttgctttggtttactcaactttgtctttttccttgcttgttggtggcctaatcattgatgtcgttaaccggcttttgtgcttgcttatgcttttatga

SEQ ID NO: 102675 - DNA, 897 bp, Glycine max
  Peptide Sequence Number=SeqID_219453
atggaagcagcaaccggaatttcagaagcaagtggagttcaaatgaaacatttaagcataggcctccagacaaacaaaaattcagaaataaatgatgcattacagatgcaaattgaagtacaaagaagactacatgagcagcttgaggtacagagacacttacagctaaggatagaggcacaagggaagtaccttcaggcagtgttggaaaaagcacaagagacactaggaagacaaaatttaggcgctgagggagttgaagcagccaaagttcaactatctgaactggcatccagagtatcccctcaaagccttgactctaaattttcagaactgaaagaattgcaggttttgtggcctcaacaaacacaagaaggccaagccactgattgttcaatgggaagtttcttaaactatagtgaggaatctcaaagagacagagaaacacatagcatgaacctgaatttgagagcctgtaatggccctccattttcagtttcaaaagggtgtgcagaagagtctatgcatttaaagcctgattacagattgtgtgatgaagtaaaggagaatatgatgtttctttcctcatcaagtaatagtaaagtagtgaagggtgattttttatcagagaggccatcaagcctcttgtccatgaatgtaggagttcaagaagaagaaaattttggtagaacaacggttccaaaggaagaaggttggaagagaagagagagcactgaaactggaagagtgccagttaaattgaactacgagaagatttctcaagattatagacttgcaaactttgatgtgaaactggacctgaattcccatgatgataatgatgcttcttcccactgccaacagtttgatttgaacggtttcagctggaattgctag

SEQ ID NO: 102676 - DNA, 1011 bp, Glycine max
  Peptide Sequence Number=SeqID_219454
atggagaatgatatagagggtgtgcattggtgcaacatatgctctaaaatggtgaatccaatgagtgatgatgagaacatatgccctttttgtgagacagaaatttctgaggtaatggacaacctaagggaccagaatgatgttgttgacttaaggtcagcttgggtgttctcactctacgccccgatttttctcggtttgatgggtgttttcagcccttccctagcaagaattgcttcacatggaggcagcagctcaaggggggtggaagaagaggttgagcaagagagggaaaatgagcttgtgcttgggagaaggagaagaacttcaacttacatgatgcacctctttcgtggtcttcacgttaggatggtgtctgaacttgaaaaccctgaagacaataggaacatggatggcagaagcatacttgtgattgatccattcagtgaaggtgcattgattttgaggggccctaacttgagccacacaagtagcccaaatgagagtaatgctgttggcagctccttgaatgaccttgtggtaggatctggctttgatttgttgctacagcatttggctcagattggtcctggtgggtattcaagtgtgaaccctccggcacagaaggcggcaattgaggcattgcctagtgtgactagtgaggagaagttgcagtgcacagtgtgcttggaggatgttgaggttgggagtgaagcaaaggagatgccatgtaagcacaagttccatggtgattgcattgtctcatggctcaaacttcatggttcttgtccagtttgcaggtttcagatgccatctgaggattcaactcttgaagccaatgtgggagttggaaatggggacaatcagaacagtgagctggtcagagctggagaagagagaccaagaaatggaaggaggaactgtcgtggttgtggctgtggttgtggtctccttgtgatccttgactttgtgagaaactgcaaaaagatgcgattgatgctgcaattgtga

SEQ ID NO: 102677 - DNA, 201 bp, Glycine max
  Peptide Sequence Number=SeqID_219455
atgaaaaaactcctcaacaatgaagtgtttagccctccattaacatggagagctcactacaaggctaaaaacaagacttttgagcttctcagattacgaatgtgcgttcagcgagcatgtctcgctgatcgtgagttagtgactcgacgcttagcggatggttcttctcgtgttgtgcgagctgactttcttgctaagcag

SEQ ID NO: 102678 - DNA, 459 bp, Glycine max
  Peptide Sequence Number=SeqID_219456
atggcctcgatcaaatttggcaccgttgccggggagcagtgtccaaagtgtatgactagaggcaatccatctgacttacaaccctttgatcctgcgatagataggacacttcatagattagttaggcatcattttgtaccttttgagcatcctaagcattctgttattggtgagactgagcattttgtggttggtaattttgaacatcctgattttgagcattttgagaacatggcccaacctccaccccgtgagaggactctatgggaaatggctgcacctgatttcacctatgaaagcttgtgcatccaataccctgatgaggatgtcccatatgttcttaaaactggactgatccatttgcttccaaagtttcatggccttgtaggtgaagacccgcacaaacatttgaaagaattccatattgtctgctccaccatgaaacccccagatgtctag

SEQ ID NO: 102679 - DNA, 558 bp, Glycine max
  Peptide Sequence Number=SeqID_219457
atggccggtcatacaatgatcaggcaagttttgtgggacttttcatatactgcatactgttctcaagaaattttattttgtctgtattatcatacaagaaaatgcaatctgactggtaattcgctgcagttgtttagtgctggggcagatgtccttcacagaattggggaggatgggagaattatacaggaatttattcaacttggtgctaaagctaaagttgctgcttcagaggcaatggatgctgaagctactctaggggagataccagatgaattcctggatccaattcaatacactttgatgaaggatccagttatcttgccttcttcaaggatcacggttgatcgtcctgtcattcagaggcatcttcttagtgatagtactgacccattcaaccgttctcatcttactgcggatatgttgattcccgatgatgcgctaaaagctagaattgaggagtttgtcaggtctcaggaaatgaagaaacacttgagcctacagagtaccaaggccacaattcagactacaaatggggaaacaatgttggttgattag

SEQ ID NO: 102680 - DNA, 1029 bp, Glycine max
  Peptide Sequence Number=SeqID_219458
atgggggagacacatgaaattcctcaccacaatctagccgacttcgagccttgcctcggatatgccattgaagggcaagcagttgatgttatacccctgcaaaacactttggagggccctcagtatcacccacaaccacaccccttgcattccacagcgggtaaaaaccctcatgctatggcagaaatgggaaagttggatcatctagaggaaaggctcagggccattgaaggaggcgaagattatgcctttgctaacctagaagagttgttcctagtacccaatatcatcacccctcccaagttcaatgtgccggactttgacaagtacaaggggactacttgccccaagaaccatctaaagatgtattgtcggaagatgggggcatatgcaaaagatgaggaactactaatacatttcttccaagaaagtcttactagggcagctgtcacctggtatactaacttggaaccttccctagtccattcttggacggacctaatggttgccttcgttgggcattatcagtacaattttgatatggctccggataggatgcaactacagagcatatgcaagagggggcacgtcctcgccttcagagggctacacgccctcaccttgccttcagaggagtacacatcctcgccttcagaggactacgtctcctcgccatcaaagggctacacgccctcaccttcagaggactacacatcctcaccgccagaggactacatgtcctcgccttcagagggctacacacccacaccttcagagagttacacgccctcgccttactttcagaggactacacgtcttcaccatcagaggactacacgtcctcgtctacagagagctacacaccctcgccttatgagggctgcacgccttctccttcagaggactccacgtcctcgacttcggagggctacatccctcgccttcggaggactacacgccctcaccttcagagggctacatgcccttgccttcagaggactatatgtcctcaccttcagagggctgtag

SEQ ID NO: 102681 - DNA, 1515 bp, Glycine max
  Peptide Sequence Number=SeqID_219459
atgtctcagaaagagaagggtccgggtatcaggctatttggaaggaagattccggtgccggaatgtcagattccggcaaactctggacccacgtatttgattgaaaatgagtataacatgatcattctctttctgctttctttgtctattttttcggatacttgctgcagcataaagaaaacagaactcaaaatacctagtgaatgtggagaaaactctgagcaacaagaaaattcttctgattcaagggatagtaaacaagagtcccaacataaagtgcaggaaaatgagccaattgtaaatcccaagcctgtggaagataatatggagactggtagctctgatcaagataaagtcttaaagaaacccgacaagattcttcagtgcccacgatgcaacagtatggacaccaagttttgttattttaataactacaatgtcaatcaacctcgacacttctgcaagaactgccaaaggtattggactgctggtggaacaatgagaaatgttcccataggtgctgggagacggaagaataagcacctagcctctcaataccaacacattatcgtaacctctgatggaattccagcctccaggctagaaaccacagactcgtctggtctccaacagcaacatattgctagtcttgaatcctcagtttctttcaggtcttcagcagataattgcaccatgttgaaatttggtaccgatacccctctttgcaaatcgatggattcaatgcttaatcttagagaccagagaagatgtgctgatgcaagttctatcagctgtgtagagtatagaggggaaccatccttatgtggatcttctgtgatgactaatggtgctcaaggaaatgaattatcagaacataatacatcaaattggttgcaatgttaccctgttcctccatgggtattaccttatccaggttggaataatgtgaattccatggaagcggttcatcgatcttcagcaccaatgtgcaatccatataataacactggtcctacagcaatgcaatggtgtcccacaccaatggttgcaattcctggcatgtgcccaccaagcattcctttgcaatttgtaccaccatcatactggagtggaacgccactttggaatgctggaactggggcagtgtcaataggatccaatgcttgcctttcgccgacttcctcgactaataacagttgctgctcaggcaatggctcaccaacacttggaaaacacactagagatacagtttgcactgatgaagagaaatcagaaaagtgtgttttggttccaaagaccattagaattgatgccccaaatgaggcctcaaaaagtcctataataagagctacattagctatcaagcttgataagcagcaatttgtatcaaatggtgatattttgaaaaaaattgaaccaaaagaaggcaaagatcgtgtgttgggtgcctctcaaatcttggaagccaatccggcagctatttctcgtgctcatgcatttcaggagagcttatag

SEQ ID NO: 102682 - DNA, 159 bp, Glycine max
  Peptide Sequence Number=SeqID_219460
atggtgggacccacgattgagggacacagagatggacgtcgcagaggccttagcgtacgagggcttcgacgaggagggaggtggagagaaagagctaggttttctgagggagaagagagatcaacactcaacggagaaagggggtgtccaaaggggtag

SEQ ID NO: 102683 - DNA, 300 bp, Glycine max
  Peptide Sequence Number=SeqID_219461
atggttgcttcagggacaaatcaactacaacccactttgtcacttccagagaaaccatcaaagcttgggttcaatcttggtgcaacacgtggcaactccctgtgcgataaggtgaatctccacatggtgagggtggaagagaatgacggcgaggttgggggaattggtattgggattggaattctaggtgaatttgttaaaggttttagcggcgttgttttgccaaagtttcttgcggaggtggaagggtttgtggggttcgagggtgagagtgtggaaggagccgacggtgacatgctg

SEQ ID NO: 102684 - DNA, 1286 bp, Glycine max
  Peptide Sequence Number=SeqID_219462
atggatgtcacctttattgaattagagaatttctttgctttccaatcttcccactcctctcgtctgggggagatgatgagtgaagagcagaattgggaagattggccaggttttgaagcttcaaatgatgttggggtggaggttcagccgcgagaattagagacaatatcgatagaccaaagaaaagaaactgaagatgttgaaaataatgagcaggttatagcagaaattgaagaatctgcagaaactgaaagtgaacaacctttgcttgttgaagtagaaactgaaagtgaacaacccttccatgacttaacagtgccacaatcagaatctcctgagaatatctctgaggtacaagttctaaactctcctcaaaacatttttgatggttataaattacctttcaggcataatcggggacaacctcctaatcggtattcagcagatcatgaaactagcaagtcaaagcacccaattgccaattatgtctcaactcacaaattatctaaacccttcaaggcattagtttataacttatctgcaaacgatgtcccttatacagtaaatgaagctatgaaaaatcccaagtggatccaagcaatagaggaggagatgaaagcgttacaagagaataacacttggtcacttgttccattactagaggggaagaaaacaatgggattagaaaaattgaataccataagagtattaatatcacttgctgcaaacctggactggccgctgcaccaatttgatgtaaaaaatgcttttctccatggggatcttgaagaggaagtgtacatggacattccacctgcatggtttggtcgatttagctttgcaatgaggaaacatggtttcaaacaaagtcattcagatcatactctcttcttgaagcatcaacaagggaaggtgacagctctaatgatctatgttgacgatatgataattacagggaatgatgaaaaggaaatctctagactacaagagcatttagcaactgagtttgagatgaaaaatcttggagggttgaagtacttgaaatcttcaccagggagagggctaatgtttgcaaaaaaacagcatctgcaccttcaaggctatactaatgcagattgggtagggagtgttactgatagaaaatccacatcaggttacctcacatttgtgggaggaaatcttgtctcttggaggagtaaaaaacagaaggtggttgctttatctagtgcagaagcggagtttagaggtatggctgaaggagtatgtgagcttctctggttaaaaag

SEQ ID NO: 102685 - DNA, 726 bp, Glycine max
  Peptide Sequence Number=SeqID_219463
atggaaacacctacaataagggtgttgaaacaggaagaggagaactcactccttgcagagcttacagcaaggatgactcaagcattgaatctcaacccaacacaaagtcaaagttcaagttctaaagcagcaatacaaattggaatcaaattagatgaccctgcattcaaaaaatggagaacaaaaaatgcagtggtgaagggatggctcatcaattctatggatctaaagttggtgagcaactttattagatttctgacggctaaggctatttgggatagtattgctacaacatactttgatggcagtgatacatcacaagtatatgatctcaaaagaagagtgaccaaactcaaacaaggtgacagatctattgaaacgtattataacaacctacaaggactatggagagagatcgattttcgtcgaccaaatcctatgatatgtgatgccgatattcagagatataatttaattttgcaagaagacaaagtttataccttcttagatgggcttgatgatcgtcttgacaagattcaagcacatgtacttcagatgcaaccattcccaatggtggaacaagcttatgcactagtccaaagagaagatttgaggcaatttgtgatgatggtaaatgaagatattgcatcaagaggtgctatgctttcaaggagggggcataaacctcaacatcgattatctcttcaaataacttcaaatgtctag

SEQ ID NO: 102686 - DNA, 342 bp, Glycine max
  Peptide Sequence Number=SeqID_219464
atggtagcaggaggtggtgcgagtgcaacttatgttgatactgttggagatttaggctatgcatcagagcctggcaactatgctgaatatagtggagctccgaatgaggaggaggtgttgcaatatgcaagagttgtaattgatgatattcaaacccatgacttattgcctgccttagataatatctacgacttattcacaacttgcatgattggttatggtcagaatttggtatggaactggatggattcttctattaaagggagtggcaaaaccattaatgttggagatcctgtttatattcttggaaacgtctcttctacagaagaagctgctgcttga

SEQ ID NO: 102687 - DNA, 471 bp, Glycine max
  Peptide Sequence Number=SeqID_219465
atggcagagaaagattccggcaccaacgacagcgttcggggctacaacctcatcgacgaagcgaagaaaaccctcgaggcagcatgtccttcaactgtcatgtgcagacatcataaccctagcaaccagagacaccgtggccttatcaagaggacccaaatacaacctttggacgggaagacgcgacagattatttctttgctggcagaatctcgggcgaaacctgaccctactatggaccctgcattgaatgctaagttggagattcttgcgaagaaaggattgctgcagattgatcagcagcttgcattggatgcgggtaccaaagggtttgtattggatttcgcttcgaatggtgataagttccaaaagggttttgcgaatgcgattgtaaagatgggggagattgatgttctggttgggaatcaaggtgaaattcgtaagaaatgctcggttttcaaccgcaactag

SEQ ID NO: 102688 - DNA, 453 bp, Glycine max
  Peptide Sequence Number=SeqID_219466
atgaattttacaaaacaaagaattagaaaggtgaaaataaagagtaatagaaaagggggaatacatattgttcaagctcctgatgtggccgttgtggttgatctccgggtacagatcttgatcatcgtcatcatcctcattatcgttatcactattatcggaatcgttttcgggtttaacaggggagggacctttctccatggagtccatgagcttgaagtggaccaaggaggagttgaatcgcgaaacgtggaaggagcgaatgtgttggatctcggtgcggtagcgcttgcggagcttctccattttgtggcagcattggatgggggttttgggaggggaggcactggggcagcggcttgcgatggcatcagtaacctcttgccagtgggtggccttcaggttgttgcgttgcgagtgatgacgctgagattgagcaccgtcaccagttag

SEQ ID NO: 102689 - DNA, 339 bp, Glycine max
  Peptide Sequence Number=SeqID_219467
atgctgcaaatcgccaaactcctcacccaaaaagatagaagttacaattttcattggtctgtgtacggtgttatactgagggcgagccctggtgtagcggtaaagttgtgccttggtgacttgttggtcatgggttcgaatccggaaacagcctctttgcatatgcaaggtcgatgtcgacagcagggacactcgctggtggcgcagcatggacggagggacgaacgacagcctcttgacgttgcgaggaagcagaacgcagaagtgaagaagaggatgaacagtagcagaacacgtgagggagagggagagggagagagacaagagacaggtttttaa

SEQ ID NO: 102690 - DNA, 171 bp, Glycine max
  Peptide Sequence Number=SeqID_219468
atggagatgagaaaccaaccttttatgaagacagtatgcaatttgaatcaagagagaacaaaggtcatagacaccgtgagagtgtacgatctgaacgaggtcatagccaccgagaagagtgagaacgagggtctcaaagtcgtaagggagagtgtgggtggagagaaatga

SEQ ID NO: 102691 - DNA, 360 bp, Glycine max
  Peptide Sequence Number=SeqID_219469
atgatgcatgcacctgactcaacactcagatgcaatgtggtgatcagcctgggagcccaaaggagttccctaccaggtgacaagccccctcagtacaaagtacactctgccacagctactctatttcctatgaacatggccaaaacaagtgccaaagaccctggaaggtcagtgcacttcgccccccacgaacatacacaacatccaacgtatgaacgtggcccaaagcaagtgccaaagaccctggaaggtcagtacacttcgctcccccacgaacatacacaacatgcacatgccaatgcatttccaacattccatttccatgttattctcaacataaagatcatctcgtctcaatga

SEQ ID NO: 102692 - DNA, 165 bp, Glycine max
  Peptide Sequence Number=SeqID_219470
atgagttatttgaagatcaaaatcgtgggggttctcacagaacacgatgaaaaaaacatagcactgcagaatgcagggacaactccaggaagaggtggcagcaacgtgttcgaggttcaagggcaacctctcagagaggccttaccctcctttcgtttattataa

SEQ ID NO: 102693 - DNA, 1098 bp, Glycine max
  Peptide Sequence Number=SeqID_219471
caacaagttcttgccacaattcgaggtttgaagctcagtaaatatcttcatgaagaacacgttccaaagaaatttgagtccaaagaatatgaagaagctgcaccaatcctcacaaagatggttggtttagagcaatcatggcagatttggaaaagattagaagtatattatgcgtctcagactcatgcgaaagtaaaaaaattgaaggtacagttgcgtatgattacgaaagataagtcaatttcaaaatatttacttgctatcaagaaaatcgtagattcactagttgcgattggttctgcgatttctgatgatgatcatatagaagcgattttctatggcttgcctgaatattgttacttcgctaatactgcttttggacctagttattcttctggcagaggaagaagagataattcaaattttagaggagaatataacaatctcggtggtagatccaactttcgtggtggttacaattccaatcgaggaggaagatacaacaatggaagaggcaatgacagatcgaacaaggacaaaattcaaataattcttggaatcagaacaatagactacaatgtcaaatttgcgaattttcaagtaaatcacagtcagtatcaatgtttctctcaatctgatcaagcattcatgtcaacaccaacaactgttatggatcctctctggtatccagacagcggagcaagccatcacatcaccaatgatgagagcaacctttctgttaagactgattacacagggaatgatcgagtaaaaattggtaatggttcagataatcaagtattttttgaattccatgctaacagttgtaatgtcaaacaggaacatgccaaggagactcttcttcaaggaaagtttagcaagggtctttatgtctttcccaaccttcagcatcaaaaccacatttctgctttccattctacaacaaattcttcattcacagtcttggagctttggcattcaagacttgctcatgcctctctaaaagctgcacgtcagcttcctttctttacttctcagtctgtttacgctagtcctcttgatcttattttacagatatttggggtccagcccccgtaa

SEQ ID NO: 102694 - DNA, 567 bp, Glycine max
  Peptide Sequence Number=SeqID_219472
atggaattggcaatgcccactaaggcaacatcttgcagttgcttactcaagaagctatcaaaacaacttgagggagctaaggttgagaaaactctttgcgctttcagaattgcattctctagacgaattggtgattcggttctcatttgttcttctaggaagcaaactattgtttctcgcagtagcactgaggctgagtatagaggacttgctgctgtcactgcagatatcttatggctgcagcatttgctcagagagttgcgtgttccagttgcattgccaagaatttattgtgataatttaggtgttgtccaccttgctgcgaatcctgtcatgcattctcggacaaagcattttgagttggatttgcattttgttcgcaataaagtcttgtcgcgcgagcttgttgttgttcatctatcggctgaatttcaggttgttgatattctcactaaagctatttcaaatcctcaatttacaatattcaaatccaaactcaaggtttcatccacttccaccatgattttgaaagggggtgtaaaggaaaattgtcaagcagacaattag

SEQ ID NO: 102695 - DNA, 267 bp, Glycine max
  Peptide Sequence Number=SeqID_219473
atggagctgataatcatcatcactcttcttagtttttccttctcttatctaataccaacttgttcttcttcccaaattcaattggaaccttcactccagcttgaagatgataatataggagtcaatacaaacctgcagctttctctcccaacagttcctagaaagctaagatttactgagaaggttaaagaagatgacggagccagagatcttgcatcacacaaacaggagaattcctttgctgctgcagctagcttgtccatgtaa

SEQ ID NO: 102696 - DNA, 1488 bp, Glycine max
  Peptide Sequence Number=SeqID_219474
atgggttggactagtatagttttggttgaccatttgggtgaaggtaataaagtggctttttggcattcaaatattggtcttgagcctgaatctcaagcgtttgtgttcattgacgatgatcaagtttccgatggatacaaattacaaaaccagaaagtgaaggaatacgaaaatggagttcatgcagttttagagaacaatgaagaaggtttagattcatcacaatatcacatggagtcagctgattgtatgaaaaatgaatatgaagcaaaggtaaaagacttagttgagcctgtatctcattctaccaaggatatagaatcatttatgatgtttccaaatgatatagaatcagttaaaaggtcacctacttcaccaatctctaatcctgtgaagggaagaaactcaccttggaatcctgaggatggttacatggacaaaactgttacacaatgtgaaccacatctggaagtgtgttacaaagagagtaattatcatgttgtcaaggatatctgcattgatgaaggggtccttaaaaaggataaggtcatgtttttgaatcccgacgatgaaaaggctcacaatttcttcccttctgatagttacgaaaataaagaaaagcagaaagacaacaccagtatcggtgtactaagcctaataccaacaggggaaaaggctcacaatttcttcccttctgagagttacgaaaacaaagaaaagcagaaagacaacaccagtatcaatgtactaagcctaacaccaacaaaggagtctgacaaggatcctgctaatcatgatcagcccaaggatttgatgcacaaagatgaggatgcaactgaaaaagtttccagtaatgtcaacaaagagacgcctttacccgaagacaaggttttgttgcaagatttactcgctcaggattctgtatcttctgatgacaagggtgaacagatctccaatgagcctgaattgcactcccaaccggaagagtccaaaaatacagttgaggaagcaatattggaaactccttctttggcattggaagatgatgaatcaaataatgataacgtgctttcagagaaaggaagcttcactcatcaattggatccttcagttccttcggattgtggtaaagaggattgccaccaagctggtgtttgtaaatgtgatgaaattcaacaaacaatgaagccggtagaagggaagtctgatgatcaggctgtaactggcactgttcgtcacagcctaggcgaggcaagtttctctgccattggccctatgtcaggtcgaataagctactcagggccggtgccttattctggcagcatctctcttcgatcagacagcagcactaccagcacgcgatcctttgcattccccataattcaatctgaatggaatagcagcccggtcaggatggcaaaagccgacaggagtcactaccggaagcaacggtggtggaaggatagctttctttgctgtaaattctga

SEQ ID NO: 102697 - DNA, 125 bp, Glycine max
  Peptide Sequence Number=SeqID_219475
atggaagcaagggtttgtggaaagagctcacaactacaaaatgtcgacacagtcccaacaccgctagcccactcggtttttgtgctctatgcaatggaccgagcgaaatcacgttttgggataag

SEQ ID NO: 102698 - DNA, 414 bp, Glycine max
  Peptide Sequence Number=SeqID_219476
atggatccgagggcaccaatgtggtcgtgttgtttttttttttgtgtggaattttcttgggaaaattctggttggtgggaaaatgggatagaaaataaaggggtgatgatgataacggtgagtggggataaaataaaagtagcggaatctgataaagatggagactttggagagaaacaattgtgggaattgaaggacactcggaaaagtgagagtgagagagatactactactacggaaaagttgcatatttttggtgtgaaattaaattttgatatgaggggaagaggtgaaaatttaatgctacaatataccctattgaatttggggtattggagggtagggtcagggtttcgtttcactgttgctaatgcattaattgcagaaggagaaggtggagggtgtaatgtgtga

SEQ ID NO: 102699 - DNA, 1225 bp, Glycine max
  Peptide Sequence Number=SeqID_219477
cattcttggtagttcagatgtttcttcctatgttggtgtctctggaaaattacagttacaaaaagagaggaagaaagagctatggatagcgagcttggaaatgagtaacatgaatataggagggaagccaagagattgcaccgaattgcatataattggagattgcattcttggggtgaagtggaaagatgtgaggaagaaagttgtaggggaagggatacaaatgttatgtattcaagaaacaaaaaaggaagatattgtacaaggggtgtgttatgtgatatggggcagcaaggaggtaaaatgggggagaaggataccttggactacaagggacttggaagagaagaatgttgtgattatatatatgcttcttgacattgagagaaaaaaaaagatgttgggaagagttgaaaatgaggaagagtttaatgagtttgtacagatgatgaaagttgttgacattccacttgttggcaaaaaatacacatggtacctcccaaatgggagggcttgtagcccaattgatagtgttttggtgttcgaggagtggttgtttttgtggcaaggatgcacccaatttgtcatgcctagatttttcttggatcattgtcctataattctaatggataatgtaattgattggggggccaagccttttagggtgctagattcttggttggaagcaaaagtcaagaatatgatagataaaggagggggtagtaactctcgatatttccattcgatggttcgatggaaaataagaaaaaatgcacttaggggagtgaaaattggaggtgagtgggtggatgagccaaagaggataaaagaagaggttgaacgtttgtttgatgaagctaaagtgaaggaggcaatgtgtgagtgtggtggtgacaagagtttgggtccaaatggtcttaattttaagtttgtgaaaaccttttggaatgtgctaaagaaggatattacgatattcatgagagaattccatagaaatggtgtgctaccttggggatgtaatgcatcttttatcacgttgatcccaaatgtggagaatccacaaagccttagtgaatttagacttatttcattgggattgaaattttctccaatccatggtgctatgatggccaacaatgaggttgtggatgaagctaggagaaggaagaaacaatgtttgatcttcaaagtcgattatgagaaaacatatgatttagtgtcatag

SEQ ID NO: 102700 - DNA, 285 bp, Glycine max
  Peptide Sequence Number=SeqID_219478
atgtaccttcaacttcagaggactacacgtcctcgccgtcaaagggactacacgtccttgccatcagaggactacatgttccccattttcaaaggggggcatgccctcacctttagaggattgcacgtccttgccatcataggactacactccctcgccttcgaaaggcgacacgtcctgaacttcagagggctacacgccctcgcctttagaggactacgcgtcctcactttcagtgtgctccacatccgcaccttaagagaatttaaggtcctctatccttaa

SEQ ID NO: 102701 - DNA, 750 bp, Glycine max
  Peptide Sequence Number=SeqID_219479
atggcgttgcccagcggctgcccctgcttatccaacagaaatgcgcccttgccctgcgccgagatgccgatggcctggatggcgccggcggcgacgccgctggcggacagcacttcacggatcacgtcggcggcggtgcgccacagcgatgccatatcgcgctcggcccagccgggctgcggcgcgacgatcgccagattgcgccgcgcaacgccgtgttcatggccccggcggtcgtataatcccgccttgatgaagcatcaacgccagcacggaggcgatcgccagcgaagccgccaggctgtagacgccgacgtccttgctgaacaggctgatcaggacgccgaccatatacgggccgcaaaagccgccgaggttgcccagcgcattgatcacgccgcgcgcgccgccggccacttcggcgttgaacaatttgggcgggatggtccagaacaccccggctgccgcctgaataaacacgccgcagccgaccagcgcagcgtaagaccaccagacgtgatccttcagcagcaccgacagcgccatgcaggcagcaaagcaggccagcggcagggcgacgaagactttgcgcttgccggtgcgatcggagagggtggagatgatcagcatgccgaagatggcgccgatatagggcaggatagcgagcaggcccacttgctccatatcgccgtgggtcagccctttcaaaatggtcggcagccacagggtgtagccgtagataccggtctg

SEQ ID NO: 102702 - DNA, 204 bp, Glycine max
  Peptide Sequence Number=SeqID_219480
atgaatggtgttcgagatacccaattggttcatgtccaaggtttcaacatcaagtttaggtcttacgagggatttttcgaagtggtcgtcgatgcgcatggtggcgctgcagatgagcgcaacattgcggtggccacagtggcaaaaccaggagaggatgatgaggtcgaggaggttgccaaggtggggtggaagccacagtag

SEQ ID NO: 102703 - DNA, 447 bp, Glycine max
  Peptide Sequence Number=SeqID_219481
atgtacattttgacttgttggaagaggcaaagctgtgttgctacatttggacctaatattagaatttatgaaattaagaagtgtttatactcacctttattatcattcaagtcaatctcgccatgggatagaaagtatagggatcgatcatactgtagatcaccttatgcatcaagaagccgcaacaaaagtaggagttatagcttaagcaatagttacatccacacacctccactgttgggatttgcaaagaattgtctgtggagggagaaatatgcatcgcacgaagcattacaaaatggaggcttcaatcccttctctttctctctaacgtttgggaactctatcagagcaatcagaggaaaaattgaggaatctcagaaaattgctagagatgccgctatcgctgtcggaagacacgtgatcccgcttagaggtaagggatga

SEQ ID NO: 102704 - DNA, 457 bp, Glycine max
  Peptide Sequence Number=SeqID_219482
atggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagca

SEQ ID NO: 102705 - DNA, 417 bp, Glycine max
  Peptide Sequence Number=SeqID_219483
atggaggccgacatggaggccatgaaagagcaaatggccacgataatggaggccatgatgagcatgaagaagataatggaagccgatgcggttgcagttgccgctaccagggctgttgctaaggtgaacctgatgcccccatctgatctcaaccaaatgaatcatccaacctcagatatggtgggcaaagatttaggaagtacggacgaccccatgatgtgcaaattcaaaacgagtacgccttcccgccatatggcttgcctcccaactatacgccacccagtgtggcgtacactcccaatgagaatgtcaataactccactcctatacccattgagagccaacaaccccaaactcgtcatgcacatgtctcttaaaccgtgggggagacacatgaaattccccaccacaatctag

SEQ ID NO: 102706 - DNA, 300 bp, Glycine max
  Peptide Sequence Number=SeqID_219484
atgtggttacatatgaaggaaagaagcttgacaaacaaagctaatcaaagcaagcaagaaataaaatcaattattggcacaaaatcaattgtgcaaaaggcatttgaaatgaaagaacattcaatatctggtgaatggccagatgctgtgaaagtttggaaggtcacgcacatgagatctaatggaacttggtgcattccaaaaggagaagaaatcatggaagctttggagaatgtgggtgatatatatcaggaggaaatttcaaaagctcatgtatcacttgttgaacattttgccatg

SEQ ID NO: 102707 - DNA, 426 bp, Glycine max
  Peptide Sequence Number=SeqID_219485
atgcagaccgttaatcaatggaaggagtcctattcattcaatcaacatcttcgatccaatccagatgacagcaccctcaccacatggtctccacctcagaaaaatcatagattaaaatggcaatttcatcaaagcattgacagcaacggcaaatggagtcccagcacccctagagaagcagaggcttgggctctacatcaagccataaactggactcatgaacttggcatgcacaatgtaatttttgaacttgattgcaagttggtagttgataacatggtcaaaaacatcaagggctctactgattttcatgctattcttaatagatttagagcaagttttgtaatttctcaaagggtgagttttgtcaaaaggcatgccaatctagtagcttataactcaataaggattaagattttatgttag

SEQ ID NO: 102708 - DNA, 174 bp, Glycine max
  Peptide Sequence Number=SeqID_219486
atggacattctcaccctgggtcaagggtttggcctgcggttcggggatgaaggggatgtcccacattattcccataatacacatgcaacaatgatgattaggaaattttatgcaaaactggtcatgcatgcacccatgtggacactcaagcatcaagtttttatggtcatgtga

SEQ ID NO: 102709 - DNA, 407 bp, Glycine max
  Peptide Sequence Number=SeqID_219487
atggaggaaggggtggaagcagatgaagtggtaaggtcattgagcagcttgaggatgaacatagggtctttgagcaggaggagttgggtctcagaaactgttccagagatgtggggtgctggtgctggacatggtggagatgtttttgagagaagcactagagtggatgatgataatgatgaagaggagctcatgtgggctgccatagagaggcttccaacatttgagaggctaaggaaaagcatagtcaaaagggtcttagaagagagtggaaggttcaattatgaagaggttgatatatccaatcttggtttccaaggcaagaagaaactcctccatgccattttaaggaatgttgaagctgacaatgaaagatttcttcgtagaatgagggagaggattgatag

SEQ ID NO: 102710 - DNA, 272 bp, Glycine max
  Peptide Sequence Number=SeqID_219488
ggggtgtcgtgaccttgttggatatccctggtggaggaaaaagagtggttaaagagattttagcatttttggaggggaatggcttagaatctttaattatccacggtcagtgcattgatggtgcccatgtttcatacgttgagaatggtttagaatctttaattatccacggtcagtgcattgatggtgcccatgtctcatacgttgggaatggcttagaatctttaattatccacggtcagtgcattgatggtgcccatgtttcatacgtt

SEQ ID NO: 102711 - DNA, 837 bp, Glycine max
  Peptide Sequence Number=SeqID_219489
atggaagatcttaacgtcgttgacggcattaacaatgcaggtggctggctggtgcgcaaccaggcgctgatcctcagctatgcggtgaacatcgtggcggctatcgccatcattattgtcgggatgattatcgcgcgcgtggtatcaaacggcgtcaatcgcctgctggtcgcgcgtcatattgatgccaccgtggctgatttcctctcggcgctggtgcgctacggtatcattgccttcacgattattgccgcgctgggccgcgtcggcgtgcagactgcctcggtgatcgccgtactcggtgctgccggtctggccgtcggtctggcactgcaggggtcgctctccaacctggcggcaggcgtactgctggtgaccttccgtccattccgcaccggtgagttcgtcgatctcggtggcgtaatggggaccgtacagaatgtacagatcttctcgaccacgctgaaaaccgctgacggcaaaatcgtggtggtgccaaacggcaaaatcatcgccggcaacatcgtcaacttttcgcgcgaacctatccgccgcaacgagttcattattggcgtcgcctacgatgcggatgtcgatcaggtgatcgatctgctgcgtgaagtggtggaagcggacgagcgcgtgctgaaagatctgggtatccagattggcctgaacgaactggcggcttcgtcgctgaactttgtggtgcgctgctggagcaaaagcggtgatctgcaaaacgtctactgggatctgatgaagaactttaagcgcaccctggatgcgcacggtatcggtattccttatccgcagatggacgtgcacctgcatcag

SEQ ID NO: 102712 - DNA, 264 bp, Glycine max
  Peptide Sequence Number=SeqID_219490
atgcacgaaactcttaaggcatcacaagtagccatagttgatgaagttgaacgcaatgttatagaacttgtgtccaagcaatcgaaaacttcaaatgaggctacttctagagacaagggagaacctaatgtcatcatcgtctactccaccaattcaagacctcctcctctgaactatgcacagcttgcaactactaccagggatcaagtgcaagacatgataggccaagcaatggaatccttcattgatagaaaacgtcaataa

SEQ ID NO: 102713 - DNA, 777 bp, Glycine max
  Peptide Sequence Number=SeqID_219491
atgtatttccgttttaatctggtcatgttcagagcaccagacgcattgccagggagcaatcgcatccggcttgaacttttaaaaacttacggagcactcatcatgacatctatcagttcactaggcagtagtaacagtattcaatcattttcgcaggtcggccagcgcagtggcatgcaaccaccgcctccgccgccagatggcgaaggtcaaggcaaagacggtggcggcttattaggggcgattgactctgcgttgaaaagcgcgggcatcgagggcgggctggagtcaatctttggtcagtcaggtaccagcagcaccagtgcaagctcagacagtagcgaaacgactgacagcagcgacagcaccacagatgcggccagtgcgctgaatacctttttacaaaacctgatcagtgccttgcaatcgcaaggaacaacggacactggaagtagtgacagtgaagaatccagcactagtagtacagaagcaagcgcagcacagggtatgccgcctccgccaccttatggcggacatggtatggaagccaaattacaaagtcttatttcttccttgagtagcgatagtaccgacagcacggcaaccgatacgtcttcagacagcagtagcagtgaattggaaagcagtttccagtcactggtgagtgctttgggtggcaacagcgatagcgctagcctcagcggtttcttgcaagcattatcttccggcatgcaacatcgcgggccagcaggtaatgtagtcagcaccacggcgtaa

SEQ ID NO: 102714 - DNA, 2298 bp, Glycine max
  Peptide Sequence Number=SeqID_219492
atgccggtcattagcattgcctggtggcttgcgccggcagcagccacacccatcagcaggctggcggtggagatgatgccatcgtttgcgcctaacactgcggcgcgtaaccagccgctgcgttgtaaaaacctgcgagtgagttacatcaaatctccgtctacaacaggcaaatcgcttagaataacggttatgcatattgaaatttccattcctgcgcaaacgctgaccttgtttgatgacaatggcggacaagtgacacggtatgccgtatccacggccgctaatggggcaggctgcgtcaagaacagtggctgcacgccactgggtgcacacatcattcgtgccaaaattggtgctggggctgctgaaaatacggtgtttgtcgggcgccgtccaaccggggaaacttttacgcaggatttaaaggtgcaattcccggagcgcgactggattttaacccgcattctttggttgagcggtaccgagccaggtaaaaaccgacttggcaatgtggataccatgcagcgctatatttatattcatggtacgccggatgaaactgtgctgggtgtgccgggttcacatggttgcgtgcgcatgcgtaacgctgacttgatagcgctatttgacctggtgccgcattttgctacattgttaccagtcgtcttcggggtgttgtgcctgacctttgccttgctgcatctggtgccgggcgacccggtggatgtcatgctgggtgaatccgccagccccgctgatcgtgtcgcactcaaagctcaattggggctggaccagcctctgcccgtgcaatttgggcagtacttgtcgcatttgctgcgaggtgattttggtcactctatccacacacaaacgcccatctcacaactgctatggcaggcctatccagcaaccttgttactggcagtggttgcattggcaataggcttggtgataggtattccattaggcatctggtctgcattaaaagctgggcactggcaagatgtgatgattaccatgctgagtattcgcctggccgccatgcctgcattctggctagggccggtgctgatgctggtgtttgccgtgtggctcggttggttaccagtcagcggcacgggcagtggtgcagccattttgttacctgcactaacgttggggttggggttaagcgcgattttgacgcgcatgacacgcaccagcctgcttgaagtattaaacgaggattacatccgcacggcccgggccaaaggcctgagtgagcggcaagtcttacttaaacatgccttacgcgccgctttattgcccttagtcaccatcgttggtttgcaaatgggcagcctgttagcgggtgctgtgattactgaaactattttcagctggaacggcattggccgactattggtagatagcatagaaaagcgtgattacccggtcacccaggcttgcaaccgatgtgatctatcgctggctggatccgcggacacggggcacgcaatgaaaacattttctttactcaccttgggcttctggctactagtggtcatgcttggtcatgtggtgggattggaacccaaccggattgacctcaatgccattctgcaatggcctagccagcagcactggttagggacagatgatttgggtcgcgatatcctggcgcgggtcattcatggggtagaggtctcttttatggtgacgctggtggtgacggcggtgaccatgacggttgggctaagtatcgggctggtggcaggctataaaggtggcaaactggatgctgtgctgatgcagctcaccaatattttcctggcgttcccagggatgctgctggcgattgcttttgccgcggtgctgggcgccggaattaataacctgattcttgcattgtgcctcactggctgggtgacctatgccagattgtcccgtggccagtcattggccttgcgccagcgcctgcatgtgctagccgctgagtcacttggggcaggcagtgtgcgggtcatgttgttgcatatcctgcctttactgatttccatcctgctggtcgaggctgcgtacagcatggcgagtgtgatgattgccgaagcctcactctcgtttcttggcctgggcatacaagcgccgaatgcttcatggggcgccatgttacgcgatgccgtgcgctttatgctggtggcgccacattatgtgctcactgtgggtgtatgcatgatgagtttgatcctcgccatcaacctggggggagatgtgttacgtgacaagctggatgtgcgtagcgaaaggcaggtatga

SEQ ID NO: 102715 - DNA, 671 bp, Glycine max
  Peptide Sequence Number=SeqID_219493
atggcacatcacgaattacactttttacaacgcagcggctggttacgcgccgcagtgttaggcgcaaacgatggcatcatctccaccgccagcctgctgatgggtgtggctgctgccggcgcaagccaccaggcaatgctaatgaccggcatcgccggattagtcgccggcgcgctttccatggctgctggcgaatatgtctcggtcagttcgcagacggatatagagcaagccgatctcgcgcgtgaagcagaagaattaaaagaaaatcccgaaagtgaattgcgcgagttgacgggtatttatatccagcgcggcttgtcgccagaactcgccaggcaagtggcacaagcgctatcgcaacacgactcgctaggcgcgcacgcgcgtgatgaactgggtttacatgacaacaatcaggcacagccattacaggcagcactgacatctgcgctggcattcagtagtggtgcgctgttaccaattgtcacggcttggctcgcgccccacacgcaggcacaaacctggctcaccatcagcaccctgccctttttaggtttgctcggcatggtctccgcgcgcaccggcggcgccaatgtattaaaaagtgtcagccgcgtggtgttctggggggcgctggcgctggcagccactgcgctcattggccgctg

SEQ ID NO: 102716 - DNA, 752 bp, Glycine max
  Peptide Sequence Number=SeqID_219494
caccgaccacgccatatttgcctgtcagtgactttccagaactgaaagcgattacagaccgctggcaagaaatacgtgaagaagctctatacgtgcgcgaacaagagcgcatcgccgccgcgcaaaccaataatgacgctggctttaattcattttttaaaacaggctggaaacgtttttacctgaagtggtatgacgcacatcatccgtcggccagtatttactgccctaaaaccgtggctttgttgcaaagtatcccaagcgtgaaagcggccatgtttgccgagttgccaccgggcgcgcatttacgtccgcatcgtgacccatatgcagggtcgctgcgttttcacctgggactggaaacgcccaatgatgaccagtgttttatccgtgtggatggtgaagactatagctggcgcgacggacaggccgtgatgtttgatgaaacctatattcatgaggcttataacaaaaccgatgaaacccgcgtgatattgttctgtgatattgaacgcccgatgcgttacggttgggcgcaggccgtgaatcgctttttggccaatacgatagtgactgcagcgagctcgcccaatgaagcaggggaccagactggcttgattaaccgtctgtttcactatgcctgggtaatagggcaatatcgccgtcgctttaaaaaatggaacaaaaaggtttatcaagtcacgcgtatcttgttaatcgcattggtttgctatgccatctggaagctctag

SEQ ID NO: 102717 - DNA, 156 bp, Glycine max
  Peptide Sequence Number=SeqID_219495
atgggtcaaaacgtgttctacaagttcaatgactatgaaatttttggagagttagacattagcaatttaaaactgaggaaaaggtgtcgttccaaaacatacattcctaagagtgaagagtttagaattcggcttccaaacttagtggagttcaag

SEQ ID NO: 102718 - DNA, 1047 bp, Glycine max
  Peptide Sequence Number=SeqID_219496
atggtacgggttacaaacagaacagacatgcgccaactgaggggaataactagtcaaggtgcgacacacgccaaagatggcggcaaaagacctgtattattacccgaaacaaacaacaaacaaaacattatgaagcgtattggtctatcagctgttcccgaagttctatctaaaatagaacagaactacgatgtatttactataactgataaatttcgtaatctgtctttgaaagatagcagtgctagttcaagtaatcatagttttctttctactctgactcctactgcatctcttttagaaagatttaagattcgtactaatccatcggcgtttactcgtaatgttattgaaatgactaaagcaccattttttgatataaagaaccctattattaatttaaccgaaaaggcaaacaattatatgatgtcgattggctttcgctttatgccaggacaaggggaattcttaataaaagatctccgagctcctgataccttagtgggtttaagaaagttaaaagaaagcctaggcttatcgttaacaaaaggtagtcttaacagcaatccattacttaagttaaagggtatttctgactctgtttctaatagtatggagtcgctggcatctcgtgtcttggttgaagtaattacatttaatgaggggtattatggtcgattcttaatcctggtccaaatgggtattggttgtactgtatggtatggcttcgtacctggcgatggtatcaatatgccaattgaaggattaaataccctatttagtcctattgagaattatgatactatctttactaatcctgatgctcatgttataccgggctttaataaaatgactttaattgagggcgtaaataatccagcagcaccgctgtcacaggcatttgctcaagataggcccttcatggatatggatattgaaataccggattctaataaatctattattataggtgttagcttaggactagcagttgccatcttatttacatttgggattaacccatgctgcggagaagttatagtatga

SEQ ID NO: 102719 - DNA, 672 bp, Glycine max
  Peptide Sequence Number=SeqID_219497
atgggcccagttttgctagactcgcaaagacccttcttgggaggatgtgcggaaaaaggcacaggaagcgttgatggcgtcatcgaccctccatcccccgtcaaacgccacgtgaagtggaagatggcccgcaccaagaaaacaggggagatgatgactgaggccgcaaaggaaatcgctgagaagatcgatgttctcaccgctgctattagatgtccagagcaccctggacgtgtccgtgctactggagccgtagctgacccagcaaatcagggaccaactagaggagtccatcacagaaaaagtgacgcggcagctcatggcatccttcagccaaatgcagtcctagattcagtcccagatgcaatctcagggacttgcactgcctcccgagcctctggaaacgatcttgagacgggtgactcagataggtgcggcttgtacattgaagcagatcatgcccgcctggttgccctagggagagtttatgagggatccactgttgttcataacactcatttgttgcctagccaagtaaaggtgggtgtggaggagggtacagatgcagatgctccagttcctgtatccactgatgaggtttccttagtggggcaggcacttcacaccttccttgcttggccgacacatctggtcaagtctttatcacagcag

SEQ ID NO: 102720 - DNA, 255 bp, Glycine max
  Peptide Sequence Number=SeqID_219498
atgcagagtttgcaggatgtggtccagcaacggccagttatgagcgtggaggagtttctacagaaggtggcctggctaagagtccagccttctcctttgggaggagagccttccactggagtgctggacatgtcttcttctcagcctgagtcatctgcaccaatgccagacctgccccttcctcaggattcaccatcaggcactcctgcactggacctgaatgagtatgccatggactctgcacaggatcattga

SEQ ID NO: 102721 - DNA, 297 bp, Glycine max
  Peptide Sequence Number=SeqID_219499
atggctactagtgatcatgctatctgcgtgatagaactcatgaaagctggagttgctgcacatgatgtccaacgttatgtcaaggaatcagatcgggctgcacaatgcacaaggcaagataaaatgtcaaatgaagaattgaagctgcaggatccacgatgtcggatacaatgtccaggacatcctgcccgaaaatactggacacataaatctgttatatctttaacagattgtgcaggatccacgatgtcggatacaatgtccaggacatcttgcccgaaaatacttgacacataa

SEQ ID NO: 102722 - DNA, 453 bp, Glycine max
  Peptide Sequence Number=SeqID_219500
cgtgactcaaatgtcagtatgacagatcttgtgagcgcggaagatgacacaacaaaaatgaatgtctatacggataaccactcgggtatttccgcccgtcagcgtgactcaaatgtcagtataacagatcttgtgagcgcggaagatgacacagcaaaaaagaatgtttatacggataaccactcgggtatttccgcccgtcagcgtgactcaaatgtcagtataacagatcttgtgagcgcggaagatgacgcttttcgtcttacagacaacaaaaagaatgtttatacggataaccactcgggtattttcgcccgtcaacgtgactcaaatgtcagtatgacagatcttgtgagcgcggaagatgacacagcaaaaaagaatgtttatacggataaccactcgggtatttccgcccgtcagcgtgactcaaatgtccgtatgacagatctt

SEQ ID NO: 102723 - DNA, 108 bp, Glycine max
  Peptide Sequence Number=SeqID_219501
atggaggaagcacttgcgcatgcaccttctgatgtggagcaatctagacatgcagtggaggcttgtcaagcaatagcagaaaaaggttggagcgattgttcaacctaa

SEQ ID NO: 102724 - DNA, 195 bp, Glycine max
  Peptide Sequence Number=SeqID_219502
atggagcattgcctacgacacatggctgaccagcaggcgaccaagtccaaagccaaagatgttaaagaagtgctactagtaggaaatctagaattgcctacaaagaagctccccgcgaagcggtccaggaagggcaccattgaagaggattccagtgtggccccacaagccgacacgggctttgacaaacactga

SEQ ID NO: 102725 - DNA, 183 bp, Glycine max
  Peptide Sequence Number=SeqID_219503
gcaggcgcagaggcgaaacaccactatagcctgggagatggccggcagtgggcaacagacgcaccgccatcacctttagagttcacctctgctcatcccacaaaaggtttgagtatttcctacaccacatggccgaccaataggcgagcaagtccaaagccaaaggtagtgaaaataccttag

SEQ ID NO: 102726 - DNA, 1374 bp, Glycine max
  Peptide Sequence Number=SeqID_219504
atgggtgtagtgaggggggtgatattggatgaatcagtactcttggctgaaagtgatgatgataaaactgtatctttactccgaccaggagctgagtctctcatccaaacactcgttctatccagaacgcatagtggaattgctcatggtgttggccttccagatgacaaggttatggctggatggagtaatgctgatgatggcagtgttattatttatctgatttctaataagaaggagttcttacctaaattaagcagctataattggctggttgttgttctgaatgttggaggtgaaagttcatgtcacactccaaatatacttcagattgaaaacttagaggagttgccattgaccatatgccacttaaataaaagatcaattggaaccaatgctgtgactgtgggttatacaatgaagccttctcgtgtcgaagattttgcaaagaggggtgcatttcctttgtgtcctactcaaaatgggttgatgtttgttcctctcacatccaagcttccattatcatctcagttaaaggatgttgacatagttcttcacaaagccaccgatgaaatattatctgttgaagataataaaattacttttacacagaacatgcaagcattgcaaagatacttggatcagcaccaggatttctgtgttattgatccactgagtaatgtttatcctttattggacaggctagaaattcaacaatttctacttggcttggtggaactgaacactgaagggaaatatttgatcagaggggcccattttcttaaggttgataactttgatgaatttgattttgcaactggactagctgaagctagattgtctcttccatgtatagtgaaacctaaggttgcttgtggtgtcagtgatgcacacaagatggcaattgttttcagagtcgatgattttaagaatttaagtgttcctcttccaaatgttattcaggaatatgtggatcactcatccactttgtacaaattttatgtcttgggtgaaaagattttccatgctgtcaagaagtcaataccaaatgctgatattttgaggaaatcatctgatggtgatgagctcaaacctctactgtttgatagcttgaaatctatgccgaccgctgacagtatcacaagtaatgtgtccattgaccttaagctggttacagatgctgcaaattggcttaggagaaggcttcagcttaccatctttggttttgatgttgtaattcaggaaggtactcatgaccatgttattgtggatgtaaactatctcccatcatttaaggaagtgcctgatgacatctctattcctgccttttgggatgccattagaaataagtttgactctagggtgcctaaataa

SEQ ID NO: 102727 - DNA, 645 bp, Glycine max
  Peptide Sequence Number=SeqID_219505
atgggaaacgctatggggagtaaaaaagccaagataatgaaaatagacggtgaaacgttcaagctcaagactccagctagagcaaacgacgtcgttaaggactaccccggacacgttctcttggactctcacgcggtgaaaaacttcgggcctcgtgccaagccacttgagcctgactacgagctcaagcccaagaagatttatttcttggtggagttacccaaggttaagcccgaaccactaggaacaaggagggtgcgatccagtgggatccgtggaatgaacgcccaggataggctcgatttcttgatgctgtccaaacggagcgtttcggaccttactatggtgaagcatgggcctggcccagaaaatggtgggcccaccaggctcaaaatgaggctgcccaaggctcatttggagaggctcatggaggagagccacgacgggggcgaggtggccgagaaaatcataagtttgtatatggggaacaatgccgccgtggatggcagtggcgcaaccgtggaggctcacaatcgcaaaccaagaaggaaacgggtgagtttcagtccagtggaacaaggggaaattcatgaagaatcagcagctcctcaacagtcactagtttatagcagtccttctagatag

SEQ ID NO: 102728 - DNA, 522 bp, Glycine max
  Peptide Sequence Number=SeqID_219506
atggaggagcaagcagaatatgataatgatgaattggagaaagtgaatggtctactcacagaaaaggaaaaagagatacaagatttggaagctaagctggaattttatagatcaaacatggtagatgaggagcctatggtctataatatgagtatttacccaatggaagccttgaagatcgtctttcctgcaagaataacacccctccgttgccatggaaagctcgaattcgcattgctgctgaaactactgctgctcttgcagctgcttctatggagagctatccatgttttccagtttgccaataaatataagggaccctacagcaatggcttgaagcctattgtgtgccccttctattgttcttactctggttatcaacataacaaggctaccaagaacccaatgtacctaaactacattaaggttaatggacagacccttggagctgcagattctaacaatacctttggatgggataacaagcatgttggagcaaggataatgctttctaaggtctaa

SEQ ID NO: 102729 - DNA, 510 bp, Glycine max
  Peptide Sequence Number=SeqID_219507
atggcttctccaacaccgagtttgtggcctcaaaagcctacaatagtgttgttacttatatgcatttcattttcacattcatattctgttgaagaagcaataacatcttctaagaagttagaccaaccagtgtttcctccaccagcatacactgaaatcaagtgtggatcatgtccttgtggagacacctgtggtgagcaacttccaccaccaccacctcaaccatctcctgctcctcctcctccttgtctatcaccaccaccgccaccaccatcaccgccgcctcctaaaattccctcttgtccacagaattgcaaccccttgccaccaccaccaccaagatttgtatatgtgcctttgccaggtgtaccaaaaccatatacttgggtgtactattactctgctgctgaaaacagaggtgtggggttgattgttttggctggtttgggaggactctcaatggcaacactactcttggatgacatcttgaagctaaagctatatttctga

SEQ ID NO: 102730 - DNA, 1737 bp, Glycine max
  Peptide Sequence Number=SeqID_219508
atggaactatttgatgttttgttgattggtcgtagttttacttggattagtccagccaacacgacggcagattatgtctacaaagaaaatttgaagaagctaaagtttgagctgaaaaggtggaattatgatgcttttggtgatcttgaggaggcaaaaaggaggtcagccatgcaaataggcactttggatgatattgatgaggaaggtgattttaagacatccttcttccataatactgttaattggttcagaagggtgaatggtataaggggagtaaatgtcaatgatacatgggttgaggaccaattacgtttaaagcaagaagttaagaatttctttgaacaaaggtatatagaacatggggggccgaggatgtctttggaggaggaagacatcttgaaggtagtcaatgaatttcatcacaatggtactctaccgaggggtgtgaatgcaacttttgtgtctttgatccctaaaggcaaccctttggcaccattcctcttccttatggtggcagatggtctaggaggtttgatgagaatggctactgataaagacctctttgtcaggcccaaggtggttgtactcaaatgtttcaaaccggcctcaagtctgaaagacaacttctttaagagtaagttggctgaagttgcagtggcttcggatcttcaacaaagattggcagccattctaaatttttgggtgatggttattccattcatctacttggggataccagtggatccatcaagagttcccccacatcaagatgtgaaacttactaatgaaaggaagaaatgctttaaaagatactttgatgatgtggatgtaaggagacaagttaatttggagtttgcaaatttttctaatggaagagaagcctttcataatgttgactctttaagagataaaggtgaattggatgcaaaatcttggtggcttgctcatggtgcttatgcaccaacacttctaaaaattgcccttaagctacttgggaaaccatcttcatattcttgtgatggaaggagaatgtattgggttaattggaagaaagtgtgctcctcaaaggatttgggatgcctaggtatcaaggatttagagacttttaataatgcattattgtataagtggatgtggaggtttttggtagataataattcgacgtgggctaggacaattagagaaagggctaaagtctataaggatattttgttatctccttctacgtcacttggtggaagaatgttagcaagggagattgatggtttctctgtggggaaagcatatagtattatgaaaaatgtagtagatttggaggagaatggtttttataaacaattatgggcagttaaggctccctcaaaggttgttgcacttacctggataattgcccttaatagtgttttgactagggagaatttaagaaggaggggtatttctttagccaataatgatgtcacttgtgtgaggaagatgatccggccaaacccagttagttttgtggaaacccgtcgacctgaccgtcacttctcttcttcacgctcatcttcacgctcgatgccaccgttgcactgcgagggaagttgtcgcgccaaccttgttgccaataacgtggacgaagacgtcaacgatctgggaggggtcgaacttcggcggcattgtgaagcggtaatgatcgaagaggaagaggaaaaggtacaacaggaagagagggttatatatattggagattag

SEQ ID NO: 102731 - DNA, 1020 bp, Glycine max
  Peptide Sequence Number=SeqID_219509
atggcactggccaaagaccaaagaattccacgtgattcaagcatgagcagcaaggttcaaaactgtgttttcagtgagactagcgtggaggttacctccatgactgttcatagggtcaatgagtaccacaaatctgtgttagaagatcaggaagatggctcaccaactactaatggtctcagcaatgattcagctataacacattctcctcctctatgtggcagtgtcaaaggctatgcttataagggcacaaactatcagcttgaagaagcagaacctctgattaatttcaaagggtatagcaatctcatgcaaggtggtggatctttgcttagctttcagcagaacaagatggtccctaacaactgttacatgaaagaaaatggtcagaaagaggtttgtgtttgggagaataatttgcatcaaggccgtgaccattggaatcaaactagtccaagaaacactagagacatgcgcctggtagagaatgccaattgctttcaaacttctagtggctatatctccatagttaataatgccaaagagaaacaacatggccaaagttcatcagggttgctctacccagcaccaactattcctaatgctagtagcctccacaagttaggagcacaagaatcagttttgcaaaagcgcccttttatgggggagagcatgaaagctgccaagaagcaatgctcaattgagagcaaaacgaccaaacataattcaagcccatccaaggatcctcaaagtgtggctgccaagaatcgaagagagaggataagtgagcggttgaagatactacaagaactggtgcctaatggctccaaggttgatttggttactatgctggagaaagcaattagttatgtgaagtttcttcaactgcaagtgaaggttttggcaaccgatgaattttggcctgtccaaggtggaaaacctcctgatatttctcaagtaaaagaagtcatcgataccattctttcatcacaaaaagagagaagttcaagctcaaagtag

SEQ ID NO: 102732 - DNA, 840 bp, Glycine max
  Peptide Sequence Number=SeqID_219510
atggctctagagaacctacatgtaaaatttaaaacagaagaacgccctgttactcatgagaacactactttgtcaaaatctatcttacatgaatatgctgccaagctgaaggtggaaaagcctgcatacaacactgttcagctagaagggctgcttcctcttttcgtatcatctatgaccttccagggtacaacatacgttggtgatgcagctagaagcaaaaaagaggctgaacagttagcagcacgtaacgctattacgtcaattctagatggtgctacctcagggctactatatgagacaataaagtcgaaatatagtacttttggtgcagtcagatctaccaaatcggaatgcattaatgctagttcagcagtcgttgaacatgtaccatccctggttgcagttcctgtggctgctaatgggaatgagacaaaagttgcacttattgtgccttccttcaatcaggaatgtcagatgcgggaacatgtatcatccgttcaagccatcaccattactgaagttccaaatctgaatctccttccaggcccagaacagtctactgctggtgtttcatgtgaactgtccattggcattggttctggtgcattgtcaattggtgatgggtcacgtgaactgtctgttggtgatggttcaggttcaaaaaagcggaaaaggaacaagtcaaaggctaataagaagttgggattggaatatggggagaatgtgcttgctttagtggctatgttggcaattgaggcgttttctttgaacagaatcgcttcttattcagtggcacaggagcatgtgaaagtgattaatgatcattttgcagcatag

SEQ ID NO: 102733 - DNA, 147 bp, Glycine max
  Peptide Sequence Number=SeqID_219511
atgcagaggcgagaaactcggcttagcacgagagtacgtccacttagcgagacctccagattagaaaagctacaactctcgctaagcctggccctggccagctcagctaaaatgatgcatcttaagtacagaagagcatgcgcttag

SEQ ID NO: 102734 - DNA, 219 bp, Glycine max
  Peptide Sequence Number=SeqID_219512
atgggaaaaaaagtcgggagtgcaattgtgggttcttcttttttggttctgttgctgttggcttctttagtgattgctgatttagagaccttaccatggagaggtctgaggagtaacagaacagcaaagatgggaaagggaagtgtaactcatttacttaaaatggaaggttctggtcaagctaaggttttgaaatttgaagtaactttctggatttga

SEQ ID NO: 102735 - DNA, 390 bp, Glycine max
  Peptide Sequence Number=SeqID_219513
atgataagtgcaaaaagagaagtgtatgaattaaattgcagcaataacattattgagatgattggtttgaattcaaaggatggtagcaaagaagagaatgatttgagcggtttaagcagcaaggtgtcctcttcagctatgcttctaacacctcagagtgaggatgagatattgcaggccagcaatttgaagaacttcacattcaatgagctaagaactgctacaaggaactttcgtccggatagtatggtgggtgaaggcgggtttggttctgtgtttaaggggtggattgatgagcacacacttgcccctactaaaccagggacaggaatggtcattgctgtgaagagacttaaccaagaaagcaaccagggacacattgaatggttg

SEQ ID NO: 102736 - DNA, 303 bp, Glycine max
  Peptide Sequence Number=SeqID_219514
atgtcaacaagtgattacgagttaataaagattgagacgtttgttcttaaagtacgcatgaactgtcaaggatgtatcaacaaagtaaggaaagtactccaaaaagttgaaggtgtctgcaaagtagatattaatgcagaagagcagaaggcaattgtcacaggcattgtcgatccatccactttggtccagaagttagtcaaatttggaaaacatgcagagatatggaaagcaggacacaacggtcatcaggacaataaccaaactcaaataataaacggtcctagtgactctgaaaattag

SEQ ID NO: 102737 - DNA, 159 bp, Glycine max
  misc_feature (107)..(107): n is a, c, g, or t
  Peptide Sequence Number=SeqID_219515
atgttaaggagacactttccgacaaatccaattgatgcccttgactacagtaataaacagtttccatacacagatcagaagggaaaagtcatgaccagtacaacagnctatgttgaaaggagaaaggttagaccaagaggtttcaaggatcccaaataa

SEQ ID NO: 102738 - DNA, 186 bp, Glycine max
  Peptide Sequence Number=SeqID_219516
atgggaggcgccatgcgcgaattcctcgagtttcgtgcccttgaaaaacgaaatcggtcaaagacgacgaaaattggaatgaaaagcgaatgcggtgaggttgataaaactgagaatcagaagagaatgataaatctaccggaaaatgcgagtttgacaggaaaatctgaaattgaatcgttatga

SEQ ID NO: 102739 - DNA, 510 bp, Glycine max
  Peptide Sequence Number=SeqID_219517
atggaattcgttattcttctcggcaattggcaataccctttaatgtcattcttctcaggattctgtggcttgatatacggtgtgacgctgtctgtcaatgtgaataagtttaggtgtggatacccaacgtttaagggtcaggttttgaatggacagcaactctgggatctaatagaaggccttgaaggaaatgatttattgttctatactcacttgttaacaggttatattggttcagagtcttttctaaacactgtattgcaagttgtcaacaaacttcggtcaacaaacccaggtcttacatatgtatgtgatccagtgatgggtgatgaaggaaagctttatgttcctcaagagctagtatcagtctatcgtgagaaggttgtcccagtagcttcagtgttgactcccaaccagtttgaggcagaactactgacaggcttcaggattcagtctgaaggacatgggcgggaggcctgtaggcttctccatgcagctgggccttcaaag

SEQ ID NO: 102740 - DNA, 390 bp, Glycine max
  Peptide Sequence Number=SeqID_219518
atgaagaagaatggtgggtcagtggcatatgttagctttgggacagtggtgactccacctccacatgagattgtggcagtggcaaaagcattggaagtaagtggttttccctttctttggtctctcaagaagcatttgaaggatcttctgccaaaagggtttcttgagaggacaagtgagagtgggaaggttgtagcttgggccccacagactaaggttttgggacatggttctgtgggggtgtttgtgactgactgtgggtgtaactcgaaagtgagcgtgattgccactatagttaccaaatctcttggaagaagaaaattgttttcccagataaatagcttcattgttgtttttattcttgttggacaactgtccttgatgagttga

SEQ ID NO: 102741 - DNA, 390 bp, Glycine max
  Peptide Sequence Number=SeqID_219519
atggtcactacaagtagagactacattacaaaaggaaacaaggcagtcacatcttctcaaacaagaaaaaggacaatcacatcatcgaataacacaagcataacctacctaagtaaggttggaggtcgcagctgcttgttgttgtccacggttggactcccccaacttacgaatgatgaaatcaacccgaccgatggaaccctcccgacgctgggaaggttaaagtcgtcagaaggaatgaagaggctgtggaacagaatcaagcagggggcgaaagggcaagaggtgcttcaaccaacaggtgctgacactagggttagaagctacaaccaaggtttaagcgcgaaaggggaaagaggtgaggttcagcgcgaaagggaaaagaagtga

SEQ ID NO: 102742 - DNA, 200 bp, Glycine max
  Peptide Sequence Number=SeqID_219520
attttcaggaaagtgatagatctcatccagcacaagctgttgcagcccagatacgcacactgctatttaaacatgaaggctgcacggtgttttgtgagccaccttgatgtcaccttaacatcaagtgttggacctgagtgtgtagagttgatctctatagtgtgtggagttgatctctattgttcagagagcaatctctg

SEQ ID NO: 102743 - DNA, 312 bp, Glycine max
  Peptide Sequence Number=SeqID_219521
atgacaaagtggcggaattacgtgagttacgtgacgtcgagacacaacgctctgataggatgtggcattgggagattgtccaaggacataaagaccttggcccaggaagagctccttggtattttgaaggttcatgagaaagacccatgctgtgtgaagaggaaaggtgaatgtagatggaagaactacgtgaagaagtcctttatggataaggatttgaaggagaagagcaaggtaaggttcgggaggatttttgacctactacaaaccatgattgatagaaggattgtcatagatgggagtagtgattga

SEQ ID NO: 102744 - DNA, 210 bp, Glycine max
  Peptide Sequence Number=SeqID_219522
atggcttattccctagtggatgtagcctcctttcacctcttctccttctccattcagcttccattaaacttcaagaaccaaaggactccattgatgaagaagatccaaggcctacaagctccacacggagctacatcatgtggtatcagagcatcttcgtctaggttctatcattgttttagtcacaatcttcttgtgctgaacctttag

SEQ ID NO: 102745 - DNA, 196 bp, Glycine max
  Peptide Sequence Number=SeqID_219523
ggttcacgtcatatttttgagccgcctcgggatcctccacagcgccctaagaggactagaattgtatactgtagcaggctactccccgaaaatgaatgcctacggaaggtggggtaacctctccctcgctatccatccttcgccaattcgccttaacaaaataccttaccttaaagggctaccacgggatacgtga

SEQ ID NO: 102746 - DNA, 240 bp, Glycine max
  Peptide Sequence Number=SeqID_219524
atggcttccgcaaattctaatcctcctcctcctcctcctccaccaccaactttggtggctgatttttcttttccggcgaatgtgatggcgattccaattcctgtgtctgcaatgctgattcaaacagcgtttccacaacaggatctgacggctacacctacaggtgtgacaccccttcaggccaaagcttctagaaaaaaaggggcatggctagttaatattttcaagcataaaggttaa

SEQ ID NO: 102747 - DNA, 915 bp, Glycine max
  Peptide Sequence Number=SeqID_219525
atgccacctatagtagtcatgactcttgagagaaaaggaaagaaagcctcaagaggcaacattaacctcccatacttccatgggaaggacaatgtagaggcttacttagattggaaaataaaggtagagcaacaacttaaaagaaagtctacttcaaaatcttatggctctcactcttatccaaagaaagaccaaagtctaggcatcttaggggcggcaccttctaagcccaaagatgataaggggaagacaatagaaaagcaaccccctaaggctagtatgcaagagaagactagctctataaagtgctttaaatgtcttggaagaggacatattacttctcaatgccccaccaagagaactatgattatgaggggccaagacatttatagtatccaagatgaggctactacctcaccttcctctagtgatagtgaagaagcaaaaggggaaggatctagtgaagaaatctacccccaagaagaaagacaacctttaatggttaaggaggagtgtaaggaggtaagtgtctcctctaagaggttaactaagaaggaaagtcattttgcaataaaaacaaatattaaagaaacttcccctcttagacaacctccacatcttctactttgtaaaaaggcacttgttagcactaccacacctcttgggcttgatattattcctcaagtaaaggagttgttggatgagggtttggttcgtaagagcttaaatccttgtgctttgttggtgcccaaaataggtgttattaggcctcaaatccctaaaataggtgatatgatgaatgtgttgagtggtgcaaccctcttttataaaatcactcatgtgtccaacatcttcaagattcatgtagatagggacttattaggtaggttcatggttatcaaactctcgagttaa

SEQ ID NO: 102748 - DNA, 461 bp, Glycine max
  Peptide Sequence Number=SeqID_219526
atggcagctcgcccagacgagctaagacttagccatgaagcaactggctcgcccagggaaaacccgaacccgaaccaatacccggtcaactcgggtattacccgccaaagttgggatggattcaaacgggtacccatgggtacaagttttattaccatgtctaaggagcaccttaagtctagtagtagagtgataaggaaaaatggagttggatcatctggattcaagaaaagacatcaaaagaggattccttatggtagacctcaagatcgacaaagattcagaccttttcagcgacaaagtgcaccagtaactaaaggtaaccaagttgtttttcaagttggaggacggatgctcactgctatagatgtgtgtcgcaacctacccttcggcgggagggcgacgcgtgactcgcgggatgcgtgttccacgaaaggaatacgcgcggagtcgccaccaac

SEQ ID NO: 102749 - DNA, 273 bp, Glycine max
  Peptide Sequence Number=SeqID_219527
atggccaaaatacaaggcccaaaagaagagaaaacctattctaatatttacaaggatgagtggacccaaccttggtccatgggcttagaaatctaccccgaggttcatgagaaccctagggcttgctttagtagctctagcccaatcctcttggagtcttctatccaatacccttggggggtaggattgcatcagctaccttcatcccaaatgccttgttttgctataaataggcatgggaaggctgaagtaaaggatcctagagttcactga

SEQ ID NO: 102750 - DNA, 216 bp, Glycine max
  Peptide Sequence Number=SeqID_219528
atggttggagcattctcgcaaaacatcgtgaccctgactggtctccctatgatcttacttagtgagagtgacctgacaaacccattgtgtggtgtgtcttgttatgtactcctaagcgccccagggtggtttgtcactgacatgatgaataggtggatgactatgaagaacctcatgctagaggacacgggaacaccacgctctgataggatgtga

SEQ ID NO: 102751 - DNA, 624 bp, Glycine max
  Peptide Sequence Number=SeqID_219529
cagaagctcctggctgagaagaccaagaagaagctgcaggaagctgcacagttaggaagcgttgatggcatcatcgaccctccatccccggtcagacgccacgtgaagtggaagatgacctgcacgaagaagacatgggagatgacgactaaggccgcaaaggaaatcgctgagaagattgattcgtttgaggagcaggccacacagggatcgttcgtcccccatggacgtcaggatgttctggccgctgctattggacgtcctgagcaccctggacgtgtccgtgctactggagccgatatcagggaccagttagaggagtccatcacagagaaagtgacgaggcaggcacctcctgagcctctggttggtcctggtccctccggtcctcgggtgagcacaaaggggagttgtgttgatccctcaggaaacgatcctgagacgagtgactctgacaggtgcgacttgtacatagaagcagatcctgcccgcctggttgccttggggagagtttataagggatccactcttgttcataacactcctttgttgtctggccaagtaaaggtgagtgtggacgaggttaaagatgcagatgcttcagttcctgtactcactgcagag

SEQ ID NO: 102752 - DNA, 930 bp, Glycine max
  Peptide Sequence Number=SeqID_219530
atgttgtctctcaataatgctttcagtgatgatgagctagaggcttttgaccgtcgtgtacgggagggagctggcgtctctatagttgagtatgccgttgaacccaagttcgatggtttggcgattaccctaacctatgagcagggtttgtttgtgcaaggtgccacacgcggtgatggatataccggtgaaaatgtcacgcataaccttaaaaccatccgggcgattcctagccgtctcaatatgaccaatccaccagcgttgcttgaagtccgcggtgaggtcctcatgctaaaaaaggactttgaaaagcttaaccagcaacaggcggcggttggcggcaaattgtttgccaatccacgcaatgcggctgccggtagcctgcgccagctcgactctaatatcacagctaaacgccccttacatttttttgcttatggcttaggtgccagtgatggtgtcccagaactgcactctcatgccgaagccatgcaatatctggctgatttacgcttccctgtctctgtgctgcgaggggtaaaaaccggcgtgcaaggcttacgtgattattacgcggaaattggtgaaaaacgtaaggacttgccatttgatattgatggcgtcgtttacaaagtgaacgactttgacatgcaggaaactcttggatttgtgtcgcgcgcacctcgctgggcagtcgcccataaattcccggccgaagaagcgacgacagtggtcgaggatatcactgtacaagttggccgtaccggtgccattacgcccgtggccaggctgaagcctgtgttcgttggcggtgtaactgtcaccaatgctactctgcataatgaagatgagttacgccgtaaaaacattttgattggcgatacggtggtggtgaggcgggcaggggatgtcattcctgaagttgtgctg

SEQ ID NO: 102753 - DNA, 156 bp, Glycine max
  Peptide Sequence Number=SeqID_219531
atgaattacgttttggttcatgcatcctccacccacgagtttggagccatgcatagtgattgcttagtgcaattctccattctctacccctttttcggagccccatcaattgcgttttcgttcatgcatcctccgcccacgagtttggagccttgg

SEQ ID NO: 102754 - DNA, 256 bp, Glycine max
  Peptide Sequence Number=SeqID_219532
atgggtcatgaggatgataatgatgataataataacaataacaataaaaacaacaatagcaagaatgatgatgatggtcatggtggtgattatgttcatcaggaacttgtgtcctcactgcagcaacaaacggttacacgtgttcatcctagaacaagaggagaaagaggtggtataacacaaggacaacaaccaccaacaaatcaagtgcaacaagatgaaaaaccacaacacatatctaaaagaactcagtgtg

SEQ ID NO: 102755 - DNA, 156 bp, Glycine max
  Peptide Sequence Number=SeqID_219533
gcaagcaatttctggggcttcagactcgatggtggaggatgcatgaatgacaatcaattcgtggggctcgggataagatttgtgggtggaggatacaagaatagcgctacgcaagcaattcgtggggctccagactcgatggtggaggatgcatga

SEQ ID NO: 102756 - DNA, 309 bp, Glycine max
  Peptide Sequence Number=SeqID_219534
atgtatatgaatcatgaagatgttggatgcatgagtgattttacaaaagagggttgcaccactcaacacatttatcataccacatatcatagggatttagtgcctcataataccttttttgggcactgtcgcaacctacccttcggcgggaggacgacgcgagagctcatgggtgtgtcttccaagggaggaaaatgcacggagtcgccaccaacgtttattcgaggaaaacgtcgaaaaaatcagaaagggtgtttccctcgctcctacgtattcctcaattgtgataaggaaatcagaccaaagtag

SEQ ID NO: 102757 - DNA, 371 bp, Glycine max
  Peptide Sequence Number=SeqID_219535
ctcagttggaggtgggcaacaggggatggtgggtttatgcgtgctttgtggatgtggaaaacttgttgtgcaccatcgcccgaccgccacctagtaccacatgtgatggagtggtacctggagatatgtcgcgggggtcaggagaccttggggacgtcaggcgagctcctggcagtcaacagataaaaggaacaatgaccacaaagcgaggaggcttgtggtggctggccagctgtgaatcttgtgtgatatatggaggattgcctctggtaatcgattaccaagggcttgaaaaacgaggtcaggaagctaggagagcttctggtaatcgataccaagggaggaataggtcactggtaatcgattaccag

SEQ ID NO: 102758 - DNA, 461 bp, Glycine max
  Peptide Sequence Number=SeqID_219536
agagggtggttcggcagtttgggtacattcagatcgttcctccgccaccggttcgtgattcgttgacagatcatgtggtgcctacaggggagctctgtgtagttcctgggcaggtggtcccagacaacatggagtggttttttcagatttcgcacccttttgtgacaccgacggaggacattgttgagccgagacctgcgcctccccctccccctcatgatgatgacttcgttgagccacctgtccccgaggttccaatcgcgttggatctccctacgcattctatggttgattgcacaggatgtgtaaggattgctgagcatttggagcgggtcatcaacctcaggatggtgaatgaagggactgacttatatgatatcatggatctttgtctgaggatagctagaggtgacgacccagatgacagtcttaggccgcggcagagacgccgcataaattag

SEQ ID NO: 102759 - DNA, 147 bp, Glycine max
  Peptide Sequence Number=SeqID_219537
atgtggtcatatgcgcccttttcggagatgcggatatacccaagtgattatccgtacaaagagcaacatttgttgatcctaacccatgcatcaggtggcaggcatatatacccgagtgattatccgtacaaagacaacatctgttga

SEQ ID NO: 102760 - DNA, 660 bp, Glycine max
  Peptide Sequence Number=SeqID_219538
atgttgcgcttagcgccaccttcacgcttagcacgggaacctatcaagatctcatcctctgacgactttagttcatctgatagtgaggcaactccaactcccactccacaaccatccagtccaccaccagtgcagaccaagaagtctctctctttaatcaacatatccaagtttccattgcttggatccacatggagaaaatgctggagaccatgggtccaacaaactagagagaatattccttgcagaaagtttttagttgctttccccataggaaaacaacaatactactaccctgagagcaagatcatccagaacccgcatgtggaattcatcctaagacaacatgaggtagtgactccacctcaatggacaaagtgtgatcatatccatacttcatctactcaatatgcagctctacccccagatgccatagtacctctcggtactccatcatggactagaccaatgtatcccaacctagtcaaaatgtgtcctcaatggatgcctactagtacctccaaaaccatttgtccatcccctgtgccagttgagcagaagcaagaaatcacttcaagtgatccttatgacaaggcactaaggcttactctgtgtgacaccctctaccccgacatacatataattaagaaaaagatataa

SEQ ID NO: 102761 - DNA, 477 bp, Glycine max
  Peptide Sequence Number=SeqID_219539
atggagtaccgagaggtactatggcatctgggggatgaattccacatgcgggttctggatgatcttgctctcaggcattttctccatgtggatccaagcaatggaaacttggatatgttgattaaagagagagacttcttggtctgcactggtggtggactggatggttgtggagtgggagttggagttgcctcactatcagatgaactaaagtcgtcagaggatgagatcttgataggttcctttggggtcaaggacttgtgtccaacttatggagaatctggcaaggcatcagcatcaaggtcgcgcgctaagcgcaagattagtgcgttaagcgcagtaggtgtcttcagccaggctcaacgcacgactggtgctaagcctgaattcacttacccacaccaccgtgcctatttcgggaaaagagctctggaggcagtgttcgcttccggcaagtgcaccggatcgcacaagtag

SEQ ID NO: 102762 - DNA, 429 bp, Glycine max
  Peptide Sequence Number=SeqID_219540
atgaccactcttacacagatatggatgatgttgctacttagcaacattcctcccggcgaccacaatgccgatcttcccccacggaagtatcagttgggatcgcgcccgcatgacacccagtggacccgaagaagtccaacaggaccttggggggtgatgcccgcaagacacccaatggacctggagaattccaacagggtcctggggtttctagctctgattacaggcctctgtcagttctacaaagtgcttgtcgctcccagcaaggtcatcaggccccccactaaccgagctttcatcaagaagtactgcgcccccaggcaggcgcagggcgagacaccacaacagcctgaggttgaccagcagcgggcaacaggcacaccgccaccacctctagagttcacctcagctcatccacaaaaaggttag

SEQ ID NO: 102763 - DNA, 507 bp, Glycine max
  Peptide Sequence Number=SeqID_219541
atggcccacttggagctctcgattccatgggcgcgggctcaacagagcagccgcaccaactcgccccgggggctcccagctatcctgagggaaacttcggagggaacccagctactagacggttcgattagtctttcggcccctatacccaaagtcagacgaacgatttgcacgtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 102764 - DNA, 261 bp, Glycine max
  Peptide Sequence Number=SeqID_219542
atgaaccggaagctgggttacggtgcccaactgcgcgctaacctagaccccacaaagggtgttgctctcttaagccagcaggaccgtggtcatgcaagtcgaaatcccctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatgtgaacggcacttgcacatgg

SEQ ID NO: 102765 - DNA, 378 bp, Glycine max
  Peptide Sequence Number=SeqID_219543
atgcggagataccttatggttatccgcaccttttctcagccagaggcaagcgagcccgttgacacacagagactaacatcgtcatctgcacctttgtcatccagagacggcgagtccgatgacatgcggagataccttatggttatccgcaccttttctcagccagaggcaagtgagcccgttgacatgcagagactaacatcgtcatctgcacctttgtcatccagagacgacgagtctgatgacatgcggagataccttatggttatccgcaccttttctcagctagaggcaagcgagcctgttgacacgcatagactaacatcgtcatctgcacctttgtcatccagagacggcaagtccgatgatatgcggtga

SEQ ID NO: 102766 - DNA, 216 bp, Glycine max
  Peptide Sequence Number=SeqID_219544
atgcctccgccgatgaggaacagcacgcccatgatcgcgctgcccatgatcgccgtcagcatggtgccgacgaagaactctcggctcgtgatgctcatcgcctgcgagaacgggaacgtgagggtcatcgccgacatgccgacggcgaagaagtcccacagcggtgcctggccgcccccgccgtacttgggggtgtcgaccgggatcatcgcgtag

SEQ ID NO: 102767 - DNA, 1005 bp, Glycine max
  Peptide Sequence Number=SeqID_219545
atgcaagatatttctgcggcttatattttaggtggcgagcgcatatttgtgaccgtgagtattggtatcagccagtatcctgaagatgccgtcaatgccgaagaaatgattcagcatgcggaccaggcgatgtacgatgccaaaggccgtggccgtaatagcctgcggtttttttcgttggcaatccgtgatgccttgtcgcagcgcgtgagccttgcgcgcgatttgcgtacagcgcttgagaatggcgagttgcgcgattattaccagcctatcgtcaacttgcgtagcgggaaaaattgtgaaagcagaagcgttgatgcggtggcagcacccggaacgtggcctgatcagtcccggcactgtttattccagtggccgaagaaaccgggggatattaatgccatgggcgactggatttttaaccaggcggcgcaacatgcaacgcagtgggagtcactggtaagcgatgatgcttttgcgattagtgttaataaatcgccagtacagtttgttgagaaaatgagtgtccaaagtgactgggtacatgctttacgtagtatgggcgtggcaggtaaacgtattgttgtggaaattaccgaaggtttactcctcaacccggaccccgtggttgaagagcgattattacagtatcgggacatggggatacaggtggccattgatgattttggcactgggtattcctcactctcgtacctgagtaaattcgatattgattatctcaagattgaccaatcattcacgcgaaacttgaatgccggtaatgaaagttatgtgctgtgtgaagccattattgtgatggcgcacaaacttggcctcaaggtgattgccgagggggtggaaacggcgttgcagcgggatctgctgatcgctattcattgcgattatgcacaggggtttttctattctccgccggtcccggcagaggcttttgaacaaatgctggtacaacaatcacgtgaagagtcagctgctgccaattaa

SEQ ID NO: 102768 - DNA, 394 bp, Glycine max
  Peptide Sequence Number=SeqID_219546
atgattatgaggggccaagacacttatagtagccaagatgatgctactacttcaccttcctatagtgaaagtgaagaagcgaaaggggaagaatctagtgaagaaatctacctccaagaagaaggacaacctttaatggttaaggaggagtgtaaggaggtaagtgtctcctccaagaggttaggtaagaaggaaagtcattttaaaataaagacaaatattatagaaacttcccctcttagacaacctccacatcttctactttgtaaaaagacacttgttagcactaccacacctcttgggcttgatattattcctcaagtaaaggagttgttggatgagggtttgtttcataagagcttaaatccttgtgctttgttggtgcctaaaatag

SEQ ID NO: 102769 - DNA, 675 bp, Glycine max
  Peptide Sequence Number=SeqID_219547
atgaggaaaggcaagagtgaagcaaacactgaaaagaagaaggatactactctaaatgaaggcaaggaagtaccttatcctttggtaccttcccggaaagaaaaagaaagacatttagccatatttcttgacatcttcaagaagttggaaattactttaccctttggagaagcacttcaacaaatgcccctctatgccaaatttttaaaagatatgctgacaatgaagaactggtacatccatagtgacagaattgtggtagaaggcaattatagtgttgtgattcaacacagtcttccacctaagcacaaagatcctggagttgtcatgataccgtgttccattggtgaggtttttgtaggaaaagctctcatagacttgggagctagtatcaacttaatgcctctctccatgtgccagcgacttggagagatagagataatgcttacatgcatgacccttcagttggcagatcgctccataacaagaccgtatggagtgattgaacatgttttggtgaaggtgaaacaccttatatttccaactaattttgtggtgatagacatagaagaggatgctgatattcctctcattcatggtcgcccattcatgtctactgcaagctgtgtagtagatatgggaaagaagatgttgcaaatgggaatagaagattag

SEQ ID NO: 102770 - DNA, 648 bp, Glycine max
  Peptide Sequence Number=SeqID_219548
atggcgatcgccgcgcgcgccggcgtgcgctcggtgtcgatcgagcagatccacgccgcctacgccatgggcggcagccgcatgcagatcgtctggcacgtgatcctgaaggccgccatgcccgagatcttcaccggcatgcgcatcggcatcggcgtgggctggaccacgctggtcgccgccgagatggtggcagcggatcgcggcctgggcttcatggtgctgaacgctgcgcagttcctggccagcgacacggtcatcatgggcatcatcgtgatcggggtgttcgctttcgcctttgatctgctggtgcgggcggtcttaaccgaatctgcgctcgtttctgatccttatccgatccatccactcacagaacagaagtatgagcagcattacggtgaaggttatcagcgcatcctccgttgcactggtccgttcatattcaagtgttcttttcaagtatcccggcggaagttgactgactccttcgtgcaatatgtccgccactcgcctgacctccccaaacaccggggcagcttgtgcgaaccagacgaccttgaccgtcttcccctcaagatgaacatgccttgtgcgtccatcattgaagcagtcggggttggcgttcagatattgccctccgcagtgtag

SEQ ID NO: 102771 - DNA, 540 bp, Glycine max
  Peptide Sequence Number=SeqID_219549
atgaagaacttagatcagagtttgaacatctattttctcacaagacagattgttgaagctgttaataaagatgaaggtggtatgttttttctctatggatatggaggtacaggaaaaacatacatttggaaaaaacttgcaagttcactgagagctgacaataaaattgtaataatggtggcctctagcggcatagtttctctgctattgcctggaggtagaactgcacattcaaaatttaaaattccagttccagtttttgaagactcaacttgcaatatccatcaaggaactcaattagctgagctattaaatcagacaaatctaatcatttgggatgaagcacccatggctcacaaattctgttttgaggcacttgatcacagtcttagagatatcatcaaacacaactcaaaggacaatacaatctttggaggtaaagtcatggtctttggtggagatttccggaagatcctgccagtcattccaagaggcagccgcaataattccaaattgttatcttacttatatacattctaa

SEQ ID NO: 102772 - DNA, 378 bp, Glycine max
  Peptide Sequence Number=SeqID_219550
atgcggaggcaaaatttggtcattctgcaccctttgtcatccagaggcggcgggcccgatgacatgcggagacaaaatttggtcattctgcaccctttgtcatccagaggcggcgggctcgatgacatgcggagacaaatttggtcattccgcaccccttgccatttagacacagccgtgtccgatggcgcacagagacaaaattggtcattctgcaccctttgtcatccagaggcggcgggcccgatgacatgcggagacaaaatttggtcattccgcacccctttgccattcagacacagtcgtgtccgatggcgcgcagatacaaaatttggtcattctgcacccttcgtcaatcgcggccgacaagcccgttga

SEQ ID NO: 102773 - DNA, 457 bp, Glycine max
  Peptide Sequence Number=SeqID_219551
accaagggcaaggccagctgaggctccttctgcatcagcagctcctcatctagcttctgcatcagcagctcctcctctagctcgtattgcagcagctccttctaccttacctcctctggtagcacctccagactccatccctacagtagagcaatttaatgaatgggtagcctggccagggactcagcctcctcctcacatggacgatgaggatcccgccgctcagctaacacatcaatcagtagatgagtcatcagagtcatccactcctgagcccttgatcaggaagaggagggtagttgtaactccggaagtcgtagccactcctaaaaagtctcctgaggccactccaaagcctctggcaccaatggcagataccacttctccacagcaggcaacagatccttcaacgcctgaagatcaaaccacaccagtccagtctccaaacgcctctctt

SEQ ID NO: 102774 - DNA, 261 bp, Glycine max
  Peptide Sequence Number=SeqID_219552
atgggggataagcttcatcgtcgagagggaaacagcccggatcaccagctaaggcccctaaatgaccgctcagtgataaaggaggtaggggtgcagagacaaccaggaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggagggtga

SEQ ID NO: 102775 - DNA, 462 bp, Glycine max
  Peptide Sequence Number=SeqID_219553
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcaccaaagtcggactagagtcaagctcaacagggtcttctttccccgctga

SEQ ID NO: 102776 - DNA, 435 bp, Glycine max
  Peptide Sequence Number=SeqID_219554
atgtggaccaccacgggggaggagcttgccacccagctcgcccaggcgagcaaggttgcttcctccagaagcaacagccttctggaggaaggatctggaaggcccaagtggtgtttagcattggttgtgtggaaggtgggttttgtggttgatttagggatggactttgtggataactgggtggtgggtaaggagaagggttgttattggatgagtaatgacattgtttggctggtgggaagtttccatgtaggaacgacaatcgcagcatgggtttctccttcatctcaccctcttcctctagcctccttttccgcgtacactcgggcatactcgcccgccactttgtgctcatgggccgtggctagatttaattcttcttggtacttgctgacgatggctaacatgttggtctttgtctcgcataaatgctga

SEQ ID NO: 102777 - DNA, 474 bp, Glycine max
  misc_feature (376)..(376): n is a, c, g, or t
  Peptide Sequence Number=SeqID_219555
gcaactttaaccacagtagatctcccacctggaacttatgatcggttccgtctcggtcgtgcctttgcttctgttgcctctgcgttttctcctgagtatcagcaacctgcccatggagatgtaccgctgactgggttcaggacacaaccatcgtccgaaccgtcagctaccaagtcccatgggggcctttggttggaacccataacaaacttaaaaagcacttctgccggtcgacaaatgcgtgctccggttgtagcagtgttgaatgaacggcaggtttggaaccagaccggtgctcctcttcatttgttcccgttaacgaccacaaagcccttaactgctcctcctcgctacttgcccttttttactacaaagnccttctattttcctatcttcacccttcctactccagctaatggaaaaatgcctttgaatggtcgtaatcgtcgacaacccaaccgacgtccaccatag

SEQ ID NO: 102778 - DNA, 225 bp, Glycine max
  Peptide Sequence Number=SeqID_219556
atgggcaatcagagttcttgctctcctctccccgagggaacggaactagcactagaattccgagccacctatccatcggtctccttcttggcatcaagagtcgtcagtactgaaaaggccctggcattaccatcgggaaatctaggaggacagctcgccgagcctatggtggacgtcggttgggttgtcgacgattacgaccattcaaaggcatttttccattag

SEQ ID NO: 102779 - DNA, 360 bp, Glycine max
  Peptide Sequence Number=SeqID_219557
atgccaatctccccctacaaaagtatcagttggtctgtgtcgtcccgacatggggatcgcacccacaagacacccagtggacccggaaaagtccaacagggccctggggtttccagctctggttacgggcctctatcagtcctacagggtgcccgtaccccccagcaagggatcgcgcccacaggacacccggtggacccaaagaagtccaacagggtcctggggtttccagctctgattacgggcctctgtcagttctacggagtgcccgtcgccccaacaattaggccccgcattaaccggactttcatcaagaagtactgcgcccccagacgggcgcagggcgagacaccacagtag

SEQ ID NO: 102780 - DNA, 459 bp, Glycine max
  Peptide Sequence Number=SeqID_219558
atgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagccccgttcccttggctgtggtttcgctggatag

SEQ ID NO: 102781 - DNA, 213 bp, Glycine max
  Peptide Sequence Number=SeqID_219559
atggctcacgagtgcgtcatccaagggaggaaggctcgcggagtcgccaccaatgtttattcgaggtgtggtctacgaactttattcatgaaaggttcgggagttgtttttacgcatggggaagagtggtttcctcgctcttacatatcctcaattgcgatgagaaaatcagacctacgtagttcttgcgaaagcggtaaagttacatgttga

SEQ ID NO: 102782 - DNA, 327 bp, Glycine max
  Peptide Sequence Number=SeqID_219560
atggccatcgctgaagatattaatgacatgtcatttatcagtgcacaatcagctgaagtcacctcacatacaacagacaagggacatgatggctgggagaaggctgaaaatgaagtgacaagtttaaagaaacaagtccaggcactgactctcagaaattcaaaacttgaagatagagtcacctatctagacagtgcacttaaggagtttgttaggcagctaagacaaacaagagtgcaattgatgaatggacaacccagaagaaagcaaaccaccaaggtagaggtagaggtagaggtagaggtactcactatgccttgcaactaa

SEQ ID NO: 102783 - DNA, 531 bp, Glycine max
  Peptide Sequence Number=SeqID_219561
atgagtgaaatagaggaagtgcaagagcaaatgaaggctagcatggaggccatgaaagagcaaatgaccacaatgatggaagccatgatgagtatgagaaggatgatggaggtcaatgcagctatagtcgttgccgcaagtaccgccactgaggtggacccaactcacccatctaccctcaatcaagtccagagcaagcatcatttcccaccatatggcttgccttccaactatacgccactcaatgttgtacacactctcgatgagaatccttgcctcggatatgccactgaggggcaggcgtttggtggcatacccctgccaaacactttggggggccctcagtatcgcccacaaccacaacccttacattttgtggtggaaaaactgcctcctaccatggtagaaagggaaaattttgatcatatagaagaaaggttgagggtcatcaaaggaggcggaaattatgcctttgctgacatggcagagttgtgcctagtgcccgacgtgatcattcctctgaagttcaag

SEQ ID NO: 102784 - DNA, 216 bp, Glycine max
  Peptide Sequence Number=SeqID_219562
atgggggttcaaatagcaaccaggcccacttgggccttccaggatgttcctccagaaggcggttgcttctggaggaagcaacctagctcgcctgggcgagctggaatatccaagctgaggcgcttccgtaacgtttccgtgggtgatttcgcgacgattttcaaccgttcttcgacgttcttcgttcgttcttcgttgttcttcggtcttcaaccg

SEQ ID NO: 102785 - DNA, 231 bp, Glycine max
  Peptide Sequence Number=SeqID_219563
atgtcgagacgctcgaaattgaacaacggaagctctcgagaaattcaaatggtcataacttttcacacggaggtccgattaagcttttcccatggatgtccgattcgggcggataatatgtcgagacgctcgaaattgaacaacggaagctctcgagaaattcaaatagtcatagcttttcccatggatgtccgattcgggcgcataatatgtcgagacgctcgaaattga

SEQ ID NO: 102786 - DNA, 147 bp, Glycine max
  Peptide Sequence Number=SeqID_219564
atggagaattggcgaacagcgctacgcaataacttcgcggggctccagactcgaagaaaatggagaatttgcgaacagcgctacgcaataacttcgcggggctccagactcgaaggtggaggacacatgaacagcgctaggcaatga

SEQ ID NO: 102787 - DNA, 231 bp, Glycine max
  Peptide Sequence Number=SeqID_219565
atggcaacaacaacggtagctagaggcagagcaaggccaattgttgatattggacctccatttgaaggaggagaggccaaggttaaacttgttaacgatagtgcccaagtgataacactccctactcatctagaggcgataaagatcctgccgatgactcatcttggcattccgactgagacagaggctgtagcgacaataaatgcatgtgctagggtgaggttgacgtga

SEQ ID NO: 102788 - DNA, 201 bp, Glycine max
  Peptide Sequence Number=SeqID_219566
atgcgaaaaataccaaaaaaaggggcaaaaaggtcttttccttggttttcctggaccctagcgcaccaaggcttgcctctggctcgcctgggccaccaaatagcttcatggtttaagaaaccagctcgcctgggcaagctcactgcttcagggttaagtttcagcttgcctggtgatcgaggccgtacccgaatcaaataa

SEQ ID NO: 102789 - DNA, 516 bp, Glycine max
  Peptide Sequence Number=SeqID_219567
atgccagttggtctatgctatcctgacccagatcagtgttcatgtagcacaacttatcttggatgtcatctaccagtttataggtattgcacctccgagacacccagtggacccagagaagtccaacagggcactgggatttccagcattgatcacaggcctctaccagttctacggggcacaacagttggggtaagaccagcagcaaacgcaccaccactacctccacatcagccaccgtccctagaatccatctcagctcgcatgaaaaggatggagttgaaggataacttctatcagtatacactgcaccagcagcgccaggaccccaacctttacccgtggcctactcccgagctgttcagagccactgtcgcatggcctgaggaggatgtgatgcaatcctaccccgtaagggcattggttagaagactccaagtagattgggctagagatccaaggaaaggccctagggttctcatgagccttagggtagatttcgagcccatgggctaa

SEQ ID NO: 102790 - DNA, 246 bp, Glycine max
  Peptide Sequence Number=SeqID_219568
atggctgcggttcaaagaaatttcaacaagtttggaattaaagagatagccaaaattggaaagctgcttcttatccagatcttaaaggaagaacacctgctttgccattgtgggagcaaaaatatgaaacctgttgccaaacctgatacacttgtggggggagatgtttattctatagagccaccatatgattttatagtcaatcacgtacttgatgctcactggggtgtcctcaatgaagaagat

SEQ ID NO: 102791 - DNA, 204 bp, Glycine max
  Peptide Sequence Number=SeqID_219569
atgaggaaggtgaggcccaaacggattcttcggagtctaggccttggggctaaagatactcggtttgagtgctcctttaagcccatgttgatcccatgtggttggggcattctcgcaaaacagagtaaccctgactggtcaccttatgatgtgagccttcatatgatgagtcacatgctagagatggagagacttagtctgtga

SEQ ID NO: 102792 - DNA, 1545 bp, Glycine max
  Peptide Sequence Number=SeqID_219570
atgacaaagagaatacgtaaggattcttccttgccggaggatgtagagaaagtgaataatagctctgttgaattggatacaagggaaggagtgaatgatggttttcctagagctggagctggagcaaatgattcgcttcttcctggtcttttttatgatcttgcgctgaattgtcttgcttgggctagtagatctgattatgcttcactagcatggtgggaggtatttaaccccaagagaaatagatggataacattacctaagataccttgtcatgactattttaatcatccaggcaaggagtcctcggctgtggggagtgaaatgctgagttgtatggactcagattcaggtacatgggaactattgccaaacatgcatacaccacgtacattgtgctctggtttttttatggatggcaaatgctatgtgattgctagcatgtatccacttattgtttcattgacttgtggggatgagtatgatgttaagactagaaattggcggaaaatagaggaacatctaaccaacatggtgaataaatatgacaacgaaaggcacacctggagtgaattgggaaggcttccagtacgggctgattcttctaatggatggggcctggctttcaagggttgtggggagaaacttctggttatgagtggacaaaggggtccagaagggttcaggaatggaaccatagattggaaagtacttggtgtgaaggagcatcttcgagtgtttgtgtacaactatgctgttatgggatggtccggtgagatgcttttagattcacttagtagaagatttgctggtatctacaatctgacttcgctttcaggggattatgttgactctatggatgaattgttgcaaccattggttgatgaagcaaagttggttggttacagttgtagacgagaatggatctcagcaatggtaacctctttaaccacatacttggcaaaagaaattttccctagttacattagtcaagtagatgaagagagggttacaggaattcagtcatctgctatagtatcatggctacatctcattgatttgacgatagcttttgacaaaaggattaagtctttggtagaccattctgggatcacaagtttgaatgccttaaccgatgatgaaaaagtaattaaagttacaatttctatcaatgctgctcattactttgaatctgttctaaaggaatggtctgaggatgtctttttccttgagatgggaatggatgaggatgatcaaccagaaatggaaaacaattcaaataattatggtgaattgttgccagagagttccaaaaggtttattttttatgatgagatcaaaaagttagaagagttcaaaacacaatgggttgaaaagatttccctagtcattttcagaggttttgattgtcattctcgagattatgtgaataacaagaggcaatggctagagggtgaagaaggatggactatgtcaaagactctaatagaagccctggattatcttcaaagcaaaatgtcagtggtagaagaattgatcgattga

SEQ ID NO: 102793 - DNA, 402 bp, Glycine max
  Peptide Sequence Number=SeqID_219571
atggagataatgaaaaaaaagttgaaggaggcgatcaaaactgagttatcccaaatggccttacaacacttaccccttgtagacgcgcttgaccctaacgtattggctgcacgtgttaacacaaaaggaagttgtgttgaagctgttggaaatgttgtagctgaggagccttctgctgttgatgtcactactatgggcttgtacatagttggtgacgactatacacggctagtggccttgggaaaggtgtttgatagtgctggcatgatacacaatgttccttacgcagatgatgtggtcaaggtcagtgttgtaactatttacgacgatgacgtcagggtcccatttcccactgttcttatactgagaaatcactcaaaccaagatccttctagtgaatga

SEQ ID NO: 102794 - DNA, 1128 bp, Glycine max
  Peptide Sequence Number=SeqID_219572
atgagtgattcatctaaagaccctttgacaccttcacctgagaatatccatgtccaaactatgagccttggaccaaaacctgtagccatcccctacggtgtgaagcttaatggtgtaaattattctctttggtctcaagtcgttgagacctttgttgctagtcgtggtaaatttggttattcaataggaaaaactccaaatccctctacagatgatgcttcatatgacagatggagtatggagaatgatattgtgaaaggttggctcattggggctatggaacctgatttgatgaatttgtaccctgatgtcaatcaagctcaacaaaaggaaattgacgaagaacgtgtttacatctttttagctagtctagacgacttgtatgatcgtgttcgaagtgatattcttcatacggaaccttttcccaatccagacaacgcatttgttgttgtcaagagtgaggagcaaaggagaaatactatgttgcatagtcaagtgactcctagtgtgactatggaacctaaaactactctaactcagaatctacaagatattcctagaccacttcaaggcaatagatgggacagaatggaccaatcatatcacattcctgactattgtgagcctgaggcacttcagggcaagtttcagattccaattctcacccttgcaatgccaaagcagacgacttctaaaaaaggtgaaccaaagcccacagaaaatgtacaagacaccactctaccacaacctactacaactactagtaaagtggaagaagcaattgaagagaagaaaagtgtttcacctccaagccctgacttaaagacacaacaaaaaatggattttcaaatcctttcagaaccaattaaggatcaaaaggtgaaagaggaattggtgccaaaaccaacaccaccaccaagggtagcgacaatgcaaacatatgaaaagtctcaaaaggttcaagaggtggttgagtcaaaaccaacaacaacaatgctaaccaagggtgaaaaggagtttgaagcaaaaccaacaccaacaatgttgaccaaagtcaacacaactgaaaggcctcagaagggtatgctctgctttgatgcacctgagtttgagggagagaatggttga

SEQ ID NO: 102795 - DNA, 379 bp, Glycine max
  Peptide Sequence Number=SeqID_219573
atgaagaaaggaaaagcgagaaaggagaatgaagataggggagttggggaaggaggtgttgcttcggtcgaggtgaaagtgttatggaggttcgtcgtggtgattgtagcggtggttggttcggttgcgatgtcaatcggagatcaatggatgtatgacagtataatgtttgaagaagttgatatgaatgatgaaaatgaaaacgaagctggtctgaatgaagaagaacatgttgattgttctgatgtgttaaatacttctcaatgggctcgatcagtcgcttatgaaattggatttgtggcgatgattatgaagtcagacacaaacactgatataagaggaaggacttcatttgtgttaattggttgtgaaaggagtg

SEQ ID NO: 102796 - DNA, 579 bp, Glycine max
  Peptide Sequence Number=SeqID_219574
atggcagaattgtacctaatgcccaatgtcgttatccctctgaagttcaaggtgtcgaattacgataaatacaaggggactacctgccctaagaatcaccttaagatgtacaacaagaaaatgggggcatactcgaaaaatgaaaatttgttgatgcatttcttccaggaaagtcttactggggcaactgtcacttggcagtatcactacaattctgatatggctacggataaaatgcgactacagaacgtgtgtaaaaaggagcacgaatctttcaaagaatacatccaaagatggagggatctggcagctcaagtagtgcccccaatgatggagagggagatgataacaatgatagtagacacgttactggtgttttactatgagaagatggtgggttacatgccttcaagcttttccgattttgttttcactgggaaaaagatcgaagtgggtctgagaagaggcaaatttgattatcctactttgatgaataggaagcctggggcaaatggagagaataagaaggagggagaaacccatgctgatgtaatcctaccccccaagggcattggataa

SEQ ID NO: 102797 - DNA, 256 bp, Glycine max
  Peptide Sequence Number=SeqID_219575
tgggctaactgcgcatccaccgctaagcacaacttcaactcgcttagtgtggcagaagaatctggtagggcgtcaatatcaaggccacaggctaacgcacgactggcgctaagctcaaatccacttactcgcgctaagcgcgaggaattagggtacaacaataacaacaataagaacatcaggaacaactttaacaagggtccagggaaagagctctcgaggcagcaagaggagcaacttttgcagagatacctag

SEQ ID NO: 102798 - DNA, 147 bp, Glycine max
  Peptide Sequence Number=SeqID_219576
atggtctactatgccccttggacagaattcaaaaagaggaggagtaacgctattcatcccttaatgaagaagcagaaccatcaaaagaacactagacaagaagctgaattgctaccactagccatgcaagagcaaggaagcaaagag

SEQ ID NO: 102799 - DNA, 781 bp, Glycine max
  Peptide Sequence Number=SeqID_219577
gtcgactcctagaggatcccacaccatcgggcttcagcagtcgctgcagcgtggccatgtaggtgtccaggtattcggcgccgatcgcttcgatcatctcgatcgataccagcttgtcgaactggccctgcaggtcgcggtagtcctgcatcagcagcgtgacatggtcctgcaggcccgctgcctgcacgcgctgggcagccagcgcgtgctgctcggcggagatggtggtggtggtgacgtggcagccgtagtgctgcgcggcgtgcagcgcaaaaccaccccagccggtgccgatctccaccacgcgatcgcccggcttgagctggagttgctggcagatgcggtccagcttgcggcgcgaggcggactccagcgattcggattcgccggtgaacagcgccgacgaatacatcaggtcaggcgacaggaacagggcgaagaaatcgttgcccaggtcgtagtgggcggcgatgttgcgccggctgccctcacggctgttgcggtgcagccggttccatccgcgcagcagccagccagccacacgggccgggccctgctccatgccgtccagcagttcgcggttgcgtaccagcagttgtatcagggcaaccagatcatcgcagtgccactcgccctggatgtagctctcgccggcgccgacgctgccctgcgcagcgaccttccggtagaacgcggggtcatcgatggtcaccgttacctgcagccctgcgtgggcgttgcccagccggacctcgccaagggcatcgcgcacgcacag

SEQ ID NO: 102800 - DNA, 189 bp, Glycine max
  Peptide Sequence Number=SeqID_219578
ggaacaaaaggtgcagaagacgatgtcagtctctgcatgctatcaagtgttctgtcttacagacagcaaaagaatgtttatacggataaccactcgggtatttccgcccgtcagcgtgactcaaaagtcagtatgacagatcttgtgagcgcggaagatgatgacacgactgtgtctgaatggcaaaag

SEQ ID NO: 102801 - DNA, 462 bp, Glycine max
  Peptide Sequence Number=SeqID_219579
atgacatgcggagaaaaattatggtcattctgcacaccttttgccattcagacacagtcgtgtccgatggcacgcagagacaaattatggtcattctgcacccttttgtcatccagaggcggcgagcccgatgacatgctggagacaaattatggtcattccgcacaccttttgccattcagacacagtcgtgtccgatggtacgcagagacaaattatggtcattctgcacccttttgtcatccagaggcggcgggcccgatgacatgcggagacaaattatggtcattccgcacaccttttgccattcagacacagtcgtgtcctatggcacgcagagacaaattatggtcattctgcacccttttgtcatccagaggcggcgggcccgatgacacgcggagatttacatcatcttccgcgctcacaagatctgtcatactgacttttgagtcacgctga

SEQ ID NO: 102802 - DNA, 267 bp, Glycine max
  Peptide Sequence Number=SeqID_219580
atgaggtacgaagacctctggccatccttcgtcgccaacctgatggctatgatatctcccagaaggatctaccagcctcctttcccaaagtggtataaccctaacgcaacctgcgcataccatgtgtcgcaacctacccttcgatgggagggcgatgcagggctcgcaggtgcgtcttccatgggaggaaaatgtgcggagtcgccaccaacgtttattcgaggaaaacgtcggaaaaatcagaaaggtgtggtctacgaactttaa

SEQ ID NO: 102803 - DNA, 387 bp, Glycine max
  Peptide Sequence Number=SeqID_219581
atggaaaagaaaaaagagagtaaaagaagaaaagagatgagagaagaagaaagaagagttgtacaaaaagatgaaagggcaaagcaatttggagaagaggtggatacatatgaggaacaaggcaaccattgggggatgaaacctttaactcacaccatctctaagccttatgctttggttgatgtggaacaacatttgttaattcttgacttgcatgatacttttgatttgcataatattttagatttgcatgattttgttctagttaaccaatatgattcaaggatgaatcactttgaaaagggagagaatgatatgaacctgtcaaaggggcccaattatgatgaaagcttgcttgtggagcttctatggaggctggatctttga

SEQ ID NO: 102804 - DNA, 234 bp, Glycine max
  Peptide Sequence Number=SeqID_219582
atgacgtatgaggcagcaaagcaaattacaaacaggattgatgtattgactactggcattggacaacctgagcaccctggtcgtgtccgtgctattgaagtcagtatcacaatcaaacactactttggatcggcttcaaggggatcccacacctcttcatccatggctcctcaagaattagagcagctgacacacaaaattagagaccagctaaaggagtttatgagggtttga

SEQ ID NO: 102805 - DNA, 270 bp, Glycine max
  Peptide Sequence Number=SeqID_219583
atgctcaaaagacaaaagaaagtgctagaaaaggagactcaacttctcttggcccaaacagaattgaacaacataaagaaacagctacaaagtgctgagaacacaaaatccaaaactctttctgagcttgataaggccaaagtgacacttcaggaactgagaaagaagctcaacggtgttagggaatctaagcaatcagcaatagaagctgctgaagttgtgaacaataggccaaacaacttgagcaggcactatcccaaaaagctatag

SEQ ID NO: 102806 - DNA, 192 bp, Glycine max
  Peptide Sequence Number=SeqID_219584
atgtgggttccgtggggttcgagtgacgacaatggggtactgtgggttcgagcgacgacaatgtggatgtcgagggagcggtttccgacagatttcaggcgggaggagaaagagaagagcgatttcaggcgggaggagaaagagaagagcgatttcaggccggaggatgaccaagagaagagggagggcaag

SEQ ID NO: 102807 - DNA, 210 bp, Glycine max
  Peptide Sequence Number=SeqID_219585
atggcgtgctggttgcgtactgcagagagcgagaaccctaggttggttgtgtacacacgttggcgtcaatggcgaccacaaaggagcccaggtggtggagggaaaaccgatgttaacaacatggttaacattagttttaggaaaaccaatgtcgctagaggcagtttaacttcagttttaggaaaactgatgttgttagaagcagtttaa

SEQ ID NO: 102808 - DNA, 1089 bp, Glycine max
  Peptide Sequence Number=SeqID_219586
atgagtgaaatagaggaggtgcaagagcagatgaaggccgacatgaaggtcatgaaagagcaaatggccacaacaatggaagccatgatgagtataaaaaaaatgatggaggtcaacacggctacagtcgttgtcaccactgagggtagggaggtgaagcatttggaagtacgggcggttctcattttgtgcaagttcagaacaagcattccttcccaccatatggcttgcctcccaactatacaccacccaatgttgcacacactcccaatgaggatgtcgataactctgcacccatactcattgagagccagcaaccccaatctgatcatgcacatgtctctcaacccatgggggagacacatgaagcaccccgagaccacgctttggccgactccaagccttgccttagatatgctactgagaggcaagcatttggtggcagtccctcctgcgatggtggaaagggatgaatttaattatatagaggaaaggctaaaggtcattgaaggaggcgaaaattatgcctttgctaacatggcaaagttgtgtcgagtgcctgacatggtcattcctccaaagttgaaggtgtcggactttgataagtacaaggggactacttgccccaagaatcacctaaagatgtacggcaagaaaatgggggcatatgtgaaaaatgaaaaattgttgatgcatttcttccatgaaaatcttactggagcagccgtcacctggtatactaatttggaagcctcccgagtccattcttggaaggacctaatggttgccttcattaggcagtatcagtacaattctgatatggctccgaatagaatgcagctacataacatgtctaagaatgagcatgaatctttcatcggcaaaaggatagaagtgggtttgagaataggcaaatttgattatcctacttggatgaataggaagcctggggaaaatggagagaatgagaaggagggagaaacccatgttgtggctgtcgttcctacatggccaaatttcccattagcccaacaatatcaatactcagccaatatcagcccttctcattacccacctgtcataccctaa

SEQ ID NO: 102809 - DNA, 402 bp, Glycine max
  Peptide Sequence Number=SeqID_219587
atgaaactgttactttcatggatcaagttgatccgtaaacagcccaacaaattcccgatagcggtttccgccatcgccggcaacaatgatggaagaagcaaaaacgtgaaggagaaacgtacctcaaagaagaagcagaaacgcgaagaagaagccttcctcctaatcctggcaacaatggcggcaacgaagatgaagaagaagccttcacttgggaagaagatgcagaatcgcggcgcgaagaagaagaagaacgaagaagatgcagaatctcgaaatagaagcagaagaatgaagaagcagaagaagaagcagaagcagaagcagaaccgtccgaggaaggaagaagaagcaggcgggggagagagagaggcgagagttattttttttaaaaattcctga

SEQ ID NO: 102810 - DNA, 136 bp, Glycine max
  Peptide Sequence Number=SeqID_219588
atgccaacgtcatcacgtcagctcggcggctcctcaccagaatcttactccctgcaccctgctgctgtcattctgctcccacaaacaaggttcgcgatcatcacaagtatcacccacacgatacaaaattgcgagg

SEQ ID NO: 102811 - DNA, 747 bp, Glycine max
  Peptide Sequence Number=SeqID_219589
atgtatatgttgttgaggtttatccaaaacaaaagtagatgtggaaattggaatagccaaagccatagccatacggcagtacccacccttgcagtgttgactatgctgctagctcaacccattttcctctctcgcaactttcccactctcaacaaccgaaactcgagaacttctcttcaacttcacaaccctcctgcactcataagagtttcaccgcaaagaacgccaataatagcctcttctggttgttttggttgcttcgtaaaaccgcttgatgtcagaaccaaaacctcgctgggtgcgttttttaagaaaagaaagggttgtgcacatatttgccatagtttgaaggaagagagcgaggttggtgggaatggcaataatggaagagactggacgacctccattttgctctttctactgtgggctgcgctaatgtactatgttttctttctcaccccaaaccagaccccgctggacagagtaaaatcaaactcagttttaaaatgcccgagtaacattagaatcttcaatatgtcaagggacacgtatttcttgaaaaagctcctgaatctgaaaggagatgatggtttcagaatgaatgaagtgctagtatcattgtggtatttaatgggcttgtggccattggtatatagcatgctcttgcttccaaccggaagaaggcttcttaaacaggatcggtattttgaatcaaggttgtcaaaccaagattcaaattatgaatag

SEQ ID NO: 102812 - DNA, 792 bp, Glycine max
  Peptide Sequence Number=SeqID_219590
atggtgattcctgaaaattatgaagaaaatggaagacaaccagagccaacacctaatgaactagaatcatctaggaggccccagatgaatcctcaactaccagccatattgcaggattgtgtcatgtttaatgatgatgacccatttgatgaggagactatcaattttgctttattttcagattgtgagccattgacatttgaagaatcctcgagtgatgataattggagaaaagccatggatgatgagattcatgctataaagaagaatgatacatgggagttaacaaatttgccaacaaataaaaggcatattggagtgaagtgggtggacaagacaaagtacaatcccaatggagaaattaattgctttaaagcaaggttggttgcaaaaggatataaacaaaagccaggtactctgaccaacggaattttttatgccaacaataatgatgtggagcttgttagatacacagattgtgattggggaggagatatagaaacaagaaaaagcacgtcagggtacacatttcatctaggtgcaagtgcagtatcatggtattcaaagaaacaaccaattatagcactttcaacaactgaagttgaatatattgcagcaactagctgtgccacgcaagtagtgtggatgagaagaattttagaagtgatgcatgataagcataacactctcaggaaaatattttgcgacaacaagtttgccatggcattaagtaaaaatctagtttttcatggaagatccaagcacattgatattcgatatcacaagatttga

SEQ ID NO: 102813 - DNA, 201 bp, Glycine max
  Peptide Sequence Number=SeqID_219591
atggcggagacgaagacgaagaggaacttacctcgacaatgccgacgcgaggatgcagcaacaccaccgtcaacacccacgaagaagaagacgaacgaaggtcacgaagaagacgaagaacacgcgattggaaggtcacgaagaagacgcagaaaaagatcgtgctcaagtttttttgagaggaagaagaaggaagaatga

SEQ ID NO: 102814 - DNA, 276 bp, Glycine max
  Peptide Sequence Number=SeqID_219592
atggaatttttcctagagttacttgagcacttagattatgattgggtaaataatgtcacagaagcaatattgctgtttcttagaaactggatctcatctagtaaaaatgtaggagtctgtgaaatggccactgttgataatgatggccgcaggagaaggtataaaccaggccctaaaaatggtatcaatgatatgggaaggagccaagaacctttgtcaaacctgcatattgaactagcattaaaatatatgctagattgtcatttatataactag

SEQ ID NO: 102815 - DNA, 405 bp, Glycine max
  Peptide Sequence Number=SeqID_219593
atggtcgaatacctactagttgccatcaactacttcaccaaatggattgaggcaaggccgttatgtgaaatctcagtttgcgaaaccactggtcaagcggaggcagcaaaaagagttatcctcagggccttgcgcaccaaaatcgacaagcccaaggacaacaaccaacgaacctccttatcgactcacatagggcacagacgccataatccccgtcaaagtcggggaaccattcataaggagattgttgttctaagaacaacacaacgaaaagcacatgagggtagaactaaagacataggacaaggtccaagagatgacctgaatccaagaaaaggccacccaacttcgaccgacagggagatacaataccaaggttcaatctcgagcctttcaacctggtga

SEQ ID NO: 102816 - DNA, 408 bp, Glycine max
  Peptide Sequence Number=SeqID_219594
atgaagacacgattcatgacaaaatttctggcagaatttactggcaatgaccaaacaaccccagactggtggaaactctatgtggacggtgcgcccaacgtgaagggaagcggggcaagtatcatcctcgaaggccctaacaatgtcactttacaacaagctctcaagttcaacttcaaggcctcaaaataccaggccaaatataaggcacttataatgaactgcatacccaaggagagcaacaccaaagcagacctgctcccaaagctagttagcaccaaaaagactggacattgtggaagcaagactacaagagattttgatgatgccaacattcaagtgttcttcatggataattcaagtgaacttcaagaaatccaagaaatacaagttacatctacaagttag

SEQ ID NO: 102817 - DNA, 480 bp, Glycine max
  Peptide Sequence Number=SeqID_219595
atgggacttgatgacaatgtcgtcgatgtagagctcgacatttattttggtctggtgtttgaagacccgatccatcagtctttggcatccaggaaactcagtacgtggaacttggatgttccatcgactagcctatcgatgttgagcaaatggacgtcagctatgcatctgtgctcgtggctagtaaggtctctgttaagctgcgtacattgctcgggtttagcctctagtctttactctttctcctgcaaagctgaggagtggatcggagtgagactagacggtatcaggcgagacttcaagcctatggaatgtcttccagtaaaggatgtctatggagctaccttggtcaatgaggaccttgaacaccatgaaattggtgatcacgatggagataaccatggggttgtcctggttgatagggttgatacactagaagtctctatcaatgaaaatgataggaaagagattttatggtga

SEQ ID NO: 102818 - DNA, 339 bp, Glycine max
  Peptide Sequence Number=SeqID_219596
atggatgttgtcaggaagggtgcatggaacattggaaaaatcttggcatcgcctgcacctctttgtaaagtcgagggaatcggccctgagtgtcagccactagtagtcgacacgtaccactttggttgcaacagagcatccttcgatgtggaagccatagatcccttcatgaagttcttacatgacatagtcttcttgttggttgttcagacatttgagggtcatctagtttggtttctccccttctcctgccataacctccttggtgtctatggtgggagtttgaagtgtttcctagatgatggttttgagatgtctgttagacaagtggcctcataa

SEQ ID NO: 102819 - DNA, 279 bp, Glycine max
  Peptide Sequence Number=SeqID_219597
atggacgagttaggcaaacgagtcaaagtctatatccaaattgaggagatgtcaaggttcagagacgaggagcgagacccggaggacaccaagaagatcagcacagaaacaacaatgttgacagaagaagggacagagcaaaagatcaaggaagacattggcaccactagcaaagacgcgagcgacaacctccgcaagaacagaaaaatgagcccgctaacaaatcagaggtgttatcaacaccattgcaggcaaattttcctatggagggtagtctag

SEQ ID NO: 102820 - DNA, 501 bp, Glycine max
  Peptide Sequence Number=SeqID_219598
atgcaacagggacaggcagttattctcatagctaggttccctgaccctaagtatggtgttaaaatgggtttttcaaaggaagcacaaaacataccatggtggttccaaagtcagaaaagatgcaaagacaagctgaaactaccaaggaacaagcatagaatcatggttacctcaaggaaaatcacgaaggtgatggagaaagtgcttgggatgttggaaatggttttggaagaaaggaggagaaggaaatggcgtttttccaaggctacacgaaaagcaaaggttgaaacacttaagtgcttctgctcgcgggaaaggaagccttcctcagatgccagacattgtatcagagatcgcaacggtcatatcgtggacatctatcaaatgaacccccagaccaaatttcgagaagatccaacagttaacgaaggctgggaagcgtttttaccgagacagcttcatgtagcttgcttgagaagcttcattaagaggctttcttga

SEQ ID NO: 102821 - DNA, 186 bp, Glycine max
  Peptide Sequence Number=SeqID_219599
atggagaattggcgaagagcgctacgcaataacttcgcggggctccagactcgttggtggaggatgcatgaagagcgccaggcaatgacattcatggggctccgtaaaaaacgacaggcaatgacattcatggggctccgtaaaaaagtggagcatggagaattggcgaacagcgctacgcaataa

SEQ ID NO: 102822 - DNA, 276 bp, Glycine max
  Peptide Sequence Number=SeqID_219600
atggttcatcaagtcaagttgaatcatggaggtgaccatcttgcgaaaattggggcaaaagatgaatcgagttacatcgctgcttgtctactaccaaacacatttaggattgttgatgtccttgttactttcagtttcaccttgacaaagatgtcatggaccatgaaaagaacaggctttacgggcgccctttaccgaacccgtgctagagctagagtaatggggaaaagtggaggaggtacaagagaagatgaagggtcgacatggaggccatga

SEQ ID NO: 102823 - DNA, 288 bp, Glycine max
  Peptide Sequence Number=SeqID_219601
atggagttcctcctccgtagtttcgtccttgattccgtcatcaagaaaaccctaaccgccctccctctctcccccgcctcaagaaaactctcctcctccgcaccctccaaaccctcttccgtacaaccacagtttagacaagaagcgtgggatctctggtttctaaaattcctatggtgtggagcgtttgagagattctttttttgtctctttctctttgttctggatgaggagcatgctgaattttgtggaggagaagtttttgtgctagcgaggtggtttttatga

SEQ ID NO: 102824 - DNA, 459 bp, Glycine max
  Peptide Sequence Number=SeqID_219602
atggaagggttagtggacctagcagcgattgacgctttcttcgcctttcatcatggcaaggaaagcccggtcgtcgccattgtggccatgattctatcttcatgcgaaggatgtcccatgagaggagtgccatcagacgaaagcatcacgcctttcatcgcacgaggtttcagtgaccacaacgcgagggtactccaaggagttcgcaaggcatgggatgcagcagttcgaacacaaggactggattggctcccaaatctaaagactgtgagagacgatgaggttaaagcttcggaagaaagtgatgaggtacaagtcctaaaggcagagcttgaaagagcctgggtagtcgaagagaagttcaaggcagcaatagtgagctcaaactccgaagaggtgaaaggaatcatcacgggtcaaaggcatgatctggaaggacgagctaaaggcttgccttag

SEQ ID NO: 102825 - DNA, 438 bp, Glycine max
  Peptide Sequence Number=SeqID_219603
atgaaaagagaaaaacatgcctcctattgtagtcataactcttgcaagagcctaagtgaagaacttcgtgactattacgaaggaatgcataggtcacatcttagacctcactcccatagaagagaaaaggaaagaaagcctcaagaggctaacattaacctgtcatacttccatgggaaggacaatgtagaggctaacttagattgggaaataagggtagagcaacaacttaaaaagaagtctacatcaaaatcttatggctctcactcttatccaaagaaaagaccaagaggacacattacttctcaatgccccaccacaaaaaccatgattatgacgggccaagacatttatagtagccaagataaggctactacttcaccttcctctagtgaaagtgaagaagcaaaaggggaagaatctagtgaagaattctaa

SEQ ID NO: 102826 - DNA, 372 bp, Glycine max
  Peptide Sequence Number=SeqID_219604
atgggtgagagtagtgagctggcagagaaagaaaaaggaggagagagagaattagttactgatcatgggaaaagggttcaaatagctgatgggcagggtcgtggattttgcatcagaaactaccaatctctccttgcagtacaatctgcctttgttgagactgaatccattatgagcacagggatcagacaacaattcctgcattatcttcctcagcttgtcatcttggtgttcttctgtcttcttccaaacagtccaactcataaacttgcacggccaaaagggctgaatattgcagtcagcaggaaagaacatttgctgtgtattcccaattcccagcttctacttgatttcaaagttgaatctcaatag

SEQ ID NO: 102827 - DNA, 2283 bp, Glycine max
  Peptide Sequence Number=SeqID_219605
atgtgtacatggcagattctctccaactccccaaataatttccactggcaacgcatcaccaccaccaccacccaccaacacgcttcacctccctcctttcccctcccttccatgcaagatcttcttcgccagggggaagagcgcgtgctagatgatggtttcgggttctcgaattcccttttcacgaccggctctgggaaaaaagttaccatatcttccagcggtctggttagggcaaagacactactagacactattgacagtagtatccaaagtcctcaccgtacgaataaattgcacgcgattggcgaaaaacgaaagcaacgacaagaggaagaagatgaatcgcctcaattaaagctgcatagagttatagacagtccttctgtaggtggtggttgtcgagcattgaagaagaatggttttgaagaaacagatgcatacaagcaggctccaattaaattccacactgcaggtggaaggtctatatccatttccaaggacgcgctgcagcgtgctcagagccttcttggcgacgtgggagatttgtttgagggaggggatgctggcagttcgatgttttcgtttccgtttgagaggcaagcggacacggctgcctctagtcaaagaggggattgtaacactcctttggttcgtcgggttttgacaccggcgaggagcaattgtacggcaaagagtttcacttttcccttacagtcttctagacaaagagaattgccgcccaagtttccttgtgaaggtgatgggaataacttaataacggaatttgatgctgttggtgaagagagtggttataatagcttgaaaagtaccaatgcttgtggacagaagaaacctctgtatggctggaaccaagcaccacattcagcagtacatgattcttcattgaatggtttttcttcaaaaatagatacacacgctgtatcaatacgcaggccattggttgatgtttccaataccactaacccagatcaaacaaacaataggcaacctgctagtggaaaacggagattaggattgcgtgtaactgtttctccctttaaaaagcctcgaagttcccaaatttctgttcctttagaacaggatattggaaaatctcctcatgatttgtctcaattgtcctctggtgtttctggatgcaaaagagaggtttctatccgatatccatttcagtatccaaggatgcacatcaaggatttttttgttgtgcctccattacaggagaaagcgcattttcccaacctgagcaggcaggtcacatcagttaatgcagaaaagtatgtgttttatgaaagatctggtgataatggtatgggagcagaagcttttgtccatctattggctcaccatggagcttccatgcattttgctactaaagagtgggtcacgaatcattacaagtggattgtttggaaattggcatgctatgagagatactatccagctagttctgctggaaagtttttgactgtaacaaatgtgctcgaggaactgaagtacagatatgagagagaagtgaatcatggccaccggtctaccatcaagaaaattcttgaaggggatgcaccgccttcttcaatgatgattctatgcatttcaagtatttgctctagtcatgcaacagaaagtgggacttgttttgaaacacaaaatgggactcagaaagcagcagcagtaaaagttgaattaactgatggatggtatttgatgaatgctattttagatgttccattgtcaaagcaacatgctgctggaagattgtttgtgggacagaagcttcgaatctcgagagcaggattatgtggctggaatgggccagtttcaccccttgaggtgtcatcaacagttagtttattgctgcacataaatggaacatatagagctcactgggcagaacggttgggattttgtaaaattgccggtcctcctttggctttcagatgcataaaaagcaatggtggtctagtaccacaaactttggctggaattacccgcatatatcccattctttacatggaaaggttaagcagtgggaggtctgttgtcatgtcagagaggatggagaataaaatgatggagctgtacaatcagagaaacccaggacctgctatcaccctgatacatgcctatatgtccattaatgaatccagactcagttctgtttcattttctgatacctatcaattggtatcagagctctcaatcctgggagcttcaatagtgattatgagagcaacaatggaatctagaatggaaggatag

SEQ ID NO: 102828 - DNA, 292 bp, Glycine max
  Peptide Sequence Number=SeqID_219606
agataggaaaggcatagaatctgatgcactatgctggtacacagttttgtctcaccatgttggtcaacttgatgaacttcctgaggtgccatataggattttcttggtagcgccactgaacgagttgttctccaacatctgtgggaacccatgcttgaattcagatgtgactaagttggatggtattggcttcccaagaggtaagagtgaggtcagacccgaggaggaattggaggatgacgtgatagcagaggatgtcagtgagggcgacaagagagcagtggtggtatga

SEQ ID NO: 102829 - DNA, 463 bp, Glycine max
  Peptide Sequence Number=SeqID_219607
tggtggtgttgcttccaatactgagattcagtttgatgaacatgttccattttccatttactggagatcaaaaatcaatggcggtgcaaggagtttaggcatggtggtggtgagagttgtgtcgaggtcgaaggaccgtaaaggagagcgtctaagaggaaggaatgaaggctcctacccttatttatactactccaccttcacaatgaatggtggagattacttgtatcctaggggtacatcctttgtggtacaagtagagggtacatctacttgggttgttgtgactgagaacaagagagagtacatctcttgtggatcaattctagtggagggtacatccactaggttattcaaagagaacaagggagggtacatcccttgtggatctttgcttgtaaaggattttacaaggttgaaaagaaatctcaaggaccgcaggtcgcttggggactggatgtag

SEQ ID NO: 102830 - DNA, 1170 bp, Glycine max
  Peptide Sequence Number=SeqID_219608
atggccatggccatggctgaggcttcaagaatcacgttacactccactctcctccctttttttacccccaaaacccacgttggtcaccgccacttaagcctctcgtcatcacgcaagcaccaagtccagtgctcggtgtctgcaggcgcggcggctcagacgaacccagtggcttggggctgcgagattgactcgctggagaactcttcggctctgcagagatggctgtcggagtcggggcttccgccgcagaagatgggaatagagagagtggaggtgggagagagagggctggttgctttgaagaacattaggaaaggggagaaactactctttgtgcctccctcacttgtcattactccagattctgagtggagctgccccgaagctggtgaagtattgaaaaggaattcagtgccagattggcctttgcttgcaacttacctcataagtgaagctagcctcatggaatcttcaagatggagcaattatatatcagccttacctcgtcaaccttactcacttctttactggacgcaagcagaactagatcgctacttggaagcttcacaaattagggagagagcgattgaaaggattaataatgttattggaacatacaatgatttgaggctcagaatattttccaaataccctgatttattccctgatgaggttcggttaccctcaatgggtggaaatgttgccttggttccttgggctgatatgctgaatcatagttgtgatgtggagacatttttggattatgataagacatcaaagggaattgtcttcacgacagatcggccctatcaaccaggtgagcaggaaggcgctaatcctagtgattcagttgagttgtcactgtcactgaagaaatctgatgcgtcctataaggagaagttagagctgttgaagaattatggattatcagcatctcagtgttttcctatacagattactggttggcctttggaattaatggcttatgcttatttagctgttagtccttcaagcatgagaggagattttgaagagatggctgctgcagcatcaaataataccacctccaagaaggatttgagatatcctgaaatagaggagcaagcattgcaattcatactagatagttgcaagtggatcactggatctggatgtgacttctcctaa

SEQ ID NO: 102831 - DNA, 609 bp, Glycine max
  Peptide Sequence Number=SeqID_219609
atggatgaagatcagaagaattggaatgaaatggctaaggttatgatgatggttaacaaaaaaccaactgatatgttcaacacaattcacattaaggatcagtcttatggtgaagttagtaggagctttgttgtaagatggaaagatgaattagagcatacttggcatctcctagatagtaatgacaagatacactctattaaatacaaccaagatcttcagaacccaactatagtgcctggctggactgaactgggagattactatggactgacagtcaacccgaaacagtgccaccttagtgctccactgtcaccctcccttcacatccttctagcgacaccttcttctccgctgtcggtgatgccagccccccccatgacgcttatctcgagcttctttggctatgactccttcggcgactgccgcttcttcccatggaaattgccttttacgccatcgagaactttggcaagggccctacaaaggggttcaagcaaaggattggatcggttgatggggatacagaactgtactttggtgattttggggttagctaaattacttggtgaacttaaggaatgtggtcatggtattcctaagttttag

SEQ ID NO: 102832 - DNA, 186 bp, Glycine max
  Peptide Sequence Number=SeqID_219610
atgtcgctgattgctgacaggggtaaccctaacgaggccatagatgtatcttcaaaggagaggttgagtgttgaggccccttgcagtgacaatacaggccttgctgcaaaatcgaggatagcaaccctatccatctttgttgctactagacggatgcctatgagaggccgtattaggtgttcttag

SEQ ID NO: 102833 - DNA, 574 bp, Glycine max
  Peptide Sequence Number=SeqID_219611
gcgttctctgaagaccttgctaagtgcgcttaccgtgctaagcgagttcatcctttgaggatgaacactcatcctcttgctgaactacctgagttggtgccgctaagcgcaaccgttaaggagcttagcgcatatccttgcagcagatgccagctaagcggaccatatggcttccagaaaaagaaagagtatttgtacaaggcccacaacttagtagaaatataccatactgagcgggatgagtttaagcctaaattggagagtcataacttccataaacgcctcaccaatttagttgaaagcagcatagatctagctttggtgaaggagttttatgccaacctttacagctccaaagggccttcaccaaagcatgtcagggtcagaggccacttggtgaggattgatgtagacaacctcaacacctttctaaagacacttgtggtactagctgagggccaccctgggaagattctcaggaaatatttaacaactcttgctcagatggacatgaatgtgggagctctcatctctggtcagattacatctatggcccagtctaactcttctagac

SEQ ID NO: 102834 - DNA, 390 bp, Glycine max
  Peptide Sequence Number=SeqID_219612
atggcaccagaggatatggaaaagacaaccttcgtcaccctatggggaactttctactacaaggtgatgtcctttgggctcaagaacactagggcaacttaccagcaggctatggtgacattattccatgatatgatgcataaagagatcgaagtttacgtggatgacatgatcgctaaatcaaagatcgaggacgaacaccttgtcaacttgcgaaagttattcgagcggctgcacaaatacagattaaggttgaatcccgcgaagtgtactttccgggtcaaatccggaaagttgctcagttttattgtgtgtcagaaaggaatagaggtagacctagacaaggtcaaggtcatcctcgaaatgcccgagccatgcattgagaagtag

SEQ ID NO: 102835 - DNA, 528 bp, Glycine max
  Peptide Sequence Number=SeqID_219613
atgcgtagtgattgcttagtgcaattctccattctcattctttttcggagccccaggaattgcgttttcgttcatgtgtcctccaccttcgagtttggagctatgcgtagtgattgcttagtgcaattctccattctcaacctttttcggagccccatgaattgcgttttcgttcatgtgtcctccacctttgagtttggagccatgcgtagtgattgcttagtgcaattctccattctcaaccttttttggagccccatgaattgcgttttcattcatgtgtcctccaccttcgagtttggagctatgcgtagtgattgcttagtgcaattctccattctcaacctttttcggagccccatgaattgcgttttcgttaatgtgtcatccaccttcgagtttggatgcatgcgtagtgattgcttagtgcatttctcaattctcaacctttttcggagccccatgaattgcgttttcgttcatgtgttctccaccttcgagtttggagccagcgtagtgattgcttag

SEQ ID NO: 102836 - DNA, 1140 bp, Glycine max
  Peptide Sequence Number=SeqID_219614
atggaatcagtccggggcacgcagacgggccagcaggctgaccagcacgaacaacagggcaacggccacgccgttgtgggccaccgccacttccagcggcagcgccagcttcacattgaggatgccgagggtgacctgcagcaccagcagcgcgatcagcgcactggcccagccacgcatgctcggcaggcggaacaggcgcacgcccagccacagcaggtagacagccaccaccaccgcgaacaggcggtgcgccatctggatggcgatacgcgaggcgccatccagcacaccgccttcgtagtccacgccgatgccgcgccacagggtgaagccttcgacgaagttgtgctgcggccaccactggttggcgcaacgcgggaagttgtccagcgaggcgctgccgccgccgcaggccagcgccgcgtagttggcactgacccagccccccagtgcgatctgggtgaccagcaccgccacaccgatgcgcagcatccacttcagcttcggtgcttcggccagggtgatcggcatgtgcgttgcgcgccaggccatccacaccagcagcgcgaacatcagcatgccgcccagcaggtggcccatcaccacgatgggtttcagcagcagggtcaccgtccacatgcccagcagggcctggaagatcaccaccgccagggtcagcagggcagcgcgcgccaggtcgatgttgctccagcgcagcgccgcgatcagcaggatcgcctcgcctatcagggccaaggcgctggcggtgccgtgccagcccatcatgtacagcggtatgccggcggccaccagtacgcaggcggtcaccaccgccgtgcttccgaatcgccgcttgcgcgtggccagcagcgccagggtcaggatctcgatgcccagcgcgccggccaggaagcgatgcacctgttcacgccaggccttgtgggtttccagcgggcggatctccgccgcggggtggccgatggtctcttccacgtgctgcggccaggtggcctggccatagcaggtgggccagtccgggcagctcaggccggcatcggacaggcgcacgaaggcaccgaacatgatcgtgctcgcggtcatgatcatggcgaaccacgccaggcggtggaaattgcg

SEQ ID NO: 102837 - DNA, 225 bp, Glycine max
  Peptide Sequence Number=SeqID_219615
atgtcagtgaaaaaccttgtcgggcgcctaggagtacatgacatgacaaaccacacactagcaagtgaatcagggtcacagtgttttgcaagaatgctccaactatgtgggattgacacaggcttaaaggagcactcaaaccaggtgacccccaaggcctacactccgaagagtccgtcagggcctctccctcctaattcaggtccaatccagaaaacattttag

SEQ ID NO: 102838 - DNA, 246 bp, Glycine max
  Peptide Sequence Number=SeqID_219616
atggaggcgtttggtttgcttgcgggaaacagcaaggagaagatgaagaagaatcatttttcgtatttgctgaggcttgttgggccgcgtccaatcgtgcgtgtccacttggtgggctgcgtccaatcgcgcatgtcctactgtccaaccgtgtccggtgacgacagaagcaacggacactgcgtcgcaccggagtcgtacccgcatgcgtgtccggtgcgagtccgacgcgggacacgccgatga

SEQ ID NO: 102839 - DNA, 252 bp, Glycine max
  Peptide Sequence Number=SeqID_219617
atggatccagcaactgctgaaagactttcccaaatagatcaagaaattcaaaacatcgataccgagaaggcccaacggcagcaaaccctggctgccttttgggagcacctgcctcccatcgatccagcgcttgtggctgcagccatgcaacggatcctggaccgcattcgcggtctggagaaaggaggagggccctcctccaagaacaacgagacctcattttgtgtggctggtttgtctatgtgtgcgtaa

SEQ ID NO: 102840 - DNA, 180 bp, Glycine max
  Peptide Sequence Number=SeqID_219618
atggagcaatcctcactcgacagctcgaaagcggatcagtacaaacccacgcgtgcttcgtcgtaccctgacaactcctctttcactggcttctacttgtcttttactggcttatttgtacccagcttcatgatggaactcccctcggccaatcgtcactcgacagcagctccgtcctag

SEQ ID NO: 102841 - DNA, 219 bp, Glycine max
  Peptide Sequence Number=SeqID_219619
atggagaattggcgaatagcgctacgcaataacttcgcgaggctccagactcgaaggtgggggatgcatgaacagcgctacgcaatgacattcatgggtctccgaataaaaaggtctccgaaaaaagtagagaaaggagaattggcgaacagcgctaccaataacttcgcggggctccagactccaagtggaggacacatgaacagcgcttggaaatga

SEQ ID NO: 102842 - DNA, 131 bp, Glycine max
  Peptide Sequence Number=SeqID_219620
atggcggagccatcgaaaaagcggaaaggaacctcgagtcagagtcagcggcattcagggtcacaggaagccccaattccttcctccattccctctggatcattattctcatcaaaggaacagcgtatatg

SEQ ID NO: 102843 - DNA, 411 bp, Glycine max
  Peptide Sequence Number=SeqID_219621
atgccgatctccccctgtggaagtatcagttggtctatgtcgttccgacatagggatcgcgcccgcaagacatccagtggacccggagaagtccaacagggtcctgggtttccagctctgattacgagcctctggatcacgcccgcaagacactcagtggacctagagaagtccaacagggtcttggggtttccagctctgattatgggcatctgtcagttctacggagtgcctgtcacccccagcaaggtcatcaagccccctactaaccgagctttcatcaagaagtattgcgcccccaggcaggcgcagggcgagacaccacaacagccaggggattgccggcagcgggcaacaaatgcaccgccgccacctctagagttcaccttagctcatccacaaaaaggttag

SEQ ID NO: 102844 - DNA, 210 bp, Glycine max
  Peptide Sequence Number=SeqID_219622
atgcaatgcgggctgacgatggagggattcaacatccggcagcggacccgtctgagcgcgcgtaaaccccatagccacccctggctaacgccagcggtggccgcgccggaaggcgcaagaatcacacaaaaactgctgtccggtgaaaagctgactacgtggatgcaaggggacgagatgatttgcgaggtgacacatcaggacgcctga

SEQ ID NO: 102845 - DNA, 222 bp, Glycine max
  Peptide Sequence Number=SeqID_219623
atgattctgttatatcttcatctaagggacgatttcaggataaagcaaaaaggcacccacatgggtagtgctaatagcaaaagtggtagtgccattagcaatactgtacatacaatggaccatgacataggcctagttagacatgccacattttatataatgggtatggatagattagaatattgccaattagcacttaacattcctcagaacactatgtaa

SEQ ID NO: 102846 - DNA, 201 bp, Glycine max
  Peptide Sequence Number=SeqID_219624
atgaaaggtgaggagtgctggcaaaggcactccatcgccgaaggatttattatcattagggacgagaatgatatcacctcaagaatcctagaggtagccccaaaattcctatgggatgtggaatcacaaatgttagagaacaaagagaagaaaatggagactgttttaatttgtagaaaaaagttttgggctatcgtctaa

SEQ ID NO: 102847 - DNA, 225 bp, Glycine max
  Peptide Sequence Number=SeqID_219625
atgggtgtttccttgaatggtcgggtgatggactatgttaaggatttgactatactaattgctcgatttaatattttatttcaaatgtatgtttgtttctgtgagcttacccttgcattgttgcacatatggtttgtgcctatgatgatcacagttcttcccgggagcaaacaattggctaccagtggatcaggttcttcacgactaaagacccaggagttctag

SEQ ID NO: 102848 - DNA, 300 bp, Glycine max
  Peptide Sequence Number=SeqID_219626
atgaaggtcaaacagaagacatatactaatgtgaatctcccatcgctatctggtgatgaagctaaggatagagatgataagcaaaactcctatatggataagcttttccttaagaagcaacctgtatcattttggagttttggtcacagatgttttggcaaaccaggggaggaggttccccttccaatggtggctgaagcttataaggaaagattcaaggaggcgcccatatcaaaagagtatcaagaatggtgcaaaccatggaaggggtcccttatgatcattgtattgggaaaatag

SEQ ID NO: 102849 - DNA, 330 bp, Glycine max
  Peptide Sequence Number=SeqID_219627
atgaccatagaaactcctcatccaccacccacaaccaccggtggccaccaccagccgtcgttgcttgctgttgaaccaccacacaaagatgaacactttaatcaaagtgaaatcctcagaatccacctcagggattcggtggagaacaagctctcaattctttctttcatagtttctctaagtaagtatttgcaatttcttatgagggaaaatacttgtacttgggggcatgccactcagtttggaactcccttgagactcaggctgatcaccattgggagggcagagttgcctatgcacgacagggtgacctcgacacttgctgcctag

SEQ ID NO: 102850 - DNA, 279 bp, Glycine max
  Peptide Sequence Number=SeqID_219628
atggagttaatgctttattttaatttgttgctggcatcaaacactcaaagtaacaatgaagaagtgcaaactccgaatgttacatctggaaactcagagaggcaagatgaatcaaacaatgatggatgctccaatgttgaaaaagctcaaaagaaaaggaaacatggagaagtagcaccactgccaccaccatccacgaatcccacacccactaatcctattgctggagagtcaggaggtggtgaagagctatttgtagaaattgtgaaaaatgtttaa

SEQ ID NO: 102851 - DNA, 755 bp, Glycine max
  Peptide Sequence Number=SeqID_219629
gagatacctcaaaggatatcggaggtggtgtgcctaaggtccaaatgaaaggcaaggatagaaatggggccacgaaaaagcaaggagcacatgctagagataaggcttcttcaaaacatgaggtagcccaaccttcaatccctattatagacaatgaaagaaaggatagagacagtttagaggtaattcttagccttcaaaatatgaacatgggatttgtgtttggtaacaattgtcaagcaagatgttcatcctctattcctccaagaattaatatagacatgaaagaaatggaagtcagcacaaccatggaaaccgaaagtgaaactattaatcagtcaagcaaaatggagcatgatggagatacttatggtaattttggaggtatttggtgcttatggaattttgatctttggaaggtggagatccttcatagtgaacatcaatttgttcatatgaagataggtctgaaaaagcaacccatgtggtttatcactgttgtctatggaagtcctaagcttcaagaacgaaggtctagagcaaagtgggtagcctttggggttcgtaatactcattacttccatggtgtcatgactaccaagaggaggaagaggaacacctatgaagctattcaagatgctaatggtgtttgtgtagcaaacaaagtatatcttgaaagcgttgtgttttctatggggaactacaaggcgctaggagtagatgggttccaatctattttctataagagcaaatag

SEQ ID NO: 102852 - DNA, 1122 bp, Glycine max
  Peptide Sequence Number=SeqID_219630
atgcaggcgggcagcagcgcctatttccgccccgatgcgctttttcccattgcggccggcgatgtgctgaatttgcgtagtatcgagcaagggctggagaacatgggggggataccgggcgtcatcagcgatatccgcattgctccgggcgaacgagctggcgaaagcgatatcgagatcctgcgccaacaggataaatattggcgttttaccgcctgggcggatgacgccggcgttcgttctacggggcgttatcagaccggcggcgcgctgtatctcgataatctgaccgcattgggcgacgttttatacctgtcgatggcgcgcagcattctggcgccgccgggcaaaggcaatgaaagccgcgccctgtactatagcttgccttggggatactggcgcttcagcgcgttgggcggagacagccgctatcaccagactttcgccggcaacttcaccgattatcgctataacggccgttcgcagtattgggggctgcaggctgactatacgttggcgcgcgggatgaatgagaaaacgtcgttgaatgcgcaactgctgcaacgtcattaccgctattacctcaatgacacggagattgccttgcagagcgcacggctaaccagcctgaagctgggcgccagccatctttattatggcgcccgtacgcaaatcgcgctgaccgccgacgcccttgccggcgtcgggaaagggagctcacatgccgaacagcagctgcgagcgggcggcagtatgctgaaacccttcaatgcatttggtcatcgtctgcgttatctcggggagttatcggggcaatgggcaagcgccgcacagccgatccaggataagtcgtttatcggcgaccgttctacggtgcgcgggtttagcggcgatagcaaattgatcggcagcagcggagggtatctgcgcaatacgctgacgctggaacgtgacatgctgcaaccctatattggattcgactatgggcagttggccaaacaacagggggaaggcggccagttggcggggagcgtcattggcctgcaggtgaatcaggggcgtttagctgcggacatatttcgccggcacgccggtgatcaaacccggcgcgctgccgagtga

SEQ ID NO: 102853 - DNA, 537 bp, Glycine max
  Peptide Sequence Number=SeqID_219631
atgggatcgaaccaagcaccctcttttaagaaaatgttctatcctgtcaaaatcaagagtctagaagtagccagtttgcaagagctagcgcagaggatggatcaacttcaactgtttattgaatccattgcatccctcgctcaatattacgaccagctactacggtgcttcacatttggggactttcagttaataccaatcatagaagagtttgaagggatattgggatgcccgctaggaggaaggaagtcgtatctattttctgggttatacccttccatggcaagaatagccaaagtggtcaaggtcccgataccaaggaagcacttggaagataaagcaaaggctttggtagatcaaggagagtggacttcattcgctgatgttctagcactcttggtgtttgggattgtcctctttccaaatgtggataggctagtggatctagcagtgatcgatgcttttctttcttatcaccacagcaaggaaagtctggtcattgttgttttggccgatgcttatgacacattcgattga

SEQ ID NO: 102854 - DNA, 2418 bp, Glycine max
  Peptide Sequence Number=SeqID_219632
atggatcatataagtaacgaggctagtgttgacccttttgcgattggcccttctagcattcttggtagaacaattgctttcagggttctcttctgcaagtctatctcacaattgaggtatcatatactttttgtgctgtcgaatatcttcaaaagatttaggggattttgggcacccattgtgtcatggttgcatccgagaaaccagggcatattggcaatgatgacaatgattgctttcttgttgaaacggtacaccagtgtgaaagtgagggccaatatcgcatataagcggaaattttggagaaatatggtgagagctgcattgacctatgaggagtgggctcatgcagccaagatgcttgatagagagacacaaaagatgaatgaatcagatctttatgatgtggagttggtgagtaacaagcttgaagaacttcgccatcgccggcaagaggggtctcttagagatataatattttgtatgcgtgcagatcttattaggaatctaggtaatatgtgtaaccctgagctccacaaagctaggcttcagatgccaagactaatcaaggagtatattgacgaggtatcaactcagttgagaatggtctgcaactctgattcggaggagcttgcattggaagaaaagctttctttcatgcatgaaacgagacatgcatttgggaggactgctttgttgttaagtgggggtgcttcccttggagcttttcatgttggtgtggttaaaacactggttgaacataaacttttgcctaggataattgctggttcaagtgtaggatccattatgtgttctattgttgccactaggtcttggcctgagcttcaaagcttttttgaggattcattgcactcactacagttttttgatcaaatgggtgggatttttacagttgtgaagagggttacaacatatggcgcagttcatgagatcagacaattgcagatgttgttgaggcatctaacaagcaatcttacatttcaagaagcatatgacatgacaggtcgaattcttgggattacagtttgttccccaagaaagcatgaaccacctagatgtcttaactacttgacttcacctcatgttgtaatatggagcgcagttactgcttcttgtgcctttcctggccttttcgaggctcaggaattgatggcaaaggatagaagtggagagattgttccttaccatcctccatttaatttgggtcctgaaaagggttccacttcagtgcgccgttggagggatggtagcttggagaatgatttacctatgatgcagttgaaagagttgttcaacgtcaatcactttatagttagtcaggccaatcctcatattgcaccattattgagattgaaagaatttgtacgagcttatggaggtaattttgcagcaaagcttgctcatctagcagagatggaggtgaaacatagatgtaatcaggtactggaactcggctttcccttaggtggacttgccaaactgtttgctcaagattgggaaggtgatgtaacagttgttatgcctgcaactcttgctcagtacttaaaaatcatacagaacccttcttatgtagagcttcaaaaggcagctaaccaagggagaagatgcacctgggagaagctttcggccataaaagcaaattgtggaattgagcttgctcttgatgagtctgttgcaattctaaatcatatgaggcgactcaaaagaaatgctgagagagttgctactgcttctcatggtcttcccagtactgtcaaattcagtggttcaagaagaattccatcgtggaacatcattgcacgagagaattctacaggttccctagaagaccttcatgctgatgctgcttcctcattgcatcaaggtgttattagtcccagtggagcaactggtaaaaactggaagtcccatcgtatcattcatgatgcaagtgacagtgaatctgaaactgctgacttgaattcttggaccagatccggtgggcctttgatgagaactacttcagcagatatgttcattgactttgtccaggacttagaatttcataaagttaataccgaactaaatagaggcaaggtgactcacactagtcctcatgattttcagcatcacagttcaaggcacacaacagttaataggtggtctgagagcacagaaaacgatcagaaagaaaatggcaacaggattgtcatgaatgaatctaacataatggtaactgaaggtgatcttttacagcctgaaaggatccataatgggattgtgtttaatgttgtcaagaaagaaaacttgacaccaaataggaatcatgattataatagttataacaatgaagttgctgaatgtgtacaaattgactttccagggaaggaggtggatgctgctagttcagcttcctaa

SEQ ID NO: 102855 - DNA, 609 bp, Glycine max
  Peptide Sequence Number=SeqID_219633
atggaatggcttgcattcaagtggtcaccacaagttaaggccaacctcatttatgacttcaagtttgtttccaacaaggatgaactttactacacatacaaccttaagaactcatctatgatctcaaggttggtgctaaatgcaacaagctacgttcgtaagcaatatgtatggaacaaatcaaagcaaagatgggaggtgtacactttagtaccactggacttatgtgacagctattccctttgtggagctaatgcaaattgtgtaatttcatattcaccagtgtgccaatgtttgcaagggttcaagtctaagttacctgaagaagggagctcaatggattggtctcacggatgcatccgcaataaggaattaaggtgtgagaacaagaacaatgatggatttaacaaattgactttgctgaaaaagtctgacactacacatagttggctggatcagatagttgggttagaggaatgcaaagccaagtgcttggataactgttcttgtatggcttatacgaattcggatatcagtggacaaggaagtggttgtgctatgtggtttggtgatctaattgatattagacagtttgcagctgtaggccag

SEQ ID NO: 102856 - DNA, 189 bp, Glycine max
  Peptide Sequence Number=SeqID_219634
atgggtgcagtgcggcggcgtgacggtgcggcgatgaagagcagggttgagatcgagagaatgaagaagataagtcatttttttaatgcaaaaacaagttttaaaaactggcctgagtcaccaggtttacacaaaaccggcaaggtctggctaggttatcctggaccaaatgcatggccgatccaataa

SEQ ID NO: 102857 - DNA, 141 bp, Glycine max
  Peptide Sequence Number=SeqID_219635
atggtgcaagctcagcacgggcacatcattgcggtggatttggtcttagaggcgttgacggcgaggtggccttggcggagtgagagtgagaaggagagtaagaatagagaacgccaaagaatagcaggagctacatattag

SEQ ID NO: 102858 - DNA, 486 bp, Glycine max
  Peptide Sequence Number=SeqID_219636
atgggagatcgcttaaaggaaatgatttgtgattttggacaagagtcttttcagcaaacacttgcccctatgtatgatacattgcaaagtgattcaaagaagcctttgtatccggggtgcaaaaagtctttgaccttgttgtcaatggtgttaagtctggttaatttcaagaccagatatgggtggagtgacaaaatcttcacttcacttcttcagggagtgcaggatattgttctagaggaaaacatgttacaaaaaagttactataaggaaaagaagatattgtgtccgatgggtatggagtaccagaagattcatgcatgccccaatgactgcatattgtacagaaatgagttcgaagaaatgcacaagtgccccaggtgtggggtatcatggtacaaactgaaggatgatgatgagtgtagcagtgataaaagcaccaataaaggccctgatgcaatcctaccccccaagggcattggatag

SEQ ID NO: 102859 - DNA, 327 bp, Glycine max
  Peptide Sequence Number=SeqID_219637
atgctgaaactgatcctgatgcaaagcttctgttttcttgtgagaggggtcagaaagactttgaattcagagttatggcatgcttgtgcagggcctcttgtgtcattaccccaagttgggagccttgtgttttacttccctcagggacatagtgaccacgtggcagcttctactagaagaacaacaacatcacagattccaaactaccccaatcttccatatcagttgctgtgtcaagttcaaaatgtcacacttcatgcagacaaggagacaggaagtgactgcagcaggagtagttctttcacacttaaattacagggatgctga

SEQ ID NO: 102860 - DNA, 600 bp, Glycine max
  Peptide Sequence Number=SeqID_219638
caaacgtgtgccaaagctagagtgatgagtgaaatagaggaggtgcaagagcagatgaaggtcgacatggaggccatgaaagagcaaatgaccacaatgatggaagccatgatgagtatcagaaaaatgatggtggtcaacacggctatagaggtagacccgactcacccatctggcctcaaccaagtaaattgcccagccttggatatggtaggtcaaagaggcgaagcgttgggaagtgcgggcgacccctattttgtgcaggttcagagcaagcattccttcccaccatatggcttacctcccaactatacaccacccaatgttgcacacgctcctgatgagaatgtcgataactccgctcttatacttattgagagccaacaaccccaatctggggcaaccatttggtggcgtacccccgccaaacactttgggggtccctcagtatcacccacaaccacaacccttacattttgcgatggaaacactgcctcttgccatgagttgtgcctagtgcccgacttggtcaatccttcgaagttcaaggtgtcgaacttcgataagtacaagggactacttgccctaagaatcatttga

SEQ ID NO: 102861 - DNA, 810 bp, Glycine max
  Peptide Sequence Number=SeqID_219639
atgggcatgggctccggccgcgtattcaccctcttcagcctcgaggcggcgttcctcggcctcctcggcagcgccatcggcgccgggatcgccatcctcgccggcaccggcatcagcagcgcactctccgcgggactgctcgccgacctcccggggctcaccctcatcgcgttcgatccggcctcgatcgccacgatcatcgtcctggtcatgataatcgcgttcctctccggcaccctccccgcagcacgcgcagcgcgcaaggaccccgtggacgccctccgctacgatgacgttcttgatgtttgccgccgcgatcggctccggtgtctccgggaccctgttcacccgcgcctcgaagggattccggcgatgggggtacagtgtggccgcgatcgcggcctacgcggtggcgacgttcatgatggccctgctgcttcagcgcctgccggtcgggatcgtctacgccgtctggacggggactgccgcggttctcctgttgctgatcgaccgcttcgccttccgggtgaggacccgcaagccccagctcgtcggcatggtcgtgaccatcgtgggcgtggcgcttctcgggacggcggcgcaggcatgaacccgacactgcgtcgggggtggttccacctctccctcacggtggtgttcgaggtcgtcgcgacgctcgcgctgagagcctcggacgggttcaccgtcctgatcccctcggtgatcgcggtcgtgtcctatgcggccaccgtggctgtcctcgcgtgggcgttgcagagaattccgatgagtctggcgtatgtggtgtga

SEQ ID NO: 102862 - DNA, 200 bp, Glycine max
  Peptide Sequence Number=SeqID_219640
aaaatgcgaaagggaagcacagatgcacaatgggtgaacttttggagagagagaatgcagataagaagctggtgaaatatggcaattgtgagtgtaactgccgttacactcacttaagcagtgttcgacattctcgcttagcgaaccttcgtgctaagcgagccagagagacgtttggtttctcaaagaggctcgcttaa

SEQ ID NO: 102863 - DNA, 834 bp, Glycine max
  Peptide Sequence Number=SeqID_219641
atgagaggagcgccgtcggaggaaagcatcgcgcctttcatcgcacggggtttcagtgaccccaacgcaaggatacctcaaggagttcgcaaggcatgggatgcagtgcaaaggaaggacaaaaagcttaggggaagtagtaatgggatcatcggtggctattggaagtggctgagagtccgcacacaaggcttggattggctcccaaagctaaggcctgcaagagaggaaaaggttgaagctccgaaagaaagtgaggaggtacaagccgtaaaggcggagcttgagaaagtccaagcagtcaaggagaagttcaagtcaacagccatcaaagtccgaaaggagtatgatgaactgaagaacatcaacatagccaccgccgaagccttggaacgggaaaccaagagggcccggaaggaagaacacggccgaaacaagttccgaggagctttatggggcaacaatagtgagcttaagcttcgaagagacgagagggatcagtcacgggtcgaaggcatgatcttgaaggacgagttaaaggcttaccttaggtccaaaagaagtttgtcccaacagttaagagagacaaaaggaaatatgttggccatcattgataaatacaaagaagagctaaacctagcagctgctcatgagcaaaggctaggggatgagtacgccaaggtatcaccggaaaaggaagcaagggaaagggtaatcgactcattgcacaaagaggcaatgatgtggatggacagattcgcctttactttgaatggaagtcaagagcttccccaactactagctaaggtcaaagcaatggcggatgtgtactag

SEQ ID NO: 102864 - DNA, 183 bp, Glycine max
  Peptide Sequence Number=SeqID_219642
atgacaggatttttttcttccgccaaggttgaaagaatgagcttgtatcaagatgggcagaagattgttttggtacagaaaggcttgttaggccatgtaaggagctttgacattatggctgcaaatggatttgtcattgctaccgagaagaaattgccatctatattggttgatgaaacatca

SEQ ID NO: 102865 - DNA, 264 bp, Glycine max
  Peptide Sequence Number=SeqID_219643
atgaacaccaacaagaacagcaccaaccaagcagttctctctccacatggataccccgatggaggtcctgtcttgaaattttcgtctaataacgatgattttgcttttttgggtgacgttgtggctttgatcaatgcagagaaaggtgcgttgatctacatgcggaatgggaagatactggagacagataaaagcgtcaaggcattgaagagaaaatacgaggaaatcttggattattatcaaaaaaattggcgggatagataa

SEQ ID NO: 102866 - DNA, 1149 bp, Glycine max
  Peptide Sequence Number=SeqID_219644
gtgaggcatgcttgcccactagaaagccaccgttcatgcacagagaaaggaggggcaaattgggaccgactcttagcgaacaaagaaggagcgtctgtcaactggttccctcgatggatagaaggaagaaccagggttcttatttcatgcggaggatttctgaatgtttccttgatggggacaaggggttgcatcagttacaatcccgttcttgctataaggcaacttggctaccctatgagaggggcatcgctagaggaagagctcacacctgtccgcaaggcatgggaggtggtgcaaaagaaggacaaagaactcaggggcagtaacaatgggcccatcggtggccaccgaaggtggttgaaagcccacgtgcaaggtttggattggctcccaagtttgagaaccactaaaagggaggaagttgaggcaccggaggaagacgaagaggtgcaggcccttaggacagaactcgagcaagcccaaatagtcaaagaaaggttcaaatcagcagctcttaaaatccgaaaggagaatgccgaactaagagatataaatatagctctcctatttcgatggcgtattccgagttatggccctcattattggaaaaccatttggtggtggccatacccgggaaggtcttccagtcaccataccccaagtgagggccccaatgttaagaccaatccgctagccagtcatgggggagctagcgtaaatgccatcgaaaaggataggccgtcagggtcaaagagattagaagatgtggctacatccagaagattcatctaccagtcgctgcaggaagcatgcatggtttcttgtggcggagacaaaagtgacgaatctactttaacggctcatggactgggggcagctcgaagtgtccgagggaggaatgtgatcggctccaagtccgagtaccccccgacagtgcccaagccgacgcctttttcctatcaaagcaataaggttgtcccatggaaatataaccctccagcttttggagaaggggctgcaactgaggttgactccttgtcagccaaagtgaccaacattaccggccttagtggcgtaactcgcagtggtcgggtgttcgctccccctcactcggcggaattgccccccaaggggaacgaaccatga

SEQ ID NO: 102867 - DNA, 228 bp, Glycine max
  Peptide Sequence Number=SeqID_219645
gcggcgggcccgatgacaagcagagacaaaatttggtcattctgcacccttgtatcatccaaaggcggcggtcccgatgatacgcggagataccttacggttatccgcacccttgtgtcatccagaggcggcgggcccgatgatacgcggaaatacccaagtggttatccgtataaacattcttttgctatctgtaagacagaacgcttgatagcatgcagaggctga

SEQ ID NO: 102868 - DNA, 328 bp, Glycine max
  Peptide Sequence Number=SeqID_219646
ttgatgcttgtatacaaccagcaacagttagctcacaataggccaatattatccatggaacaatttctggacaaggtggcctggcctgaagcccaacttcttttgggaagagcccctgaggttgttcttcccagtcctataccaacaaggacagagcctgcaccaactgagtcacaacctccagtagtagacccaccggcttctctagaggttgagatactatctcctccactagctccaccggcaccacctttgatactcattcttgatgactcagatgctgaagctgttgctccttctaactcaccagcctactacctagaggatg

SEQ ID NO: 102869 - DNA, 294 bp, Glycine max
  Peptide Sequence Number=SeqID_219647
atgaaagataagagggatgaggaagaaaaactagaaaaacaaaagaaaaagaaggatagtgatatcaaaagagcactccttaaacaatccttctaccttctcctatcaagggaaacatcccttagcactgccatacctcttaagcttgaggttattcctaaagtaaaggagttggttgatgagggtttggtttgtaagagcttaaatccttgtactttgttggtgcccaaaaataggtattatgaggcaccaaatccctatgataggtgctatgatgaatgtgttgagtggtga

SEQ ID NO: 102870 - DNA, 654 bp, Glycine max
  Peptide Sequence Number=SeqID_219648
atgggcgaacgagagggcaagccggaggtttaccgcgaagccgtgcagccgctctggcgcgttcagggccgtgcacccgatgcgctaacatcactaaatgactcgcgaactctgttcgcccaagactgctctgggcattgtcaagcaagggtgcgttctcctcgccgaccggcttcattcggtcaccccaccctaggcgagcacgcatcttctgcgtgctcgcctttgcgccttcggttcaggcgcgaagcgcgggctatccatgtcctttacggagatgtagtcatgcttcttgacttggaacgctttcgtcagcgcattcttgacgaactggagaaagtggagcgttcgcttcaaaattcgcaacaggctgccgcaacagtgcttctcgaccaatcaagcgtgggaagactttcacgcatggatgccctgcaacagcaggccatcgcccgaggcctgaccgagcggctgcagctgtccaaacgaaagctgcaagctgcgcgcgatcgaattgactctggtagctatttcctgtgctgccagtgcgatgaaaaaatcgaactcagtcgcctagagcacgaccccgcgacagtgttctgccgcgcctgcatgcaagagcgcgatgtgctcctccaaaatcgaccaaggggctga

SEQ ID NO: 102871 - DNA, 396 bp, Glycine max
  Peptide Sequence Number=SeqID_219649
atgatcccggaagaggcggctcaggacttccctggcgccgcggcgctcgcggccctgcgtgcgtggtacgccggcatgggcatcaccgacgccgtcgcgcagtacctgccgcacagcacagacgctggaaggtcgtcgcccaccgtgctaggtgagatccggcgccagctggcggaccgcgcccgccggtgtcgccgcgatgacctggcgcagctgatcctgcaacccgcctccgagcggccgaagcgggtccgcgccgtcatggcggcgatcgacctgttgcgcgggctctccgtgccgcggccgctggtgaccgacgccgtcgagcgctggctgcccgcgcgcatcgccaaccctatccaggccgacggtctgcgcacgctggccgatctgacc

SEQ ID NO: 102872 - DNA, 376 bp, Glycine max
  Peptide Sequence Number=SeqID_219650
ggtacatctacttgggttattgactgagaacaagagaggttacatctcttgtggatcagttctagtggagggtacatccactaggttgttcaaagagaacaagggaggtaataccggtgttcagaccaatgttgtaggatttacgttggtggatcttaagaaactcacttaccagaatgattctttcatcctggcagaacaagctaagaaggtattttatgttcaagacccttgctatgaaaggtgttcagtggttctacatgggaaaacaataggtgttaatgttgaagatgatgattcataccttgatacttatgttattcctttgtccacacaaatgtcgcctaatgtcgtcggagaagaagaagctgacgac

SEQ ID NO: 102873 - DNA, 231 bp, Glycine max
  Peptide Sequence Number=SeqID_219651
atggtgcagcccaaaccaagtgctggccttaaggggcaacctcaccaacatgctctcactcatcatgccttcttgtatttcaacaaacaaaagcttgggccccctaagcctaagtcatgcgaaaataccattgaggcatttcaccgagcacttggtgggcgcacttttgggtaccaacaacaagggaatggggcaatgtggcttgccccatcatctcagaacacaacctag

SEQ ID NO: 102874 - DNA, 630 bp, Glycine max
  Peptide Sequence Number=SeqID_219652
atgactgagatgcttgtgattgttgccgccagcctgctgctggcgtggccgctgggcctgtacctggcccgcgtgatgcgtggcacgccgatgaaggtcgacgtgctgttccactggatcgagaagccgctgtaccggatgttcggtgttgatccggcacgttcgatgtcctggcgcggctacgtgctggccttcgtcctgagcaacgtggtggtcgcggtgctgacccaggcggtgttcatgacccaggcctggctgccgctgaatccggatcagatcccgaacatgcgctgggacaccgcgctgcacacgatgatctcgttcctgaccaacaccaaccagcagcactattcgggccaggcgcagctgtcctacctctcgcagatgaccggcatcaccggcctgcaggtggtgacgccgatgatgggcctggcgctggcggtggcgacactgcgcgcgctgttctcgcgtgcgccgcaggctgcggccgccaccggtagcggcgatgaccgccaagtggcggtgggcaactactacgtggacgtggtgcgcctgtgcgtgcgcttcctgttgccgctgtgcctagtgtggacactggtgctgcccagccagggcggtgggatcctctag

SEQ ID NO: 102875 - DNA, 219 bp, Glycine max
  Peptide Sequence Number=SeqID_219653
atggccccctctctttatagcgacgttctctgcttgtccagcaccgggaagggacaacgatcggtcagtcgtgaccctatcctccatttgcgtccgttcctaagtacctacaagttggaaacaaacaatgtgcggccaatcgtgaccgggtcattgtcttaccttgattggttttctgtctttaaccttgcctcgacccctgacagtagctcgagatga

SEQ ID NO: 102876 - DNA, 374 bp, Glycine max
  Peptide Sequence Number=SeqID_219654
atggtgggatcaaagaggagtcgtgggcggccaccaaaaacggtgtctccggtacctgttaatcctccatcgccggtggctccaccggaaatggaatcagaaatccatgacgaagacgaagatggtgatttggctaatagtaaacaaggacctgttaatggaagtgaaacgatggctcaagaaaccctaatcgaagaccaagatggaattgggcataaactctgggttgacatgattagtggaaatagaaatccagctaagggtagagttatgcagtatgtggctcccaaggtggtagatggtgaaatagatgtgaaaattgaggatgaggatgttgccccagaattgaaattttgggaaactactttgatctt

SEQ ID NO: 102877 - DNA, 393 bp, Glycine max
  Peptide Sequence Number=SeqID_219655
atgggactgtggcacatgtgccttctcatccaaagcgcaaagctactcatccttacccataaaaggcatcaaaaaatggtgcaacatttcatgcatccctgtcatgctactttctggttttctagttttggtgccactactagcttccgttggttatacttcatcaagaaatacgcttgcacctggtctacatttacttactatactaaatggaattgccaaccacatattatgttatatgacattacaaatttagatgatattggatcaaaggggataacaaaaattaccaacaacagtctcagaggtgttggaaattctactaaaacactaccgacttctgagatagcaaagcaagggaaacaagctccagtgcttcatggtatcttttga

SEQ ID NO: 102878 - DNA, 432 bp, Glycine max
  Peptide Sequence Number=SeqID_219656
atgatcaaaggaaaaaatgacttgcttgttgagatgccaatcaatacctcttttaaatcaactcctcaagtgaactcaaagaagaaggatgcagagacttatgatactcctgttgttagttctaatgctaaaagtgtcaataaagacaagaatgaattaccacttgtggatgctcttgctgtaattattcctaaacctcttgttactaacattcctcaatctattgataatttacacaatcctatctctgaatccgaaaaaggtatcgaagaacctactgttgcaaatcaagaaaagttgtatgtgggaatagtggttgctacttcaattgctctacaacaatctgccaaacccccaaatttacctcttgattttgtccaagataatgcataccttattgatgttgatcctttcacaatcattgatgtttag

SEQ ID NO: 102879 - DNA, 189 bp, Glycine max
  Peptide Sequence Number=SeqID_219657
atgaagggagaagaaaagatgccatctttcgatattgtttccgaagttgatatccaggaagttcgcaacggcgtagaaaacgcaacccgcgaagttgagtcacgtttcgattttcgtggcgttgaagcctcgtttgagttgaacgatgccaataagaccattaaggtgctgagcgaatctgatttccag

SEQ ID NO: 102880 - DNA, 225 bp, Glycine max
  Peptide Sequence Number=SeqID_219658
atggaggcaactccctttgacttcccccaagttctcttcaattactttgctactcaagtgatgaaggacaaaagcattgagaaggacatctatcacaaggttgtcctgaccaaagttcttggggctcgtggagtgataaggaagttcttgtacaagactcctgaagaagtacaagacaaaatatattttgatggggtgttcttgcctaaacaagaggagccttct

SEQ ID NO: 102881 - DNA, 174 bp, Glycine max
  Peptide Sequence Number=SeqID_219659
atgatggacactagtgcaggtctggtgatttgtacaacttcaccttcttcggatgaagcagaaggatttctagaagtttctaagagaaggaaaaggttttgggtgcaaaggttttctgagggaaagacaatgcagagagttagcaagaggtttgatagtgaaaggttgaggtga

SEQ ID NO: 102882 - DNA, 231 bp, Glycine max
  Peptide Sequence Number=SeqID_219660
atggttaagaaattagctcacctgggcgagctagttactttagggctaaggcatgatgggggtgttttaaggggttccaaggttcaatacttgagagaattgataaagaaaaagaagaaagaagaggaaatgaagccgaggtgctaccgaatcgcgactgtgattgtccctacgtcgtttcttgttcggtgttcttcgcaccagtcagttagttttatttttagggattga

SEQ ID NO: 102883 - DNA, 147 bp, Glycine max
  Peptide Sequence Number=SeqID_219661
atggttcagctaagtgcacatcgctacactaagcccaacatcttcactgtaagttgcaccttaaaaagcgccaagcatcgctaccatgctaagccccaaatgcttactggagtttacaacttcaagttgggcatagcgcgaggctag

SEQ ID NO: 102884 - DNA, 390 bp, Glycine max
  Peptide Sequence Number=SeqID_219662
atgtatctaagaaagactacacaaaacaaaactttcatcattagaaagttggtgaatttaaagtacaaggagtggagatcagttgaagaacacttgagtgacttccaagacttggttaaccaattggttactgtgaagctggtgttggaagatgaattacaagcactaatctttttgagttctttgcctaaaagttggaaaactttggtggtgtcattaagaaactatggtccaaatggacaacttactttatttctggtgaaagatagtatgtccaatgaagaaagtggaagaaaagacatgggatcaagtagttcccaatcccttgtcacagataataaaggtaggagtaagagtagaggacaattaagtaaagccaaggatagatga

SEQ ID NO: 102885 - DNA, 366 bp, Glycine max
  Peptide Sequence Number=SeqID_219663
atggctaaattgcctaagccatttagggtgtttgaatgcaaagcttttgcttgtgtaagtaaggagcaaagacaaaaactttatgataaagctattccttgtatatttttggggtacaaaaatgttgaatttggctacaaattatgggatcctaaaaaaagaggagttatcaaaagcaaagacgtagtgtttcatgagcgacaaactatgttggtttctgatggattagaaaccagtgaacaaggtggtaaggttgatcttacaccagtcacccctgctagaagaattgccatagaaggggtagatcttgataatgaacttagggttgatgatgagctagcaataaagtatggtgatgatcaagct

SEQ ID NO: 102886 - DNA, 237 bp, Glycine max
  Peptide Sequence Number=SeqID_219664
atggatcaactagaagggttcgaggagactagaaaggagaacatggtttcgaaattgaagaagagtctgtatggattgaagcagactccaaggcaatggtataagaaatctgactcattcatgacgaatcatggatatatcaggactaattcagataattttgtatatgtcaaaatatttccaaatgatatgctgatagtgggacaagataagaagattaacattcgtggaacataa

SEQ ID NO: 102887 - DNA, 390 bp, Glycine max
  Peptide Sequence Number=SeqID_219665
atggggggtgttgtgaccatgatgcatatccctgtttctcaagaggggaaatacttgtacttgggggcatgtcactcggtttggaactcccttgagactcaggttgatcaccatggggaggagggagttgcctgtgcatcacagggtgacctcgccacttgctgcctactttttctaagtgagagtatcgcgtggacatgcttaggctatttcctgatgaatggtaccacattgcatttgagagttaaggctatgaggaatcaaaataggggaaaagttgctggagttgttgagtatcaagggttagattgcttccaacgaaacaatccatctgctttcaatgaagggtacaaccctaatggtgctcataattggataacaggagattga

SEQ ID NO: 102888 - DNA, 717 bp, Glycine max
  Peptide Sequence Number=SeqID_219666
atgccaaaggataccgaagaaaggggcaaaaaggtcattttatggattttcctagatcccagctcgcccaggctagcatctggctcgcctgggccatcaaataacttcatgggttcagaagttaagagaattaagagaagagagaaagaagaggaagaaagaaaaagaaacgaagtcgaggcgctaccgaatcacaaccgtggagacgaacgtgcttttctttatatgctttcgttgtcccgtcgtgaggccaaaaggcaacctggtgtaggaaaatgtgccaaatggacaggtgaatatggtcttgtgctgaacctagtcaatgaatgggagaaagaagtggtccttgcgagtttcctggttaagtctcctatagtcaatgcaaagtgtccagttgttggtcactctagtcgaaatcaactcattgtcttggtttttcataacagtgatgtcagacttcttaggaaccacttggatgggttggcaagtgtccacccaatggccttttgtggcgtctttctagaagcaaagcttcatggtgaatcaaagaacaattcaagagttcaagataagaatcaagaagaattcaagactcaagaagaaagtttagagtcaagaatcaagattcaaggttcaatatctcaagaatcaagatcaagattcaagactcaagattcaagaatcaagagaaggcttaatcaagataagtatgaaaag

SEQ ID NO: 102889 - DNA, 738 bp, Glycine max
  Peptide Sequence Number=SeqID_219667
atgtacaacttcacaatgtttgatgacatggtaaatggctttgccaacattgactatttaatagatgttattggtgaggttgttgaaattggtcactggaatctgcatggcaagccaaagaaagtggtttttacaatgataaatgaatgtgaaagtatcatcagttgtactttgtgggaggcactggctatggagcttaaggagtgtttggataggcatgttgttgggccggtagtgttgttgttgagtatgactaaaatcaaagaagctagagatcactttttgcataatgcacgtgtcaaatgttttgatgaagttagccaagtgaaaaagaagtgtatgtgtgtgattggggctactataaccaagttgttggtagacaatggttggatttatgatgtctgtcccagatgtaacaaaaaagttgatggagaggctttgtctttcatttgtgttagctatggtaacgaaagtgcaagtacaataccaaggtctccattcatcaagttgtaccataggttttgtgtagatgaatcagtttttgatccaagagatatactggaagctcttgatcatttatttgaagatgagacattaatcagccctgttcttgctaaacttctaaccttagagcatcaggatgaagctgagccatctatatcgttgatgcatgagaataatgatgttattgatagtgtaaattatttggtgttactcattggtttaattgttatttaa

SEQ ID NO: 102890 - DNA, 231 bp, Glycine max
  Peptide Sequence Number=SeqID_219668
atgctcgtgacaagtttgatacagctaagccagggctcattctcatcacctgtgttgcttattaagaaaaaagatggcagttggcattgttgcatagattatcacaccttaaatgccattacaattaaggataagtttctgatgcccactatcgacgagcttctggtggaattaggtcgtgcttcttgcttctccaaactcgacctccgacagggatttcatcaaatttga

SEQ ID NO: 102891 - DNA, 369 bp, Glycine max
  Peptide Sequence Number=SeqID_219669
atggctagtatttggcctaagcttttggaatcagaagtgtggtatgtggaaaagaatttggaaactagtcgtgccttagagaattcgagtattcatatggcaagtagctcatggaagattgaaaacaaaaatcattgtcccttagttcaagaaacttctatgcatgtcttaagagactgttcacagaccctatggagttggaatcaccttgttgctatagaatttaaaagtgattttggtagtgcttggtattcgagggccaagcaacctccgagaacgaagagggaaagagaaactagagctcaaggaagagaatggaagttctttcttgcattcatcaaggctggtgtgaacatttatagccactaa

SEQ ID NO: 102892 - DNA, 315 bp, Glycine max
  Peptide Sequence Number=SeqID_219670
atggaagattgcccgattcacggggaggttcaaatactttgctacacaggattggatgaagttgtgggtgctcccaccatccacgaggatcatgacattgtggaggagcttaagaggaaatcgggaagtaggagttgcaatggtgggcaaggctatgggaggggaatgaaatcgagcaccacgacgacgtccaaaaatgaagcagttgaggagaaatggtgttgtgaggcccacaattctattggcaagccactcaaactccgtgagataatcattcacagacccgtgctgttggagtttgaaaaagcgtcgtga

SEQ ID NO: 102893 - DNA, 795 bp, Glycine max
  Peptide Sequence Number=SeqID_219671
atggcttacccgcattaccgatcacagttcggagacacaacgttcactaaggtcttcgttggaggcctagcttgggagactccaaccgaagaaatgcgcaaatattttgagcagtttggcgacattcttgaagctgtcattatcactgataagagcacaggaaaatctaaaggctacggattcgtaacattccgtgatccagaatcagctagaagggcatgtgctgatccaaacccagttatagatggaagaagagcaaattgtaacattgcttctctaggaagacctagaccatcaccacctagaggaagaggtacattccaaggaggagcaccagtgacggcagcagcgtcttacggtggagtgccggcggctgggccgccggcactggcgccgccgccaccgccgctagtgtacccgccatatggtagaaatgctggtgacaatagctaccctacctacacccctgattatgggtaccaccaagcctcattgtataacccacaaattcagcaaccacaatactaccaccaacaactctacggaccatcatcttccaccatgggttccccttattactatggctattctgtgcaagcaccaaggggcacattctcttcaacccaaccacatcgcataccagctggaccctcctatctatactaccctacacccatggaaagctctttctctgcttatcgtccaccacctcaattgcaacaacttccaataaggcaaccccctccttcccctagtggtagtttttcttttctcttctctaataagctgatttaa

SEQ ID NO: 102894 - DNA, 1134 bp, Glycine max
  Peptide Sequence Number=SeqID_219672
atggtgaaggacaggtttcccatgcccaccattgatgagttacttaacaaattaggccgcgcatcgtggttcttgaaacttgacctccgccagggatttcatcaaatccgtatggctaaggaagacatccccaagaccacctttcaaactcaccaaggccattacaagatgaagcccttgcttatcctcccacatgtgccatctggaagcaatggtcatcaccctttcttagggaaccagttccattaccttggccacatcgtttcagatcaaggtgttgctcttgaccctgataagattcaagctatgcttgattggccgcacccttcctctcccacagaactgcgcagatttctgggtttaaccggcttttatcacaaatttgtcaggggatatgcgtccattgctggcctgttgactactttgcttcgcaaggatcaatttctttggaactcagatgttgagttagcatttacacaactcaagcaactcatgaacgaggcaccagtgcttgctaccccggactttgctattccgtttgttctggaaaccgacacctttggttctgccataagagttgtccttattcagagctcacacctaatcgctttctatagcaaatgccttgtcccgtgttgtcccactattggatggtcaactcttcattctgtcgatgctcaatttcgacttcttggagcagaaaggatatggattccttcagatagtccattcatttcaaatctcctggccgagtttcacaccaccccccctgagcagtcacatggggtttccaaaacccttcataggcttcaaaccaacttcttctggccacatatgcgttgtgacgtttgccgctacgtgtctcaaattttcatctgtcaacagacaaagtatcagaccaggaagccaacaaaggttgcttcaacccctgcccattccaacttctccatggaaggacctttctttagattttattaccggggcttttccccaatagaagttgttgattcgttaatggctgcccacactactattcactttactctagaacgtcttctccttaaggctcaaacaactatgaagcattctgttgatgctcatgatcgtgatgtttcctataatgctggtgactag

SEQ ID NO: 102895 - DNA, 525 bp, Glycine max
  Peptide Sequence Number=SeqID_219673
atgaatcttaaggggaagaaaccagtcctcccagtccccggcggcggcgaagccaccacctacactcgcctcccgctcaagcacgactattctgctccctcccctctctcctctcccgaaatcaagctctctgaaacagccccaccgatcacccgcctcctccgtaatcgcaaaccacaaaatataaaacaagatgacgtcgtattcgagtattctgattccgaacctgaaagcgacaacaagtatgaagccttcgacttttcgggatacgagaatgtggacgaaggcgaggaagagactctgagcgtgagggagaagggggtgccagcggtgatgcgatgtttcgaccgggcgaagatatacgtgaagtcgggggacagtgggaacggcatggtggcgttcctctccctcttcaaatcccacggagaaaggaggagtgagtacaagcacggagtgagtaggagcacgtttcgagaaattgaaattcttaggtttttaggagaatttcatatgactcagttttag

SEQ ID NO: 102896 - DNA, 168 bp, Glycine max
  Peptide Sequence Number=SeqID_219674
atggatagaccaaggtattcaattgagtcctcaagcaatatctttgctccttcgttcatgacaagccctctcaatgccaccagaatgtcaccttacaaggctacctatggggtcttctctggtggaggtcgtcgattctctactaacaaactatgtcgtgctccatga

SEQ ID NO: 102897 - DNA, 477 bp, Glycine max
  Peptide Sequence Number=SeqID_219675
atggggaaaattcctcacgttacagaatggtcttataacaccgctgttcattctgccacaggactgtcaccttatcaaacagtttatgctatgttgcaagctctccataagaagcttttcaaagctcaaactgctgtgaaggtgcaagctgacaaaaaacgcatggaagtgtcctatagtattggtgattggtggttagtcctttcccctaaagatgcaacttgggaaccctgggatgatctctctcaaacatttcaccttgaggacaaggtgattctcctaggagatggcaatgttagtgatactataactacaaacaacaacacaacgagcctaagggaggaagagaccaatttatcactgaaggaagactcgctcaaccagttgtgttcgcccagtgaaaaagctcataaagagaaatcatgtgacaactcaggaatggatggaaagagcaatgtcattaggaaaactaaccta

SEQ ID NO: 102898 - DNA, 240 bp, Glycine max
  Peptide Sequence Number=SeqID_219676
atggtgggaatgagaaatctgtcacggatcgttattgcattcaaggctcagaagtctaaacaacagtgccaggatgaacattggttggagaggaattggggtgaaggtgaatttggtggacaaccagtgacagggagcttgggtgttggaagtagctggatgtggaagaaagccgaggcagcgtgggtctggaccagactcttaacctgttgggctgaaatatccaatgatggtgagtag

SEQ ID NO: 102899 - DNA, 1080 bp, Glycine max
  Peptide Sequence Number=SeqID_219677
atggccgatcaaacctgcgacacgtccattgaacgcttggaggagtctatgaaactcctctccatgtcacaatctgaccttgcttccaaagtcgattctatcctcacccaacttgccaaccttactcccacgccttcttctttaccccctttggagtctcgttttgctccttcattttacgatcgcccttgcggtgctctattcaagctcacccagcatggcacagtgacaaagtaccttatcggcttcgaatgtctcacaaatcacattgttggcctccctcacccttttctactcagctgcttcatttcttgtcttcaaccaaaaatccgctacaaggttcaagccttacaaccaatggccttaccacaggcaatggcccttgcaaagttacaagaggacaagttagaggattgttgtcatttcaattgctctaaacctctcagcaacccccttccaccacctttgccaccagcaaacccacaacctcagctcgtaccatccacaattgccccaatccgctctgttgctccatcttctctggcaacacctcgaccccactatcatcgtttatccctgaacgaaataacagactgtcacgagaaaggtttgtgctataactacgatgagaatttcggccccaaacatcactgcagggcccatttcttcttgctcatcaccaagaacgaggatgctcatgctcctccgagaagcccagccaagaaccgctacctccacaaatcagttttaatgtgttgtccaaccatcccacctacgaggctttctgtttgcaaggctctatcaactacaaccttgttacgattctcaatgatggagaaagcacacataacttcctccagaccagggtcgttaagttattgggtctttcttcgcaaagaaatagggccttgtgggtcatggtgggtgacggcttcatcatcaattgcctgcaccgttgttctaacattccctcttccattcaagggcaccattttgtggccgacctccatgatctgcccatcagtggagctcgtgtggtcttggacgtccaatgtcttaaggaactgggctcaattgtga

SEQ ID NO: 102900 - DNA, 2559 bp, Glycine max
  Peptide Sequence Number=SeqID_219678
atgtcccaatacaagggtgcttattcacggacataccttcaccgtaacgctgcgtgtgcttcccttgagtggggcagatatcgtgttagccttatccggccaagccgtagtcctttttcttctccggtattgttggtaaagaagaaagatgagacatggcgtatgtgtgttgactatagggcactcaattcaatcacggtaagagatcgttttccaattccgatcatcaaagaacttctcaatgagctagggaatgcctcatggttctcgaagcttgacttgcggcaaggcttccatcagatcttaatggcggatgaagacatcccaaagacagcatttcggacacaccacgaccactacgagtaccgggtcatgccgttcggactctgcaatgcaccgtcaacgttccaagcatccatgaatgagatgctccgccccttcctgcgcaaattcgcagcagttattttttacgatatcttgatctatagtgccacactccaggatcacgttcatcacttggattctatttttagctctctttcgaaggccagatactacctcaagcgttcgaagtgcctgattgggcaatgccagctcgattatttgggtcatgtcgtctccggtaggggtgtgcgacctgatccctccaaaatccaagccattgtcgactgggccacaccacgatccccaaaggatcttcgagcctttctgggtctcacgggtttttataggaagtttgtgaaaaggtatgtcgccatcgcagtgcctctgaccaagttactctacaaaaatgcctttcactgggtatcagagtctcaatctgccttcgagaacctgaaaacaaccatgattgccgcgtcggtgctggctcttctcgatttcacgattcctttcgccctagaaacagatgcgtccagcacagctataggcgtcgtccttcatcaacagggacaccatatagcatatttcagtaaacccttctgccctcgtcttcaacaggcttttgcgtatgttagggagttgcacgccattgtcgtcgcggttcgcaaatggcgacaatatctccttgggcataaattcacgatattcactgatcatcgtagtcttcacgagctcatgtctcagataatacagaccccggagcaacaattctatctggaaaagctgctagggtatgattacgatatccagtataagactagagcttcgaacacattgaagggaacattattagctagctcagaatttcataagcaacgagaagccatactttcccacccagaagcctaccctgatttctctatctccgacgaccttatcatcttcaagggtgcaatctggctcgactcgcaggatccattcatttcggctttgttgcatgaataccatgcgactcctctgggcggccactttggagtgaagaagacattacatcgcctccgcactaacttccaatggattaacatgcttaaggatatcaaagccttgttcgcagatctttccttggattttgtcactcatcttccaagctcccatgggttcattgttgttctcgttgtggttgatagattctccaagggggttcatcttggcaccctacccactcaattcatagcgttcagggtggccaatctattcatggatactgtgtgcaagctccacgggttttcccgaagcatcatctcggaccgggatacaatcttcctcagctcgttttggaaggagttattcaagatgagtggtacaactctacgaatgagcattgcctaccatccacaaacggatggtcagacagaggtcctaaatcgcacgcttgagacgtatctccgatccttcgttcatcatcagcccgcagaatggtcatataataccttgcaacattcgaataccgggctcaccccttatgaagtaacctatggaaaacctcctccttccgttcccagctatctccgtggctcctcccgcaatgaggcaattgataccatacttaacacaagggaagaaacttacgcaaccctcagacgtaaactcctcaaggcacaagacaccatgaaacatttcgcggataagatgcgtcgcgatgttcaatatgaagttggccaactggtatatgttaaacttcgtccccatcgacaactttcactccgttcccaaccatccaacaagcttgctaagcgttacttcggaccttttcgtgtattggaacgcgttggcagcgtcgcatatcgcctgcaactgcctgaagggtccaagattcgcccaatatttcactgttcattattacgacctcaccatggtcccagtgatttgcaagcaaccccccttccaccagaaacgcttcataataaccttatattggagcccttagccatcctggactcacgcgtggatagttcaactcaaccgcccacgaagctcatattggtgcaatgggtcagtctggctccggaagattctacctgggaaaattgggacgatgtccgtagatcccatcaccttgaggacaaggtgattttcctaggggaggatattgttagcagcaccagcagtgacgaagga

SEQ ID NO: 102901 - DNA, 181 bp, Glycine max
  Peptide Sequence Number=SeqID_219679
atggctgatgccaagtttgcggggctgctcgcccctagccattgcttaagtttttccatgtgcccggtggtcggttttggaccgtggctaggtcttggcaagccgttggttgaaattttgccccccggtcaacttcgtggtttttgcccgttgttggcttggctagggtcggcggtgctgg

SEQ ID NO: 102902 - DNA, 171 bp, Glycine max
  Peptide Sequence Number=SeqID_219680
atgtcgcgggggtcaggagaccttggggacgtcaggtggggtgctattgcccaaaaccaagcttggccaatcccgacccaacccgggcatagtcaaaaattagcctctggtaatcgattaccattcatgggtaatcgattacaggggttaaaaatggagacaggatgttaa

SEQ ID NO: 102903 - DNA, 519 bp, Glycine max
  Peptide Sequence Number=SeqID_219681
atgcgtagtgattgcttagtgcaattctccattctcaatctttttcagagccccatgaattgcgttttcgttcatctgtcctccaccttcgagtttggagctatgcgtagtgatttcttagtgcaattctccattctcaccatttttcggagccccatgaaatgcgttttcgttcatgtgttctccaccttcgagtttggagctatgcgtagtgattgcttagtgcaattctccattctcaccatttttcggagccccatgaattgcgttttcgttcatgttgcaattctccattctctatcttttgggagccccatgaaatgcgttttcgttcatgtgtcctccaccttcaagtttggagccatgcatagtgattgcttagtgcaattctccattctcacccattttcaaggccccatgaattgcgttttcgttcatgtgtgcaccttcgtgtttggagctatgcgtagtgattgcttagtgcaattctccattctcaatcttttcggtgccccatga

SEQ ID NO: 102904 - DNA, 417 bp, Glycine max
  Peptide Sequence Number=SeqID_219682
atggctcacttcatagcatgcaagaaggtagatggcgcttgtcatgtttttgattcattcttcaaggacgtggtaagattgcatgctttacctagaagtgatgatttagttgatttgaggccaaatatttttcaagaaagagggaatgatgaggacatcaaagaccaggcccaagcccagaaggaagcccaagacctaatacaaggcataggagggccaatgacaagagcaagaaccaaaaagaccaaagaagctttacaccatataatggctgtcgcaacctacccttcggcgggagggcgacgcgagactcacgggtgcgtattccaagaaaggaatacgcgcggagtcaccaccaacgttttatttgaggaaaacgtcgaaaaaactggaaaagacgtggtctacgaactttaa

SEQ ID NO: 102905 - DNA, 881 bp, Glycine max
  Peptide Sequence Number=SeqID_219683
ctcgagttcgggacccagggaccgctctccccgctgttcaaggcgctggccggcaacccgatgatcgactggctgttcatgctgggcatgggcggcgtgggcgtcgccctgctcctggggatcgccacccggatcgccaccgtcgccggagtcgccctcatggtcctgctgcgcctcgccgtgtggcagagccccaacaacccgatcgtcgacgagcacctggtctacgccctcgtcctgatcgccctcgccgtcacgcccgccgcgcgccgtgcgagcctcgacgcgctctggcagcgactgccgatcgtgcggaggatcgcactcctgcgctgacgcgcgcgcgaccccgaacccgctcgtcgtggcactcaggacggcgttgggccgccgaccccgtcgtcgaggatcccgcggatgaggacgcggatggcgaaatcccgtcgcgcctgttcatccggctcggtgagcagcggcgcggcccgcctgacacgagggaatcgcgcaggatccgcgctctcgtacgcggcccgcacatccgtccgttcggcggcgccccgtgcggcgcccgaccgcacggtccgctcgatcgcagaggaggaggcgaactgggcgatgaggtccaccgccagggcggcccggtcgtccggcacaccccccaccgccatgagcgcgagttcgtgctcggcgagccggagagcaccggggagcgtcgggatggtgcccagcgccaccgccccgaggcccgggtagcgctccagggtgccgatcgtgtcgacgatcgtctcggcgagcgcgtcctgccaccctccctcgccgatgtcggcgaggcgtacccgcgcataggcggcgtcgaggacgtgctcgagcaggatgtcgcg

SEQ ID NO: 102906 - DNA, 228 bp, Glycine max
  Peptide Sequence Number=SeqID_219684
atgctgcgcgatgaatatttaaaaatcaccgcggctggctttgtccatcaggtcaatcaaggcgtcttccagctgctgcgcagaagcctgtgccctggcggtcggatgcctgatatttttcaggtcatgggtaggccggtccagccccaggtacaactgtcgcttgccgccagcatccggcttttcgtaaatggccacccggcagggcgcaaatgtgggatcctctag

SEQ ID NO: 102907 - DNA, 723 bp, Glycine max
  Peptide Sequence Number=SeqID_219685
atggccaatcgccatggcctgattgccggtgcaaccggtaccggtaaaaccgtgaccctgcaaagcctggccgaacagttctcacgtattggcgtaccggtgtttatggcggatgtgaaaggtgatttatccggcatcagccaggtaggcggcggtaatgccaaaatcgacgcacgggtacaacaactgggcttgaccgattatgccaaccaggcctatccggccatgttctgggacatgttcggcgaacagggccatccggtgcgtaccaccttgagcgaaatgggtccgttgctgctggcacgcatgcttaacctgaatgaagtgcagggtggggtactcaatgcgattttcaaaatcgcggacgacaatggcatgctgttgctggatatgaaagacctgcgcgccatggcacagcattgtgctgaaaattcggctacttaccagacccagtatggcaatatttccaccgccagtgtgggggcgatccagcgcgctttattgcagctggaaaccgagggtggtgaccacctgttcggtgagccggcgctcaacctggaagacatgatgcaaaccgatgccaaaggcttcggctatatcaacatcctggctgcggataaattactgaactccccgcgcgtgtacgccactttattgctgtggttgctctccgaactgtttgaaaaactgccggaagtcggcgatatggaaaaacccaaactg

SEQ ID NO: 102908 - DNA, 245 bp, Glycine max
  Peptide Sequence Number=SeqID_219686
acgctgacatctccggcaagggtgcagaggacattgacatctccgagaacggtgtagacgctgacatcttcgggaagggtacagacgctgacatcttcgggatgggtgcagacgttgacatccccggaaaagctgcagacaccgacatctcaagaaagggagcagacgctgacatctccggcaagggtgcagaggacattgacatctccgagaacggtgtaggtgacgacgatagccacttctag

SEQ ID NO: 102909 - DNA, 1324 bp, Glycine max
  Peptide Sequence Number=SeqID_219687
gtcgactctagaggatcccactctacagcagcaccatcggttgcgtggcggccacgctggtgctgacccaggccgggccgggcgacgtctggctggcgctggccgccatcgttgtctccaactattgctactgcgtcggcgagtccgtggtggcggcgttcctgcccgaactggccaagccgtcggcgctggggcgggtgtcgggctggggctggagcttcggctactgcggcggcatgctgaccctgggcctgtcgctggtggtggtgaaactggccgaggccgacgggctcgacgccgagcacttcgtgccgcgcgtcatcctggtgacctgcgcggtgttcgcgctggcggcgctgccctcgttcttcctgctgcgcgaacgcgcgcggccatccggcgagccgcaggcggcgctggccatgctcaagcggctggcctacgcctggcgcgagacaggccagcattttcccgagttccgccggctgctgatgtgcatcgcctgttatcaggccggcatctcggtcgtgatcacgctggcggcggtgtatgcctccgaggtcatggggttcaccacgccgcagatcatgctgctggtgttcaccgtgaacatcggcgcggcggccggcgcgttctcgttcggctatgtgcaggatcgcatcggccacaagccggcgctggcgatcacgctgtgcggctggatcctgatggtgctggtggcctacgccgcggtgacggcgccggtgttctgggtggccgcgacgctggccggcctgtgcatgggcacgacccagagcgcgggccgcgccatgaccggcgcgctggcgccggccgggcgcctggcggagttcttctcgctgtggacgttcgcggtgcagctggccgcggtcatcggaccgctgacctacggtctggtgacctggggcacgcatggcaaccaccgcctggcgatcctggtgaccggactgttcttcgtcggcggcctggtcctgctgtcgcgcgtggacatggcgcgcggcctggcgcgccgcgccgcgtaagggcgcgtgcggtcgccgcaactgatattcttatgaagtcccggatgccgccgcggcgcctcgcggcgcggcggcatccggcgggttgcgtattgcgttgtcggttgtcgatgccgttgccgtcacgattggcgcgcgttcctgcggaatacgggcttatggcccgtattttgcgtaaggtgcccgtaagagcgcggcgatacggttgcgagtggcagtcagataaaagcggcatcaacaacagaatcacagattggagacaagatcatgtcgaatgctattga

SEQ ID NO: 102910 - DNA, 2637 bp, Glycine max
  Peptide Sequence Number=SeqID_219688
atggagaatgttaaggctatcaaggcaattctgcagacttttgagatggtttctagccttaaaattaactttgcaaaaagttgttttggtgcatttggaatgtcagataggtggaagagggaagcagccagttgtttgaattgtagcttgttgtccatcccgtttgtttacctaggcatacctataggggcaaaccctagacggtgccacatgtggaatcctattcttgaaaagattcctaagaaagtggtggagaagctagtgtctatacaaagaagattcctatggggagcatgcctccctaaagagaaagggggattgggaatcaaggacatcaataccttcaacatcgccctgctaggcaaatggaggtggaatctatttcagcatgaaggacaattgtgggctagggttctggagtctaaatatggaggttggaggggattggacgaagcacatcgagacaatcatgagtcaatttggtggagggatctaaagatggtcgttcaaaactcacaacaggggatggagctgagtaatagcatagagtggaggcttggctgtggagatagaatcaaattttgcgaggataagaggccattgtttgacaatgagataccaatggctataaatttcttacaacatgttgaaaacagagatagagagagggcaggacaacgagggagagtgagtgagagagtaagggagaacgggagagagagagcgacagagaatcgagcggagacacggagggagaggggtcgcactgcagtcagagatacaccgagagcaaggcgtagaaaggaacactccgatggaaggaacgcgtccagaagagggagatactctttcgaagcaaacacaatctatgaagaagatcgagaacatagcgacactcggtctaatcaacagcagggcgcatggatacaagtgaggggtaggagaaagaatgagaagaagaccctgccagagtttggaagggaagtggatggacattatgcttgtggtcggaatatcagtcgtggaaggggatcaactcttacctggagggacagaccagacgagtggggaaaagtatgggaggtttttatacccacgaagaggaacaaacaaggccatagatatggttttgtacatttcaaaggggtggagaatgaggataggttggagagaaagcttgataataatatatacataaatgacatgaagatgttcgtcaataaaccaaaatttcagagaggaggatataaggcagataatactcaaacagggaccataagcagaacaggaggtcaaatcatggaggacgaaccttttcaccaaccgaaacatcaccacaccctgccgtctaagactaagacttatgcggaagtggtgaagcaacataacttgcaggaaggaaaaggggtacaggggattacgtcgggggaagcaataacagacgataaaatagagcctatagtcatccaaacagagaagtcgaagacaaaatggcttgataaggtgtgggtgggtcatctaaaaaacgaaggtatgtttgacagagtggaagaggagctacaggagatgcagggactgggtggaacgaaggtgaaatcggcatattggggagaggatatggtcattcttcatgacttagacgaggtaacagttaacatcatcaatcaaagagaacttgttacaggcgcgactcctttctcctccattcagaagtggacgccgatgatggtgccgtcgtatcgcttaacatggcttctcatttggggagttccgttgcaagcgtgggatgcagaatatatagcagatatcgtggcgacctgtggtgagctggtggagttagacccggcaacggaagacaagtcgaggatgaatatcgctcgagttctgattcgcacgaaggggaaaccacttattgctcaaaagctcagcgtcatagtggatggttgtagacattcgttggaggtgagagaggatacggtttccgggtggggaagaaagaggaggttgaaaccaaacgagggactcttttcgtcacctttctccaccgacatggaggatgaagatgatgagccaaacacctatgaccatcgatggatatcgcccgacggcctcacggttagcaacgtcggcgcgtctcctacccaaaggccgtcgtttggttcctgttcgcggcgaaggaacgatgtccgtggtagcacggctgacgtgtcaccacgtcgttcgagcacgcctccacgcgtcacgaaggtttccctgcccaacccaatctcagatactgttgtggaaactgcagctgcagggcctctgttgaatatctctcggtcaatggatgcttttgacaaaacgaatgaccaaggggccctggaagaatatccttcggtcaatggatctgagggatctccagtggtcaatcagaattcaaatttattgggtccggctgatagagactttgcaatgttttcccacggtgtgaaggaggatgaagtaaataggaagcactgggagatagcccgacaattgggtatatcatttcctgtaaacatcaaaaacaggggtaaggagaagttggatgtggataacacaggatattcatttgcagcatcagcagagacgggaaataatacaaatgacccatga

SEQ ID NO: 102911 - DNA, 2358 bp, Glycine max
  Peptide Sequence Number=SeqID_219689
atgaagtcaccacaaggtgacgaaggtggactaacctcaatgcacctcgaggtctcgtcggaaatgaagaaaaggctcggtgatgcttgggagtgcggagtggatatctcctccaaatacatgggggatgacatgaagtggaacctgagcctgcgcccggattatacgctgacatgggtccaatgttgggggatcccgatcctagcatgggattcaacaaagatcagacagatagtcagtatcatgggagagatggtggaggttgacgatgaagtcgatgaatgcaggaaattggatagagcacggggatgcggaaataactcagcaatgtgccagtgtcgaagaagcagaggtacaggctcgtcggaggaggaaatcgactccgatggaagctttatggcttccccgacatcggtgaggacaatgatgatggaaatggaagatggtgcgtcgcagttgggagcgcaaccaaacaaggaggatccacggcagaaagaatggagaggagcaggcaacagcgccgaagaccagtcctcgcagttacccagcggtccacctgaaggaagctccatgggcctcccgacatcggggcggattatcgcaccggaaatggaagatgatgcatggcagctgagaacacagccaaacatcatggtgccgcggcggaaacagggcaaaggagaaggagatggcgtcgacgaccagccctcgcggttacccagcggtcaaactgaaacacagcgaccactgggtaatggtaaatccccgcggacaaaggcacaacaacagaaatcaaatgaggggcaaaccaaatcaggaaagggtgaagaacggacggcgggaggaccaaggcgcagtgcatgcaccatgttcgatgaagaaaaaagtgaggatggaaggggaaagtctgcgggcagggataatggcacagcaagaaaagaaaagagctttaaaggtgaaagtagcttggtggacaatagaggctacgtggcaggaaattttagaagggaggaaaaaggggtaaaaggtagagacggggaggagttggatagctcaactgaaatgggctttactacctacacccctattaaaacccaatcagtcaaggagtgtagcccacagaataaaaagacagattcagctatctcctggaaagtgtattcccgaaccaggaggtataaaaagcaagtgcaggatggaaatgccaactatgaagcccaaaccaatggcttagtaatacacacaacaccaacgcagcagcaacaaaataaagaaagtacacagcagcagcaaataatggccacagacaagggattagaagaaagcaaattgcaagatgcaatagagttgtgggaattagcaacaaagttgggggaaactaagaaggagtcaatagagaaatcaatgtgtcaggcattgtggggggatgctgatgtggcttgggaaatgcagccggcaaataatacaacagcagggggaatattatgccagtgggttaaagaggcacagcaggttcacataatgtccgtatattcaccatgtgatactcacaacaaaagaacattatgggaagccatcagacagctgaaatcatcaaaccaagggggcttatggtgcatctcaggggatttcaacaacatcagagaccaatcaaagagagcgggagtatgccaaaggggggtagaggagagcagtataaaagagttcaacaaatggattgaagacatggagaaagaggaggcaccttgggtgggtagaaagttcacgtggttcagacccaatggagaggcaaggagtaagttagacagatttatggtatccccaaagtggcttgctaaatggctcggatgcacacagcatccattggacagcaacttctctgatcattgctcggttctgcttagatccaagtgtattgattggggtccaaagccgttcagaatccttgactgctggctattggataaatcattcaagtcaattgtgaaggagtgctggacagccaatcatcagaggggttggggaggatatgtacttaaagaaaaaataaagaaattgaaagaaaggttgaagatatggaacagagagcagtatggtgatacttttcagaaatataagaagattgagaaggagttaaacaacctggaagtgagcacaagtgatagactactttcccttcaagaggtgattaccaggaaacagctccaagaagatctgtgggtagctgcacaaacccacgaatctttgctaaggcaaaaggcgagatctagatgggttaaagaaggcgattgcaattcccgatattttcatttgctggttaatgcaagccgtagaagtaactctttgaacggagtgtga

SEQ ID NO: 102912 - DNA, 480 bp, Glycine max
  Peptide Sequence Number=SeqID_219690
atggtgatagtggtaatgtctgcaacagcgacaccaatagagatattagtggtggtggtggaggtggcattggtggtggtaacaatacaaatagtgatggcattgacaatgtggtgtttggtagcgatgttagtggtggtagccaatggtagcaacattggtggtagtgttagtgacggtagtcacagaggtaatattagtaatagtggcaataatgtcaattatgttggtggcaatggtggtgtcagtgatggtggtggtggcagtaagtggtggtgtggtggtggtggtgacaatagtcacagaggtagtattagtagtggtggtagtaatgttagttatgttggtggcgatggtggtgtcattgatagtggtagtagtaatgttggtggtggtattgttgtcgtggtgacaatgacaatgacggtaacattagtggtggtagtaacaatgacaatggtaatggcgataaaaacctaa

SEQ ID NO: 102913 - DNA, 378 bp, Glycine max
  Peptide Sequence Number=SeqID_219691
ggaaggaagtaagaagttggtgaagaaaaggaaagggaattatgcaagaggtgaaggggtgttgagatggaagagaaagaggtgtaaagccagttgtagagaagatgagaaagaaaatcaatgtgagagagaagagggcttttacttcttgcacctttttgttcctgcaccctccaaaaagacgcacattcccaccaagatgatgaaacccatcatcactagttcccaccccgttttaacccttcacttttgggtgtccctcatcacaatgatctctaccacctccacctccactcaacccctcccctccgatgttgtcatctgcgccatcaacaagaagggtattattgccctttggggtacaagaagcaagaaagg

SEQ ID NO: 102914 - DNA, 459 bp, Glycine max
  Peptide Sequence Number=SeqID_219692
atggtgacgttgcgcacgccaaagcgctcctgcagcttgccggccagcgaggaggcaatcgccagaccaagactgagcagaccaaaggaaaaagccacctggctgactggcgcatccagcttctgcgccagctggccgttaaacaggctccagcgcagcatctgcgcggcaaaacacaggaactttgccaggcttatagttcactcaacaggaggaaatatgaaagaccgggcatatgaatccgtatccagcggggatgaggtttgctgcatcatcggtcaggcggttatcgagttaagcgatgaacagcagcctgtgaccaggtccaccctgtcgctgaaattactggcgatggccgaccgcgacagagatgatgaacgcgttctgctttactggattgccagaaaagccataaaccaacctcaccagctcaacatcggcgtcgggggctggcgctag

SEQ ID NO: 102915 - DNA, 1416 bp, Glycine max
  Peptide Sequence Number=SeqID_219693
atggccattgataactcaccggtggcggaaaaagtgatcgccctgaccattgaacaggcgctggcgcaacaggcccaggtcaccgtgctgtgctgtgtcgatccggcttattcgtcgtgcaatcagccgattgagatcgacgccggggaagacccggacgattttgtcgtggcgcaggatgaacaaaacacggctgaaatggtggtacgccatgcgctggcaccaatgctgcgcgctggcattgacgcacgcgggctgattctggccggtgaagcggcagaaaccattgtggcgcagtctgaggcgttgcacgccagattaatgtcgctccatgttctcgcttttcccgctcacgctggccgcttttgtgctgctggcgatcatcatcgtgatactgctgcgcaccaccgcgctgcgcgtctggcagggtgtcctgctgtggctatccaactgagcgacgcgccgggttatcgcgtgctgaaagtgcaggagccggcgctgtggcaactgctcaatcgcgagttgcagcacaagctggcagagggcgtacctgcggagcaggcgctgggcgatatgcgcggctggctgatggatttggtgaatcagcgcatggcgcgcgccagcgatgcggcgatcatcaactacatccgcgtttcggtgcaggagatgcaggcgctgcagcagcaggatacgcagcgctgcttccgtttcctctatccgcaggtcagcggtggcgtcaatctgcaacaggtgctgtcgccggagcttaatcagcgcgatggtgaagcgctcgaggcactgttgcaaaacagtaccggcgatgagctggcggtggatcagcctcaggcgcagcgcgatctgcagcgcgtggtggaaaaactgtatggcaagtggggcgataagctgcagcagctgaatatgccggcggatacggcggtggatcgcggcacgatgtgcgcgatgtcgattgatctttacagcggaattctcgcattgccggacaaacaagcggccaatcttttgcgtaagatggcgtgtggcgttgccttttacactgcaacgtctgatgaggacaccctaatgaataaaatgcttattagcgcgttagcgctttttatgctggccggttgtagtgtcagcaaacccgggggttttgagcgcgtggatgaagatgcccgttcaaataccgtacagtatcgttacgatccacagaagctggataaagatgcgctggaacttgatctggcgaattactgtaaccagcgcggcttcgataaagtcgagtcgcttccggcgcaggacagcaatttgcctggcctgaagaaagtctgtgacgatagccgccatggccgtgatgccagccgccgccgtgcccgtggccccagctgggaccgcgtccatggtcgtgctcgataa

SEQ ID NO: 102916 - DNA, 774 bp, Glycine max
  Peptide Sequence Number=SeqID_219694
atgacgctctctaactgcgtgaagtggtttccggagcgcaaagggctgatttcggcctgttcgatcggcgcttacggcctcggcagtctcggctttaaatttatctgtggcgcgctgctcagcactcaggggctggaaaatacctttgtgatttggggtgtgctggcgatgacgatgattattgccggggcactgatgatgcgcgatgcgccgctgcagcaggccggttcacgtcagcaacaggccacacaggagtttacgctggcgcagtcggtgcgcctgccgcagtactggatgctggcgctgatgttcctgacggcctgcatgagtggtttgtatgtgattggtgtcgcgaaagacattggtgaaggcctggtgcatctgagcacgcaaacggcggccaatgcggtgacgataattgccattgccaacctgagcggacgactgattctcggcgtgctgtcggacaaaatggcgcgcatccgggtcatttcgctggcacagctggtttcgctgagcggtatgagcatcctgctattcacccacatgaatgaaaccaccttcttcctgtcgctggcctgcgtggcattcagctttggcggcaccatcaccgtcttcccgtcactgcgtgcttggctcgctggtagcttcggtattcggcggcttcaccgtgaccttcagtctgattatgacgctgctggtgatctcgctggtgctgtcgctcagtatccgtctgccaaatcgtcaaaacctggtcgcgccggtactgcataa

SEQ ID NO: 102917 - DNA, 849 bp, Glycine max
  Peptide Sequence Number=SeqID_219695
atgggttatgaatccggagttgttgtttctaatgcactgattgatatgtatgggaaatgtaaatgtgttggtgatgtgttgagtgtgttcgagatgatggacgagatatatatttttcatggaactcgatcatgtcgggttcagcctgatttggtcattgttacaacaatacttccggcttgtactcatctagcagcattgatgcatggtagagagatacatgggtatatggttgtaaatgggttggcaaaggaagaaagtcacgatgtttttgatgatgttctactgaacaatgctttgatggacatgtatgcaaaatgtgggaacataagagatgcgcgaatggtttttgttaatatgagagagaaggatgtggcatcatggaacatcatgatcactggttatcgaatgcatggttatggtggtgaggcattggatttttttctcgtatgtgtcaggctcaaatggtacctaatgaaatcagttttgttggattgctatctgcatgcagccatgctggcatggtctttgctagtagcctgtcgtctccacaacgacatagacttggccgaggttgctgctagtaaggtgattgaacttgagccataccattgtgaaaattatgtgttaatgccaaatgtttatggagttgttggtcgatatgaggaagtattggagtggaggtatacaatgaagcaacaaaatgtgaagaagagaccaggctgtagttggattgaacttcagttctgcaagagcatggctacgtcccctttatctagcatttggtctgcaaagaaagttaggcatgagttcatgacgacttatgttgttgggatggatatgtgttga

SEQ ID NO: 102918 - DNA, 153 bp, Glycine max
  Peptide Sequence Number=SeqID_219696
atggctggaggagtggaaaccgcagcgcagggcaatctcggtgagcgacagcgcgctgaattgcagcaactgctgcgcggcttccatacggcggcgcatcacatactggtgcggcgcttcgccggtgctactgcggaacatacgtgcaaaatg

SEQ ID NO: 102919 - DNA, 310 bp, Glycine max
  Peptide Sequence Number=SeqID_219697
atgtcgtcaccgtcgacgtctctcggtcgtctgcgtcctctctctcgtatgcatcttgcttgggtctctcgtaacgtcgtgtgcgtcgccgtcgtcgtcaccgccgttcgtgcgctggagactgctgttggtcacaccactgaagactgttgtgttgttctgttcgtggctttgttctcgcgctccaagtttccttttgcaggagaaactcgggtagggttgagtcagtcggagaaaaaactggaggaatctcagggaaccactagagatgccactattgctgttggaagacacgtgagtcctcttagag

SEQ ID NO: 102920 - DNA, 789 bp, Glycine max
  Peptide Sequence Number=SeqID_219698
atgccccagggacataacacaccttcgctgtatgaaatgctcaccggcaacttcaccggcggcctggccctcgatcaggtcagcgaacagaatcaggtgattttgtccgtactcgacaatatgcagcgcatcctcaactgccgcgccggcacgctggcgcatctgccggactatggtctgcccgatatgaccaaaatcctgcagggcatgccgggcactgcccatgagctgattggcaccctgtctgctgttctgctcaggtatgagccgcgcctgaaaagcatcagagtggtgctgctggagcaggcgcagcccggcgaattgcgctacgcgattgatgcggaactgaagggactcggtctggtgcggtacggcactgagtttatgccggaggggcgcgttctgttgcggcatctcaggcagcagcaatatcttgatgtgactctgcaggctgaagcagccagaggcagaaaaccctgttctggtgcaaagggtggtattgcacactgtacctcagatggacgttttgtctgtaatgacggaagcctgagccagtcgaagaaaatttgctccaggtatgattcgtcagaaagcacgcagcaggcaaaatcaccgcttaacagcggaaaaacgcagaccaaaaagatcgccacatcaaagaaacagccacagccagtggctcaggatcagaacgatttgctaccacgaaaaccaacctgcgccccgctttatatggccagcaaacccggctatacgaatttacctatttgcaccggtaatcaatattaa

SEQ ID NO: 102921 - DNA, 285 bp, Glycine max
  Peptide Sequence Number=SeqID_219699
atgtcagtgaaaaacctcgtcgagcgcctaggagtacatgacaagacaaaccacacactagcaagtcaagtcactctcactatgttttgcgagaatattccaaccatatgggatcaacataggcttaaaggagcactcaagtcgggtgacccccaaggcctacactctgaagagtccggtcttgacattaactcgtcgcccttaaagggtcttagcattaactcgtcgcccttaaaggaacttaacattaactcgtcgcccttaaagggtcttatagtcgcgtga

SEQ ID NO: 102922 - DNA, 170 bp, Glycine max
  Peptide Sequence Number=SeqID_219700
atggttgttaccggcttccagaatgcgcggcttatccgggtcaaggtcttcacgccccatcaccagcttccaggtattgttaaccctatccggatggcggaacagccctgccacggcgacaaactgcgcatcttcttccattggcatatcgaggttcgcatcaccgccag

SEQ ID NO: 102923 - DNA, 147 bp, Glycine max
  Peptide Sequence Number=SeqID_219701
atgacaattgtgttattaaaaagcggccatggcggcgccatggtggaatggcgtcacggaatttcgaaaaaatgccaccaaatagcggtggcattgcgggttgcatatggcggcgccatggtggtcatggcggaatcgcgtttgtga

SEQ ID NO: 102924 - DNA, 291 bp, Glycine max
  Peptide Sequence Number=SeqID_219702
atggaaataggggtgtgggtgctggttttgcctcttctatgtcaaacttttccagaacatcatgaatgtacttgtgctaagaaaggaagatccctgatttgcagaccatctacatatgcaaggaaaaatgctttcacatttccagatgtaaagataaagagggacattgatgcaatcctctctaggaatggatcaatcactagagccatgagcaagaggatccaagaggattgggctagagatgctgaagaaggtcctagggttctcatgaacctcagggtagatttctga

SEQ ID NO: 102925 - DNA, 303 bp, Glycine max
  Peptide Sequence Number=SeqID_219703
atgtatacatggagaaaaacaagcaaaaaaaagaaaagagccatcaagtggagtattattattggagctgcccaacaagcctccaagaaaggtccaagtccaggtgcaacttcaacctcaagaggaagagggaaaggcaaagaggttcaagttgatgaagaaacagaatttgagagctctaagtctgaggaaagagaagaattatttaactttgaatatgaaggagaagaggaggagggatataccccactagataagaatgaaattaaatatgttgggattgaggaagagccagaagattag

SEQ ID NO: 102926 - DNA, 744 bp, Glycine max
  Peptide Sequence Number=SeqID_219704
atggattttggtgctactcatcatatcaccaatgatctagataatctccacatcacaaattcataccatggccaagatcagctcattgtaggtgatagtatcgcttttcctatagcacatactagtaacaccattttacacactcactcacattcactgcgacacctatctaatcaacctcgtcacctcaagaggcacccttggctttcactccaacaccaaagagatcataaagatatcacatccttttacttcacccgtttcgctgatgacatcacagagaaggagctgtggcaccatttcaaaaaatggcgggacgttagggaaattttcattccaaatcgaggaaactacatggggaaaaggtatggatttgtcagatttaaaggggtacgagatatcccatacatgacaaggcagctggataggattgtaattggtgggatgaaattatatgtcaacctcccaaagtatggaagggagttaccaaggaaggtagattcaggaatcaaaatacatgtacacaaggacagaactcaaacagaagatgctcgagcccgacaagcatgccagataaatccagcctcatatgtggatgcgctgacacgaactatcagtttactgggacaacgagtgacctctaacaatcgtgtatcttcaacgtcctcggttcacatcgacatcaggccagaagacactaaatggctgaagatgagctattgtgggagacaagattggatataa

SEQ ID NO: 102927 - DNA, 645 bp, Glycine max
  Peptide Sequence Number=SeqID_219705
atgacttccaatactagaagcgctaggattaatggatccttcatgccaatgtctcatccgttgatccaaatgcatgtgatcacattgcttgggaatgtccagacttccaagcaggcatggaacactctcaacaaaaggtatgccagcaagacctgtgccagaatcatgtatctaaaagaatgtctcactcatttcacaaaaggctctctatccatgactgattatctccatggaataaaatctttaactgatgaattaaccatcataaatgctccactagatgatgtagaccttgtcattcacaccctaaatgggctaggtgttgagtacaaggaggtttctgtagctcttcacactcgtgaaaaaccgattgactttgaagagcttcatgatcttctctctgattttgagagttatctcaagagggatggcaacaacaattatacctcatttgttgctattgctcatgcatcacacaagggtaagcaaccttaccacaaaaagtcctacaatccaaatcatggatcatcctccaatcgatccacctctccactccttaaagaaggtgctttgtcaatactgacaaacccagccatacagccaaggtgtgctagaagcttcatggatatcccaaaagaaatctag

SEQ ID NO: 102928 - DNA, 435 bp, Glycine max
  Peptide Sequence Number=SeqID_219706
atggggttgccatgtttatgtgggcaaggcgaaaagacaccatataagatatgggcaaggcaaaagctaagcatgtcctttttatggatatggggttgtcatgtttatgtgaaacatatgatttcaaataaactagaacccctatcgaacaaatgtctctttgtgggataccctaaggaaactaaaggatactatttctacaacacctttgaggacaaaatgtttgttactaggactagagtgttccttgagaaggaatatatctccaatggaaccagaggaaggaatgtagatattggagaaatccaagtgacacagagcactgatccacctgcaatggaacaaaaatcgatgccagaaatggttgtggttcctctttctattcaagtagcacaaaaattgttgtggaagcaatgctttccaagattattttga

SEQ ID NO: 102929 - DNA, 303 bp, Glycine max
  Peptide Sequence Number=SeqID_219707
atggtaccaattaggaactttgctagaaatgttcgtgaagaggagacatccctaaatgcaatcccagtgagaagtgacaacaagagattgtatgtaccttacccgatacttgactatatatgtgttccagctactccaccttcttcatcttctcattctccatcgtcgatggcctctatagctgacattgctatgatggactacactaatgatgacagagaagaggaggatctttctgaggatgcgagtgaagtgaatgtgtcattagggatcgaggaagacccatctaaggattcttcttag

SEQ ID NO: 102930 - DNA, 132 bp, Glycine max
  Peptide Sequence Number=SeqID_219708
atgacttaccaagatgccatcattggacctgaatatgagaagtggcttgaggctatggaatctgagatggaatccattgttcttatgctgaaaacttatccaacccaagatccctcgagtgaatgggtataa

SEQ ID NO: 102931 - DNA, 330 bp, Glycine max
  Peptide Sequence Number=SeqID_219709
atgcgggctgtggccatgacccaaacaccaccactatccagatctgccacaccggatcaccaacaacccatttgctcgtcggacgaagccatctgttgtcatcgtgacagtggctgcattgcaactaagggtcgtgcagcagaccttaagcacggtcacgtgaggtcagatttagcggcggaggtgtcatattccacggtggaggggcgacagagggtggtggttgttgttgtggaggggtgcagcgcggaggatggtggtggttggggaggagaaaatggaatcaccctgctgagaaaggatggggatattttggtgaaaaatcattaa

SEQ ID NO: 102932 - DNA, 330 bp, Glycine max
  Peptide Sequence Number=SeqID_219710
atggttgaggacacagacgttggtggatttttgttttcaaggcctcaagaaaagaatagcacaagtaacatcaaagaaaagagggtatgtctcctcttaagtttagggttcgggggtagggttaagggtttacaacctagggtaaaggctaagcgcgcatccaccgctatgcgtaacttcagtgcacttagcgcgacagaagaatttggcagggcatcagcatcaaggccgcacactaagtgcgagatcagtgcgctaagcacaacaggtgtcttcatccaggctcagcgcacgattggcgttaagcccgaatccacttacccgcgctaa

SEQ ID NO: 102933 - DNA, 672 bp, Glycine max
  Peptide Sequence Number=SeqID_219711
atgcaatatttcattttgatacccataagtagtggggcttctttctgcaccattcttcaccaattttttgagtcacaaccatttgatgctattgaggatcatcctcacccgtacattagtacccctacaatatatccttcctcatcaacccgaccaaacaagcttgagttcacagcagagtcaggcttacttaacgaagaacttaatccttttggtaaggacgaagacaaagttcttcacaaccaacctcaagaggaagataaggaggaagaagcccgacctatttcaccaattaaaatcgtaccaccatgctacataccattgaaaatgaatattttgaagaatccaattttcaagattttgaatacgggcatagcttggatcacaaagaagtccaacatctgggcattatacatccttgcctccaagcaatgggaaataagaaagctctgtgaatcctacacatgttcaaatccttcaatctcacaagatcatgcaaagttattttatttgatgatcagtaaaaacatccttaaattgatagaaaatgatccatcaacttcactgtcaaccttgatagcatacatcaaaaggattaaaggatacaccaccacgtatcgcaaagcatggctggaaaaacaaaaggctattgaaggcatctatgacaactga

SEQ ID NO: 102934 - DNA, 327 bp, Glycine max
  Peptide Sequence Number=SeqID_219712
atgggaacaccttcagaagtgtcacgagcgaggtcaggttctgatgagaggtgcattttgtcttcagattcaaaggaaggttttgtgaagagggcaacattggtgttgcatttgccggttaacaactttgagcggaagaggttaatgagggtgcatacgtttcttacagtgggggcacacatctatagtggttcacgaaacaacacatttaggggaagagattgcagaagtaagggtttaagaagaagaaggggaattatgaagaacatgttgcagaccattgcaaccaattctctggcgagcctcaggtttaagcggcgctactag

SEQ ID NO: 102935 - DNA, 261 bp, Glycine max
  Peptide Sequence Number=SeqID_219713
atggtttctggtgtaggggattcggatgacgaaaatgaggatatcaatgatctttttgatatattgtgctatgatgcgaaatccagtggcatgtcaattgaaaagaagattgagttccttgagagtttgactggaaagttgatgcaatcctaccccgcaagcgcattggatagaagactcgaagtagattgggccagagatgcaagagaagcccctagggttctcataagccttagggtagatttcgggcccatgggctaa

SEQ ID NO: 102936 - DNA, 761 bp, Glycine max
  Peptide Sequence Number=SeqID_219714
ggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgttattacggattcccgtaaagctaactgcccgccagcccttcgatttccaaccgcataaatacgacatcggtatacttactggattaaagcgcggttatgaggataatctctttattcgcaaactgatggatctgccggaatcggaatacccgctttattacagacatcatttagaatatttcctgtccaaagagccagacggtgaacaagagtttttcaccttcgtctggcagatcgttcaacgacgcatcaagtttatcgagcagaaagatccttttcattccagtcatgcacgggatgtagagttgatcgccatcctcactaggtttcagaaatacctgcgctctattgatcaatggcataccgagaaaacactgccagaaataatcgcagagcaatacgagcagatcaagcgccaatcacaggaaatcgcaaaccttaaagaagaattgaaagaagcaagaaaactggagaccaaggaattcattgatattgcagatgggggggcccggtaccagcttttgttccctttagtgagggttaatttcgagcttggcgtaatcatggtcatagctgtttcct

SEQ ID NO: 102937 - DNA, 1110 bp, Glycine max
  Peptide Sequence Number=SeqID_219715
atgaagagatcgcctgatgctggacacctttgtgcaattgcttcccgaactgggcgtagcagtcggccagaccttcctgatgctgggcatcgcgctggccgcgtcgatcctgctgggtggcccgctcggcgtgctggtgttcctgaccggcccgggccagtcgctggaccgcccgctggcgcaccggctgctgagctggacggtcaataccgtgcgctctttccccttcatcatcctgctggtggcgctggtgccgttcacccgcgtcatcgccggcacctcgatcggcccggtggcggcggcggtgccgctgtcgttcgcggcgattccgtacttcgcccggctggtcgagcaatgcctgcgcgaagtgccgcgcggcgtcatcgaggccgcgcacgccgccggcgcatccgaactgcagatcgtgcgccgggtgctgctggtggaagcgcggtccgggctggtgctggccctgaccgtgctggccgtgagtttcctgtcgtattccgcggtggccggcgtggtgggcggcggcggcatcggcgacctggccatccgctatggctattaccgcttccagaccgacgtgatggtgctgaccgtggcgctgctcgtggtgctggtgcagatcatccagttcgctggcaataccgtcgcgcgacgcatcgacaaacgctgatcccgagaggaatcccatgcccgtcaaacgaaatcgtcttcggcgccaccgccggcccctacagcgaccagatcaagctcggcatcaagccgatcctggaaaaacagggctacaccgtgcgcatcgtcgaattcaatgactacgtgcagccgaacttcgccctggcgcaaggcgcgctggacgccaatgcgttccagcacatcgtgtacctgcagaacttcgccgccaagaacaagctcgaactgtcggaactggtcaaggtgccgaccgcgcccatcgccatctacagccgcaagtacaagagcgtggacgccgcgcccgagggcgtgagcgtggcggtgcccaacgatccgaccaaccaggcgcgcgcgctggtggtgctgcaggagctgggctggatcaagctgcgagaaggctacgacccgttgcgg

SEQ ID NO: 102938 - DNA, 193 bp, Glycine max
  Peptide Sequence Number=SeqID_219716
atgtttttcctatacggatttagaggcacaggaaaaacattcatatggagaacattagcaagttcattgagagcagagaatcaaattgtgattattgttgcttctagcggaatagcctctcaattattaccaggaggcagaactgcacattccagatttaaaattcctgtaccaatttttgaagactcaacat

SEQ ID NO: 102939 - DNA, 267 bp, Glycine max
  Peptide Sequence Number=SeqID_219717
atgctcgacgtgccgggagttgagctccaagttgctagctggagtagttggagcgtgggggttgatgaacttgaggttgagctccaggttgttgcagttggtggttggagccgagggaagcgagccgttgagtcgagcatgggagttgagtcagtctttcgagagtcgttcaacgtagtggagctacttgttgttgaacaactctcctcgagaaacctccccgacgagcagtgcttgtcttctagctatgatactgtaagagcgtag

SEQ ID NO: 102940 - DNA, 318 bp, Glycine max
  Peptide Sequence Number=SeqID_219718
atggaagagaaggtaaagcaaaaaattaatggaggtttagggagcacctacttgaagctcttgtgctctgattaccacttgatggaagcttgcttgtggagcttctatggagtatggatctttgagcttcaatgtggtccttcaatggcttatgagaaccctagggcattcccttggatctctggcccaatctacttggagtcttctatccaatgcccttgcggggtaggattgcatcattccctccaccttggaaaggatttgacctcaaatattgaggttcttcatagtctgggctccttccctcaacacctgtaa

SEQ ID NO: 102941 - DNA, 231 bp, Glycine max
  Peptide Sequence Number=SeqID_219719
atgaacaaacctgaacaagtttgggaccaaacttggcattggatggttgatgacattgtctataattataaaaaatcatcaacaagtccagcattacagcttgatgataggactcttcaaaatctggtcttgcttgaaattgaacaactattgcaaacaaatcaaagatcgcttacagactatccttcaatgccatatccagaagatgcgaattgcccaacctatctgtag

SEQ ID NO: 102942 - DNA, 609 bp, Glycine max
  Peptide Sequence Number=SeqID_219720
gatatgccttatttgcaagatggaagacccgttgatatggtcttcaatccgctaggggtaccttcacgaatgaatgtaggacaaatatttgaatgctcgctcgggttagcaggagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 102943 - DNA, 672 bp, Glycine max
  Peptide Sequence Number=SeqID_219721
atggtattggaggagggggaatttttacccacctactctagattttgcaggttgaggactaatcctcaggagattgaagctaggctctgtattccccgcaaggggtttgttttgaatgctaagggccagccatggaagcttctcataaatgatctgacgacactggcccaaacatggagtgtcttttcttactccaacctggctcccacatcccacacctcagatctgaatatggatagagctaggttggtctatggcttggtgactaacatggacataaacatcggagcccttatctcaggtcagatctcttctattgctcagagtagctcctctaggctcggatttccagccttgatcactgccctatgcagagctagaggagttacctctaacagtctgacttatgagagcctgagcccgaccattaacttggcctacattaagaaaaaatgttggaatgtggatgatctaacaattaactttagagggcgcgaggaaggcaaggctccttccacttctgctactcctacaccagctcctccaggctcatctactcaggactctcagtgctttgagtcaatgcttcagagtcttcatcaaggacaaattttattaatgcattgcttgcaggtagtagctcctccaggatccattctgacagtggagtag

SEQ ID NO: 102944 - DNA, 354 bp, Glycine max
  Peptide Sequence Number=SeqID_219722
atggatcggtacttcaataatgcatcattcacatacatccatgcttttcattggttgcattgttcattgcattctttccttgaaaatcaaactgtaatcattgtaatcataccgaaagagcgcgctttacgatgcccttaccaaatgcgttttagggctagagtaatgggtgaagtagaggaggtgcaagagcagatgaaggccgacacagaggccttgaaagagcaaatggccacaatgatggaggccatgatgagcataaaggagataatggaggtcaatgcagctgcaatagccgctaccagcaccattgttgaggtggacctgaccccctatatggcctcaaccaaataa

SEQ ID NO: 102945 - DNA, 1862 bp, Glycine max
  Peptide Sequence Number=SeqID_219723
atgtctaggcctctgcaaagaggtgtgttaggtggggttagggtccctgagaggggctatgacttgtgggactcccaatctaaagataaaatagaaaaggaagatttggataagaggggttctgcagatcacagcccttttgctttgaggtttcctctgagggttcttttgggaaataattctgagtcaaaatatggcaatgtcaaagctgagaatggttttgcttctgatcccttcatggttggcaccccgcgaagcctgcttaagttgatgttgctttctttgaagttcagcttagtgtttatagttgttctggctcttactggatctttttggtggactttgtcgatttcatcctcatcaagaggtcacatttaccatggttatagaaggcttcaagagaagcttgtctcagaccttttggatattggcgagttttctcgtggtccgttgaggttgaaggagtcggaattctgttctgaggagtttgaaaactttgttccttgctacaatgtttctgagaatgtggaattgggagtttccgatggcaatgaagttgaccggcaatgcggccgtgagcttaggcagaattgtttagttctgccaccagtgaattacaaaattcccttaaggtggcctactggaaaagatgttatctgggttgctaatgtgaagatctcagcacaggaggttctttcttctggaagcttgacaaagaggatgatgatgctggatgaagaacaaatttcatttcgttcagcttctcatatgtttgatggtattgaagactactcgcatcaaatcgctgaaatgattggacttagaaatgaatcttacctcattcaagctggggttcgaactatactagacataggttgtggctatggtagctttggagcacatctcttcgacagtcagcttttgactatgtgcattgcaaactatgagccttctggcagtcaagttcagctcactctggagaggggtcttcctgctatgattgcttctttcacttcaaagcagttgccatatccatctctttcctttgatatgttacattgtgcaagatgtggcattgattgggaccagaaagttgactggcttctatttagttctggccctttcaactacgctaaatacctagctctttctcattccgatgagaaaaatggccttctcctgattgaagccgatagactcttaaaaccgggtggatactttgtttggacatcaccactcacaaatgctcgtaacaaagagaatcagaaaaggtggaagtttatacaggattttacattaacactttgctgggagcttctgtcacagcaagatgaaactgtcgtatggaagaaaactagtaaaaaaagttgctatgcatcaagaaagtctggttctggcccttctttgtgtggtagaggtattgatgtggagactccctattatcgagaattgctaaactgcataggtggaacacagagcagccgttgggttccaattgaaaaaagggaaagatggccttcccgggctaacttgaacaacaacgagttggcaatctacgtcttgcagcctgatgaacttaccgaggactctgacagctggaaaatagcagtccagaattattggtcactcatgtcacctttaatattttctgatcatccgaagaggcccggtgatgaggacccttcaccgccttacaacatgttcagaaatgtgctagacatgaatgctcattttggtggctttaattctgcattgttgcaagctagaaagtctgtgtgggtgatgaatgtggtcccaataagtggactcaattatcttcccttgatccaggacagaggatttgttggcgttttgcatgattg

SEQ ID NO: 102946 - DNA, 436 bp, Glycine max
  Peptide Sequence Number=SeqID_219724
atcttttgacatgaaggatcttgatgaggccttttttgtgttagggattaagattcacaaagataggtcgcaccatacactcgagttatctcaaaagacttacattgatagagtcttagggagattcaatatacaaaattgtaaacctagagatgtttcggttgtcaaaggtgacaaattcaacaaggaccaatgtcctgagaatgagattgagcgagcagagatgaacgaaaaaccttttcagagtgctctagttcccaagaaggttatgaggtacttgcagaagactaaggagtatatgtttgtgtataggagagttgacaacttggaagttgtagggtacacaaattcaaatcttggtgggtgccctgacaataggagatcgacttatggatacatatttatgatggatggggtactcatgttgtttggttga

SEQ ID NO: 102947 - DNA, 627 bp, Glycine max
  Peptide Sequence Number=SeqID_219725
atgtggcacaagcacttaggtcatatttctaaggaaaaggttgagagattgacaaagacatatattctaccttccttggcttttgatgacttggaaagatttgaagcacttgaaaagttcaaaatttttaaaaccgaagttgaaaaggagttaagaaaagtcatcaagattgtaaggtttaatcgtggttatggtaaatatggttccgcgaggcaacatatagggccattcgccttatacttgcaggattatgggatagttccacaatacaccatgcctatgacttctaaacaaaatggtgtagccaaaaggaggtcaactagagagaggagatctgctattgatgatgactttcaagtctatcttagtgaggatgcatatgacgttggagatattgttgatccaaagagcagtcaagaagttgtttcttgccctcagccagaaatatggatgcatgcaatgaatggagagatgcaatctatgtcaattaatggcgtatgggagccagttgaattacctaataattttaagacaatcggctataaatgggtcttcaagacaaaaaaggacttaaatggtaacattgagatattcaaggctagaccagtggcaaaggattttatatag

SEQ ID NO: 102948 - DNA, 273 bp, Glycine max
  Peptide Sequence Number=SeqID_219726
atgcagagaggacgaaccttgaaaagcagaaccgcgacgctaataaaaactctttcagacagtatctgtgcctttgtgctggaatcttcaaaagctttgggatgccaaatggctattataaagagtgttggtatggtgtgtgagaaagaaagaagtgaaatcgaggaagttaaggttgtgtggtgttcgcacgtgatgtcgtgtatgagatgcaaaccaaaggaacagaaaacactagagaaagaaagagtttcaaccagtgaagtcacgtaa

SEQ ID NO: 102949 - DNA, 647 bp, Glycine max
  Peptide Sequence Number=SeqID_219727
gtactgagaatgaactgacaaccgaagatatcgctgctgccgatgtcgttattcttgccgttgatgtgaaaattaaaggcgaagagcgttttaaaaacaaacgaattgtccgcgtgaaaacggagggatctaccatgagtgagaataaaccacctgtctcgcaggaaattaaaaagcatttgttaacgggtatttcatggatgataccgctgattgttgccgccgggatctgcattgccctcggtcaggttctgggcggtaccaatgtcgccgagaaagtcggcaccattccatggatgttgaatcaaatcggcggctgggggatggggctcatcgtcccgctcatctgtgcggcgattgcctattctattgccgacagacctggttttgcccctggactgattgttgggtttgtctgcgggcaaatccacaccgcattacgtgcggttgccaaaatcgatgcaagggctgatgcccattatggtgctgccggtattaagcaccattatcagcggtctgttgatgatgaccctgataggcaagccgattgcctggctgcaggaggccttgattcatctgttggagtcgatgcagggcggttcacgattcctgttgggggccattcttggcgcgatggccacctttga

SEQ ID NO: 102950 - DNA, 789 bp, Glycine max
  Peptide Sequence Number=SeqID_219728
atggatatgaatcttggttccttcatttctagtcagattacactcagagcccagcatgactcgtcgaggcttggctttcctaccttaatcactgctttatgcaaagcccggggagtccgctctgacttcctgaccttggagagcttgagtcctgccattaatttagcatacattaagaagaactgttggaatcttgatgatccaatagtaactttcagaggacctaggaaggccaggggtaagagatctgaggccccttccacagcaccatcagaggcactagcaccttcttcttctacacttcctccctcttcctccatagagatcccagtgattcctccagcacctacacagattccacttcctactcctatctctacaggtccagcaaattctcttttcactcctcagatgcttcactccatgctccagagcatccatagggggcagtccatcgtcatgcagagccttcagggcttgggcttgccctccattatgagcatggaggagtttgattctcaggagcctgtgactgaggagcctccagcagtagcagaggatgaggacgagctcactcctcctaagccttttgattttgatgcaggtacatatacggctcaagaggaggaggctactccagagcagattcctgagccatctccagcccctacgcatgcacctgatgatgccacaccagtggtggagcctaagcagactattcaggattctttagcagctccaacactggatcttaatgaagaccaaccacaggaggagttggacgtttaa

SEQ ID NO: 102951 - DNA, 504 bp, Glycine max
  Peptide Sequence Number=SeqID_219729
atgcagcatacgcatgccattgcgaaattgcttactttacaatactcacggttggatggtccacaagatccattattagatataccggttgatatggaaccagaactggtcatgatactttacacttatagattagtctttgatgtgccatcaggattaccccctagcagaactcacaatcattcgatcctattggttgaaggtgttggaccagtaaaagtcaagccatataggtatcctcacagccggaagaatcagattgaagtaatgatagttgacatgctcaaggaagggattattgctcctagcgcaagctctttttcatctccaatcattcttgtcaagaagaaggatgacacttggagattttacacagattgtagggccttgaatgccatcacaatcaaagatagctttcctattcccactgttgatgaactaattgatgaactacatggggcagtatatttctcaaagcttgatttgagatctggttatcactaa

SEQ ID NO: 102952 - DNA, 234 bp, Glycine max
  Peptide Sequence Number=SeqID_219730
atggataaagaatgcattcgacaagaagcaaggagtagaatcgtctcaggccacggtcagaagtcaagacaaatcaatggcagaaatcaaccaaggtacatagggacggatgttagtggggctagggtcacgaccgaccgatcgttgccccttcccggcgctaaacaagcagagaacatcgctacaaggcagcccaaaatggccccgaggaaacttgcctcaaagagatcctaa

SEQ ID NO: 102953 - DNA, 462 bp, Glycine max
  Peptide Sequence Number=SeqID_219731
atgaatcacgaccacccaaaactaacattcgtttacccaacatttatacgtgttggaatgagtgcaattggccctttcccgccagatattggatggcaagtaagccagttcccggcgaaaatgatgttttatgtttctgtgggattaatgctgaacagtaagagaccttatagctacgacatagatgtgttgtacgatggtaagtctttaacgccggaggatgcaccggcaattgaatccaggtttattaacacagccgtatcgaatagagatgactttgtggcgatctctaccaatcttctcgaagatgttgttatgccagaaggcggactttatacaataaaagctcggcttttcgctggaaaagctaactcatctgaaaaagagcttattgatgaaggccttggttacttcactcttgccgaagattggatgaacaacgagatgaaaaaaacggattaa

SEQ ID NO: 102954 - DNA, 423 bp, Glycine max
  Peptide Sequence Number=SeqID_219732
atgatcatcatcaaaacatcaaaggcaattgcatctacatcggagaggtatacctataggtgcaaatcaaaggaggggcaactgtgggaacctatcattaaaaagtgtgagagagccttatctaagtggaagcagagacatctttcctttggggggagagtgacccttatcaagatccccaagaaggtgaacgacaagttagtctgcctgcaatgtagattcctgtggggaggaggatcagacacaaacaagattggttggatcaagtgggacacagtatgccttccaaaagaaaaaggtggattgggtatcaaagacataagcactttcaacatggctatgcttggcaaatggagatggaacttatttcatgatgaaggacaactttgggcgaagatactggtgtctaagtacggagggtga

SEQ ID NO: 102955 - DNA, 434 bp, Glycine max
  Peptide Sequence Number=SeqID_219733
cgtggctcatcaccatttatcacggcgaagtcggcatgaaccagattcaaccaaccacgaggcgggtgctcgcgggaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 102956 - DNA, 141 bp, Glycine max
  Peptide Sequence Number=SeqID_219734
atggcttcctttcgcgatttggagcaaaaatggtgtgcaaaggttgaagctttgatggagcttcaatgtttgcatgccgtttctctggttccagtccctcgcgtttctctgcactcatcggggccagttttcgaaggctaa

SEQ ID NO: 102957 - DNA, 1126 bp, Glycine max
  misc_feature (238)..(238): n is a, c, g, or t
  Peptide Sequence Number=SeqID_219735
agccgtcgcggcccagcgcgtaggtgttgtagttgacggtgggattgtcgttggcggtttcgcccttgtgcttgacggccaccgaccagaccaggcgctgcgtgctgctgtcgtacttgggcgcctcgacccagccgtccatcaccagctcggggaagccgcgcttcttgcgctcgacgttggactcttcggtgccatcgcgcaggctgtccagcagttcgctgacgttccagttctnggcgtcgtcgtccttgatgtagccggccttgtcgaaattgatggtgatgacccagtcgtcatcgtcgctcttgggcatgaccacgcccagcagcgagggatccttgccgttgccgtaggccgccatcaggcggtcggcctggatgcgcggcacgaagaacatcgattcaggcaggtgcaccacggcctgatcgcccagcttgacgtcggccgggccttcctgggcggcggcgtaggctgccttcatggcggcctcgatttcctgctgcgcggcggcattctgggccgaggcgccgaagggcaggaacaacaaggcactggcggcggccagggacaggcgggaaaggaaagcgcgcatgataattattggagcgtctgtgaaaggggccccattgtctttgcacgcgactttcaactttctgaaagccaacgcctaattcgccgcacgattttgccagttgcgtccgattcctgtcgctcaacgggtcttcttgcgctgcggcgcgttgcgcaggcgggtgccgagcaggcggtcgtgcaggaactggccgtccggatcgaaccaggaccagatgaagatcgtgaacggcgcggccacgatgaacatgtccatcgagggccagccggtggcgctggcggcggcccacaccacggcggcgcccgccagcaccagcggccacgccagcacgtagcgcaggatcaggcgggcggtggacggcgggttgccatcgcgatcgaccagccggatgttccatgtcttcatcggcagcgtctggccgcggcggcgccagcacagcacgaaataggcgccaatggccacgaacagccaggcttggcgggcgggccgcagttccagcgcgttcttgctctgggtcagggtatccatgag

SEQ ID NO: 102958 - DNA, 977 bp, Glycine max
  Peptide Sequence Number=SeqID_219736
cccagcacgcgttccgccagcgcgcctttgtccgatgccgggcccagcacctgttccaccgcccgccgatggtgcggtgcattggtgtgcaggcgtatccagccgtccgccgtcgcgtagtcgccggccagggcgtcccaggcggcaggcagcgtccaacccagcgggcgcagcgtccagccgaaccagagcgaggccaggcgttgatcgatccagacctgcggcgcttcggttgcctcgcggcgaagcaattcggcgcaggccaaaccggcggcgctccaggcggcggtagccaattcggtgacgggaaaagccgaaggcaatgcaccggctttgccaaatctcgtcgagcagagtgtggatcagaggcgtcatcggccactccttgcgggcgcaacgtcgaacgtgcggccgtcggccagtttggcgcgcaggctgtgggccgctacgccggcgaacggctgcgcgctgaagttggcggtcagcgtcgaaccgtcgctgaaggtcgtctgctgcacccagccgtcccgatcgagccagcggaagtcggtcagcgttttgtcccacagggcctgatgcaacggccggaaggcggcgtcggcgcgtttgatcgccggcaggcgggccgccagggtggcgcggctcagatggaacatcggcgcggtgttgtacagctggctgagcagactgcgggtggtctgaacgtcgctgaacttcagattgtcgtaattccagtggtggctgctgacgatcgcatcgtggaaaacggcctggtacagcggcaggcgatagcgcggatcgaattcgacggtgcggtagggctgcttcaccttggcggggcggaagaaaaacgccggttgggcgttgggccaccaggcgccgagataatagggcgaggatttatcctgattcatctgcttgtcgccccagccgaatccccaggtttccatgccgtgggcgaacatcagctgcgggcg

SEQ ID NO: 102959 - DNA, 1027 bp, Glycine max
  Peptide Sequence Number=SeqID_219737
atgtcctcgccttcaaaggactacacgtcctcgccttcaaagggctacacgccctcgccttcagaggactacatgtcctccccttcagaggactacacaccctcgccttcagagtgctacacgtcctcgccttcagagagctacacgccctcaccttcagagggctacgcgccctcgcctaaagaggactacacatcgtcaccttcagaggtctacacgccctcgccttcaaagggcaacacgccctcgccatcaaacgactgcacgtcctcaccttcagaggactacacatccttgcctttaaaggactacacgtcctcacctttagagggctacatgccctcgccttcagagagctacacgtcctcaccgttagagggctacacgccctcgcattcagaggactacacatcctcatcttcagagggctacacgccctcgctttcagatgactacatgtcctcaccgttagaggactacacgtcctcacctacagagggctatacgccctcgccttcagaggactacacgtcttcgcctttagagggctgcacgccctcgccttcagaggactacacgttcttatttttagaagggctacacgccctcgcttttagagggctacgcgcccacgccttcagaggactacacgtcctcgccttcaaaggactacacgtcctcacctacagagggttacacgccctcaccttcagagggctacacttcctcaccttcagagggctacactccctcgcctttagagtactacacgtcttcaccttcaaaggactacatgtcttcaccttcagaggacaacgcgtccctgccttcagaggactaggcgccctcgccttcagaggactaggcgcccttaccttcagagggctacacgtcctcgccttcagagggctacatgccctcgccttcagagggctacacgccctcgccttcagaggactacacgtcctcaccttcagagggcttcgccttcagagggctacacgccctcgcctacaaaggactacat

SEQ ID NO: 102960 - DNA, 1179 bp, Glycine max
  Peptide Sequence Number=SeqID_219738
atggcagagaagaagaacaagaggataaagagcattaggcatagacctataaccccgagaatggaaaaggagaaggaaacaacaaagagtggtccttcaagaagaggaaaatggattgcccattttccttcacctcctactactccaaaggaaactccttgggaaggttttgcatttcctgagttgattaagtatcacaggttgaagaaactagtagagatgaagagcacctactacaataacctggtgaaagggcaacagattatgatgacacaaatggtttggttagacattgatgggttatcttcaaaggaagttatggcttaccagttgggtctcaaggaagctagatttgctttcaacaagcacaagcttttggcctatgtggttgcttggattattactttgagggggagcaatcatgctcagttgactgaggaggatcttctccttatcagtcttatgcaaaggaagttgaagatcaactgggtcaacattattattgatatcatgttgaagacaaagagaattgactcttccaagtatccttatgtagttcttatctctaggattattgactactttggtgttgataatcaagaggaagtctttggttttgttgaggcagagtttgaagtgaagaccaaaagtcttgaagcgaagcggatgatgctagcaaagatggatgagcccatgagagtgcataaggaagactatgctgagcttaaggagtgctttgagtctatcttagaaaggttggatgctatgggagcagcacattactccatgttcgtccatgacacctcgtctgtggcctaccctgtcgaccaccgtgagttcaacaccattatggagatcgaggatgtgagcaccacacactgtgcgacggttaggacgttcaagggttcagggggaggccacgtggaagacgttggagtaggcaaagatggcgtgggagagggcggcggcatcgaggaggtcaacggggaagagggtgaggtaggtggcggtgaaggggaggaggttaaagagatgggaggcgtcagagccagggaagatggtggtgtggatggtgtagtgtgggttctccttctccaagaggtcagatgcatgaacgatccaatagcgaaatcggcccggttaggtcattggatcccagttggattgtccgaccactag

SEQ ID NO: 102961 - DNA, 149 bp, Glycine max
  Peptide Sequence Number=SeqID_219739
atggcagacttggcctccgcaacctctgaagaagaatggcaagaaagattaaaagatgtgaattcaacacaatcggtagacctcgaggacgaggcctcatcaagccccaaaaatgttttgcaagacaatgaagatgattgttacggaat

SEQ ID NO: 102962 - DNA, 518 bp, Glycine max
  Peptide Sequence Number=SeqID_219740
atgagggattcttaccctctttgccaatcccaggtcgaagaaaagagggtatacggaatccctagctttggctctcccgggagactagcccagtccaccgattcaggtgctggtaaacgtcggatatttgccattggcaactacgtcaaccaacggttgctaaagcctcttcatgattgggcccctcaccgtaaaggtggtcggggtgatcctgtagaatatccgttcgctcgtggtagacccgttgtctcttttgagacagggcagccattgggttatctgtcgtcttggcctctcttcacactgagtcaccatttagtgcttcagtcttgtgcagagaaggtgtatccgggcagatattttgacaggtacgctatcctaggcgatgacatatgtatcgctgataggaaggttgcgtccgtatatcatcaggtcgtgacagatcttggtgtagatctttctatacctaagtctcttgtctccgattctggtggtgctgaattttcaaagcgttttag

SEQ ID NO: 102963 - DNA, 369 bp, Glycine max
  Peptide Sequence Number=SeqID_219741
atgtctacaagattccttctggggcattgtggcttaactgatcaatggccaagctatcctcccgatattcacatcggacgcaccaccaccatcaagttcgtgcctgaactcatagctctaaggttgccaccattggatctcagaaagaagaaaggcaagtactttacaagggatgttgctatgaagattgttgcattgaattccaacgttgagtttgatcaaattgatgtcatgctcttttattttaaggacatgcaagaaggagacaatgagtttcatcaacactttaaagctgcaatgagaagagccattgttaatgcttgggcaaggtttactgcacttaaagagcatccattctctcctgattag

SEQ ID NO: 102964 - DNA, 408 bp, Glycine max
  Peptide Sequence Number=SeqID_219742
atgcctcctccatctctaagacctcacaatcactcacaaactcatctcaagctctcaggacggcttcctcttcaagctctggtctctgcagatcttcacacaacaaaatctctcaaactctctggaacttggacctttctctctctagaactctctagacatgcagaagcttcaagaaaaggccaaactcccttccaaaatctgatttcaggcttaaataggatggcccttcgctcagcgaacatgcacagctcatccttcttccagattctttcttgcgctcagtcgaggagtgttgcgctcagcggatggctcgctaagttgacaggttggcttagcgagaaagtgaaaatcagcactatacaaactcgcctaattaacctgaaattgagagaaaatgattattaa

SEQ ID NO: 102965 - DNA, 923 bp, Glycine max
  Peptide Sequence Number=SeqID_219743
atgaagacaaaagcttgcatcaaaatcactgacaatatagtaagtgaaactaagcaagaagctctataccaagatgatgagcttgtggggcttcaagaagtgttggaagtttaccctgatatcattaatgaatctcttgcagatgttgatggaggtggagaaaagatagatgcaaatttacttaaacaaccaaacttggttgaaccaaatgaggatgaatgcatattaagtgagaatgagattgagagtagaggtggtggttacagaatatttaatcatcctagaagtcatggtgttagtttgggagctccaattacaccaacatttccacctcttccattcatatatcagtcaacctcagagtcgatgtcaattcccactacccctgttggagatgcttcaccttcagcaccaaatgattctcttacacttgagtacccacttgatccaaattgtgaacatattgctaatcagaggcctttcattcgtgcatatagaggatattcttgtttcctatttatgctgaaagagtataggtggtacccagcaaaagagcgagccattgttcatgattggccggaaggcacatccacacaagattcccctaacattgctacttctgttaatgataatgaaatatatgtgaatgttgttggaggtccaaattacaatgggaacgtgttcgggctaggcgctttgagcaaaaggtttagttgctcaaaatcagctccatctacttctattgctcctgtggaagaccaaatagaggaaatgcgtgagacaattactaaattgaatgttgagcttttggcaaaggcagataaggagaggacacttgaggaaaagatgtttccatcgactactagagcagatggaactgagtaccatgttcatgatgctcaggttgatcatcctcatgacat

SEQ ID NO: 102966 - DNA, 197 bp, Glycine max
  Peptide Sequence Number=SeqID_219744
gtccaaattacaatgggaacgtgttcgggctaggcgctttgagcaaaaggtttagttgctcaaaatcagctccatctacttctattgctcctgtggaagaccaaatagaggaaatgcgtgagacaattactaaattgaatgttgagcttttggcaaaggcagataaggagaggacacttgaggaaaagatgttgtag

SEQ ID NO: 102967 - DNA, 709 bp, Glycine max
  Peptide Sequence Number=SeqID_219745
atggtatttggtggagatttccggcagattctcccagtcattcttaggggtagccgctctgatattgttaatgcaactattaattcatcttatctatggaatcattgccatgttttgacactatcgaaaaacatgcgtttagaagccaatacagatgcaacagacagagaagaaactacagcttttgcagagtggatccttaatattggtgatggaattgctggccagcaaaatgatggttatggttcaattgaaattccaaaagatctgttaatcacagaatatgatgacccactctctacaatagttaattctacatttccaaatttatctcaccatcataccaatcctgaatactttcaaaccaaagccatattagcttccacaaatgaaaccgtacaacgaattaatgattatatactatcattgataccaggtgaccaaatggaatatctaagtgctgattatgtggacaagtcagaaacactagagagttctcatttccgatcactaacaacggaatttcttaattcattaacaacatccggtctaccgaatcataacatcaaaatcaaaattggatcacctatcatgttgttaagaaacttagaccaaactcaaggactatgtaatggcactagattaattgttacaaagttagctaaacatgtgattgcagctgatataattgctggccaaaatattgtca

SEQ ID NO: 102968 - DNA, 285 bp, Glycine max
  Peptide Sequence Number=SeqID_219746
atggaaaagacaacttgggcaagtttgatggtaattcggatgaagactaactctattaggccaagaaaggatatacttgatgatattacagatactttagaagatacgcatattcatgaagaagtccacaaagacaaagaagatggaaatagtagagactctcaatccaaagaaaatcaaataaacgtggatcttccaacggagtggagaacttcaaggtatcaccctcttgataatatcataggtgacatctcaaaacggggtaacaactcgacactttcttaa

SEQ ID NO: 102969 - DNA, 496 bp, Glycine max
  Peptide Sequence Number=SeqID_219747
acagcaaaaagtttatacggataactactcgggtatttccgcccgtcagcgtgactcaaaagtcagtatgacagatcttgtgagcgcggaagatgaccgtgactcaaaagtcagtatgacagatcttgtgagcgcggaagatgacggcgcagaagacgacattagtctttacgtgctatcaggcttttcgtcttacagacagcaaaaagtttatacggataaccactcgggtatttccgcccgtcagcgtgactcaaaagtcagtatgacggatcttgtgagcgcggaagatgacgtaaatctccgcgtgtcaacgggcttttcgtcttacagacagcaaaaagtttatacggataaccactcgggtatttccgcccgtcagcgtgactcaaaagtcagtatgacggatcttgtgagcgcggaagattacgtaaatctccgcgtgtcaacgggtttgtcagccgcgattgaagaagggcgcagaagacgacattag

SEQ ID NO: 102970 - DNA, 240 bp, Glycine max
  Peptide Sequence Number=SeqID_219748
atgatttgtctccgtgtgtcatcggacttgccgtctctggatgacaaaggtgcggataaccatgagatgacaatgatttgtctccgcatgtcattggacttgccgtctttggatgacaaaggtgtagataaccatgaggtgtctccgcgtgctatcagactcgattgtctctggatagcaagggcggcggatgaccatatgttgtctccgcgtgtcatcgaacttgccgtctctggatga

SEQ ID NO: 102971 - DNA, 240 bp, Glycine max
  Peptide Sequence Number=SeqID_219749
atgaggccgaggcgttaccgaattgcgatcgtaatcgacttctacatcgttcttcgtttggtgttcttcatttgtcatccggaagtggaggttgatccgtggtcatgcttggtctccaactcgcttgatgacagtgaagtctcatctagagtttttctctttgatgatacattgtcgctggtagtccctaccgccacaatgtatgatatcaaagaggatgatatctctagaaacctttga

SEQ ID NO: 102972 - DNA, 564 bp, Glycine max
  Peptide Sequence Number=SeqID_219750
atgacttttttttttcttgtaaagaactacgtaggtctgagttcctcatcgcacttgaggatacgtaggagcaagggcaacgctcttgtcgaccccaaaaaagatgcacccttgaatctcgcctcgccctcccgccgaagggtagtaaatgtcgaggtcaccctgtcatgcacaagcaactccctccctaatggtgatcaacttgtgtctcaagggagttccaaaccaagtgacatgccccaaagtacaagtactccctttcatcagaaactacaaagatgcttaaaacactttaatcactctatttcctccaccaaggatatacatcatggtcattgcaccctgtcgcaacctacccttttgcgggtgagcgaggcgaggctcacgggtgcgtcttccaaaggaggaaaatgcgtggagtctccaccaacgtttatttgtggaaaacatcggaaaaaccgaaggaaaccagtcatgaagaatattccagattcgggagttgtatttacgtttgaggaaggtattagcacctctcacgtttgtcccaaaggacaacaaccttaa

SEQ ID NO: 102973 - DNA, 309 bp, Glycine max
  Peptide Sequence Number=SeqID_219751
atgcccgcggaacatttcttccgcaagtgtcaatggaagaagaactgcggaagaaccttctttcgtggaactacgcagaagaacttcttccgcgagagtcaacggaagaagttacacacactccagtcacacacttcttcctctctccatttctctaactctgaccatgcaattggcgttggtctcattgcattctctgtagaaatgacgaacaaggccaaaggaaaaggcaaggaggtcgctggaaaaggttctgccgacaagcgcaagggcgccttcgacgatgacaagactggtggcggccgatag

SEQ ID NO: 102974 - DNA, 468 bp, Glycine max
  Peptide Sequence Number=SeqID_219752
atgcaatcaagtggccattttcttgcatgctcaagaggagtatttttatctggaaaaactgtacatatatacagtgctgatattaggaatcctttgtttttatctttgcttccacaaaggggttggcttcccatacatgaagctgttcttatatctcatcctcatgagaatccatcaaaaacaattagtttgagaagttcaatatctggaagggtgatccaaataattcttgagcagaactataacaaagagcacaccttgctggctaaaacaattagagtctatgctccttattggttggaagtagctagatggataaaactaagctaccttgctatagctgctgccacttccgtcccacatgactcttacatacgaatgttagtggccaagagtgctataataatcacagttgcagatgatttctatgacttggaaggcctcactgatgcagtcagaagctattaa

SEQ ID NO: 102975 - DNA, 297 bp, Glycine max
  Peptide Sequence Number=SeqID_219753
atggtgggttacacaccttccagctttgcggatatggtcttcgccggcaaaaggatcgaagtgggtctggaaagaggcaaatttggtcatcctgctttgataaaaactggggcaaatgaagaggatgagagtgagggagaaacccttgatgtggctgccattcctatatggccaagtttcccaccaacccaaaaatgtcattactcaaccaataacaacccatctccttacccaccacccagttatccacaaaggtcatccctaagtcaaaccacaaaacccacctaccaatgctag

SEQ ID NO: 102976 - DNA, 480 bp, Glycine max
  Peptide Sequence Number=SeqID_219754
atgcagcaggtcgagataggcgaaggcgatgatgtaggtcggcaccgccagcggcaacagcagcgcccaggtcaaggcgcgccgcgaggggaattcgtaggccgtcaccagccatgccgagcctgtgcccagcaatgtcaccagcacgccgacgccggccagcagcacggcggtgttggccagcgcctgcggtatcacataggtggccaggtgtcgccagtgcgacagatcgccgcccagcgcccaccagaccagggtgagcaccggcgccagcaccgccaggccgatcagggcggcgccggccagccagccggtgccgcgttcagcccagcgcaaacgcagtggccggggcagggaatctgtatgcatgcttcagaaggtttactgcggggaagacgccgcgcgggcggcgcctatagtagcgtcaaggcctgccgtcgcccgtccgggtgttttccgggcgagcgagggcaggcctga

SEQ ID NO: 102977 - DNA, 462 bp, Glycine max
  Peptide Sequence Number=SeqID_219755
atggcccgcaaggccgccggcggcgaccgcgacgtggcccgcgacatcctggacggcatctgcgacatcggcctggccaacgcctattatgtcggccacatgaagaacgccgaacccggcaccgacgcgcgcaagtggggcgacgccatcaaggtggtccgcccgaccttcgccaacgagaagagcggtggcacccacgtgaacgtcagcggcgccgccgtggcggcccatgcgcccaacaaggccaacgccatcaagctgctcgacttcctggtgtccgagccggcgcaggcgctgtacgcgcaggccaactacgagtacccggtgcgcaagggcgtcaagctcgacccggtcatcgccagcttcggcgaactgaaggtcgatcccctgcccctgaccgagatcgccaagtaccgcaagcaagccagcgagctggtggacaaggtcggtttcgacaactaa

SEQ ID NO: 102978 - DNA, 249 bp, Glycine max
  Peptide Sequence Number=SeqID_219756
atgcgtggagaatctgtagcacttgggagccttgtcagagagcaggcgactcactgtcatggagacaacaaatgtctcaacaacccatgttattctgtgagcccaaagaatgatttcaagattaagttcaagatcaagattaatttcaagtttcatcaagaagattcaagattcaagaataatcaagatcaagattcaagactcaaagattcaagaatcaagagaagacttaatcaagataagtattaa

SEQ ID NO: 102979 - DNA, 303 bp, Glycine max
  Peptide Sequence Number=SeqID_219757
atggttgatcagaccaagagcatacataatttaagcactgaaagaagcattgaacacaagaaacacagtcaattagatattaaaggctcttttctcgaaataggcacagtggtgtgctctggaattctatgcaaatcttctgccttcagggtgtaccctaattctgcacaaggcaagcttcaaataggctctgaattcgccacgttgtgcttagcgccaccctcgcgcttagcgcaagtaagtggatttgagcttagcgccagtcgtgcattgagcctagctgaagacaactgttgtgcttag

SEQ ID NO: 102980 - DNA, 321 bp, Glycine max
  Peptide Sequence Number=SeqID_219758
atgggatttcatgataaatggcttagctggattcgtctttgtcttagaactatccactatagtatcaacctaaatggtgattcagttgggcatatatctcctgggagtggcggattttttggatgcttccctgatgaggacatggcaatgactaagggcaaggaacctttagaaggacttggaggacctatggcaagggctagaacaaagaaggccaaggaagctcttcaacaagtgttaagcatgctatttgaatttaggcccaagttacaagtggagaagcttcagattgtcaattacaccatgttccaagaagagtag

SEQ ID NO: 102981 - DNA, 606 bp, Glycine max
  Peptide Sequence Number=SeqID_219759
atggctgacaaagaagccataaagaagaaaaatagaggtttagcattgaagactagcattccatcaagtgacaaaagtgaagatgaaaatgcagaagggtcgaatattgaaaatctgaacttgctttggaaaaagacaagtcatattaaggtagactgccccatataccaaaagaagcaacaagaatataagaagaataagggtttattcaaaaagaagaagaaaacatatatcacttgggatggcactgaatcaacaacttccaacgacaataatgaaaaggaagaagcaaatttattcttgatgacaaacaatgaagctaaaagtgagggaaccatttttgattcgaaagattattataactatgatcagctactagatgctttcaatgaaatgcatcaagaagcacaaaagttggcaattgtaaataatcttctaaaaggaagtcctaaagagtcttctcctgcaagagaaagggtagtgaacaataaccctcttgaaggacacttgctacaacacaactgtcttcctaaggagtggaaaaaacctaaggatctttctattaacaacatcctaggtgatactgcaaagggagtttctacttga

SEQ ID NO: 102982 - DNA, 381 bp, Glycine max
  Peptide Sequence Number=SeqID_219760
atgctcattggtaaaagcatccacacgtcgattgaaaatgatccatcaacttcagtgtcagctttgatagcacatgtcaaaagcattgatgagcacactatcacataccagaaagcatggttggtaaagaaaaaggtcattgaaaacatctacgacaattggaaaaaatcatttcatgatttaccgagattgttgcaagctatgcaagaatttcttcctggtttggtcatagagaaggaaacactatcaatgttccccaaaagaaaatcaaatagtatatggttttgtgaaattccatcatttttcagaccatgtatcgatgggtttcaatattgcaagctcgttgttcaagtcgacaaaacatggttgtacaaaaagtaa

SEQ ID NO: 102983 - DNA, 219 bp, Glycine max
  Peptide Sequence Number=SeqID_219761
atgaccaaatatgaccctaaaatcaaaagagcattgcataggaacaatgctaaaacaaggagaaggaagatggtcgcagtgaatgatgaacaaccggatagtacttgcaggattaccttacccctaatgtgggagtcactacaggtgaaaaagaggctaagttttgaattgcaaaaagtagcagttgggccaagctcaacagttgggctaagcgcataa

SEQ ID NO: 102984 - DNA, 366 bp, Glycine max
  Peptide Sequence Number=SeqID_219762
atggagaaacagactcagcttcttcgtcacgatcttcttggggtgtgcctagaagtggataaacaattatggtatcttaatagcgactactcgaggcatatgacaagagacaagtcaaagttcatgtctctaaaagctaggaaaggaggatttgtaacctatgttgataacaacaaagggacaattctttgtgtttatgtagatgacatcatatttggttctactaataaatctctctatgaagattttgtgcataagatgcagggggagtttgaaatgtcaatgatgggagagctgaattatttccttggtctacaagtgaagcaaatgaaccatggaacctttctccatcaaaccaagtattga

SEQ ID NO: 102985 - DNA, 363 bp, Glycine max
  Peptide Sequence Number=SeqID_219763
atggaggatttgaaggtggtgagtactaggagtgggaggccacatgcagagtataagaagaaggagaaatcatcttctctagagaaggaaaaggaggtgcccattgaagaaggtccaacaaaggacaaggaggctcctactaagaggagttcggagacatggaaacaaaatgggcttttgtacgacttgatagtgaatttcttcaagagttgtttggtgggtgtatatatggaggaaggggagttagatagatcaaaggaagcggaatggagaaggaggaaaactgattggagacgtcacttcaaggagaagatgagtcaagaacaagctcaccaccataggaagtcatggataagagcttga

SEQ ID NO: 102986 - DNA, 460 bp, Glycine max
  Peptide Sequence Number=SeqID_219764
atggcagggcgcaaccccatgacgctgcggggcgaaacgccccgagtcgggagaacgtcaggctgcgcgatcgcgcggccggctggcgtaaacgtagaacagcaccgccacgatgctgcacagcgccatcgaggtgaccattggccaggcgcttttgcccggcgccatcgacagcaccgcccccaccagcgcgccgatgctgaagcgcaacgtgccggccagggaagacgcggtgcccgccatatgcggaaaatcatccaggatcaccgccatggcgttggaggaaatcatcgcgatgcaccccaggtagaccgctacgccgatcaccagcgcccagaagcccaggccgacggcgctcaccgccagcagccacagccccatcgccagctgtaccaacagccccagcttgaacatcttgaccgcgccgaaccgccgcacgttgcggctgttgatcagcgtc

SEQ ID NO: 102987 - DNA, 384 bp, Glycine max
  Peptide Sequence Number=SeqID_219765
atggcgcggcatcggcaagcacggggtcagggatttcatgtggagagtatccaactttcggtagtgcatcgcttgccgcaaagttatcgttggctatccggtttcaccggcgtgaaggtcgaaccgattccgtttaacggaatagacgaagataacaacctgattgggctgaagttgctcagccatgaaggggccgaggcctggcaggtaatgcaacagctcaatctgtcgctgcaggagattcaggtcgactgcgcgattgtcgaatgggaaggagagccttgcctgttcgtgcagcgcagcgacgagagcgccaccatgtgccgcctgaaaaacgtcggcgccgcgatcgccgaaccgctcagcgcgcagtaccctttctga

SEQ ID NO: 102988 - DNA, 745 bp, Glycine max
  Peptide Sequence Number=SeqID_219766
ctcggcgcgggtggatattcccgccaaagccaccggcgaactgacgtgggtgcatgacctgcgcgtgcccggtatgctgcacggccgggtcattcgtccaccgtatgcgggctatgacaccggcagctttgtcggcacctcattgctcagcattgacgaaagctcgatcgcgcatctcgaaggcatcgtgaaagtggtgcagatcgcggattttgtcggcgtggtagccgagcgcgaggagcaggccatcgccgcgatggacgcattacaggtgcgctggaagccgtgggaacacagcctgccggacctgcgcgatatcgaacaggctattcgtgataatccccgcacttcgcgcgtggtgcatgacagcggtgaggtggatgccgcgctggcgaatgtcgcgcagcgttttacccgcagctatgtctggccgtatcagctgcatgcgtcgattggcccttcctgtgcggtggccgactatcagcctgattcgctgcaggtgtggagcggcacgcagaatccgcacctgctgcgcgccgatctggcatggctgctggagaggccggaagagaccattgaagtgaaccgcatggaagccgccggttgctacggtcgcaactgcgccgatgacgtggccgccgatgcggcgctgttgtcgcgcgcagtaggccagccggtgcgggtacagctgacgcgcgcccaggaacacgtgtgggagccgaaaggcactgcacagctgatggag

SEQ ID NO: 102989 - DNA, 192 bp, Glycine max
  Peptide Sequence Number=SeqID_219767
atgtcggctttgaaagaacaaatggtttccatgatggatgccatgttaggaatgaaacaactaatggagagagggccaccccaggcagcgaagggaaagggaaaacttgatctcatcgaagaaagattgagggctgttgaagggtttggtgattatccgttcgtagacatgaccggcctatgcctggtgtag

SEQ ID NO: 102990 - DNA, 285 bp, Glycine max
  Peptide Sequence Number=SeqID_219768
atgtgtgccgagaaagggaaagcaaattgggagcaactcttggctggtatggtaggggcatccattaattggttcctgtcgcaacgtgcccttcgtgggcgagcgagggcgaggctcacgggtgcgctttccaaaggaggaaagatgcgcggagtcgccacaaaggtcgacaaaagcggggcttttgctcctacgtaccctccatcgaagaggaaatcagacctacgtagttctttcttatgcgtgaatcaagtgattcttttacttgaagggcgatcattttaa

SEQ ID NO: 102991 - DNA, 591 bp, Glycine max
  Peptide Sequence Number=SeqID_219769
atgaagcaaaacttgccactttttccacgtattggcgtcacctgcgaagacgttgatgtcggcgtcgcccttgatgccgggaatggagccggtaccggtatattgccagaacgtccacggatgcggtccgtatttttcgtcaggatgaccggcgacggagcgcagccagaacggatagtccgccatctgccgcagatcgttgtcatcgaagaaatcgaccgtcgtgtagacgatcgggcgcttgccgtaatgtttttccagcgcctgcaggaagatgcgcatttccttgcgcacgaccgctgcgttggggcgcagcttgcaggttggcgactgcgggttccattccatgtcgagaacgggcggaagcgcgccggggtcacgcggcacattctggatgtaccagcgcgcctgctcgatcgccggacggcagaaataatagaaatgataggcgctccgcgcgatgcctgcctgacgggcgccgttccaatgttcctgaaagcggtcatcgacccggtcgccgccttcggtcgccttgatgaaggcaaaggaaatgccactggcgcgaacggcgctccagtcaatattggtctg

SEQ ID NO: 102992 - DNA, 1031 bp, Glycine max
  Peptide Sequence Number=SeqID_219770
atggaatggaacccgcagtcgccaacctgcaagctgcgccccaacgcagcggtcgtgcgcaaggaaatgcgcatcttcctgcaggcgctggaaaaacattacggcaagcgcccgatcgtctacacgacggtcgatttcttcgatgacaacgatctgcggcagatggcggactatccgttctggctgcgctccgtcgccggtcatcctgacgaaaaatacggaccgcatccgtggacgttctggcaatataccggtaccggctccattcccggcatcaagggcgacgccgacatcaacgtcttcgcaggtgacgccaatacgtggaaaaagtggctggaaagcaacaagcaaaacaatcctcggaagggagctactgctcccgttatcgcagccgccctgctggcatcgacagccatgtccaatgcacaggccgccgcgtcccctgcgcctgctgccgcgccggctgaaaacgccgtcaatcttccaaagccggaatgcgagatcgatttcggccagtggatggacaatctgaccaaggaagcccgcgatgccggtgtcggcgagaagggcatcgccgaactgcacaaagccatgcttgagcagaaggtgctcgaccgcgaccgcaagcagactgtcttcaacctgaccttcacggagttttccaagcgcctcatctcggaagcgcgcctgaagaagggccgtgacaatctggtcaaatatgccgatgtcttcaagaaggtcgaagatacctatggcgtaccgggaccagtccttgctgccttctggggcctggaaaccgactatagtgccattcagggcgatttcgacacgctgaatgcgcttgtcaccctttcctatgactgccgccgtccggacctgttccgcccgcagctgatcgcccttctcaagcttttcgatcagggtgtcgtcgatgcggcgaccaccggcgcatgggctggcgaaatcggcatgatgcagcttctgccgagggattatctcgaacgtggcgtcgacggcgatggcgacggcag

SEQ ID NO: 102993 - DNA, 475 bp, Glycine max
  Peptide Sequence Number=SeqID_219771
atgccgatctccccctgcggaagtatcagttgggatcgcgctcgtaagacacccagtggacccagaggagcccaacagggccctggggtttccagctctagttacgggcctctgtcagtcctacagggtgctcgtccctccctgcaagggatcgcgcccgcaagacacccagtggacccggagaagtccaacagggtcttggggtttccagctctgattacgggcctctgtcagttctacggagtgcctatcgcccccagcaaggtcatcaagccccctactaaccgagctttcatcaagaagtactgcgcccccaggaaggcgcatggcgagacaccacaacagcctagggaaggccggcagcgggcaacagatgcaccgccaccacctctaaagcccctcagctcatctacaaaagctagagcgttgcctacgacccgtggtcgaccagcaggcgaccaagtccaaagccaaa

SEQ ID NO: 102994 - DNA, 222 bp, Glycine max
  Peptide Sequence Number=SeqID_219772
atgacaattattgtaggggtagggatcacaaaccactctttaagaattcacctagtccaagtgcccaaaactggcgatgacacagaggaagatgacactactaatggctccaccgccatgatcaccaccaagcctaagaaaggcaaggccacattgcctcttaagagggacaagctcatgagtaaaattggcatatcggaatgtcctgtgcttatttggtaa

SEQ ID NO: 102995 - DNA, 1108 bp, Glycine max
  Peptide Sequence Number=SeqID_219773
atgatagcaccgagactaccacgacctcaaaacgctcgaagcgtgtggtcatcgaattcgacgaagaaaaagatgcaagaagaagaggaaagacctcttgtaagaaagagaaaatcacctgagacttcgaccaaatctgctgtccaaacagaggcaggcgattcccaggctcaaatgcctaagaagaaaaagaaagtgaagcagatcgagcctgaaccttctgtgacggtcgagggtggtgagccaatcaggaagaaaaagaagaagacaaagtcttcaaaagaacaaggtgagaatcaacctgttgacgtccaaccaccttcgactgatgttggcggcgctgaaacagaaactactccctctattgctgagatgggcaaccttgtcgaacaaccggacttaccacaagaacaccctaccgtcgaggtacaacaaaatgtttctgtagaagaaataccctcatgtgctcgaacctctcctgctcctgagacggatgcagtgaatgttgaggaacagggtgaaggtcaaggtattggacccagcagtcctcagggatcgagtcagagaagttcatctgaagaacactttcccgatgaagaggccatacaagaggctgaagctggaggttcagacattttcccagtgtcttcgacatctaagctttccgctagcatagggatcgcagaggatacattcattcaaatgcaagacgaagaccctgctgcagcccttcgactcctgctgaacaccagtcaagccaacacctcaagtgaaaagaatcctggtgcttcgtcctcatctgatgctgatataacctctacagtacgccaagattgcctgcttttgaagttatcaatggaatacgcacgggcagacgtacttaaatccattgaagagaacccttctgctgcttttgggcacctaaactttttgaagaaattgcataacccccttacttctgatgaaattctgggcaaagttatacaaatcgagtccattatcgatcaatttgcaaatactgtgcagaaaaaacgcgaaaatggcgccagactcgatgcccagaaacaggcacatatccttctgctcgagaaagcccgagcggctcaac

SEQ ID NO: 102996 - DNA, 459 bp, Glycine max
  Peptide Sequence Number=SeqID_219774
gaactcgtactgcctcctgagcctgaggttggtccttcagttgctcatatcaacataaaggagaattgtgttgatcccttagggaacgacctagacacggatgagccagagaaatgcggattgtacgtaaaaaaaaatcctccatgtctggttgccattggaagactttatgaagggtcgaccaccattctcaacatccctttggccaatgatcaagtcaaggttggtgttgagaaagttcgagatgcagatgctcacattcctgttatgtgggatgctatcgtgtttggggtgcataatgacaacttccccttgtacataaagtgtgaagatctgtctgaaatagcacacagtggtcaatgtctcaacatctctattatacaattgtggattctgcatatgaatgagacaagtatgcgggcggggaatgccaatgtctatggattcctcgagccatag

SEQ ID NO: 102997 - DNA, 357 bp, Glycine max
  Peptide Sequence Number=SeqID_219775
atgggtggtggtgcatggccgttcttagttggtggagcgatttgtctggttaattccgttaacgaacgagacctcagcctgctaaatagctatgtggaggtctgtgatgcccttagatgttctgggccgcacgcgcgctacactgatgtattcaacgagtctatagccttggccgacaggtccgggaatcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgagaagtccactgaaccttatcatttag

SEQ ID NO: 102998 - DNA, 538 bp, Glycine max
  Peptide Sequence Number=SeqID_219776
gaaatgggcacttgtaatcgacaaggacgatgtggacgacattgtctgtgaaaaatacggcattagcaaggagaaatgtgcccagttttgtcagactcgcagagacccctcgtgggaggatgtttggaaaaaggcacaggccatccagaagcaaaacactgccccccacgtgttgtctcgtgggggttatgaatatttagaacaaaagctcatgactgagaagacaaagaaaagactggaagaagctgcccagtctggaagcactaagggtgtcattgaccctccatctcccatcagacgccacgtgaagtggaagctggcccgcaccaagaaaactgggcagatgacttctgaggcagcaaaggaaatagctgagacgattgattctttggacgagcaggcgtcacagggatcgttcatctcccatggacgtcatgatgtcctaactgctgccattaggcgaccagagcaccctggccgggtccgtgctgctggagccggtgtcaccataaagcaatacttcggattggctccatga

SEQ ID NO: 102999 - DNA, 297 bp, Glycine max
  Peptide Sequence Number=SeqID_219777
atgattgcctcctttggttaccgcaaagagcatgatggctcttgggtcaaaaagagtgctcaacccgctgatgatgaagacaacctaccagttgaagataattcctctcttcttcgaaggcttttggacaagttcgatggtcttcagacttttgttggtgacaagtttgatgccatggaattgcaagtcgacatgcggttcgatgccatggattcaaggatcaccaaggttgaaaaagatgtctccttcatccgtacttgctttgatccaccaccaccgcctccatcatcatcttag

SEQ ID NO: 103000 - DNA, 234 bp, Glycine max
  Peptide Sequence Number=SeqID_219778
atgactactggtgatccaccccaacaaaagacaagtcaaggaaatgagaaaaagaaagaagatcagaatattactcaagctgaattctatgcattcaagcaatatttctcccttttagaggaagaactcaagaatattacaaaaggtgatccacctaaacagaagagaagtcaaggaaatgctaaaaagacagaagacgacaatattactgaaggtaagtgtgatttttcctaa

SEQ ID NO: 103001 - DNA, 748 bp, Glycine max
  Peptide Sequence Number=SeqID_219779
caacaccgatgtgcgcatcgatgatataggatttacgctgatagacctaaagaaacttggttaccataatgaccctttcatcatggcaaaacaagctagacaaggcaaaacagttggtgttaatgtagaagatgatgattcatacatggacacctatgttagtcctttgaccgctcaaatcactcgtaacgttgtcggagaagaagaagctgacgacgttcatgctaatcgaaatgatcatgatgaaggagaattgattaacatcgacttcatacagctcatgtttgtcaccagtttcatcatccaccacccttttcttctctgtcttctcacagtagtttacaaaagcaaaggtgaaacgaaagatattgagctggtagaggaggaacaggcacagattggtgctgatccttctagtgagacctccaataaatctgagaattataaggaggaagcacggaatgcaacacagaagcataaaccaaagaaggtagagagtgtcaatgatgatgcagaagcctttggtgatcactggaaaatttcgattgctcaatgcattctgaagctgaaccacttgaacatacgaagaaaagagatacaggccatcaaaacaggagattcagctgtgctgaagataggaaattcgggtaaagttgtgataaaacaagacatgaagggaagaaggcataaatatggatttaacaacaacaaacgtgagaaaggcagagaagaaaatggtggtggatga

SEQ ID NO: 103002 - DNA, 801 bp, Glycine max
  Peptide Sequence Number=SeqID_219780
atgctttctagaaaacacaaaaaaacatatgcccaaaaggaaacacatagaagcaaaaacactcatagaaagtgggaggtaaaaaaacatagagcatgcaaacaacataaggatgattggaaagacctagatatcaccttacaaatagataacccaagctggctccagaaatgttgggtcgcatggttgattgaaccgatgaaggcaagttgtattaatgagaggtttatactagaaggaacgaagaagggagaaaatataatgttactattagtggatggagaaaagagattagaagacatcattgacgccaagcaagagaggtggagcaatatgttccactcgataaagccatggaagccaggagaatcaacaagggcaaagagatctacgaagtcgaaggacgagtcatcgatagcagggcttgatttgggggctttgtcgttgagcatatccaaatgcttaaatttcagggaaggctttgaagatgaaggtgaatggctaggggtgcaaagagatgatagcggcggggaaaacactgcatcatcagtcattggaagcagagcaaggcgtgtggggatggattatgggatagacaaaagctatgaagggaaaaatgtgtggaaggaggcgcaagatgtagaaaagcagaggcctatggaggataaaagtgggacagaggaaggatttatgttagctataccaactatggatatcaacaaatgtatagatgatcagagatcagatttcaaaagaagacacgcaaaaggaaggagagctagaaacataaaagctctttag

SEQ ID NO: 103003 - DNA, 639 bp, Glycine max
  Peptide Sequence Number=SeqID_219781
atgattattaaagaaggctttagatggaaagtgggtagtggtgctgaaattagggtgtggaatgaaccctggctgaggttagagagcaatctttatctagaaactcgtattattgatgccttgagtggaagttggaatcctagccttattcatcagttgttttgtcctcgggatgctaatgcaatattgaggtttccaatcatagatccttatacaatggatgagagagtttggagattcgctaacaatgacgacaacgtgaacaatgatggagattggcagtggatttggaaattggaggatccacctcgtgtgaaactatttttgtggagactttgtaaggagtgcttacctagaaaggctaacctaagaacacatgttgtagactgtacactagaatgccctctttgttgtataaaatgcaatgtggacacgtcttttagagagcatctgaatcttaatggagccgggatttgtcttcaagaccatcaaggtaacattatggctattagaactaattttagacacccttgtttaaaggttgcagaaggagaagcatgggcgcttgaggaagctatggtgtttcaaaatgtaacttttgaaactgacattgaagtcacagtgaataaagatcaataa

SEQ ID NO: 103004 - DNA, 231 bp, Glycine max
  Peptide Sequence Number=SeqID_219782
atggtggatattgtagctgcaaagccctatttaaaggcaaaggaaagggaagaggatgacaatctcgccaatatgactggcaaaaccaggatgaatggatggatgatggatgacgatgatgatggtgggctgatggcatggccttggtgctttacgccatcatcaatggcggaaactttgctgctttacgccatctccaatggcggaacctttggctgctttactgcatga

SEQ ID NO: 103005 - DNA, 534 bp, Glycine max
  Peptide Sequence Number=SeqID_219783
atggcgatgaggcatagatctagttgccgtgtggtgggcgttgacagagagatgtgcaaagggaggatgggggaggggtcacatgtggtggtggtagatgggggtggggttgcacgcagtggtagtggacgagggtgggattgcacggaagaaggtggaggaagatacttgggcttccctgcagtggtgggtagaagtaaaagggctaactttaactttattaaagatagggtgttgcaaaaaatcagctctgggagtgggaggatgttatcaatggcgagaatagaagtccttataaaatcaatggtgcaatctatccctacttattgtatgagcattttccaaaaaccacaatctactggggatgagattcaaaagacggtgaattatttttggtgggggaagagtacgagaggagtgaagggaattcatttgttgaagtgggacttcatgggtcttcaaagcaggcttgggattcaaaaatcagttcgctttcaatttggccatgttagggaaggaggcttggagaattag

SEQ ID NO: 103006 - DNA, 291 bp, Glycine max
  Peptide Sequence Number=SeqID_219784
atggttagaactaaagggttaggtcatgccttaggtagagttataggtagagccctggggagagaggataatcgtcatttagatgatgttcccgagcagcaaaggtccacaacatccgcatgtaggcaactggaagctgccgctgttgctgaggatgctcctcatgtggctgacgtaactgaagatgtattccaacatgctgaagatgttgttgatgatgttgagggtttccctggtgggccgcgtgacccatcagtgttgactgcctattgtgaccatgttgcaatcatt

SEQ ID NO: 103007 - DNA, 306 bp, Glycine max
  Peptide Sequence Number=SeqID_219785
atgactcatacagatcagctgatccgtatacgttacacgaattatataacgcatacggatcatacaatccgtatgaaaccacagcagacgaaactccaacagcaaccattaatggagagcaagaagcttacctcaaccgtggaagaacaaaatgaagcagcaggtcctcaatgccgtcaagggaagcagccaatggcggcaccgccgaagaagaaccagcaagaagatgaaggcgcagaggcgtggtcgcaaatgaagaagatgaacgcgcaaggagggagagtgaaagcaacgtacgaaaggtga

SEQ ID NO: 103008 - DNA, 240 bp, Glycine max
  Peptide Sequence Number=SeqID_219786
atgtcaggtattgtgtggagcaacctttggacattgtcgaccaaaatttcattggttgcatttcttgggagattcactgaacagtctgaatgccaatgggtcgcgtatggtgtagtgatggttctaccgtggtttttgcttagtgcaatttacacgaccagcccaatcctaagccaaaaggcaccagctaggattcgggatttgagtagaaatttctaccttcgccaaggaaatatataa

SEQ ID NO: 103009 - DNA, 426 bp, Glycine max
  Peptide Sequence Number=SeqID_219787
atgtcccgccaggagaaatggcggtatgcactgagaacgttttctcactcctacttagtctatcccgctaggaggaatggcgatacccctgcctgtcccgctattgcgactagcggtacccactatcccgccattgccactggcggttcatgcttcccgccagtgtcaatggcggcacccacatatccatgtgattgtcggtattttataggttccatgtggtgttggtcattccgaccttctcttaggttttctatgtacctgactttgccaagcccacttaccattatccttaccactataaaaagtctgttcttaccaaccgcactgtcaacggtacacgaacgatcatgcaccctgtcttcaccaggacaagcaaatacgtgccgcttagttcattcgacaactctttcaaattggtcatga

SEQ ID NO: 103010 - DNA, 234 bp, Glycine max
  Peptide Sequence Number=SeqID_219788
atggaaagagagatgtgctggtgggtatatatagttggtggggtggagtccaaatctataaggttaagtgctggtgccagcttgataacgtgtttgtggtttggtatgtggtcttataagtcgtggggtaggcgcctacgcggggacagtgtatggccagctaaggttagtgttggtgtggataataacaacactggaacgggacaagaagacaaagccgtgtaccctttgtag

SEQ ID NO: 103011 - DNA, 1017 bp, Glycine max
  Peptide Sequence Number=SeqID_219789
atgtcaactttcatgttgaaaatcttccttctaatttccatctttcaaatctctttcgccactaggaggttgaatgagttagttcaggaccaaactcagcttcttcgttaccacaatggccctcttctctctggcaaaatctccattaacctcatttggtacggccacttcaaaccttcccagaaggcaatagtctccgatttcatcacctcgctgtcaccctcatcccctcacagcacccaaccatccgtcgccacgtggtggaaaaccacagaaaaatactaccaccacctcagtaatactaaaaaaacctcccctctttcaattccactcaataaacagattctcgacgaaaactactcgctcggcaaatccctcacgagcaagcacctcattcagctagcttcaaagggtgaccacaaaaacgccatcaacgttgtgttaacttccgctgacgtggcagttgaaggtttctgcacgagccgatgtgggacccacggttcttcctcagcgggccatgcaaagaacaagaactacaagttcgcatacatatgggttgggaattcagaggcccaatgcccgggccaatgcgcgtggccgtttcaccagcccatatatgggcctcaaagcccacctcttgttgcgccgaacaacgacgtgggcattgacggaatggtaataaacctggcgagcctcttggctgggaccgttacgaacccgtttggcaacgggttctatcagggcccagccgaggctccactcgaagcggctacggcttgccctggggtttatggcaaaggggcttaccctggctacgctgggaatttgaacgtggactcttccactggtgctagctataatgcgcacggtgctaatggaaggaagtacttgcttcctgctttgtatgaccctgccacgtcatcgtgctccaccctagtaccttttgggatcggtgatgctgagcatgatctagtggtgtcgccgccgtcgtcgacaatgagatcagggccaccgtga

SEQ ID NO: 103012 - DNA, 1521 bp, Glycine max
  Peptide Sequence Number=SeqID_219790
atggaaaagggtggcaaaaagaagtttgataagaggaagattcagtattacaactgctataagtgggggcactttgcagatgagtgcaaaagtggaaaaggagaaaaaggaaagttcaacaatgaggcaaaacttgcccttgatgatggatcaaattctaatccaatgctatcaatggttaccataagcacaaaagttgaaagcacctcatcttggtatctagacatagaatgctccactcatatgattggaaaaagggattggttcattagctttgatgaattaacaaagaataaagtaagatttgttaatgatagctcactcaaggcaaggggaattggtaaagtattgatcaagaggaaggatggtaagcaatccttcatttttgatgtcctatatgtgcctggtatgaagagtaattttctgagtctaggattgttattagaaaaaggatttatgatgaatatcgagaacaatgttctaaaagtgtttgatagtaagaggaggtttgtcctcaaggcttacatatctcagaataaaacattcaagcataatatggtttatggattgccacttatggaagttccaagcgaagtgtgtgaggaatgcttggagtgcaacaaaaccaggagttcattcaataaacaggttccaactagggccaatgataagcttggtgtgatttattctgatagtgatgtgtttgaagtgtttaaaaagtttgagtgcctagtagagaaacaaagtggcaaatctctaaaagttttaagaacaaatggtggtggtgagtatgtttctaatgaattcaatagtttgtgtgaaaaaaagggaataattcataaagttactcctccttatacaccacaacataatggaactatagagaagaacaaaaccattatgaatatggtgagatgtatgcttaaaagtaaaggtttgctagattacttgtggggtgaggcaacttctacagttgtgtatgcattaaacatatcacctactaagagactagaagggaaacaccagaggaagcttggactagaatctaacccagtgttgctcatttcaggatctttcgatccatttgctttaagcatatcaacaagggtaaggcaacttccttctaatatgaatgattatgatattgtaccagattctactgtagattctgaaggtgaattggtgcactatgccctaatggcaaaggttgaaacaattgagtttgaaaaggcaattcaagagccaaagtggatcaatgctatgaaagaaggaatcagttcaattgagaagaaccaaacctgcaaattagtaagcttacctaatgataagaagcctatagccttaaagtggctatataaagtgaaagttaatccaaatggtgaagtgatcaagcataaaactagattggtagctaaagggtttttacaaaaattaagaattgattatggtgaggtttatgcacctgtttgcaaggatgaaaacaatgagattggtggttgcaattgccaaccagagaggctg

SEQ ID NO: 103013 - DNA, 147 bp, Glycine max
  Peptide Sequence Number=SeqID_219791
atggagtttagtccacgcgccaaagagaatgagaaaacctatgtggtggaggagcgtggagagcacgggttggggatagcgtggagggggcttatgaaatgttatatggctgtgacctgttgtgggtatccgaggaagcaggcctaa

SEQ ID NO: 103014 - DNA, 375 bp, Glycine max
  Peptide Sequence Number=SeqID_219792
atgcaaattaaccccgtcaaatttggaagagtggaagctcaaaattatatgggggaaaagaagcaattatcgtacgtcaaagaatcaaaatggcgcgtcaatgcgcacgagaggcgacagcggcgatgtcagggcaacacggcggcaaggcaggggagtgtgacttatggaggcgatgctagcttgcaaggtagggttaatgcacagaagagactagctacgactgaatatgaactgcgattccgtgcacaccccatgcacgtgactatcaagtgcctgaacaatgacggtcctttggagaaaccgcctttgaagttgaccaaccaatttacgagattgccattatgtgcacgactcgtgctcgtgactgtatga

SEQ ID NO: 103015 - DNA, 1161 bp, Glycine max
  Peptide Sequence Number=SeqID_219793
atgaaaccgtacctacgtccaatattcctattattccttatccttctccaccaatccatttcggcgagtgcttcaaatagtaggtttatagaattcttttcaaaattaaagaattcttttaatcctaagtctgaagaactcaaatcaaaagatataaagaagctcccgagcgtcgaatatttgaagaagatacatgagggagttaaggacttatctcaagatttatttatcccgaaaatcccgtttctcaacccgaaaaacccgaaactcccaagaatcccgctatttaaatctcccccaccgccaatgtaccgtttacaactaaagtccgatcccccaccgccaatgtaccgtttacaaccaaagtcccctcccccactgccaaacgcaccaccgaagcaaatcaatattaagggcctgtccgtcgtcaaagattacttatctgactacggctacattgaatcctctgggccatttaacgattctttcgatcaggaaataatatcagccattaagacctaccagaaattttccaatcttcaagttaccggcggcctgaacaaacagcttattcagcaaatgttgtccatacgatgcggtgtccccgacgttaacttcgactacaacttcaccgacgacaacatttcctatcccaaagccggacaccgctggttcccaaacagaaacctcacatacggttttcttcccgaaaaccaaatcccagacaacatgactaaggtgttcagagattcctttgcgaggtgggcccaagcctcggggactttgagtctcacggagacaacctacgacaacgccgacatccaggtagggttctacaacttcactaactcgaggattgaagtgtatggtggcagccttatatttttgcaaccggattctagtaagaaaggggtggtacttctgaacggtaacatgggctggttacttccaagtgaaaacgccacactgtctaaagatgatggagttttggacttggagactgcggcgatgcaccagatagggcatctacttggacttgatcactctcacaaagaggactctgttatgtatccttacatattgtcctcacagcaacgaaaggtgcagctttccaattctgacaaggccaacattcaccttcagtttgctaagcatgattaa

SEQ ID NO: 103016 - DNA, 213 bp, Glycine max
  Peptide Sequence Number=SeqID_219794
atgtcgacatcaaggaagggttcagaatattcaacaatatttgggaccagtgaaaacgagagcctgtcgtgggaggacggagttttggacttggagagtgcggcgatgcatcttctagggcttgaccactctaacaaagagggctctgttatgtaccctaacgtattgccatggcagcaacgaaaggtggagctctcggtttctgatatgtaa

SEQ ID NO: 103017 - DNA, 492 bp, Glycine max
  Peptide Sequence Number=SeqID_219795
atgggcaaaccagtgaggataaattgtcaaaaggcgattctgatgatgaaatgctcagctctgttctcaagacctttgtctactagccctaatcagttagacggtgacaaaataacaggagctaccaatcataaatccgtgaatttggagggaagcctgttggttcagcacctattcaaggaccacagaagatgtagttacatgatagccaatgcactggataaggatggtaaattcactactgcccaagtctctcaaaaacttaagcagcttggtttgtatcttcctctgcccaaggatgcaatcggcattgatgtccctgcaaggactatgcaggtgtctataaattcagcattgatgtccttacattttgatccttttctctacttgtttggtcaaaaagatgctaaagaaaatgaaaaagcaacccctcttgtttgtggaactccttttctggaagactcggatggaatgccattacatcaatgctga

SEQ ID NO: 103018 - DNA, 291 bp, Glycine max
  Peptide Sequence Number=SeqID_219796
atgaggtcagacacaaatgctggtgttagaggaagagccttatttctattaacagcttgcaaaaggagtggagaatgtcttaataatgttgtttgggctctacaacggttttggggtgttttcatgaaagttgatgcattccctgtggttattgttattgacaaagatttgtctttgatgaatgcagtgaaaactatattcccagatgctatgaacttgttgtgtcggtttcacattgacaagaatgtgaaggcaaagtgcaaaaccctggttgctcaaaagaatgcatga

SEQ ID NO: 103019 - DNA, 207 bp, Glycine max
  Peptide Sequence Number=SeqID_219797
atgagcgcgagtgacaccatgagcgacagtgacgacattggtttcaacaccatgagagtgagagtgagagtgacaaagggatttagaggagttgactccgaagctggctctgtaactcagcaaaaggaaggatatgagaaatccaagtcttttaaggacgtaattcctcttgaaagttcccgtgcaagtaagaataaaaggaagtag

SEQ ID NO: 103020 - DNA, 297 bp, Glycine max
  Peptide Sequence Number=SeqID_219798
atgtgcagagttagacgccaagcagaaaactctaacagaaaaggctatagaaaatggttcttgattagtacattgtacacaaaagttgccattggatcacagaaaaaaagccacgtgattgcaaagttagggagcattaacacggcaaattgtaagctaaatcaggatgatgatgtgccacaaccaccaaaaaacaccatggaaaatgttaatccaaatgaaagcaatatcagtgaagagtctcattcttttgatgaagaaggattacctgaagttgacccaatattggctccttga

SEQ ID NO: 103021 - DNA, 240 bp, Glycine max
  Peptide Sequence Number=SeqID_219799
atgtcccaagaagtgggaaatcaagaggataactcaaagaagtctctttcaagtatgaaaagcttggctcttattgctatctttgtggattactcggccacatcgaagatcattgttgcaaactattatccatgtcccaagatgatggaaaccaaggttgggggactgctttgcgagctgaaattcgacccgatggtggaattggtgtttgatcttacttatgtgacgacagagacataa

SEQ ID NO: 103022 - DNA, 1089 bp, Glycine max
  Peptide Sequence Number=SeqID_219800
atggcagcaccaaaagaccaagatgccacacaaggccgaaaaatcaccaccacaacaacaaggccagcgccggaacaaggcgtaaagtgcccgcgatgcgactcatccaacacaaagttctgctactacaacaactacagcctcacccagcccaggcacttctgcaagacctgcagaaggtactggaccaacggcggagccttgcgcagcgtcccgataggcggcggctgcaggaagaacaaaagggccgtcgtcaagccctcttcctcttcgtcatcttcatcaccaagactctcaaccaccgaattcagccttcgcggcctcaacgttccgccctcggttgaattcaacctcggcgcgttgcccttcccctcgaggctcaacacaaaccaccacattccaacaatcataaacacagggttgttcaacaacaaccagttgtcgcctttcctggacgttaaatcagctttgtttcaacttgacgctcctccagctgctctgtcaaactccttgatgggcattgccccgcccagcgcccagaacaacaacttctgggcgctgggtcggtctcaaagctcgacactgtctgatccattaaacagtacaatgcagtccatgcagcaatctctgaatgttcatagcagccttgcttcttcaattgagtcactgagctgcgtcaaccgggacttgcacctgaagatgcagcagcagcgttacgcgacaatgatgtccggtggggacacccaccacaagggtgatgaaaacagtggcgtttcgtttcctcaaacggttaatgggttcgagaatcaaaaactggtgatgaaccccgttatgtttcagaagccagtagagagcttgccagccggcagtgccgtaacagaaggcccaagtggggcttcagttacaacagtggcaccacccaccgaatggttctttgggaattcttcttttccctcaacaggtaatggtggtggcaatggcaacaacaacattaacattaatattaatgatgcaaacaacaattggagtgatgcccttgcttgggggaattttcagcagcagcaacaacaatacagtgctttgccctag

SEQ ID NO: 103023 - DNA, 195 bp, Glycine max
  Peptide Sequence Number=SeqID_219801
atggtggcatgcttgctgcctcctttcttttggtttatgcacttttcaccatccacctatgccaacattgtcactaacttcatgggaactaccttcctccttgctattcttggtggatttctagctgatgcgtttatcaccacttactccctctatctcataagtgccggaatagaattcaaggaaaaagcttaa

SEQ ID NO: 103024 - DNA, 573 bp, Glycine max
  Peptide Sequence Number=SeqID_219802
atgggtggcagacaacacagtgcacacgattgtggcgtctcatggtccattggttattttttggagccacgcattatgttgtgtttgtttgccaaacagccccttactatcaggctcaaaggaattacaaatgattctaaagatccatctgttgataccttcaagtcaacaactttacctatattaaagcgctttggagttccatctgaaggcttggagattaaagtagagagtcatggattacctcccaatggtggtagtgaagttcttttgtctgttcctgttgttcagagtctaacgggttttgtgaggaaaattaggggaacttctttttcaacaagaatgtctgttcagtttgaatatggcatgattaaagttgcccgtggaatcataaatccgctagtttctgatgtgcacattttctctgatcacagatcaggtcctgaggctggaaaggataacgatacttgtggccttgcagatgatgcgagaagagacttgatgcctccaaatgataatggtgtggggattgctagtgcattactaggggagatagctcaaagtggagtgtag

SEQ ID NO: 103025 - DNA, 276 bp, Glycine max
  Peptide Sequence Number=SeqID_219803
atggttactggtttcgttgattttgacgtggcaatcgtcgcagacgatttcgaagagtcagaggagagaaatgtcgtgtttgtggaggccaggccatgtctcatcggcgcgaatgtcctcgatgagaatgggagtggaggagagaagctgggaagctgctgtagatggtggaagtcagggtggtggcggtggtggtcgccctgcgcgaagatcatggttttggctcagagaggtgcggcaagaaagaactcgcgcaacgttttgggaaccctatag

SEQ ID NO: 103026 - DNA, 198 bp, Glycine max
  Peptide Sequence Number=SeqID_219804
atggctttcagtccgttctcggagaggaggtggaagaagaagcggagagcatgggcgaagacgagagataagagaggagtgagaagcagcaggagaggttcgtcttgggagaggaacgaatttgcggaggctctgaaatcatcgacaattcgggtccaatgcatgatgaggatattgctaatattggacaatttttag

SEQ ID NO: 103027 - DNA, 147 bp, Glycine max
  Peptide Sequence Number=SeqID_219805
atggagtgtgactacaaatacttatggtctgactgcttcaaattagttgttggtagtaatcttgagaagactattcaacaaattatggacatgggtggtggtagttgggacagagatacagttagtcatgctcttcgagcagcttag

SEQ ID NO: 103028 - DNA, 594 bp, Glycine max
  Peptide Sequence Number=SeqID_219806
atggatcgcactcggctggtttatgggttggtcatgaagatggacatggatatgggtgccatgatctcttctcagatttctcacatagcccaatccaactcttcgaggttaagcttccccgctctaatcacaactctttgtgaagcccgaggggttgtctctgactctctcaccttcgagtccctcaatcttgcgacgatccatctacattcacaagaattgttggaaccccgacgatccatctatcaccttttcgaggtcccgcaaggccagggccagggcttcaatagaagcacccctagttggtcctccacctcctcggtggtgtctaccttctcttccacttcctcggatgagcttgagcccatgttgcagagtattcatcatggtctatgcctcgtgatccaaaacattcaccacctctcccagcagcaaccagtcatttccctgccagacttcatggaggggggtgaggctcaggacccagtggatgcaggtgttgagatggctcaggagccagctgatgatgctgatgcaggtgccactgatgctgagatggatacatattatgtagttgatatcaattccgcatag

SEQ ID NO: 103029 - DNA, 186 bp, Glycine max
  Peptide Sequence Number=SeqID_219807
atgggaggtgggagcgaggttggtgtactagaggacactccaggtatggcaataatgggagtactccgattagcgctcccccgccgcaagaatcaccggggtctccagaaaagtattcagggtggtggcatcaaatttgatcagcttcccccaaactctgcattgcctaggagagagatcctctag

SEQ ID NO: 103030 - DNA, 375 bp, Glycine max
  Peptide Sequence Number=SeqID_219808
atgtacccttacttgttctctaggaacaaccaagtggatgtaccctccactagaactgatccacaagagatgtaccctctcttgttcacagtcacaacaacccaagtagatgtaccctctacttgtaccacaaaggatgtaccctccaatgtgttaagacaaagttctcaggcggttagtccttcgaaactttgtgaagggggaaaccaaagaaatctcacgcgaaaaccagaaaactttagaaagcttttggcaaaggaagaagaagaagaagatgttcaagaagatgttcaaagagattcaaaggttgtaaaagaatatgtggaaaagttgtttgcaaaggttgtaaaggattgtatttattgttatgaataa

SEQ ID NO: 103031 - DNA, 270 bp, Glycine max
  Peptide Sequence Number=SeqID_219809
atgacccacgacagtgatggagaatggtcgacgacactgctggtgtgcttcacgatgacaaccaacttagagaaacaaagcttaagggcgcaaaagtactcagataactttatccctaatcttcctatttcaatccctaattttctaattctgaatcctagcctccatgactacctcccactttcatcgtctcactatggccttcgactttcactgtctaccaccgtgacggacacattcaccgtgccgcttctgctccgtggcacttag

SEQ ID NO: 103032 - DNA, 810 bp, Glycine max
  Peptide Sequence Number=SeqID_219810
atgggtgagtgtgaaaggttcaaagctgtaaccacaacccccttgctgcaaaaggtagatgttgttgcttacccacacaatattatgggtgaaaaatgcatgcatacttcctatactaatggtgccaaccaatattatgaaacaagaaaggagaatccttgtactgtttcaacacactttcttgagaaaattgaagaacctgattattcttgtagtgatcagagttcagttggcaattgtaatcttttccaccatttgattatcattgacaaatcaactacattttccagggctagtgtcggaggcttgcataccttgcttccaatggctaagtatgatgctagggtagttaatcacactggatttttgtcacatggcctccccatgatgcataagcagatgtgtggtgcgttaacatggcaacaaattgtagctgcaatagtgctttgtggctgttactctagactgggtttacatgaatgtctattgattgctaatgtgatccgtagatggcattttgtaaaccttgcaaccttattatcattgtgtaaaccttgcaaccttattatcattttgaggtgtaaccctgggaaaacacctttatccagaggaaacaacacttcttatggtgtggtgatcagggaagataagaacccaagaaactgctcctctaatgcaattgcatcaagttctgatggcgccttcaagctggacgaggcacgtggcaacggaaacgccattgtcagcaacgttttcacttttgctgagctgtctatggaagcgccagcagtagtggcgactaggccctag

SEQ ID NO: 103033 - DNA, 501 bp, Glycine max
  Peptide Sequence Number=SeqID_219811
atggagagcgcaagaagaggaagaaggacagaacgacaacgtgatggcaagaatgatggaagagacaacgaaaatggagagtgtgagaagaggaagaaagagagaatgccagaaacaacgatgaagagatggcgacaacgcaacaatgcaaggacgacaacgagaaattgttgtatcaaatggtttcctttcattttggctttatcctacctgactgatgctcaagtagttgttgtccgatacaatgctaagtcaaagaagcctcaatatgaaggtcctgatcctgaattggcggcaatgcttgaaagggacatgttagaaacctctccaggagttagacgggatgattttgcagggcttactgacgcaaaaaggcttctagaagaaggaatcaggagaccatggaaaggtgccctcatgtttggacctccaggaagacacttcttgctaaagcagatgctactgaatgtgggaccactttcaattttgctcctggtttga

SEQ ID NO: 103034 - DNA, 540 bp, Glycine max
  Peptide Sequence Number=SeqID_219812
atgggagatcgcttagaggatatgattcatgaccttggacaagagtcttttcagcaagcacatgcccctatgtatgatacattgcaaattgattcaaagaagcctttgtgtccggggtgcaagaatttgttgacgctgttatcggtggtgttaagtctggttaatgtcaaggccatatatgggtggagtgacaaaagctttagttcactgcttcaagtagtgcacgatatgcttctacgggaaaacatgttgcctaaaagttaccatcaggctaagaagatattgtgtccaatgggtatgaagtatcaaaagattcatgcttgcccgaatgattgcatattgtacagacatgaatttcaaaaaattcctaaatgccttaggtttggggtatcacgatacaaagtgaaggatgatgacgaatgtagtagtgatgaaaactcaaaaaagggctcgtcagcgaaggtgttgtggtatcttcccatcattccaaggtttaagcgtatgtttgctaatggagatgacgcaaaagacctgacatga

SEQ ID NO: 103035 - DNA, 156 bp, Glycine max
  Peptide Sequence Number=SeqID_219813
atgtacagttggcatgacaaagcaatgctatatgagcaatgtccctggaaacaggcaaggaagaagaatcaaccatatgagttcatgtggaacaagacttgggacaagaaccaccgggaacattactactacaactggcctatttactttccttag

SEQ ID NO: 103036 - DNA, 282 bp, Glycine max
  Peptide Sequence Number=SeqID_219814
atgccattaattcaactaagggtcaagctccagccgtcatatctcgcaactagagcttttgttttagggatttacgttttctgctttgatgctattgttcacgtaatgctgttgcaacatgcccttcgcgggcgagcgagggcgaggctcacgggtgcgttttccaaaggaggtaagatgcgcagagttgccaccaacgtttatttgtggaaaacgtcggaaaaaccgaatgaaactggtcaaaacgaaaattctaagttcgggagttgtatttacgcttga

SEQ ID NO: 103037 - DNA, 175 bp, Glycine max
  Peptide Sequence Number=SeqID_219815
atggagcttgtgagggagtttctggtgttccacgacttcaccaacaccctcgaatcctacgaggccgaattgcgcactggcatcggaaaaggattcgatgttgacaagaacctcgacctaatcttctccctttacttccccaagttccacgccgatagcctcctctcgctcctcg

SEQ ID NO: 103038 - DNA, 372 bp, Glycine max
  Peptide Sequence Number=SeqID_219816
atgagtgaaggaagctttatggttaaaaaggatgattggtgcattgggaattgtacaaaactatgtgacaaccaaagtgttatacaccttgcaaatcatcaagtttaccatgagaggatgaagcatattgatgttaggcttcacttcataagagatatggttgaatctgaaaaagttaggtttatgaagattatgtctgaagacaatcttgttgatgtgttcacaaagtctctaacaagttcaaacatagtcttagaagttggagagcaacactatggtggaaggacattcatttcagatttagagtcaaggtggagaattgttgtctatgatttaaaatttgttgttcagtctaatggaagttcggtctaa

SEQ ID NO: 103039 - DNA, 108 bp, Glycine max
  Peptide Sequence Number=SeqID_219817
atggttttggctcaaaaggcttgtagaacggctggatatgatatatgtcagggtgttggtttggccagcggttcagggataaaggaatgtcccacattatttccatga

SEQ ID NO: 103040 - DNA, 222 bp, Glycine max
  Peptide Sequence Number=SeqID_219818
atgactgaagacatttttgtctttgaaatgtgtgcggattaccgtatagggtgtctccgcatgctacctgacttctcacagtctttggataggaagggtgcgggcgataacataattgagactttttcgcggtctcggccagaagacgctgacatctctggcaagtgtgcagatgaccacattggtctctatgtgtcaacgggctcgcttgcctctggttga

SEQ ID NO: 103041 - DNA, 165 bp, Glycine max
  Peptide Sequence Number=SeqID_219819
atgaggccacctaacctgtctcagaaaaatgaagatctcggactcattcaccattggatcgctgtgaaatttgggcaccacgttcgcaactccattccgagaattctcaccgttgggaatttcgatattgtgcctgagctaagagaaatacccctcacattgtag

SEQ ID NO: 103042 - DNA, 345 bp, Glycine max
  Peptide Sequence Number=SeqID_219820
atgacgcacatccgccgcatgcgcaaactctacagtcagcgccggcgctttatgatgacgctaattgagcgctacctgggcgcggcctttatgccggtggtcaatcatgaagcagggctgcatctggtgctgaatctgcccccgggctgcgatgatgtggcgattgccgcgctggcgctgcgacgcggcgtcaaggtgcggccgctgtcgcaatactacatgcatccgcaggagcgacgcggtctgctgctcggttacgcctgcgtggatgagcgccagtgccaggatgcgtttggtgtgctcaaagcctgcctgatggaagcggggatcgccgggcggggatag

SEQ ID NO: 103043 - DNA, 165 bp, Glycine max
  Peptide Sequence Number=SeqID_219821
atggatgagtattgtagaattaaaatattgatgttctcgactaatgctaatgtaattgtctggtctattatgcaaggaacaaaaccagatgacaacattttcctttggcaaaatgaccaccatttgtcaatgtgcactgcattagagaagaataagttattatag

SEQ ID NO: 103044 - DNA, 249 bp, Glycine max
  Peptide Sequence Number=SeqID_219822
atggagcgttatctacaacacttggttcgccagcaggcggccaatcaccgtgggcaggggcagggttctgctccttttgtatgccctactccggagcagtttggggctcaggtcgcatggcccagagactggcccgaggcccaggcaggggaggagcctgcaggatcccccgatgaggcagaggaggctcgtatggatgaagatatgactgacttgctcagtttcttgggaggaagcggagccacatga

SEQ ID NO: 103045 - DNA, 258 bp, Glycine max
  Peptide Sequence Number=SeqID_219823
atggttgaggctttggctgccaaaaatgctgaaattgaggcacttgtaagttctatggatgttgttaagagccaggctgcaatgtcacaaggaaatctagcttcactgcaggctctaagagaggaggtagaatctgttgagcgaagagcagaagagaagcgtgctgcatatattgctaccaaaatggttgctatggaaagaaaagtggaattggagcatggagcagttgagtcatccactgcgctttcaaggatataa

SEQ ID NO: 103046 - DNA, 267 bp, Glycine max
  Peptide Sequence Number=SeqID_219824
atggagagggaaatgataacaatgttagtggacacattactagtgttttactatgagaagatggtgggttacatgccttcgagctttgcagatttagtgtttgcaggtgagaggattgaagtaagcctaaaaagaggcaaatttgattacgctgcttcaatgaattctagtaataagaggcctggggcaaataaagggaataagaaggagggagaaacccatgttgtggctatcgttcctacatggccaaatttcccattagcctaa

SEQ ID NO: 103047 - DNA, 396 bp, Glycine max
  Peptide Sequence Number=SeqID_219825
atggacaagagatatggttatttcacggtacaaagagtttggaatactagtaacttggctattagatacaggagtagtggccaaggtatgcatctaaacttactaaatcagttggtgttctacttaacactaaggacttgttcagtgaaggcatggcacctcaatgatcctagcgcagaagtagtattcacagctcttagaaaatcaggtgtgaaattagatgttgtgtcaaactttgacactagattaaaacctctcctacgggcattaaattctgtcaatcggtttgatgcagtagcagtgttagctgagggtgtttccatttctgatgtgcagagattggacaaccttatcggttgtcagccatttcagggtcatgaattcaatgactttgag

SEQ ID NO: 103048 - DNA, 144 bp, Glycine max
  Peptide Sequence Number=SeqID_219826
atgcataccatagacaagagtaatcctttgttaagtgttgggaatgtggtatccaaaatcactgctgtggtgggaagatctctattgggatttaggtatctaaggggatggagcaaagggcacccaaaagcaagcaacccatga

SEQ ID NO: 103049 - DNA, 750 bp, Glycine max
  Peptide Sequence Number=SeqID_219827
atgaagcttgatgttgaaagaatctttggtaggtgcattacttgtaaaaaggaaaaatctagagttttaccacaagctttgtatactcttcttccagtacctaatgaaccttgggtagaaatatctatggactttattttgggacttcctgggtcaaggggggatgagattcaatttttgtgggatacaagattcctcagtcatttttggaaggtcttgtggggaaagcttgatactaaattgttgttttctacatcttatcacccacaaacaaatggaaaaattgaagttgtcaatagaactttaactcagttgcttagagttgttgttcaaaagaatttgaagaattgggaagaatgctttccatttgttgagtttccatataataagagtgttcgttcatctactagttactttccttttgaagtagtttatgggtttaatccactaactcttgtggatttaatacattttcctgtagatgaaagagctagtcttgatggaaaaaagaaggttgaaatggtgaagaggcttcatgaaaatgtaaggcaatttcaaaagaaaaatgaccaatatgcatcacacgccaacaaaggaagaaggcgtgttatctttgaaccaggtgaagatttaaggatgaatcctttggaggaaaaaggagatgatgagaatcaaaggctggaacaagcacactcaagcaccttaagggatcatttgcaaattctagtggacctattacaagagcaatga

SEQ ID NO: 103050 - DNA, 219 bp, Glycine max
  Peptide Sequence Number=SeqID_219828
atggagattagtggtccagaaaatagcaaattagtctatggtattaaaagtgtcagatatgataacaatgattcaaataaagccagaattcacgaagatgaaagtccctattgttgtaattgcgacaacacaacttgcagagcacacagaattaagatgtctcatgatttaaaactcagagaaagcaagagcatcatgaaaatctcaggtggaacttga

SEQ ID NO: 103051 - DNA, 543 bp, Glycine max
  Peptide Sequence Number=SeqID_219829
atgccgtcttctggtcctgttttttcattctctggaactcccaccattactactgccaaactcaactggaaaaactatatgtcttggtctgcttccgtggagttatggtttctcggccaaggatatcatgatcacttggaaaagggagttgatgctgttccgaatgacaagagagctgaatgggaaaagctggattttcagttgtgtgcagtgctatggcaatctgttgaaccggatgttttggagatccttagatcattcaaaacatgttgctctttttggaagaaagcacaagagatatttgccaacgacattcaaagtttgtttgatgcaacccagaaagttgctgctctcaaacaaaccagccatgatatgattgcgcatgtagggaaagctagagcagcagtggaagaactgaagagatttcttgcagcaaaatcgttggaggaagtgaataggaagctggacaagttctacatggtgaccaagtcccgtcaatggactccctcattactagacttcttcgcgtgcctcaagccttga

SEQ ID NO: 103052 - DNA, 276 bp, Glycine max
  Peptide Sequence Number=SeqID_219830
atggtcacgtccaacaccaacaacaccatcctcaaaatctccaaactcgcgatcctcctcgttttgttcgcttcagtctgcaacgtcgctatgtcggactccaccgccaaacccctcgaccagcacgccaccacgggctctgaccctactgcgccagcggttcacatcgtgtacaccgagagaccacagaacgaggagcctgaggcctaccacatcagaaccctcacttcagtccttggcagggtcttgctattcgtccttacgacaagaaattaa

SEQ ID NO: 103053 - DNA, 311 bp, Glycine max
  Peptide Sequence Number=SeqID_219831
atggacgcgattaaacaaattctgatcgatgaaatcgacacgctcaaccgcgaagagcggcgcgataatctgccgcgttttagctttaacttcctgaaaacccatccggggctgtggggcgtgatgtacctgtgctacggcctgtgcgtggcgctgattttctcgactgagatgctcggctggccagccttctggttcgccacggtgttcgtgctggtgatgagttttctgatgctgctcgacatcaacccgaaataccgcttcgaggacatcgatacgctggatctgcgcgtgtgctacaacggcgagtg

SEQ ID NO: 103054 - DNA, 3753 bp, Glycine max
  Peptide Sequence Number=SeqID_219832
atggaggcatgtgattgtccaccaacacatcatgttccatcagaagagcaatcaaattcttctgtacttcctggaggaaagccaccccatattgtggtacagaacgatgatgttcacgctgaaggatacaattgccattctgagtactcacaagttgagaaggaaggcttctattggggaagcaagaaaaataggagaaataagaaccatagtccagtcaaaaaggtgtcacaagtgggtgaaaaacctggatcatctattctagagtctgaaaaacaaagaaaagttggtaatgatagctttctgaggattttgttctggcagtttcataactttcgcatgctcttaggaagtgatctacttctatttagtaatgaaaagtatgttgctgtgagcttgcatttatgggatgtcacacgacaggtcacacctttgacttggcttgaagcatggcttgacaatgtcatggcaagtgtgcctgagttggctatatgttatcatcacaatggtgttgttcagggatacgagcttttgaaaaccgatgatatttttcttttgaaagggatatcagaggaggggacacccgcgtttcatcctcatgttgtacagcaaaatggtttgtctgttttgagattccttcgggataattgcaaacaggatcctggagcttattggctttataaaggtgctggtgaagatgatatacaactttttgatctttccattattcccaaaaactgttcatctgatcatagtgatgatgcttcaaggtccttgcgatcatcgatcagtaggggtagaagtgatgcagtatattcgttgggaactctcctctatcgaattgcacacaggctttcgctctcaatggctgctacaaatagggctagatgtgtgaggttctttagaaagtgtttggaatttcttgatgactcagaccatctggcagtacgagcagttgctcatgaacaatttgcgaggctgattttaaattatgatgatgagttgaatttaacttcagaatctctggccctagaatgtgaactaactgttactgaagtcgaagagtcatcttgggatgctgaaaacagtaattctgaacgaggtgcacatgagctattttatctgcatgctaatgacaaatcagccgaacatggaaatatgattgagcacttagaatcagaatgtcctgcaaagatggtctctgaagcatacaaacccacatctggggaacttatagctgtcagtagcacagaattgagcaaccaagaaggggatgcaccaagcttgtatcctgatgatagctctttggcttgtgaagtatgtccagtttccacacctgtggttcagacagttgctgatccaatctcatccaagttagctgccgtacatcatgtttcacaggccattaagtctctgagatggatgcgtcagcttcagagcactgaaccggaggtgatggatcaattcaatgaaaatcgtgatagaccatcatcttttaatgtttctgtttgtgcctgtggagatgctgactgtattgaagtttgtgacatccgagaatggcttccaacatccaagttggatcataagttgtggaagcttgttcttttgcttggggaatcgtatttggcacttgcagaagcttataaagaggatggccaactgcatcaagctttaaaggttatacagctatcatgttctgtttatggatcaatgcctccacatcttgaagacacaaaatttatttcttcaatggtcagtggctcatccttagagagaaaactcattgatcttaatgaaaagacgtggcaggatgatgtaaaagatgagactgttaatggctatattgaaagaaagtcttctacttaccttttctgggccaaggcatgggcactagtaggagatgtttatattgaattccataggataaagggcaaagaaatctcaataaaagatctgaaaaaacctgcaaccagagaattgaaaatgtcatctgaggttgtgaaggaagttaaaaggctgaagaagaagttggttcaaatgaaccacaactgcagttcatgttccttggtaaattgcagttgccaaagtgacagagctagtagtgggaatagtgcaagcagtagtagtgcagatgcaagcttcatgactcatggtagaaagcatagtaaacggttgtctgctaaaaatgccaattactttcctccaaaagacccagtagatgagttcattcatgacaaggaaaatggaaaagattttgacagcaaatacattgagcacagtagttatggtggagatcttaatctgagggatactcttgagaataggattgaaattgaatctttggctgctacaaactctagaattgttgagggatcctcagagatggacgtttcatgttctagtgttgtctctcaaacggaaaatacttcaaaggaaacaggtaaagtcaaaattggtgggatatttgagtacctagttgaaccagtagtgggagacgtagagtccaatcttttatctgctttaaagtgctatgaagaagctagacaagcattacttaaatttccaactagcttgtctgagttacaatctgtggttaaaaagaaagggtgggtttgcaatgaatttggtcgaatcagacttgaaaataaagagttgagtaaggctgaattggcatttacagatgctatagatgcattcagagaagtttcagatcacaccaacataatattaattaactgtaatttgggccatggcagacgggctttggctgaggagatggtatctaaaattgagaatcttaaactacataatattttccataatgcatataatcatgcattggaaactgcaaaactgaaatatatagaatcccttagatattatggggcggcaaggttagaactgaatgccatcaatgaacatgatgattctgttacaagcagcttgaagaatgaggcacatacacagtttgctcatacttttctgcggtttggaatgcttttggcaagagaaaatactactgcaatttatgaaactggatcactggaaggtacatgggtaagtcacaccacgccccatgacagaaaagccaggaaagatttgagaaagcatgagatttcagctaacgaggccattagagaagcattatctgtgtatgagtcgctcggtgaactgcgcaaacaggaggctgcatatgcttacttccaattggcttgctatcagagagactgttgtttgagatttatgaattctggcaataagaaaagcattttgtctaaaggcgaaaatagtgctgtgcaacgagtaaagcagtatgcatctctggcagagaggaactggcaaaaggccctggacttctatggccccaaaactcatcctaatatgtatttgactattcttatggagagatcagctctttcattaagcctttcaagccatctacactccaatgtggtgctggaatcagctttggctcatatgcttgaaggacgccatgtatcagatacaaatgccgacactttcggtactagttatcccgaattacatgcaaaatattggagtcagttgcagatgcttttgaagaaaatgttggccacgatactttcatcgagtgcaaacaaatctccctgtcaaccatcttcaacatctagcagatttggagatggtggaaagatcagggaactctacaagatgtccctgaagggtactaatatgatccaattgtataacatgtacaacttgtggatatcatga

SEQ ID NO: 103055 - DNA, 333 bp, Glycine max
  Peptide Sequence Number=SeqID_219833
atgcttgttcacagcaacaaagaatcgcatctcaacgcaccagaggcccctgtcagagacaatcgcacagcccatgaaactcgtaaagggatcacagaagcaagacgcacacaaacttacggggtggtggccgcaccggagacccattatgttctgttgccttttcgtttgcgtttgttgctgccacaaacaccgttacacgcgattttcgatcactctacaacattggtctgtaatggtaacgttgtgatccaaaccgttaagatgcggactatattaccgattcagagcaatagtccaccaatgacgcaagctatagtccaccaaaactaa

SEQ ID NO: 103056 - DNA, 252 bp, Glycine max
  Peptide Sequence Number=SeqID_219834
atggtggcccagagattgaggatccatgtgagcacgttgatgcttgacggatattggcttcatgacaaggattaccattgtgacggatttgtgggaattctctgtgctacaatgagggatatggatgatgttgagtttgaggtcgaggttgagagtgttatacctgaggttgaggttgagggtgatatacttgaggtcgaggtagaggatgccgagcctgaggttgagattatcgagatacttgaagcttga

SEQ ID NO: 103057 - DNA, 1101 bp, Glycine max
  Peptide Sequence Number=SeqID_219835
atgacagctcgcgacggccaccggtggtcgtgggtggtggagaaggaggtgttagggtttgggtggcgttttggaaagaggagagtgaaaaatcgtgtttttcacactggggaacatatttataatctgcaaatctcgcttagcgagctcgtctcgctaagcgggagtccagttttcttgctcactgcgcaaattctcactcagcgcaacttcctctgcacaatggctcgctcagcgggccaattctcgctcagtgcaattcactctcgggttggaattgtgcttagcgcgccctttgcgcttagagagacatccaaagttgttattttaaaaatcccgacggtcagattatggggaaatgtcttacgaagctccagacaaaatttaaagacgatccaacggttaatgaatccaggatcacgattttactggaataggtttagggtgttacaatttttatcgagtccatgtgaagcacctagcttgggaagtatcatgcttgggacatactatgtcattgtgggaatgtacaaagattacttggagaagcatcagtgcttgaagctgcgtcttcggaagcgaatggacatggcgaagctattgtcatcgttgccatcatcatcttcgtcgaactctgagaattccaaggaacttgtgtgcgttggaacgcttgaaatcgccactcccaaacccgtcgggttcctctgcggctcaatccccgttcccacggacaagtccttccaccacgctttccattccgctcttctccccacaccccaaacggtgaatgctccgcgttaccgttaccggatgctgccgaccgagactgatcttaatacgccaccgcttctggcaaattttccggacaaggttcttcctgttggcgctgtgcactccaaggcaactggaggagaattctggtatgataccaattgcagcagtgctacgagactgatcccatttcagtctctatgcagccaagaccctctgcttttacttatatgcactacagttccctccacagttaatgaagtctacagattgactactgaaagagatgaaacattcgaagagttgctagctaatttgcttaaggcttag

SEQ ID NO: 103058 - DNA, 243 bp, Glycine max
  Peptide Sequence Number=SeqID_219836
atgggtgccaagcacctcacaaggaccaaagaaaggtcgcatgtcatcaagcaaaggtccccggacgaaattaggtttggcatcatcaaagccaaaaaaggggagattgttggagataagggagcaacaacatggaacagcctaaggctaaagcttgggaactccaatgtagctcgcaaagatgttagtaacaaaaagcagacaaaaaagtcccttatatggatgaatttcccgttctgttga

SEQ ID NO: 103059 - DNA, 381 bp, Glycine max
  Peptide Sequence Number=SeqID_219837
atgtcgcgggggtcaggagaccttggggacgtcaggtggggtgctattgcccaaaaccaagcttgtccaatcccgacccaacccaggcatagtcagccagtgaaaacttgtgacgtacctaagcaggcgagctcctggcagtcaaccaataaaggaacaaaagtccacgaagcagggaggcttgtgtggcggctggccagctatctatcttgtgttttatctgaaaaattccctctgatcgtgatggcagtgcagttgatccatgatcgcgttgtgatggagtgcctagagggtgtttgggagaccctcgaatgcaatgagaggtgccgattccgtggcacagttcaactcactgctacttcgctagtacatccggagtaa

SEQ ID NO: 103060 - DNA, 399 bp, Glycine max
  Peptide Sequence Number=SeqID_219838
atgaatgactcacatttaaaagctccattccttgaagaaaatggcttcaataaggctttgcagagttcagtgaattcatctttggaatggttggctgttagtatacagcctgctgctggattcagttcacactcttcatggaattatgataatatgtcatctttagattccaggcctattgacaagcagtttcagaaaatgttgaatatccaagcaatagtgatctcacacatgccaaggattcaaggtcaaagtgaaacatcttcacagaataaggttgatgttcatgaaaacaacctagattctcaagttgaggatcgggagctcaaagtccagcttttgcataagtatagtggatatctagggagcctcgagggaatttttgaagaagaaaaataa

SEQ ID NO: 103061 - DNA, 342 bp, Glycine max
  Peptide Sequence Number=SeqID_219839
atgagagtgaaagaaaatgaatgcaaagagaagagaagatatagttggtgtgttgtgcttctaaagagaagaatactgatgcggcatgggaagtcgcaagagaaccgggacacgacggcgtacaccaccatactcgaccacaacattcagtcaacagtgcaaggcatgacccaggccattcgcactaacgagcacctccgtcgcgtgatgggtagcaacggctgctcccctgacttgcgggtgcagttctacatgccaccctacgcccacacccgatcgatgctccacaagctcaaacggtgtttcttgaagaagaggatcattggcgtgagggaagagtag

SEQ ID NO: 103062 - DNA, 345 bp, Glycine max
  Peptide Sequence Number=SeqID_219840
atggtaaccagtttttttaactttggtcgaggtggatgtggctatgatggtggaaatagaggtagaagtaatgctggtagaggtgatggtcgtggccgtggaaggtttctaaagaggttctcctcaaggggttggtgggacaagatggctactatgcctcttcatcaaaatggagtcatagaaaggaagcacaagcatatagttgacatgttgattgggcatcatattctcggccttgatcaatgggttgatgctttgatcaagcccttctctccaaccagattccagcttgtcaagggcaaactcaatgtgatggatccttcctccaagtctcaaccaccttga

SEQ ID NO: 103063 - DNA, 1014 bp, Glycine max
  Peptide Sequence Number=SeqID_219841
atgaatgttacacaatttaggctgaataagaatttttgggctgagtatctcgtgaattgctcatcgtccactacgatagatttcaagacccctactaagatatggtctaacaaaccagttaaatacacaatgctaaaggtgtttagatgtccaacatactatcatgtaaatgaagatgtcgtctttgacaaactatctatgttgcattctaaatatgatgaagatttgggcaaggctaaggatgtcactaaacagaatttagcaccagttgaagggactgattggatgagtcaaaacgatctgaagcagcccaaaaccataacacccagaaagttacaaaggaaaatcaaagctcctaaaaactatggctttgatatggtgtcttatgcgttacaggtagtagaagaaatcaattcattcaaaccaaccacttatcaggatttagttgagctacctaaaggcaaaggagtagtggggttcaagtggatcttcaagaagaaacatggatcatccgttgaagaagtcatctattataaagcacatatggtcactaaaggctatatgggaactctggacatggagttagagaaactcgatgttaaaactatctttctccatggaaggctggaggaaaacattataatgcaacaacctaaaggttttgaggtgaaaggaaaggaaaattttgtctatagattgaagatgtctctttatgggttaaagcaatcaccaaggaagtggtacaagagatttgatgagttcattgtctctcattggtatataggtaatcctggaaaggaacattggcaagctgtgaaacgtatattcaggtaccttaaaggtacaactgatgttggactcatccagcatggagacacatcctatgctttcgccgtggctttatccactggaaaggaaaagtacataactctggaaaaagtagcaaaggaagggatatggctgaagggtcttgaaaacgatgatggaactcacaaaccaaaaggaggggaattg

SEQ ID NO: 103064 - DNA, 573 bp, Glycine max
  Peptide Sequence Number=SeqID_219842
atggcggttccgatacatcaacctattccaatggtggttccgattccagatccagtttcgatggagattcctcagtctattctaacgttgactccaattctggttgttgcgacaccgcttcatgcggttctatcgccgtggcgactttgtattcacaatcacatccttctcgcatgcgatttctatgagcaagtagaaccagtgttgagagaggttcttccttggtttcttggatgtcaaacttcgtggcatctgtgggataaaatccactctcattttcgttccttgattcatgctaagatgagacaactacaaattgaacttcatagcatgcaattggagaatagatcagtgtctgaatatctacttcaaattcagactattgttgactctcttagttcaataggagtgacaatttcttcatatgaacatcttgatgttattcttgaagggctacctagggagtatgagtgtacaatgtctttgatttgcagtaagtttgaacctctttccattgatgaggttgaaacattactactaggtgatgaagttagtaggcttgacaaattttag

SEQ ID NO: 103065 - DNA, 1357 bp, Glycine max
  Peptide Sequence Number=SeqID_219843
gccggagttgaccagcgcggtggtcttgccggcgccgggcgcgccgatgatcacataccacggcagctggtacaggtactggcggctaaagcgggtcatccagcggtgtttgccgtcgccctggcccggtgtgaagcgcgcctttttcagcagctgcgccgcttcgtcgaagcgctgcgccaactgatcgtcttgtttgacctcgggcttgccgtcttccgccggcaccgcttcggcggcgcgcaggttgctcagcaggcggctgttgaaccaggcgctgtagaggcgcgggatcaggcggcacaggaaccagatcaggtagataacgccgatggcgatctggcggttgagttccggctccagcgggcgatagtcgccgatggccaccagcgggccgatcatccagatgatgaacgccagcgcggtaatgccgacaaagccccacagcaggcggctgccgttgatttccgcctgggtattttccggggcgaccaacagcgtaatttctacccggcggttcaacgcgcggttcactttgttatcgttcggcgcgacggggttgctttcgccgcggccctcagccttgacccgctgcgggttggcgaggtgcttttgcaaccgggcgctgaccgcttcggcgcgcgccagcgacagctcccagttggaggcgaaacgggcgctgcggatcggcacgttgtcgctgtagccggtgaccaggatcttgccgctgacgccgttcatggcggcggcgatgcggtcgataaccggaatatagttggcgcgcaccgtggtggcggcggagtcgaacagcccgtcgcctttgaggatcaccacgctttgctgcgcttcgtcgcgcaccaccaccagcccttcggctatctctttgcgcaggaagcttttcaggctcagcgtcggcggtgcggccggcgccgggttaccgatcgccacctgcggcagattggtttgataaatcgccgccagcaccgggctggtgttgtcgcccagccgccagttgagggcgatgaacagcagcgaagccaggaagccggtcagcgccacgcaggcccacagcggcaccagcgggcgccacagtttctgctgtaccggcagatccagcgcatggggcgacagcggcggggcatagccgccgcgcaccgaccggatcagctgcagcaggcgctgtttcatggtttccagctgcgagcggccgttttccatcacccggtagcggccttcaaagcccagcagcaggcaataattgatcagctccagcaggttgatgtgctcgcgcgggctttgcgacagcttggccagcagctggaagaatttctcgccgccccaggtttcgttatggaag

SEQ ID NO: 103066 - DNA, 330 bp, Glycine max
  Peptide Sequence Number=SeqID_219844
atgagtcttgagtacctagctgtagagacattcgttgaagggcaatggaaaattgtatcaatatatcctcctcccatgcaaaaagcagtctctttcgttgccaccttcacaatatggattgattaccataagaaacatgttgtgaacattaatgtccttacaaggtttttaatcccaaggcctccctcggatcgtggtagacataccttgatgcaatcctatcctccaagggcattggatagaagactccaagaaaattgggccaaagatgcaagagaaggccctagggttctcatgagccttacggtagattttgggcccatgggctaa

SEQ ID NO: 103067 - DNA, 255 bp, Glycine max
  Peptide Sequence Number=SeqID_219845
atggataagaacttgaaggtaggagaagatgagtggacggagagggagagaaggagcacggaattttgtgcctcaaatgagccttggcacatgggctcagaaatctaccctgaggttcatgagaaccctaaggtcttcttcagcagctctaacccaatcctcttggagccttttgctcatggctctggtgattggtcccttcctagggaggattgcatcagtggtattctaagagagcccttgtggttggtctaa

SEQ ID NO: 103068 - DNA, 339 bp, Glycine max
  Peptide Sequence Number=SeqID_219846
atggaaattttcttagattttgagttgcagacagaactggctgggattctaaaagattatgttggccgggagagtcctctttattttgctgaaaggttgacggagcattacaagaggcctaatggtgaaggacctcacatttatctgaagagggaagatctcaatcacactggggctcacaaaattaataatgctgttgctcaagctttgcttgctaagagattgggcaaaaaacgcattattgctgaaactggagcgggtcagcatggagttgccactgctactgatatggaaaggcaggctctcaatgttttcagaatgcgtcttctcggtgctgag

SEQ ID NO: 103069 - DNA, 441 bp, Glycine max
  Peptide Sequence Number=SeqID_219847
atggctgcttcaataccattcacaggtctcaactcctcaagggtgcttcccattcccaaagagccataccacccattttcccatttcccctcaagcatgccaaagtttgcatctttgagaatcccttcttcttctgtgtcttgctctctcacaagagactcttcctctgttgtgccattggaggaacatgacaaaatgggtaatgggtcggttctgcttcagagacccgattcgtttgggaggtttggcaagtttggagggaagtatgtccctgagactctgatgcatgctctctctcagcttgaggctgccttttattccctcgctgctgatgaagagtttcagtttagcatatttgggaatgttgttttgtctattgaattgaagtctctggtcgtggaagtagggcatagccagaaacttaactgtgcaaggttttaa

SEQ ID NO: 103070 - DNA, 315 bp, Glycine max
  Peptide Sequence Number=SeqID_219848
atggccggtggtgcgaatttcgtgcagagggttctctcttacgtggtgaatgaagtggttgtcaatggtcttgccaacagcatcttaacgttgcagcctgttaatgctacaggttgtaagcattgcgtatttttttatgtcgtgcccactgctgcagccaatagtatgatttatgcccagggccctgcatttcagaggtttgcagtgaggacatcaaaaagaattggagatatttctaacaaagctgttcagaagaggcaggagctagctgagcagatcaaggacatctcaaaaaatatggaggttgtatgctga

SEQ ID NO: 103071 - DNA, 168 bp, Glycine max
  Peptide Sequence Number=SeqID_219849
atgaaagtattaatggcatcttcttcatcatcttcgtcaaatataaaaattaaatctgatccagttgatggtgacatgttatggatgcaagataagcatgtttcacagcatatttgtgttggaccttgtggcctcaataatcttaagagggataggtttagaatatag

SEQ ID NO: 103072 - DNA, 2512 bp, Glycine max
  Peptide Sequence Number=SeqID_219850
atggttaagactagaggattaggccatgcgttaggtaggattgttgccagaggtctggggagaggagaggatggtgatgatactgacgatgctgcccctgccgcacaggacatcggtgcagagactgacgcacatgataccggggcacaggataggggggacaagcctgagggatttcctggtggacccagggacccatcagtgcatacagagtatgctgaccatgttgcggccaacgtatggtctggacaggaacgccctgagttgaagttatcctcccatgggaggaaggtgcataacttaggcagtcctgttcttgcaattgaagacatggagacttctagtttccaccttcctgtgggggagatttcgattacgttggacgacgttgcgactcttctccatctgccaatcgttggtgcactgcatgacttccagcctctgcacagcgataaggcggtgctgctcttggttgagttactgatggtctcaccagaggtggccatgaccgagacaggccaatgtggcggaccatacgtacgcctacagtggctgcgagacatataccagtacagatatcagatgcaacactggacagctgccgctcgcgcttatcttctgcatcttttgggttgcactctctttgctaataagaatgcaacccatgttcatgtcgtacacttacaggccctgcgtgacctcactcttgctgggcggtatgcatggggagttgctgggctcgtccatatgtacaatcagcttaatgatgccagtctcagcaccagccgacagcttgctggttacatcaccttgttacagtgttggatatacgagcactttccgtcaattgcggagtgcaatgctaatctggactacgacgaggtgtcaccacgtgcgtgttggtggattgcgacaaagaagactatgaaaaaggtatctgcagcgatgcacaagcagcgcctggatcatctgaggatcctagatgtttgctggatgccatattcagagcatcgacctgtgcaggactttcatccgatttcgtgcttctcgggacagctctgttgggggcctgttgttgtcagatacagaccagagagggttatgcgccagttcggctacgtccagtgcattcctgcacaccctgtccatccatgggtgtcatatgatgacgtagacgatacgtggatgcactactcagaccatttggcggcagcaggtgatccatgtgttatgccaggtcagtgtgcgcttgactacatagactggttcttccagtcagatatccctcaggtcccggatgatccagccaggtctgatgtcgacgagctcagacatgcattggaggcttgcgatgtgatcgctgagaggttggagcgtcacctcagcctaggggtagtcacgccaggcacatcaacacatgaggtcatcgaagaatgcctcaagattgccaggagtgtcacccaagaccgcattgtgtacgttttcgcagtcatagaattagtattgctgatagtgtaccctggtgctcatggtttgagcagagatgattttcctcctggttttgtgtttggtgcatcaacttcagcttaccaggttgaaggtgcagcaaatgaagatggaaggaagccaagcatatgggacaccttctcccaagctggaaatgggaatatgtatgctggtaatggagatgttgcttgtgatcaatatcacaaatataaggaagatgtccagctcatggctgacatgggcttagaggcctatagattttccatatcatggtcaagggttattccagatggaagagggcaagtgaatcccaaggggcttcagtattacaacaaccttattaatgaactgataagccatgggattgaagcacatgttacattacaccattgggacctaccacaaacacttgaggatgaatatggaggatgggttagtccaagaattgtgtatgttcccaagcttctagtctttaattctgttgacatcttgaaagacttcacaacatatgcggatgtgtgttttagagaatttggtgacagagttaggtattggactacggtgaatgaggccaatgtttacgcagtttttggctatgatgttggaatgttaccacctcagcggtgttctccttcccctatatttaactgctcgagaggaaattccacaactgagccatatttggtagcccatcatatgttgttagcacatgcttcagctgttaggttgtataggaagaaatatcaggtcatgcaacatggcttaattgggtttaatctccttccttttggtgttcttcctcgaacaaattctattgaagatgtaagggctactcaaagggtccaagacttctttatcgggtggtttatgaatcccttcacatttggagattaccctgatataatgaaaaagaatgctggctcaaggcttccttcttttactcaaaaggaatcaaatctgaaggaggatagagattacattgcagatctatcggtggaaattgaaa

SEQ ID NO: 103073 - DNA, 699 bp, Glycine max
  Peptide Sequence Number=SeqID_219851
atgcatttaatgttgaaagtctttggtcttgtacaattaccattggcagctcttcttcctgttgcttataccttacacaaagatgagttcctcctgactttgtgtttggcgcatcaacttcaacctaccagtgtcgtactatcttcagaagagttaaaggctaataagaacactcatggctttgttgcagcatatccagacagaaatgttaccatagacactactgacacttctgaatttctctccctagactcttccagtggcctatggcatgcctcaaattttggggaggatgtgattgtgggtgttattgacattggtgtgtggccagagagtgaaggcttcaaagatcatggaatgaccaagaaaattccaaacaaatggaaagggagttgtgaggaagtacaggacttcaacacttccatgtgcaacttcaaactgattggagctagatatttcaacaagggtgtcattgcagcaaattcaaaggttaaaatcaacatgaactcaactagagacacctcaggtcatggaactcacacatcttcaatagttgcaggcaactatgttaatggagcctcttactttggctatgctaaaggtgtggctagagccaggctttccatgtataaggtcattttttacgagggtcgtgtagccttagatgttttggctggaatggaccaactccattactga

SEQ ID NO: 103074 - DNA, 306 bp, Glycine max
  Peptide Sequence Number=SeqID_219852
atgttgattagcttttctagtcacgtatttgagcagcttgctgctatatatcatcacaatttaattgcacttgtagcgattgcaagaaggaaccgtggagggcagacgaggaaacagcagctagggtcagaggggtatcatgagatgggaaccaaaggagggcagacgaggaaggagcagatggggagagaagggtaccaagaaatgggacgcaaaggaggcctcagcaccatggacaagtctggtgtagagcgtgctgaagaagaaggcatagacatcgatgagtctaagtttaagaataaataa

SEQ ID NO: 103075 - DNA, 213 bp, Glycine max
  Peptide Sequence Number=SeqID_219853
atgtcttgtcaagtagttctaggtgcccgacgaggtttttcactaaaaatggtgaaccaacatatgataagttacatgctagagatggagatgcttagcctttgtcagggaaatgctctgatagatgtgatatcgggacatgaggatgttgctaggtgcacccagcacttaagggctagtattgatccgcatagggatttaggtcttccgtag

SEQ ID NO: 103076 - DNA, 150 bp, Glycine max
  Peptide Sequence Number=SeqID_219854
atgggtgcaggaagcaaaatgtgggatgcaggaagcaaagaccattttaatgttgttcaaggctcaagagtgggtggtgggtgcaagggtgatggtggctcggtgaatgttcaaggagaaggtggtgggatagaggaagaagaaggatag

SEQ ID NO: 103077 - DNA, 1173 bp, Glycine max
  Peptide Sequence Number=SeqID_219855
atgaagtatcccagaggaaagcttcctcttcccatcattgtcatcacaacatgtgttcttgtttttgtggctatcttgtatgtagagaggctcagtttcctctcttccaagtccattttcaagttcaaaccatgtcctagaaaaaccaccaaaacaaagtctagtgacaaaaaagcagatgaggaggttgtggttgtgaatgcatcaacatggattgatgacaggtttgattttgaccctgaggagtgcaatgttgcaaatgggaaatgggtgtttaaccattcaataaagcctctctactctgacataagctgtccatacatagatagacaattttcttgtgtcaagaatgggaggaatgattctgactatcgccattgggagtggcagccagaagattgcaccttgccacgtttcaacccagagctagccctcagaaagcttcaagggaaaaggctgctatttgtgggggattcactgcaaagaaaccaatgggaatcttttgtctgcttggtagaatgggtcatacctcataagcataaatctatgcaactaggaagagttcattcagtcttcacagccaaggcttacaatgcaactatagaattctattgggcaccatatcttgtggagtccaacagtgacattgacatcatagatataaagaaaaggataataaaagtggatgccatagctgaaagagccaaagattggacgggcgtggacatccttgttttcaacacctacgtatggtggatgagtggtattaggatcaaaacaatatggggttcatttgctaatggacaagaagggtatgaagagtttgacaccccagttgcttacaaccaagactggggcaacatggaaggtgtgaagtgcttcaatgagacaaagccagtgaggaaaaagaagcactggggcactggttctgacaagagaataatgagtgtggtggcaaaagtgacgaagaaaatgaaagttccagtgacattcatcaacataacacagatatcagagtacagaattgatggacattgttcagtttacactgaaaccggagggaaattgttgactgaagaggaaagggctaatccacaaaatgcagattgcatacactggtgtttgcctggagttcctgatacgtggaatcaaatacttttggctatgttgtaa

SEQ ID NO: 103078 - DNA, 2130 bp, Glycine max
  Peptide Sequence Number=SeqID_219856
atggcgtacatcgtatccagcaaggttaaccaatttcgctattccacgcgccttctcttctcacaccttcttcgccatggcagaccctccacgcttttaccacccttctcttctcatcttcaaccactccatcaccctcaccaggttgggaatcaaggttatggaaatgggtcgttggggttgtgcccaaggcttctatcttcttcttcttcttctgatgcttctgctgctaatgttagtggagaaaaaccagcattggattcagatcaatctgcaaaagatggttctggcaaagagagagagtctgggagtggaggaggacaggatcagaaaagtgatgctgggaaatctgttcgtggagggcctgtttcttggttgagctttctcttgttggttctcactggagctggactagtgttctactacgacagggaaaagaaacgacatatcgaagggatacgtactaatacggaggctgttaagcagggaccttctgcaggaaaagctgcaattgggggtccattttgccttatcaaccatcacggaaaacatgtaactgaaaaggatttcatgggaaagtggactttgttatattttggctttactcactgcccggatatctgtccagaggaactacagaagttagcagctgctgttgataaaataaaggagaaagctggaattgaaactgttccggtttttatctctgttgatcctgagagggatactgttgaacaagtcggtgaatatgtcaaagaatttcatccgaagttaattggattaactggtagccccgatgaggtcaagaatgttgctcgtgcatatcgcgtttattacatgaagacagcagaggaagactcagattatcttgttgatcactccattgttatatacttgatgagtcctgagatggaattcgtaaagttttttggcaagaacaatgatgttgactcacttgctgatggtgttattaaagaggcatcttcaagctctgaatctgcaatggcttctctactcaacatggtttcggttccaccaagaatatcaccaacctcacacaccagaatcgcttcgcttcaagctcgacccgttttgccacccttttctgtctcattttccagtaggtggctcacaccacctctttctggttgctctttcagtcaactctttggatttgaaattcttggtgtttttatggacattgcagggaggagactatcaattagagcaacagaaactgataccaatgaagttcaatctcaggcaccgggtgcagcgccatctaaagatggttcaagcttcaatcagcttcttggtatcaaaggagctgcccaagaaacaaataaatggaagattcgtcttcaactcacaaagcctgtcacttggcctccgttagtttggggtgtagtttgtggtgctgctgcctcggacaacttcttgaagtcctcaatctactatgatctccggtcaggaaattttcattggaattttgaggatgttgctaaatcaattgtgtgcatgatgatgtccggcccattcctgacaggatatacacagactctgaatgattggtatgaccgagaaattgacgcaataaatgaaccttatagaccaattccttctggggcaatatctgagaatgaggtaatcactcaaatatgggtgttgctgcttggtggtctttctctggctgaagatcttgattggtttcttactgacaggtgggcaggtcaggctttgtttggaactcttacaccagatataattgttctcacactcctatacagcatagctggattgggaattgctattgtcaatgacttcaaaagtgttgaaggggatagggctctagggcttcagtctcttccagttgcttttggttctgaaactgcaaagtggatatgtgttggcgctattgacattacacaattatctgtagctggatatctacttggggctgataaaccgttttatgcgttagctttacttggcctaataattccacaagtcttttttcagttcaagtatttcctcaaggaccctgtgaaatatgatgttaaatatcaggctagtgcacagccatttttggtgcttggtttgttggttactgctctagcaactagccactga

SEQ ID NO: 103079 - DNA, 297 bp, Glycine max
  Peptide Sequence Number=SeqID_219857
atgggaggtgttccaccactaaggatggcgacatgcatgtgcatgtgtttcgctaatggtgatggcgaaacccatggtggactcgctggcaggaatggcgacatgcatgggcatatttgtttgaagcgacaaaggttctcctctcctcttcataaaatgctcaccttttccctcatcctctctgacgaggttcgatcttttttttttttatgggaatacgaggcgcaaagcaagaaaaagaaaggagacacaccttaccatgaacaatgccaacatcaccagcaaaggagaagatga

SEQ ID NO: 103080 - DNA, 851 bp, Glycine max
  Peptide Sequence Number=SeqID_219858
atggcccacttggagctctcgattccatggcgcggctcaacagagcagccgcaccgtcctacctatttaaactatcctgagggaaacttcggagggaaccagctactagacggttcgattagtctttcgcccctatacccaagtcagacgaacgatttgcacgtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatg

SEQ ID NO: 103081 - DNA, 357 bp, Glycine max
  Peptide Sequence Number=SeqID_219859
atgtggttggtggttctatgtttcattctgcaaattctcttacatcatggtgatgaagatgatgatgatgatgatgattatcttgtgtctaactcatacgttgaaaagtctttagacgaagacgatagtattgacggtatatctgatacagacgatgaagtcaccgacatgattcaaccagtgtacaaggaattcaaaatccattttggaatgatgctttacattataacaatatcaactggaatcatcctgatgaagaggacatttgtggtttggagatgccatcgagttttaatgttggccaacaattatatgttggcatggattttgatagtaaagatgcggtcaaaaatgtag

SEQ ID NO: 103082 - DNA, 1746 bp, Glycine max
  Peptide Sequence Number=SeqID_219860
atggatgacccgcaatggtcaaattgcatcatgtacgaggatccgacaggggctttgttcaaacttacgcagagcgaatccgtcaatgattatctttttgagtttgaaacccttgccaaccgcatcattggtttaccttctcccttcctattgagctactttgtttttggattatctcccgagattcatcgtgaagtacaggcattacaacccttgtcattgattcaggcggcaactcttgctcgactccaggaggaaaagttcaatgacaatcgtcatgcgctccgcgatggtacttggagattttgtgtggattaccgcactctcaacgcgattacggtaaaggaccatttcccgattcccacggtggatgaattgttggatgagctcagcggcgcttgttggtttttgaaattggatctcttacaggggtactatcagattttaatgaaggacaaagatgtcgaatatttgggatatcttgtttctgaacatggggttgaaccggttcaagcaatacaacagtggcttgctccccattcccttaaagctctacggtgtttcttgggtttgatgggcttctattggctcttcatcaaaggctatgccaccgttgtgacacctttgacacaacttctgacgaaagaccaattcgggtggtcctatgacatgcaacgagcttttgatgccttgaaggacgcagtgagtaaggcttcggtcctgcttctcccaaacttctttgttgtttgtcttagaaacacatgcatggggggcatcacttcaccattttcaaatcatcgtagcctcaaggaattaatgtctcaggtcgtgcaaaccccggagcagcagatgtacttggctagattgattggtttcacatttttgcaagagctcaaacgagaattgtattataatgctgattttatctcattccaggaagctattcagcatgatcccgctgctcaccctgatttcaccgttactcaagagctgattcttcagaaaggaagaatcagagaagatgtccagcaatttgtggcagcttgccttgattgtctgcacactaagtatgaaacacagaagactgctggattactatgcccactgcccattccttctagcccttgggaagacctgtccttggatttcattgtgggcttacctgcctaccatggacatactaccatattggtagttgtggatcgcttttccaaaggaattcattcaggcatgctgcagccccattacactgcccataaggttgctctccttttcatggatattgttggtaaaattcatggtatgccacgcagcctagtttcagaccgtgacccattatttatcagtcatttttggcaagacttgttcaaaataagtgggaccaagttatgcatgagttcagcatatcatcccctatctgatgggcagacagaagtgctgaatcgtgttgtagagcaatatttgcggacatttgtgcataataaaccatcttcttggggaaagtttttaatatggtctgagtggtcttacaacacatccaggcattctgacactggcacttctccttttgaaattacctttggcaagaaacccccaagcattccacagtatcttgttggtgcctctacgattgaagcggttgatgacttcttggccagcagagatgctgtgttcactagtttgaaaaagaaacttatgaaagctcaggaaagtatgaagcaatttgcagatactcatagaagggag

SEQ ID NO: 103083 - DNA, 240 bp, Glycine max
  Peptide Sequence Number=SeqID_219861
atgggggaaaagcttgccacccagctcgcccaagcgagcaaggacttcatttattgtgcaacaaaggacgccaagtatctcaaagcggctaaccaaaggttgcatgtcatcaagcaagcgagcccgttgacacgcaaggaccaatgtggtcatctgcatccttctcggagatgtcggcgtcttccggctgagaccgcaaaaaagtctcacctttactatctcgactcaagggttcggtag

SEQ ID NO: 103084 - DNA, 792 bp, Glycine max
  Peptide Sequence Number=SeqID_219862
atggttggagaggctagtgaattaacttccaacttggtagttactcctattccccctagaattaaatgcattagcgagagcattcgaggagttagatcaatttgtagcccccaacatatggatcaactaagatctttgtgcctttcccaagatggggatgacgaaatttggattttaacacttcccaatccaaatgaccgtatttgttctcaaggaccaagaaatgaagatgttggtcaacctgctaatgaaaacatattggattctaactactacaactcatcaaatgaatcttgcaactcatcaagcaatggtgatgacaagaactatgctttgtcaaagtggtgcttggaggaactcaataggattctagacagcaagagacaccaaggaaagattgtgatacttgtgttttacaacatagatccatcggatatgaggaagcaaaaaggaagccatgtgaaagcatttgcaaaacataacggagaacctaagaatgaatctgaattccttaaggacattgttggagatgtgttgcaaaaattacctcctaaatacccaattaaacttagaggacttgttggaattgaggaaaagtatgaacaaattgaatcattattaaaacttgggtcaagtgaggttagaacccttgcaatatggggcatgggtggaataggtaaaacgacccttgcttcggctttatatgtcaagttgtctcatgagtttgaaagtggttacttccttgaaaatgtaagggaagaatcaaacaagcttggactcaaatttatgtaa

SEQ ID NO: 103085 - DNA, 246 bp, Glycine max
  Peptide Sequence Number=SeqID_219863
atggatgttggaaaattaataaaacaaatccaatggttcttgttcagttttggagatggagatccagttcagagaagattgttccaagactcagttgtaagagcaaattctgacacaatggagccaggcgaatccaacagtggtgttatggagcctataaacactttgacgctcaagtcgataaacattttagattgggttgttacaaatctaaacagctttatctcatgtgatccttatgtataa

SEQ ID NO: 103086 - DNA, 1407 bp, Glycine max
  Peptide Sequence Number=SeqID_219864
atgacagaggcagacagtctctcttttgcctcgtatgatacggctcgatctctatgggtggcaattgaagcacaatatgcaaacacgtctcgctcccacgctctcaagtctagtgactggcgtgatgctatgagtaaggagtttgatgctctagtccaacaaagaacgtgggaccttgtacctcgacctccaaatatcaatctcataggatgcaaatggactttcagtcctgttgttaaaccaacgacggtcagattggttctctccttagccctgcgaaataactggccacttcctcaacttgatgtgaacaacgccgtccttcatggttccttaagtgaggaagtctacatgcaaacagcctccaggctttatccatccagaaatgtcttatcatcacttgctaagaccttctctttcaaagatttagggaacttacactattttcatggtgttgaggtaattcctacaatcatgggtttattcctcagccaacataagtacattatagaccttcttgagcgaaccaagatggatgaagccaagtctgtcctcactccaatgtcaaccagcattcccttgtgcaaggatgatggttccccaagcactgatgtcaccttttacagaagcaccattggcagcctccaatacttgtccatgacccggctagacattactttctcaggcaccgtttttcatgggttgttgcttcagaaaccaaggtcctcttccctcattgcctacagtgatgctgattgggctggaaacaaagatgatttcatctctacctctgcacatcttgtatactatggctccaacttgatatcttggaaatcctctaaacaacggaggctgaatatagagctgttgcaaattcccgaattgttatggatccactccttattgactgaattaggtgtcaccatccccaagtctccatcacttctttgtgataacttgagtgccacctaccttactcataatccacaaggaaaaatcaaaattcatcatgtttgcacagctgaccaacttgctgattgtctcactaaacctctttcgaagactcaccatcaacaattacgaaacaagattggtgtcactgacgggaccccactcttgcgggggatttatcttcctctagtgatggtttgcattaagactactggaaataagaagaaaaggggcggtggttttcaaccctccaccactgaaattccccatgcttttggaacaccccaatctaccactaatatgggtccgccccctgtggataacagtgctactcaccaaagggaatgtcttagggatatcaaaatagaccctagtcttgacgagatcctagaggttgctcgaagcatgatggactttcctcaatatatggaattttcttcttctcaagattgttga

SEQ ID NO: 103087 - DNA, 418 bp, Glycine max
  Peptide Sequence Number=SeqID_219865
atggtacagagtgaattggattctgagaatgttgagttcacagtgattgatgatgtgggtagtgaaagcctaggtcctggcattcgtagagaactttcattttcacgttggtgtgatgatgatggaaggatccatttggatcagcaattaggtaatgaagatgctggtgtagaagatgactccgattttgagttaccgtttcctgaaaagaatgagctgcagagcagatctttagatagagagagattctttcaccaaaagtttcagctgaggaatatgcaaatgaacggtattggtaccatggatgatgattctgttcatcggagaggtaatggatccgaaaagtatgtgtcttttgacattgaggataagtctgaaagaggaacaaaaggtgttgattcctacatttctgtgggag

SEQ ID NO: 103088 - DNA, 726 bp, Glycine max
  Peptide Sequence Number=SeqID_219866
atggtacagagtgaattggattctgagaatgttgagttcacagtgattgatgatgtgggtagtgaaagcctaggtcctggcattcgtagagaactttcattttcacgttggtgtgatgatgatggaaggatccatttggatcagcaattaggtaatgaagatgctggtgtagaagatgactccgattttgagttaccgtttcctgaaaagaatgagctgcagagcagatctttagatagagagagattctttcaccaaaagtttcagctgaggaatatgcaaatgaacggtattggtaccatggatgatgattctgttcatcggagaggtaatggatccgaaaagtatgtgtcttttgacattgaggataagtctgaaagaggaacaaaaggtgttgattcctacatttctgtgggaggtgatgggtcattgggaaaaagcttccagaatcctattcatgcagcaaatatattgaagacattgtttttgatacttatgtggtacacttccagtctatttttgaccctgtataataaaagtctattgggagatcatatgggaaagttcccacctccctttttaatgaatactatccacttcacaatgcaagctgtgttatcaaaatttatcacctggttttggtctcacaaatttgagactaatgttgtcatttcatggggggattactttttgagagaatggcatcagttgcatttacactgctag

SEQ ID NO: 103089 - DNA, 328 bp, Glycine max
  Peptide Sequence Number=SeqID_219867
atggcacgttctccagacaagataaaaagtatcgatggctcaaaagaaactcttaaacttagtgtgaggatcagtgatctatggtttattggcacgcctaacaaatctgagcaagctgagatggtgtttgtggactccgacggtgatgagatccacgctgtttgtaaacaagaccaattgaaggagtgtgttctagaggacatcccttttagaaaatacaggtttgctggatttgcggatgttgtggctggccagtttgaacctaggctattggttgatgttatcggtgttgtggaggaggttgtctttcgccaagtttcaggaaaag

SEQ ID NO: 103090 - DNA, 558 bp, Glycine max
  Peptide Sequence Number=SeqID_219868
atgacccctgaattagtgatgaaaaattgttattcttttaatatcaagtatgtaggggatgagcaagaaaaaaggagcttgcagatgaagggacttaatttgatggacaaaactttatttgttcaaggagctaggatttcgtttagtatatgggatgttgcaggtgacacagggtccctttatcaaattccaatggcttgtaaagattcagttgcaattttgattatgtttgatctcaccagtcggtgtacactgaatagtgttgttggatggtacagtaaagcaagaaagtggaatcagattgcaattcccattctaataggaaccaaatttgatgattttgttaaactccccccagatgtgcaatggacaattgtaacacagtgcatacaggcaagggcatatgcaagggcaatgaatgctactcttttcttctcaagtgcaacccacaatataaatgtcaacaaaatcttcaagtttatcatggccaagctcttcaacttgccatggaaagtggaacgaaatctgacactaggagaacccacaattgacttctga

SEQ ID NO: 103091 - DNA, 426 bp, Glycine max
  Peptide Sequence Number=SeqID_219869
atgcctgccttgagcttcacaccttcgttaagggaccaggtggtgaatgtattcaaggaattgcaggagatcctcttcaaattcttaacattgctgattgctttggtttcagtaaaaaacagtgagtcaggaaagcttttgtttacagaacagcacaagctaatgatgtatctgattttaaccattgtcttatacttcttctgtgctaccattgggacgatatttctgatatacaagggaagccttcttcgactcataatttgggtcatgcttattgtgggagctgttgtttcagttctggctttgaacttcgtctcaaccatcgtttcttggatcactttggccatgtggcttggaatattcgcagtggttgcctacgactatggtgttcctcaaaagatcaagaattggattaaggatccatga

SEQ ID NO: 103092 - DNA, 255 bp, Glycine max
  Peptide Sequence Number=SeqID_219870
atgcatcaaatcgaaggaacaatttcgttcagttcagttcgagtggacaattatggtgccatgcttattgtgggaggtgctgcttcatttctggctttgaccatcatctcattcgctgttgctattatcattttggccttgtggattggaattttgacgttgtttgtgtatatctatgttgttcctcaaagaaactcagggtgttcaatcatatttccagtcaaatgtctaaatggagatatgaatgcaaaatag

SEQ ID NO: 103093 - DNA, 348 bp, Glycine max
  Peptide Sequence Number=SeqID_219871
atggatgaggtcggtgatggtgtgaggagggggaagctggttgggttcctgaaacaaggtggagtaatgctgaagaagatgggcgagtacatgggtgaggtggggaacgtcagcattgagggaaatggactggcccaggaacgtgatgatggtgaccggtccaagtgtcttcagccattggaccccgaggacgatatcggcgccaccgatggggaacctggtattgcactcgatggtgctgccattaccaatcattacatgcatggtagtggcgagaacctgctgcaactggaggaagaaggccaggcgagactaaatgaaatcatgcgtactcccaccatttactag

SEQ ID NO: 103094 - DNA, 300 bp, Glycine max
  Peptide Sequence Number=SeqID_219872
atgtatctgattttaaccattgtcttatacttcttctgtgctaccattgggacaatacttctgatatataaaggaagccttcttccactcataatttgggtcatgcttactgtgggagctgttgtttcagttctggctttgaacttcgtctcaaccatcgtttcttggaccactttggccatgtggcttggaatattcgcagtggttgcctacgattatggtgttcatcaaaagatcatgaattggattaagggtacatcacatttgagcaagaatcattatagattcttcactcagtaa

SEQ ID NO: 103095 - DNA, 2520 bp, Glycine max
  Peptide Sequence Number=SeqID_219873
atgctcgaagctgatctcatccgtccaagccatagcatgttttcttctctggtactgttagtgaagaaaaaggacgggagctggcattgttgtgtcgactatcgagcactgaacgccataaccattaaggataggtttccaatgccaactatcgatgagcttctagatgaaatcggaaaagcttcatggttctcgaagctggacctccgacaggggttccatcaaatcaggatgcacgaagatgacatcccgaagacagtgtttcgcacccaccatggccactacgagttcaaggacataccatttggcctaaccaatgctccctccaccttccaagcatcaatgaataagttacttcggccattcctctgtaaattcgttgcgatcttctttgatgacatattggtttatagcccgtcgttcgatactcacctcgatcatcttgaagttgtgttcacctcactccagcaacactcattttaccttcatcgttctaaatgcgattttgcagaaagacaactcatctacctcggccatgtcatctcggcggtggggatcgcgccagaccccgataaaatccaggcaatgctttcttggcctgtgcccacctcgcccacagacctcagaagttttctgggtctcacgagattctatagaaggttcattcgaggctatgccgccactgctgcaccgttaatgacgcttctttgtcgagataagttccagtggagcaccgatgcacagaaggcattcgaccacttgaaaactccaaacctatcgccttctttagcaaacaacttcgccctcgcctgcaacaagcttccacttatgttcgcgagctgcacgcaatcactacggcggtgcgtcatccaaactcctgagcagcagcattacatggttaagttactcggattcaattacatgatccaatacaaatcaggcgcacagaacgtagtggcggattctttattcagagttccacccccttccaccatgctgcttttatccattccacattcattgttcatggaccagcttcgcaaatcttgtgcgacaaacacggcgtatcaagaaatgctccataaaattcttcaccatcccattgaccatctaggattcatagttaaaaatggcatgatcttctcgcaagacaagacgtggcttccggcaagccacgacctctcaagggtcctcatggatgaatatcacctcacccctacaggcggccatatgggtgtggcgaaaacattctgccgcattaatcaacacttctgttggcctcagatgcgccacgacatcaagcagtatatccgccaatgtgctacattccagacgacaaagcactctacccttaaaccggcaggactcctgcaacccatcccacctccttcttccttatgggttgacctctccatggacttcgttacaggcttaccaatatctcagggctacacgactatcctggtcgtggtggatcgttactctaaagcaatccacttgggtccccttccccagcattacactgctcataaggttgtcgtcctcttcctggacattgtttgcaaacatcacgactttcccgacaacatcatctcggacagagaccccattttcctcagtgctttttggcgcaaccttttttgtctcagtaggactaaactccgatttagcatagcatatcacccgcaatcggacggacagacggaggttatcaatcgagtgttggagcagtatttgcgcgcttatgttcatgaccaccctcgacagtggtctcacttcctttcgcttgttgagtattcgtataatacttcagtacatagcggcacgagcctatcaccgttcgaggttatgtttggcaaacctccaccagcactccctttatatggcgccgggacttcacccattgaagcagtcaataccatactttcgtcgagggagacaattcacagtacactcactcgcaggctacaaaaataccaggcaaatatgaagcgcattgcagatgctcactgtcgggatatctgctttaacgtcggagactgggtttacattcatctccgtccttaccgccaaacttcattacaaccaacgtactccaaactcagcaagcacttctatggtccttacccaattgttgagagaataggccaggtagcgtatcgcctgcagctaccctcctcgtcgaagatcaaccctgtgtttcatatttcactcctcaaactccaccaaggaccacatcccacagcagtgccggacctgtccgctttcactattgatcaccaccccctggtgcacccattacgtattttggactggaaaatggatgagtccactacgcccccaactctgatgacactggttcaatgggctggacttccgcccgaagagaccacgtgggaaaactggtccaagctccaaaaagtttacaaccttgaggataaggaggcacggacagaggaacccgcacgtggcaataaccgcactcgcacaaggcccggatatttacgtgattatgtgtaa

SEQ ID NO: 103096 - DNA, 516 bp, Glycine max
  Peptide Sequence Number=SeqID_219874
atggcacccagttttgactttgcttctagcctcctttgcacagaggacaacaccgttttcgacgagagccataataatgggggtacgatgatgtcgatgatggggatgtgtgaggacgcgtggagtcctaggaagcgccactttgatgaagagccagatgagttgccattgctgagtgatgaaagcttggcgatgatggtggaaaaagagtgccaacactggcctggtttgcgttgcttgaataagcttcaaactggggatttggacttcggtgccagaatggaggtcgttgatcggattctcaagggttttggaggggaaagttgggggcagtggtggcaccgggaagaaggtggagagatgacattgggaaggggagaaagggagagggagaaggagaagaagaagatgaagatgaaggatgatgaagaagaagcacaggggttgagtgccacgttggatggtctacgtgacactaaattgccaacaatgcacttcactaacggcattacttga

SEQ ID NO: 103097 - DNA, 549 bp, Glycine max
  Peptide Sequence Number=SeqID_219875
atgatcgaaagttttcaacaacaacaaatgtcagttctagaattgtacgtagaaaaggatgttgtcggtggttccatgtttcattctgcaaattttgttacgtcatgtggacataatctatctcatcatgagtcagaactgtcaagaaatataaacaatttacatgatgatgaaaatgatgatgatgattatcttgcgtctaactcatatgttgaagagtctttggatgaagatgatagcgttgaaggaatatctgatacagacgatgattgcactgacattattgaaccagtttcaattgttcacccaacagaaggtgtaccaggaattcaaaatccattttggaatgatgctttgaattataacaatatcaattggagtcatccggatgaggaagacatttgtggtttggacatgccaacgacttttaatgttggacaagaattatatgttggcatgaattttgacagtaaagatgcgttgaattacaggcatgatcagagaagatccatcaataaaaatttctttgattcaagaaaggataaatag

SEQ ID NO: 103098 - DNA, 318 bp, Glycine max
  Peptide Sequence Number=SeqID_219876
atgggaacatgtattgttgctaggtcggggttgtacctaggaagtcttgttgagcccatctcttttttcaactgtagagaaatcaactggcacgaatgtgaatgggcttgtgggtacgatgacgatgtacggggggttgctggagaatgggaaggggaggcgatagttgttgtcgtcgatgaaggagtcttcatggagaataaaggaggtgggaggggtctaaggtgtggctcatgggttttgaaatgccttcgacaatggagaatggtgattggagaattttgtcgggaaaaggttgaaagatctagtataaactga

SEQ ID NO: 103099 - DNA, 168 bp, Glycine max
  Peptide Sequence Number=SeqID_219877
atggcagctcgtggcagtcatcggaggtcgatgatggtggatgaggaggttgggggtgttggggcattacaattagagcctttcttaggtctatttcccattttgatggttgttgctcttgttcttaacccatggcccaaattcattcctagatccatttgcgagtga

SEQ ID NO: 103100 - DNA, 168 bp, Glycine max
  Peptide Sequence Number=SeqID_219878
atgcctaaacttgtaaaagagaatacaaatgcaagatttatgtggcattggtgtcggtatggatctatccatgcatcgaccctcatggcatgggaaaggaaaaaaaaggttgaagagattgtgggagaaaagagagacaagatggaggcaaacaacatgacaatttga

SEQ ID NO: 103101 - DNA, 357 bp, Glycine max
  Peptide Sequence Number=SeqID_219879
atggtggccgctttggaggtagaggaggccgtggtggcagaggtcgtagcaacattgagtcctacatctgccaaaagtttggtcatgatgctgcaaactgttggcataggccttcatcttcttatggcacctatgccacaacaaatgcaaccttctcctacctttgtgcagcaatccatgcctcagccaatgcaacctatgcagcagcaacctcaaattttttggggtactcttcctcaaaatgcaatgtctcagcaagtgccttcttcaacttctatgcctccacttatgcccacctccagccctatgtcctctcataatccacatgccatgactattgagatcatgcatttctga

SEQ ID NO: 103102 - DNA, 264 bp, Glycine max
  Peptide Sequence Number=SeqID_219880
atggatacctcagagccctacactggggcaatgaaaggcaccatgcatgagcctcaggtgaacctaggggcaggtcaaaagttctcacccgtcgatgtttttaaacaaaaaaaagggagtgacaaaccttgggatttcagtggattaattaaacagctccatcgccgtcactctaaaattgtcaaatgtcctacatctaatgtccaatcttttgaatttgggatgaccgaccctctcgatgagtcaatctcttgcttctcataa

SEQ ID NO: 103103 - DNA, 432 bp, Glycine max
  Peptide Sequence Number=SeqID_219881
atggctggatttccacctgtggaaataggcaccagaggcacagttggatcccttctaatgcaagaaattgagtactatagccggcaggaattcaattcccaagactggtcacagaagaacaagtctcaaactatcaacatgggttcctcagttagtactaattccagaccaacaactgtatccagagtagaaagtacaaagaaaaagcaaagtagcaagctcctaccaaagatgtgttctgtggtcgatgttctggtaaccaagaatgggtatttgatgggtatgtttgccattaagttttgttttggggccaatcccaggacttatatgcactaccactcgaaactgaaattcgaggtttacttgttgaagatacttcctggtgtggaacagaagacatctgatccaattcccttgtcatcaacaagctga

SEQ ID NO: 103104 - DNA, 309 bp, Glycine max
  Peptide Sequence Number=SeqID_219882
aagaatgtcaagaacgagcacatagacatgatctgtatccaagagccaaagaaggagggggtatgggaaagtaacatcagggagttcaacgaatggattgaagagttggaggtagaggaagtgccatgggtggaaagaaaattcacatggttcagaccaaacggagctgctaagagcaatcaaaacaattttggtgaggcatcaatggagaatgtcaaggcaatcaaaacaattttgaggacctttgaacttggtggtggacaagttggtgaccttacaacgaagattcctgtgaagtggcagatctaa

SEQ ID NO: 103105 - DNA, 177 bp, Glycine max
  Peptide Sequence Number=SeqID_219883
atgaatcgttccaccaatccaccggatggagatgaaaggctccgtacgcgggacgccgagatgtatgcggtttataggcgttcagaatccaagcgatgtcaaatccagagagaagatgaggagatgaaaaaacgtgaagaatggagtctggagagtgaggaaaaagagagattctaa

SEQ ID NO: 103106 - DNA, 1470 bp, Glycine max
  Peptide Sequence Number=SeqID_219884
gaagattatagaccagaggaagaagatgaagaagagggtaatgatggtgatagcaaatccttttttgctccttctgatggaacctctttccatgccgattccttcttgcagctcaatctgtctcgccctttgctccgggcttgtgaggccttggggtattctaaaccaacgccaattcaggcagcttgtattccattggcattgagtggtcgtgatatatgtggtagtgccattactgggtcagggaagacagctgcatttgcactacctactttagagaggttgttgttccgtccaaagcgcatgcgtgcaataagggtcctcattcttactccaaccagagagttggcagtccaagttcacagtatgatagagaagcttgctcagtttactgatataaggtgttgcctggttgttgggggtctgtcaacaaaggtgcaagaggctgctttgagaacaatgccagacattgttgtggctactccaggacgcatgatagaccatttacgcaatgctatgtccgtggatttggatgatcttgctgttctaatccttgatgaggctgatcgtcttttggagcttggatttagtgctgaaattcaagaacttgttcgcttgtgtcccaaaaaaaggcagactatgttgttttcagcaacaatgactgaggaggttgacgaacttattaaactttccctgtcaaagcccttgcgtctttctgctgacccatctacaaaacggccagcaaccttgactgaggaagttgttagaatacgaagaatgcgtgaagtaaatcaggaagcagttcttcttgcaatgtgctccaaaacttttacttccaaagtcatcatcttcagtggaacaaagcaagctgcgcatagattgaagattatatttggattagctggctcaaaagctgctgagcttcatggaaatcttactcaagcccagcgccttgaggctttggaacagttcaggaagcagcaagtggattttttggttgcaacagatgtggctgcccgtggccttgacattattggtgttcaaacagttatcaactttgcatgtccacgcgatcttactagctatgttcatcgagttggtcgtactgcaagagctggaagagaaggatatgcagtcacttttgtgactgacaatgaccgatcacttttaaaagccattgcaaagagggcaggttcaaagctgaaaagccgcattgttgccgagcaatctatacataagtggtctcatataattgagcaaatggaagaccaaatttctgaagtacttcaagaagagagagaagaaagagttctaagaaaagccgaaatggaggccacaaaggctgaaaacatgattgcacatagggaagagatcttttcccgccccaaaagaacctggtttgtcacagagaaggagaaaaagcttgcttcaaaagcatccaaggtttttaagaaagttttgggaaaatga

SEQ ID NO: 103107 - DNA, 138 bp, Glycine max
  Peptide Sequence Number=SeqID_219885
atggtggcctctttcctaagggaggtcgattgtctcaagattcaagctcagcaaggtgaccagtgggtgtggaaggaggtggttgacgggaacctggatggggctcttgaggaactgcggaagcttaagattccctaa

SEQ ID NO: 103108 - DNA, 300 bp, Glycine max
  Peptide Sequence Number=SeqID_219886
atggtttgcggggagggtgaagcggtcaatgagggggaatatgttgtggtggcgcaaggtgacgcttattcggactcccttgcctgcaaagtggagttctttgacacagtggcagaggacagggcaatgcttgttgatgagggagttgatattgaggagaataggaacaacaaagaagcagtagaggaggaagaggacgatgatggtgatcagcgctttatgaggttgttggcggcggaggtagacatgaagtcaccagtctcagaggcccctgacaacaatgatgtcggttacccataa

SEQ ID NO: 103109 - DNA, 354 bp, Glycine max
  Peptide Sequence Number=SeqID_219887
atggcttccgctctgtcgaacatcgtttctcagtcattcccaaactccattgcggaaaaacttgatgactcaaactacactgatgtcaacatcgtttcgtcgtcaatcccgttgttccacctcggtatctctcggaggacgatcgaatttccgatcacgtcaaccctgactatgaagcttgggaggttcaagatgaaatgctccttgtttggcttcaatctactctttcgaaatcaatattattgcgtgttcttgggtcgaatcactcctatcaagtttgggagaagattcatcagtactttagcctgcatacgaagtcccgtgctcgatagcttcgcactgcgatgcgcatag

SEQ ID NO: 103110 - DNA, 939 bp, Glycine max
  Peptide Sequence Number=SeqID_219888
atgaaagatgaggaaggcttttattatcctcacaatcttgatttccgtggtagagcatatcctatgcatcctcatttgaatcatttaggttctgatctgtgtcgaggactacttgaatttgctgaagggaggccattgggaaagtctggactaaggtggctgaagatacatctagcaaatttgtatgctggtggtattgagaagcattcttatgatgggcgcctaggatttatagaggatcatattcatgatatatttgattctgctgatcaccctattaacggaaatcgttggtggttaacagcggaggatcctttccagtgccttgctgcttgtattaatctatcagaggccttaagaagctcatcaccaaattcttttatctctcatcttccaattcatcaggctgctgcagttaacttggttgctaaagagaaacctgctgatgtttacacagagattgctgttagggtttatgatataatgagacgagacagcaacaaagacccagatacctttccaaatgctttgttagcaaaggtgttgcttggtcagattgataggaaactggtcaaacagacagtaatgacttctgtttatggtgttacttatattggggcacgggagcaaattaagagaagattaggggagaaaggtctcattactgatgatagacttttatatgctgcatcttgctatgcagctaaggtgacattggctgcccttggagaagtttttgaagctgcacgtggcatcatgggttggcttggggattgtgcaaaggtgattgcttgtgaaaaccaggctgttcgctggaccactcctcttggtcttcctgttgtacaaccatactgtaaaactgaacgttatcaggagagtacgtcaactaacagtggcacagaagggctggaagtgactggaaaaaggggaaatcactga

SEQ ID NO: 103111 - DNA, 2602 bp, Glycine max
  Peptide Sequence Number=SeqID_219889
tggttccaccaccggtaacaaccactaccctcatgccatggcctccttcttcagattctccctttccctcgacgcctccgattcccttcagtccaacctacatccccctttcaaaatcaaaaccaagctcatcgaggccaacctcaactccaagcctcagcttcgggcttcgaagccaacgcccaagccaaaccgacaacacccaaaaacaaaacccagttacttacccaagaacacggagaagcagaaactcttcttctcacgcgatgctgacgtcgatttctctcccgaactgagcacggagcactgcaacgcgatcctcaaacgcctcgaagcgagcgccgccgccgccgacaaaacgctgtcgttcttcgagaggatgagggcgacgggcaagttggagcgcaacgccgccgcttacaacgtaatgcttcggtttctcagcagaaggcaagactgggaaggcgcggagaagctcatctacgaaatgaagggttccgaattgataagttgcaacgccttcaacacccttatctacgcgtgctgcaagcagagcctcgtgcaattgggaacaaagtggttccgaatgatgttggattgcggcgtcgtgcccaatgtggccaccattgggatgctcatggggctctaccggaagggttggaacctcgaggaggcggaatttgccttttcccgaatgagagggtttcgtattgtgtgtgaatccgcgtattcgtccatgattaccatttacacgcgtctcaggttgtatgagaaggccgaaggcgtgatcgagttgatgaggaaggacgaggtggtgcccaatttggagaattggttggtgatgttgaatgcttatagccagcaagggaaactgggtgatgctgagagagtcttggaggcaatgcaagaggcagggttttctgataatattgttgctttcaatactatgataactggttttggaaaggctaggagaatggatgctgcacagaggttgtttatgaggataacgaggtgtttggaggtggatccggatgaaactacttatcgatccatgattgagggttggggtagagctgacaactatgaatacgcgacaaggtattataaggagctcaaacagatggggttcaagcccagttcatcaaacttgtttacgttgattaagttggaagctaattacggagatgacgagggtgctgttgggatccttgatgatatggtggattgtggatgccactatgcttctataattggtactctgctgcatgtgtatgagagggctgcgaaggttcataaggtgccgcgtttgctcaaaggttcgttttatcagcatgtgttagtaaaccaaagttcttgctccactctcgtcatggcttatgtgaagcatcggctggtggaggatgccttgaaagtgttgaatgacaagaagtggcaagatcctagatatgaggataacctgtatcatcttctgatttgctcgtgcaaagaggcaggtttgctggaggatgctgtgaagatatacagtcgaatgcccaaaagtgacgacaatccgaacatgcacattgcgtgcaccatgattgacatttacagtgtcatgggcctcttcaaggatgccgaagtgttgtatctgaagttgaagtcttcgggagttgccttggatatgattgcttttagcattgttgtaaggatgtatgtcaaagctggagctttgaaggatgcttgtgcagttttggatgcaattgacatgcggcctgatattgttccagacaagtttttgttatgtgatatgctgcgtatttatcaaagatgtaacatggcgactaaattggctgatttatactacaaaatctcaaaaagtagagaggattgggaccaggaactatataattgtgtcctaaactgctgtgctcaggctcttccagtagatgagctttccaggctttttgacgagatggtacagcatggatttgcacctagcacaattaccttcaatgtcatgcttgatgtcttcgggaaagccaagcttttcaacaaggtttggaggctgtactgcatggctaagaaacaaggcctggttgatgtgatcacttacaatactatcatagctgcatatgggaaaaataaagacttcaacaacatgtcatcaacagtccagaaaatggaattcgatgggttttcagtttctctcgaagcatacaattcaatgctggatgcttatgggaaagatggccaaatggagacatttagatctgtattgcaaaagatgaaggattccaattgtgcctctgaccactacacatacaacactttgatcaatatctatggagaacaaggatggattaatgaagttgctaatgtgcttacagaattgaaagaatgtggactcagacctgatttgtgcagctataacacattgatcaaggcgtatgggattgcaggaatggttgcagaagctgtaggtttgatcaaggaaatgagaaaaaatggaatagaacctgacaagaaaagctacactaatcttatcactgcactgcgacgaaatgataaatttttagaagcagttaaatggtcattatggatgaagcagatgaaaatatga

SEQ ID NO: 103112 - DNA, 606 bp, Glycine max
  Peptide Sequence Number=SeqID_219890
atggctatatgttgccatgttggatttccatatttgtttgttacttttacatgtaatccttgctggccaaaaattgaaaggttgttaaagtctatggatttgaaagcacctgactggcctaatatagtgtcaagattatttagaatcaaatttaaagaacttttggcagacttgacaaagaaacatattttgggaaaagtggttgcatttgaaattccaagtgaacaagatgaacctaagttatacaatttagtgaaagctcacatgattcgtggtccatgtggttcatccaacaaatcatcaccatgcatgaaaggtggaaagtgttctaggtattatcctaagaagttccagaattcaaccattgttgatcaagatggttatccggtctacatgcaaagagacaatgggcatactattttgaaaaatggtgtaatagttgacaatcgtactattgtctcttacaatgccatgttattattaaagttccaagcacatattaacatggaatggtgtaaccagagtacctcaattaagtacttattcaagtacatcaacaagggttatgataggattacagtagccaccattccaactgagcaccaa

SEQ ID NO: 103113 - DNA, 1858 bp, Glycine max
  Peptide Sequence Number=SeqID_219891
atgcaggctgagttacaagctctccgattgaacaatacttggactctcactactcttcctcctcacaaaactgccattggttgtcgttggatatataaaatcaaacatcatgctgatgggtccatagaaaggtacaaagctcgcttggtagcgaagggttatacacaaatggaaggattggattatcttgataccttttctccgcttactgaagaagtttacatgcaagttcccccggggcttttagttgaaaatcctaatcttgtttgtcgtcttcaacgttccctatacgggctcaagcaagctagtcacagtggtaatagcatcgatgaaattcaaagtatcactacattacttgatcaaacgttcaagataaaggacttcgacaacttaaagttttttcttggacttgaaattgctcgaacctctcaagagactcctctacctgctgattattcttcttcttatcgaaggctagttggccgactcatctatctcactaatacacgtcccgacattgcccatgctgtccaacaacttagtcaatacatgtctaaccctaccaacactcaccatcaggatgcttttcggtgtcgtgactccaggcgatcaatcactgggttattcgtttacttcggttcttccttaatatcttggcaattgaagaagcaatccacaatatcccgtagctcttcagaagccgagtatcgggccttagcatctaccacttgcgagccacaatggctcacgtatgttcttcaagatttttgtgttcctttcattcaaccagctaccctttattgtgataatctccaaatcgggaccaatcctgtattccatgagcgtaccaaacatatcgaaattgattgccacatcgttcggcacaaggtcaattcaggtctcattaagctcctccctgtttcttcttcgcagcaactcgctggcctcttcaccaaagctttatctccagctggccctgagcaaggatgggtgttgcttcttgatgtgccaatttttcgttatgacgggttatttttgatgtgttatgttcccaatggtactattatgatgacccatccccttgatattactatgactctcaaggagatgacgtatactcttggacatattccctttgcgattccttgtaggactagtcatgctcgtgattataggggtttgttccatggacgcggatgtggtcgtgactttggtcgtggtcgtggtggttttggtggccctattggcaatgacggaccatcttttcctccatgttgtccttatagtgggtatgaggtagatgccatcttgtctagtattcttaggatatggatgtgtggacctgatgaagaagagtggttcccacccttagggattgtcctagggcgaaacaaatctggagcaacagtttgctatttggcgtcaccatttggttcatttggagagatagaaacgaatttgccttcaatgacaacaattgatcgacctctatggttcggttatgtgggtaactggatagctggcttctctggtaattgcggttccaacactaacatggcaactgggttgtttggtatttatcatgggctaaatcttgctggacacaaaggcttctgtctggttatttgtgaatcagattcgaagatggccttacagttcatagaagaaggcgttgttgattgtcaccctcatgctcctcttgttgctgccattcggttactgatgggtctcaactgggatgtctctttccttcacaccttcagagaaggaaatttctgcgcggatgcactagctgagcttggagctacaaatactagtcctctctttttgtctttgataactgcccttctgcagttag

SEQ ID NO: 103114 - DNA, 312 bp, Glycine max
  Peptide Sequence Number=SeqID_219892
atgggtttgtctaattggagcgaggaacaaaagaactctgagtgtacgcacaaggtcgaaaaggtttgcgtaagtctcaaaacttctcttcctagaggtgagctagggctgcagcttgaatcatcgaaagagagccatccaacaggatcagacccatcgaatcgtggaacttcgagtttcatccaatatgggggaacaggaggagaaggagacgggggatgcgccaaagaagaaaccaaggagtgttgggtggactccataaccgccaacttctggcataggtcgtctaatttggtggacatcaacaactga

SEQ ID NO: 103115 - DNA, 1053 bp, Glycine max
  Peptide Sequence Number=SeqID_219893
atggaaagctacttgtacctacatccgagtgagaatccaaccattgctctcgtctctctagtcttggattcaaccaactaccattcatggagcaggtccatgatcactgcattgagcgccaagaacaaagtggaatttgtagatggaagcgtgcctgaaccattgaaaactgacagaacgtatggagcatgcgccgatgtaacaacatggcaaaacatactatggatggacaaagcggaacaaatctggcgtgatttgaagttgcgatactcgcagggagatcttttgcggatttctgatctccaacaggaagcatcaacgatgaagcaaggcgcactctcagttacagagcatttcactagattacgtataatttgggatgaaatcgagaatttcaggcctgatccaatttgcttctgcaatattagatgttcttgttccgctctcgctattatcgcgcaacgtaaacttgaagatcaagctatgcagttcttgcatggactgaacgagcaatatgccaatatccgatcacatgtgcttctcatggatccaatactcgcaatatcaaagatcttttcatatgtggcgcaacaggaatgtcaatttctaggtaatgtttcttcgaatctcaatctcgaatccagagatatctctattaatgctgcgaaggtcgtttgcgatttctgcggacgagttggccatatggaaaacgtctgctacaagaagcatgggatgcctcccaattatgatggaaagagtaaaagtaataacatgagatatggaaaaatgtgcgctcattgcggtaagaacggacacaccattgacgtctgctacaggaagcatggcttcccaccgggatacaagacctacaatggaagaacaaccgcaaataacgtggtggtagtggatagtaaagccacagatgatcaaactcagcatcataagtcccaagatattgttcgtttctctcctgagcaatacaaagcactactcgccttaatccaacatccatcatcctggaacgcagcttctaaccaatcacagaccaaatag

SEQ ID NO: 103116 - DNA, 138 bp, Glycine max
  Peptide Sequence Number=SeqID_219894
atgggaactgatttgaaagggagtgaggtggaaaggaatggtggatctgtgaacagtgaggggaaaaagggcttggttcttgctcagggagatagtgtaccaatatttgtcgagaaacattcttccacagcaaggtaa

SEQ ID NO: 103117 - DNA, 4797 bp, Glycine max
  Peptide Sequence Number=SeqID_219895
atgcgtagggagaaggagctttgcttcaactgcgacgagaagtttattcgtgaccaccactgttcttccaagctattcctattaatagctgatgatgatgaggtatcacaagaggagatttcacttgatgacgcatttctggtagcgaaggagcacgatgaccagtctcctgctcaaattagctttcatgccatatcgggacacgaacgctttgtaaccactctgggtctacacgcacaacctattcagcccttatgcatcatggttggtaatggtaatgagattgacagcttgcaagtttgtcgggatgttctgatacaggtccaggaacataaactaacagtggattttcatgttttacccttgtgcggagcagacctagttcttggtgttcaatggctcaagttactaggtccgattttgacggattatacagacttgactatgaagttcatgcaccaaggaccatatcgatatccacattttcaaaagcaagagatcgaggttcaggtcgaggccatgttgagcagtggcatcatcagacccagtcagagtcccttttcattacctgctcttttggtcaagaagtgcgatggatcatggtgtttttgcgtagattacatggcattgaacgccagtacaattaaagatcgatttcctatacccactgtcaatgagttgttagatgagctaggtggtgcttgttggtttactaaacttgacttactgcaggggtatcatcagatccttatgcgcgaagaggatgtgcatatgacagcattccgcactcaccaagggcattatgaatttcgtgtaatgccctttggcctttgcaatgctctttcttcgttccaggcactgatgaacaccacgttcaaaccatatctgcataaattcattatcgtcttctttgatgctcaacaacaaatcgaatatttgggacatgtggtatcggcaacaagtgttcaactagttcacgagaaggccctcgcaatccaactatggccacgacccacttctcttagggcccttcgagctttaaaggatgtagtgagcactgcactaatgttgcgtttaccagatttctctctgccatttaccttggagactaatgcctcaggttttggaatggtcaaaaaatggagacaattcttgctgggacattccttcgttatactcactgatcataggagtctaaaggagttaatggctcaaatcattcagaccccagagcagcaaaagtatctcactcgattaatgggctatgactttaccatccaatacaggtctggccgttcaaatgtggtggcagacgtcctatctcgcacttttgagcctcacaagggcatggtattcactttgtcaatgcctcatttcacatttctagcaaaactcaaaggtgaactagctgataaccaggagttcataactctttggcgagacctgcaggaacatccagccaaccactctgattttacttacaacgacggtgtttatatgggaataactaagacattagccagattgcaggagaattttacgtggagttctattcgaaacgacgtttgtcggtttgttgagcagtgcctcgactgtcaacacaccaagtatgtcaccaggaaaccagctggcttactcgaactactgccccttcctgccagactatgggaggatttatctctcgacttcattgttggattgtcgtcgtatcgaggaaacacaaccatcttggtggtcattgacagattcttgaaagggattcatttgggtcttcttccaactcaatactttgcataccaagttgccaatctcttcttggatattgttgccaaacatcacgacatgcctaagagtttagtctctgatagggaccctttgtttattagcaaattctggcaggaattattcaaactctccggcaccaaattacgtctgagttcggcttaccatcttcaatccgatggccaaactgaagttatgaattgtataattgagaatacaagcactgacactacaccatttgaagttacttttggcaagaaacctcccacgatcattcagtatatctcgggctcttctacagtggaagaaatcgatactttactatcgtcacgggaggcaatctttgatagcttgtgcaggaaattgttaaaagctcaagctagaatgaagcactttgcggataacaatcgcagagaagtaagctttcaagaatgcgactgggtgatggtcaaactccgcccttaccgtcaatcttcagtcattggacccaaccccaccaagctctcaaaacgctactatggtcttttcaaggttttggaccgtattagaacagtggcttacaagctccttttgcctgaaggatctcatattcatcctatcttccattgttcacttcttaagccatttctgcatgatgctgcaaatgaacctcgcccacttctgttactaggaaaggacatggagaatcatcctgtaatcacccctttggctattctcagcactcgttgggagggccccaaggaggcactttgcttacaagtggttgttcaatgggcaggtctccatgttggtgacacattatgggaggattgggcctctttgaaggaagattatcaacttgaggacaaggtgattttcgatgggttcgttagtgatagaccaagcaggatgcaagaagcccagaacgagaggtccaagaggaagattactccacctcaatgtttccacgttggagcgattgcaccacaaagcttggaacatttgctgcctagcattcacgaatgcctttctagtactgattgggcaacacgtaaagcggcagctgaggcattaagttctttggcattgcattcaagcagtttggttactgatagagcggcacccacactggcagtacttgaggcttgccgatttgacaagataaaacctgtaagagatagcatcaatgaagcattgcaactgtggaaaaagattgcagggaaaggagatgggtctcctgatgattcaaagccctcatctgatggtgggaatgaatcagctatttcgtcagaagcaagtgacccgaaaaaagtaaatcttgatgagaggaagactgattcaccagtaaagggttcatcaactagttcttcaaatatggattcaactaaggccaaagcagctagcatctcagagaaggcagttgtgatactgaaaaagaaaccacctgtgttatctgataaagaactaaatccagaatttttccaaaaacttgaaagaaggggttcagatgatttaccagtggaagtagttgttcctcgtagaggcctcaattcttctaactccaacaatgaggaagaatcagaggcaaatgctaaagattcaaaagaaagaataaattctgttggaaacatccctaatgatgatcatggatcctccagtaataaatatcgtatctttgagagaggcaatgatggaaattccaaacaaaggaattatgatgattttggccatgacagattctctgaaaggagagtgaacacaaaagaactgaggacaaaagcttatgatactgatggcaggactgaaaatgatcagagggacggttctgccaatgctgcaggtttttctaaaactgatggtcaatcagaagtacccttctccaataacagagcaaactggttggccatccagaggcagttgttgcaactggaaaggcaacaagttcatctgatgaatatgctgcaggatttcatgggtggatctcatgatagcatggtgactctagagaacagagtgcgaggtcttgagagaattgttgaagacatgtcacgagatttatccatatcatcaggtcgtagaaactttgcagggtttgaagggtcatctaataggccttctagcaagtataatggttttaacgactactccagttccaagtatggtagaggcggtgatggacgcatcccatttggcgaaagatttgcccaatctgatggaaattctttgggaatgaggggaagagggccatcttggagatctgacatgtctgaggggtgggatcattctggatatggtgcttctagaaatggccagatgtcctcaaggagggcttttgggggtagttctgctgatggaagatcaccaaaatctgtgcatgagaatgatcaagcaggcaacaggagagcttgggataaagcagcaatgcccatccggcttggtgaggggccctctgcaagaagtgtctggcaagcttctaaggatgaagctaccttggaagcaattcgggttgctggtgaggacaatggaacgtctcgagcaacaagggtagcaatccctgaaatgactgctgaagctatggctgatgacaatgttgggcaagagagggatgccatctggacttcttggagcaatgcaatggatgcccttcaagtaggtgacctagattcagcctttgcagaagtattgtccgctggcgatgatattttgcttgtaaagctaatggataaaacgggccctgtaattgaccaactttcaagtgaagttgcatgtgaaactgtaaatgccattggacaattcttactggaccagaacatgtatgacatttgtttgtcttggattcaacagttgctggagatagtattggaaaatggccctgatacctttgacattcccatggaagtaaagaaagaactcttgctgaatttacacgaagcttctacagatccagctgagacctgggaaggggtacagccagatcagcttttattgcaattggcatcagcctgggaaattgatctgcaacagcatgacaaatag

SEQ ID NO: 103118 - DNA, 2448 bp, Glycine max
  Peptide Sequence Number=SeqID_219896
atgattggaagtaaagatcgttctgctgactttgaaggtgagaactccaggagcaagctttcaaggcacaattttgaggccaacaaggagtacccagatgaaaaaggtgttgaatttctgagggattcatcagaagtgggtggttgtggtggcagctcagggttgcaagagttgaccctcagctacctttgtgacaacccaaaattcaatcttgctgagaaagagattcctggtaaaagcttgttggagaaaatgagccacaaaggtaaagaggttgtggtatgtgagaattcatatcaagatgggaaatgggtggaaagagatttcctcagcctgagtgagccaagagaagattcttcaaagagatcccttgaggaagttgttgagagagagagtaatagggagaagaagccaaaattagagattctcaacctctctcttgctttgcctgatgtgtcactttccctcacagcctcaaacgccttgcaaaacggtggtgatcatcaacaacaagttaggactaatccttgcaggccatcatccactactcacacttcatattccaatgactacactgcagcttctttgtcttactcttattcccaccctttctctcacaacccaagttgttcactcacccacaattcaactgatatgtttgattactcagtgagcaaagatgaccaaatttggaactgtggagagggaactaatggctcagtgcatagtaggttcaagccaattagagatggcttggttggtttatccaaccatggtggtggtggtggtattagttcctttatgcaaggtaataataatagtcagtataaaactactactagttcagataaccattcttttttcccttcagagttgccagcaaggccaaggtttgaggctcagtcaggggactcaagagggaggaattctgagaatctgagagtcttggatgatgggaaggcaaggaagatttctaggccagagaggattgttagggaaattgtttcagagtctatacctgtcatgacattgacaattcaggagcttactgatgatgtcatagcatcaactaaggaatacttgaggaatctcattgagaagcctgagaagaaagaggaactggtaagcctgcaaagccggctcgagagaagatctgaccttaccaaggagagtctttcaaagtgccataaggtgcaattagaggttttagtggctgtcaagatggggcttgctagcttcctatctagtcagattcagttgtctgagatggtagaggttttcttgtttaagaggtgtaggaatgtaacctgcaagcatttgcttcctgttgatgattgtgactgcaagatttgctcagggaacaagggcttttgcagttcttgcatgtgtcctgtctgtttgaactttgattgtgcaagcaacacttgtagttggattggatgtgatgtttgttcacattggtgccatgctacttgtggcattcagaggaatcttatcaagcctgggcctagcttgaaggggccttcagggacctcggagatgcagtttcattgtattggctgtggacatgcctcagaaatgtttggtttcgttaaggacgtcttcgtgtgttgcgcaaaggattgggggcttgaaaccttgatgaaagagcttgactgtgtaaggaagatcttcatgggaagtgaagatcgcaaagggaaggaattgcatgttaaaactgatgacatgctattaaagcttcaaactagaatgatatctccttcggatgccagcagttacatcatgcaatatttcagctatgcggacagcatgccagactttcctgcttctggtatttcttcaaaggatttgtcagcctctcaatctaaccttacaaaggatacaccatctctttcaaaacctaattctctattaccaaaatatggttatgacatgggctattctaggtcacatcctgatgccatgtcatgtgatctacttcagaaagacctcaaagcttccatcttaagtgaactgaaaaatgaggctgattttcatttgggggccttattaaggaaaggtggacttgaaagtttggagagcattgtgaggataaaggaggcagaagccagaatgtttcaaaccaaggcagatgaagcaagaagagaggcagaagggttccagaggatgatcaggacgaagactgcgcagatggaagaagagtacgccgaaaagctttccaaactctgtttgcatgagaccgaggaaacgcagaggaagaaattggatgaactgaaagtcttggaaaattcttattttgattactataagatgaaaaagagaatgcaagatgagattgatggtttgttgcggaaaaatggaggcaacaaagcagcaatgggtttaaatttatattttggttgcttttccttatgttttcttattgaggatactgctaaatgtgtgtaa

SEQ ID NO: 103119 - DNA, 333 bp, Glycine max
  Peptide Sequence Number=SeqID_219897
atggtgaactgggaggacgtaaccagcctccattcatggattggcattggcaccttttgcttggttggcttgcagtggcttatgggactggggtttatgcttcaaggatcagcacaatcaaggagtacaatggccccatggcacgtagcagctggtagagcactatttttcatggcaatttgtgctgcactaacagggttgatggagaagtacactatgataaaactcgtcacacaccatagagaatctcatttgatcaacttcacgggtcttgcaattctcttgtttggagtctttgtggatatgtcagtgggtttgccacgttatgcatga

SEQ ID NO: 103120 - DNA, 2142 bp, Glycine max
  Peptide Sequence Number=SeqID_219898
atggagtcatcagaggaccccatcatccaagtcaaagatgaacaactcatggtttcaccattatccggtgaaaacccagttcacagaactgcttatttcatcaaaccttgcgtggaagactcggcaactcttcctcattccatgttctcttctggaagaacagccactgtcaattcggaccacgcgaagttgcttgaagtaagatacaaagggtggcattacccaagtgcagaatggaatacatgggtccaacaaatgcaacacaagtatgaatgtgtgtggatgaaagctgggatagaccaggcaatcaaagcttcaacttttcaaatccgtaggaatgatgagttgatcattgagcttgcacaaagatggtgttctaagaccaacacgtttgtgtttccttggggagaagcaacgataacattggaggatatgaaagtttgttggggttactctgttatgggagctcctatttctagccctcttgtgagtggtgaggaaagggaaatagaacaaaaacttataggagtttttaggatgtttttcaaatctaaggccagaagggcggatcatactccatggatgaagcatttcatgagtaacgagagccgagtggagcatgaggcgttcttgtctttgtggttgtcgaggtttgttttccctggtagatcatatacaaccattttgaaaagcacttttcctattgccatacatttagcaagagggcttaaactagcacttgctcctgctgtcttggccagcatctacagggatttgagtttgctaaataacaaaatcagaattgtcgcaacagtggagttggaagttactctgtgggctccttttcagttggttcaagtatgggcattggagagatttccagctctgcagccgctccccgatgtaattgagcaaggccaactcttgatgactaaatggcacgccgtgaaaatgctgaaaggagacaacttgaaactgattttggactctgttggagctgaaaacggcttcatttggcacccttatgagaattctccagctcttcagctttacaatgaaaatgacatgtgggtatgcgataatcccaattttgatgatgaattagaatcctttgctcgctgcttgagagtctcggagttggtgggtatggagtgtatagaacagtacttgccaaatcgtgttgctatgcaattcggaatggatcaggacattcctggtatgttagcacattacaatgacaatccttggataagttatagtcagccagtaatggatacaaatttgtacactgcattatgtgcctgccatcagcctaatgttacttctaggtactatcgttggtggaagcaatcaaatccaagtaaggaaggagacatgcatgatcattgtgttgtaagtagcccagaacatttgttaccaacatcatcatctatgaagaaagagagtggaggatcctatggcccaccacctggttttacttccaagattaatgcaaaacaagaaaaagattttgatgaagagggaaagttgtcaattattgaattatccgattcttctaatgaagttagatgtcttggtgatgaagaagttggaaatggcaaggctttgtctagtcctccatctgatgtttttccatcagcaagtgttgaaggagcaagaactgtcaaggacaatgggaacgaagttaaaattgagcattcattttgtgatagaaatgatgttaatgacaaggaaggggaagatgccagccatcgtatagcaaacatagcttctaatcttgaaagcaggatctggaagcttgaaagagtgattgctaagcttaaagcagcaaaatttggccataaacttctcactcttctctttctctctgctctcaatctctctcttcgtagccccgacactcttgcttccaaagaacgcggtgcaaagaaagtggttagtttcgagattgacgaagcgaccgttacgacggtggatggtgactcttccgttttaagcagcgtcaccactttgtccgcacatggcaccagggatctccgcgaggttgttgaggagattcaggatgagtttatgacggcgtcgaatttcgggaaagaggttgcgttgttgcttgagcttgagcttgtggatggtgatgagtga

SEQ ID NO: 103121 - DNA, 351 bp, Glycine max
  Peptide Sequence Number=SeqID_219899
atgtgtcattcctctctcgcccaaaagcctctcatcgttgtcaatgttatcgccgctgttatcatgttgaaactactatcaagccctcgcctcttgtcgttgctgctgtcaagtttccttcagcttggatcttcaacaattcatctaaaacggcattgtatagtgagatctgggagcatgaaagatagccagcatctccgagtacaggcctccgatgaagaagcagtactacaacttggcactgaggtagaagctctgatcccaatgttcgaggagattagggacatgaacaaagacacacttcccgaggacacttccaacgtcatcctcttcttcaaggaagctctctaa

SEQ ID NO: 103122 - DNA, 234 bp, Glycine max
  Peptide Sequence Number=SeqID_219900
atgctctctaatgccaaccattgcatctttgttgaggtcaatgcctctaccactatcaatcttggaagcggcctcaacaacggaccctcactgcgctcaagccaaaggtttcaaaagaggaacaaagggatggagggggagggtgatgaagaagaaatggttaatggagatagagagagagatttgggggatgaagtgaaaaatcaaaagaggagagcaagtcatcaaggatag

SEQ ID NO: 103123 - DNA, 267 bp, Glycine max
  Peptide Sequence Number=SeqID_219901
atgtacaaggcaaagttgcaagagctgtgccaccagagaaagtggggtctgcctaggcactttgccatgaaagatggtccagatcacataccaagctttaagcttctgattatgtcaatcgtgtccccttcacttctggtgccattagttcccttaaagaagctaataacgaagctgccatgcttgctttcctcagcttctcttctgtgttttcttcttgctggggatgatggtcttgaggttgggaattacggttttgtgaagtga

SEQ ID NO: 103124 - DNA, 1681 bp, Glycine max
  Peptide Sequence Number=SeqID_219902
catgatggaggtgagggaagatttcatggtttcacctattggtgacagtgaaccatctttgagaactgcctattttctgaaaccccttgcaaagtcccttgatggatcagtttctgaggttctatcatcttccaagactatgcaactgccacctgtgtttgaaccaaaggagtggcctttggtggtccatttcaaagggtggcccaagctaaagcggaaatgggttgaatgggtggatgcacttcaagtaagatatggatcagtgtggaagaaagttggtatctttgatgccataatgagtaccaagtgttccatagtgaaagacgaaaacttgtgttttggggttgctgagaagtggtgtcctaagacaaataccttcttgtttccatggggggaggcaacaatcaccttggaagatgtgatggtgttgggggcttaccctcttgttggtgatcctatcttcactccacttcaaagccaggaaatgatagaggtggagaagaaattgattcatgcaagacagcaacccttgaggaagaacggagctaaggttacgacatcattatggatgaatctttttctcaatagtgggagtgaaattgagcatgaagcattccttgcaacttggttgacaatggttggtttttctcacaatggcttgatgagtaagtttgttttccccattgctattcatcttgctagagggaattccattgctttgggaccagcagttttagccagcatatataaggatttgagtctgttaaagaaaacaatagtagatttcactaatgataaattggaattggaggttactcttctgtcacccttttacctggtccaaatttgggtgtgggagaggttcatgaatttgcaaccacagcccatgttgataaaccaagaagaccctatgttgtttaggtggcacaaggttaataccttgaaaattgacaatgtgagattggcactggactcggctatggagcatttccgttggcgcccttatgttcaatatgctggtaagttcaaggtgttttatccagaaaatgaaactttggtactaattgatacaaatttggataaagaacctacgggactactagtgtcttttgttacatgcttgagagtttctgtgcttgttggaattcagtctactataaagaagtatctgccacatagagttgctatgcaatttggaatggatcaagatgttcctggtcgtgtgcctacatttcatgggactgaagccattgcatggaaaaattactgcaggaccatatctgataggagtttgtattttcctgctaggctttttgagggagatgttaccacacgttatgcaatgtggtggaagcaatcagtactatgtcgtcatcatgattttgcaaagaatattgtgcagcgaaagagaagtctgaggcctcctcctcatgggccacatgtattgaaagcaaataaaaagggttatgatgctgatgttccacctggtttttctcatttgaaaactgctccatctggaaattctggtgaagacaacggtgagccattgatggggggtctggaggaagattttggggatgcaaatgggagaaaagaatcaaggctgtctagtgaaagctgtagctgtgcatctggaataaaagtgaagtatcttgaacagagaatcaacagactggagaca

SEQ ID NO: 103125 - DNA, 1026 bp, Glycine max
  Peptide Sequence Number=SeqID_219903
atggaggggtctcacatggggttgttgctcttcttttgttcttccatgctttttgctgccttcgctgctgcctcctccagaaacttgcccataataccctttgatgaaggctacgcgcccttgtttggggacagcaacttggtcatccatagggatggcaaatcggttcatctttcactcgatgagagaacaggttcaggatttgtgtcgcatgatctttaccttcacggatatttcagcgcttctattaagttgccttctgactacactgcaggagttgtggttgccttctatatgtcaaatggtgacatgttccagaataaccatgatgaaatcgactttgagtttttggggaacattagaggcaaagactggaggattcagaccaatgtttatggcaatggtagcaccaacattggcagagaggaaagatatggtctgtggtttgaccctgcagatgatttccatcagtacactattgtctggacagactctcagatcatattttatgtggacaatgttcctattagagaagtgactcgaacagaatctatgggaggggatttcccttctaagccaatgactttgtatgcaacaatatgggatgcatctgattgggctaccaatgggggcaaatacagggttaactacaagtatgcaccctatgttgctgaattctctgaccttgttctgcacggttgtgcagtggatccaattgagcagcacgtggccaagtgtgacaatgctcctcaaagttctgaggcaactacaacaattccttcttctggtgttacaccagcacaaagaatcaaaatggagaatttcaggaagaagcacatgacatactcctactgctatgacaaagtcagatacaaagtccctccttcggagtgtgtcatcagttcccaagaagctgagaggctgaggaggttcgatcccgtcacatttggaagcggccgccgtcaccatggaaaacgacaccgtcgcagcagaggaagccagacagaagccgctgcttcattttaa

SEQ ID NO: 103126 - DNA, 297 bp, Glycine max
  Peptide Sequence Number=SeqID_219904
gttacacttacccagattgcacgcaaaagctgtgaagaacttaagcatttgagggttttggaaaataacagctctaccgtacctgctgaattttctctctgcaactgcgaaaaaatgttcaaccaaatgagtgaaatgacaaattcttggatgatgaagctcataatcccaaatccaggttctgttaacaacaacaaaatcatttcttctcttccacagagtgaacccaaagagcacccctctgatgtaaaaagtagaaaccatagtgaaagcaaatttgtgatgaagtttaattaa

SEQ ID NO: 103127 - DNA, 378 bp, Glycine max
  Peptide Sequence Number=SeqID_219905
atggttaaggaggagtgtaaggaggcaagtgtctcctctaagaggacacttgttagcactatcaaacctcttgagcttgaggttattcctcaagtaaaggagttattggatgagggcttggttcgaaagagcttaaaccctcgtgctttgttggtgcctaaaataggtattattaaacaccaaatccctaagataggtgttatgaagaatgtgttgagtggtgcaaccctcttttgtaaaatcacacatacacccaacatcttcatgattcgcgtacataggagctcattaggtagtcatcaaggggtttccacgaaccctaagagaataaaggtcattcctgagtggcccactccaccatgtataagggaaatttag

SEQ ID NO: 103128 - DNA, 243 bp, Glycine max
  Peptide Sequence Number=SeqID_219906
atggacgaagatcaatggaggtatgactttgcgatgtcacaagaagttcatatggattatgattatgataatcaagaagaatgtggggtgaatgaatcacatgtggattgttcaaatgcttttaatacgtctcaggtattcgctactcgaaatgatgttttgccatggccccgaatagttgcccatgaaaatggatttgttgcagtgattatgaggtctgacacagagaccggtagcagatga

SEQ ID NO: 103129 - DNA, 789 bp, Glycine max
  Peptide Sequence Number=SeqID_219907
atgggttgtgtgctcggacaacaggatgagaccggaaggaaagaacatgctatctactacttgagcaagaagtttaccgattgtgagtccaggtactccctacttgagaaaacttgttgtgcactagcttgggctgccaagcgtcttcgtcactacatgattaaccacaccacctggctaatatccaagatggacccgatcaagtatatcttcgagaaacccgctctgacaggaagaattgctcgttggcagatgttgttatccgagtatgatatcgaataccgcacccagaaggcaattaagggaagtgttcttgctgatcatttggctcaccaaccaattgaggactatcaacccatcaagtttgactttcctgatgaagagattatgcacttgaagatgaaggattgtgatgaaccattgcttggagaagatccagatcccgagtctaaatggggtttgatttttgatggagccgtgaatgtctttggcaatggaattggggcagttattatcactcctgaaggtaatcatctccctttcgccgcaaggttacagtttgattgcaccaacaatgtggcagagtatgaagcatgtatcctgggcattgaaaaagccattgacttgaaaatcaagaaccttgacatttacggggattcagctctcgtaatcaaccaaatcaaaggagaatgggaaactcgccaccccggcttgattccatacaaagattatgcaaggcgtttgctaaccttcttcaacaaagtggagcttcaccaacatccctcgtga

SEQ ID NO: 103130 - DNA, 332 bp, Glycine max
  Peptide Sequence Number=SeqID_219908
tggaagctgtggaagcggctctcagagagtctgaggttgatattgctgcttttcaacatgtgaagaggatcaagttgttgaatgagtcattggcatcggattgggcacgtggcgctggtgtcgccattcccaccagcgccttccctttgtgcctacgtggcgttggagtcgtagacatcaatggcaacttgggcatggcgccacatagctcagagtgcagcagggacacgccattggtggttgcacgttgcaagagggaggcgccatcacgagcaaaagcttggttccttgcttcctttgcttctttcgttcctgttgcttgtaacttcttg

SEQ ID NO: 103131 - DNA, 294 bp, Glycine max
  Peptide Sequence Number=SeqID_219909
atggaccttgcgcgcaaggtgttcaatgaaattcccgaaagggacgtggttgcttggactgcactcatcatcgagcacgtgcacaatggggagcctcagaagggtttgaggtgtctccgtcacatgcattgtgaagatgctccgatgcccaatgctagaacgtgggagggtgggtttcttgcatgtgggagcctcggtgctgtgaagcgaggttgcttctctcatacagtcttcggttttggatgtgtattccaaatgtggggttccctgagaagcgtatcgatccttttgtga

SEQ ID NO: 103132 - DNA, 1551 bp, Glycine max
  Peptide Sequence Number=SeqID_219910
atggagacaaagaaagtgaatagcaacaggcgctatatgcagcaaccaccggtgctactatgtggagtgatgggagagttgctctccaatgctgcaaagttgcttcaacaaatggcaaagtgtcataagaacaacgtcggatccatcgctctcgaccaccgccactccaccaaaaatgccaccaccggcggccacttccgcgtgctccgccgcttgatcttcgacgccgtcagctgcggcggcacctcccgctaccggtatcgccagcgcggcggcgccgacaacgatgacggcgacttcaactcggcggcgagccacacagagaaggaggagaggtccgagaagctatcggatctgctgaacgcagcggagagcaaaacagcgacggaagaggcattggcggagctgaagcaagtggtgaaggagctgcgcgaagaagacttcacgaagcggcgaatcgccgctgcgagagtgaggtcactcgcgaaggaagattcggaagccagagcgaatctcgcagtgctcggagcaattcctcctctcgtcggaatgctcgatgattcagaagacgctcattctcaaatcgcatcgctctacgctttgctcaatctcggaatcggcaacgatgcaaataaagcggctatagtgaaaattggcgcggtacacaagatgctgaagctaattgaatcgagcggttcagattcgtcggtgtctgaagcgatcgttgcaaatttccttggcttaagcgctttggattcgaacaaaccgataattggatcctccggtgcaataccgttcctagttagaaccctaaagaatttaaacgaaagtaaaatcgagtccaaatcacaaatgaagcaagatgctatgcgagctttgtacaatctctcgatctgtcagagcaacgtttcagtagttttggaaaccgatttggttttgtttttagtgtccacaataggagacatggaagtgagtgagaggagtctcgcgattctaagcaatttagtgtcgactccggagggtagaaaagcgattagcagcgttagcgacgcgattccgattcttgtggacgcgttgagttggacggactcgccggagtgccaggagaaggcgtcgtacgttttgatgatcatggcgcacaaagcgtacggtgacaggcgggtgatgatagaggcaggggtagtttcgtcgctgcttgaattaacacttgtgggaaccacactggctcagaagagagcctccagaatattagagtgtttgagggtagacaaagggaaacaagtttctggaagctacggtggaaactttaacttgggtgtgtctgctcctatttgtggatcttcttcatcgaatggagggaaagggtgtttggttgtggatgatgggatgatgagtgaggaaaagaaaacggtgaagcagttagtgcaacagagtttgcagagcaatatgatgaagattgtcaagagggctaacttgcgtcaggattttcttccatctgggaattttgcttcactcacttccacttccacttccaagagcctcccattttga

SEQ ID NO: 103133 - DNA, 1341 bp, Glycine max
  Peptide Sequence Number=SeqID_219911
atggagattacctctaagcctacagaattggatgagatagacagggcaatattgaaattggagatggaaaagctctctttgaaaaatgacactgacaaggcatctaaagaaagattaagtaagctcgaaaatgatttgagtttacttaaacagaagcaaaaagaattgacagaactatgggacaatgaaaaagttcttacgactcggataaggtcaatcaaagaagagattgatagagtcaacctagagatggaagctgctgagcgtgattatgacctgaaccgtgctgccgagcttaagtatggaactttgatgtcccttcagcgccaattagaagaagctgaaaagaacctaaccgacttccgaaagtccggacaatctttacttggagaagaggtcactgaccttgatatcacagagattgttagcaaatggactggtataccattatcaaacctccaacaaacagagagagaaaaggctggattgtctgatccaaatcggccaattgcaagcttcatgttcatgggtccgactggtgttggcaaaactgagcttgccaaggctttggctggttacttgtttaacactgaaaatgctcttgttagaattgatatgggtgagtacatggagaaacatgctgtttcacgtctaattggagcccctcccggctatgttggttatgaagaaggcggtcagctaactgaagtggtcaggagaagaccctactctgtggtactatttgatgaaatagagaaggcacatcatgacgtcttcaacatcttgttacagttgttggacgatggaaggattactgattctcaaggaaggactattagcttcacaaattgtgttgtgattatgacttcaaacattggttctcattacatacttgacactcttcgtaatgaaagacaagtcgttgagttggctaggcaaacattccgcccagagttcatgaatcgcattgatgaatatattgttttccagcctctggattcagaacagatcagcaaaatagtggagctccagatggagcgagtgaaaaacaggcttaagcagaagaaaattgatcttcattacacagaagaagctgttaaactacttggtgtactgggttttgatccaaattttggagctagaccagttaaaagagtaatacaacaattggtcgaaaatgaaattgctatgggagttctcaggggatatttcaaagaagaggagtcaatcatcgttgatgctgatgtgactccatcaggcaaagaacgttctcctctaaataaactgcttattaagaagttggacagctctgttgcggatgccatggttgtcaatgattaa

SEQ ID NO: 103134 - DNA, 372 bp, Glycine max
  Peptide Sequence Number=SeqID_219912
atggaaaaggccggttttggaagtgaggaagtggacgtgaggtgggcggcggcggagacgaggatgggggagacgtttgaggcgcgcatgtgggagaagagggaagagggatttgagaaagaattaaagaggaatgtgtcttgggaaggaaaagagtggaaagagagatcaactttgaagcaaagaagaggatcgtggaagcggcagagagattccagggttgtgcttcccccgccttgtcttgtcgtgtttcattctccacgcaagtctgctctgtctctttcacttgccgcaccgatgttaatggttcactcatctctgtctgatgttgctcaagtttgtttgcctgctctgttggtggctattttttaa

SEQ ID NO: 103135 - DNA, 144 bp, Glycine max
  Peptide Sequence Number=SeqID_219913
atgggttcattgcttgctggggccaagtatcgtggagattttgaagaaaggttgaaagctgtcctgaaggaagttacagcatcaagtgggcaaataatattgtttattgatgaaattcataccgttgtaggtgcagagacttaa

SEQ ID NO: 103136 - DNA, 588 bp, Glycine max
  Peptide Sequence Number=SeqID_219914
atggttgtcaagtatcaaagcataccccaacatgtgacgtacctggaagaagtcttcggggaactatgcaaatacgacatgcgcctcaaccctgaaaaatgcacttttgggataggcgacgacaagttcctcggcttcatgatgacacaccgggggattgaagccaaccccgacaaatgcattgccatactggagatgtgcaacccaaccaacatccaagaagttcaaaagctcaacggtaggctagcatccctgtctaagttcctgccaaagttcgtcgaaaaggcaaagccattttacaaactgctcaaaaagactgagcccttctcatgggacaagacttgtgaacaagccttcctggctttcaagaaaaccatagccacactgccagttttgagtcgacccaggccaagagcacccctgctcttgtttctctcagtacccgacgaaactgttagctcagctctcgtacaagaggaagagaagcaccaggtccctatctactttactagccgcatactccatgatgccgagatgtgctaccaaatgatcgaaaaggtgatgctagcactcgtcacctcggcttga

SEQ ID NO: 103137 - DNA, 360 bp, Glycine max
  Peptide Sequence Number=SeqID_219915
atggggatcgcacccacaaagacacccagtggacctgaagaaatccaacagggccctggggtttccagctctggttacgagcctctatcagtcctacagggtgcccgtacccccccggcaaggtcacgtcatcatagggagtgtctgtcgcccctagcaaagtcatcagacccccctaccaatcgagctttcatccagaagtactgcgcccccaggcaagcgcagggcgaagcaccacagcagcattgggatggccgggagtgtctgtcgcccccagcaaagtcatcagacccccctaccaatcgagctttcatcaagaagtactgcgcccccaggcaggcgcagggcgaagcaccatag

SEQ ID NO: 103138 - DNA, 906 bp, Glycine max
  Peptide Sequence Number=SeqID_219916
atggcatctgtcaatacttctgatgaagactttgttgccattcgacccgaatggactacagttgatcgaatacttgcctgcaggggtgatgatgatgagagggaatatcttgtgaagtggaaggagcttccatatgatgaatgctattgggagtttgagtcagatatttctgcatttcagccagaaatcgaaagattcaatagattgcggtctagatccagcaagttttcctctggtaaacaaaaaaacagtgttaaggatgatgctgaattgaagaaacagcagaaagaatttcaacattatgaacaaagccctgagtttctttcaggtggtacattacatccatatcagcttgaaggcttgaacttcttacgattctcttggtccaagcagactcatgttatacttgctgatgaaatgggacttggaaaaaccatacaaagtattgctttcttagcatcactttttaaagagggtgtctctccacatctggtggttgctccactttcaactttgcgaaactgggaacgtgaattcgccacatgggcacctcatatgaatgtgctaatgtatgttggatctgcccaagctcgtagtgttataagagagtatgaattttactttccaaagaaacagaagaagatcaagaaaaagaaatctggtcatttaattagtgaaagcaagcaagacaggattaagtttgatgttcttttgacatcatatgaaatgatcaactttgacacagcatcactaaaacctataaaatgggagtgcatgatagttgatgaaggtcaccgtctcaaaaataaggattcaaaattattttcttcattgaagcaatattctagcagacatcgtgttctcttgacaggaactcctcttcaggttcacttcaaattgtcatag

SEQ ID NO: 103139 - DNA, 1545 bp, Glycine max
  Peptide Sequence Number=SeqID_219917
atggctagagctcatcgacttggacaaactaacaaggtgttaatttataggcttataacacgaggaactattgaagaaaggatgatgcagatgactaagaagaaaatggttttagaacacctagttgtagggaggctaaaggctcaaaatatcaaccaggaagagttggatgacatcataagatatggctcaaaggagttatttgcagatgagaatgatgaagccggcaaatcccgccaaattcattatgatgctgctgctattgatagattgctggatcgtgatcaagttggagatgaagaggccactttggatgatgaagatgaagatggatttctgaaggcctttaaggttgcaaattttgagtatgttgatgaggccgaggctgcagcagaggaggcagcacaaaaaagagcaatggagacacttaacagttcagaaaggacacatttctgggaggagttgttaagagacaagtatcaagagcataaagttgaggagtttaatgccttgggcaaggggaagcgaaaccggaagtcggattttgtgcccgatggcgttggccgttgtgtgatccaagtagccgacttcaccaagtgggataaggctttagttgttgtttttatggtttccgtggaggaggatgaccttgctggtctggaagatgtaagctctgatggtgaagatgacaattatgaagcagagcttactgatggtgattcaaattccactggaattacaactgctagaaggccttataaaaaaaaagcacgtacagatagcacagagccacttcctctgatggaaggtgaaggaaaagcattcagagtccttggttttaatcaaaatcagagggctgcatttgtgcaaattttgatgagctatggaacccttttcttgtctcatattgctgaagatataactgattccgctacattcacagatggtgttccaaaagaaggactccgaatccaagatgtacttgttaggattgcagtcctgctcttgataagggacaaggtgaagtttgtgtcacaacatcctcaaactccattgttttcagatgatatattattacggtatccaggtttgaagggtgcaaagatatggaaggaggagcatgattatgttttgctacgtgcggttttgaagcatgggtatggaaggtggcaagctattgttgatgataaggatctgaagattcaggaggtcatatgccaggagttgaatctttcctttataaacttaccagttccaggacaagttagttctcaggcacaaaatggagcaaatttgacaaatgcagaagtttccaacaatcaatccaaggaaaatggtgggagtgatattgcagctgatggtgcacaaggttctggtgatgctaggaaccaagcacagttatatcaagactcgtccatattatatcattttagagacatgcagagaagacaggttgagtttataaaaaaaagagttcttctcttggaaaaagggctcaatgctgagtaccagaaagaatactttgattcaagttcaaaaaattag

SEQ ID NO: 103140 - DNA, 345 bp, Glycine max
  Peptide Sequence Number=SeqID_219918
gaaaaggcaaaggggttagagagatccaatgatggccatgaaggggcggtggtgacggaggaacttccattagtgctggccataaagctcgtcgtcgcacaacatcgacatcgacatcgacatcgacatcgtcatcgcaccactgtcctcgtggattcgagaagtcgcgacgacggagtccgccgcatcagcaccatgtcgcagaagaatgtgagcaacacttttgcggaggtttccacagtccacaacaatgttcaatgttggtgcttcgagcttctaggctcttatggaagtgtttcaaatgaaggaattggggttgggaaagtgacgaaatatatgcaatag

SEQ ID NO: 103141 - DNA, 2298 bp, Glycine max
  Peptide Sequence Number=SeqID_219919
atgaccgtagagaagaaaatgaatgattccggcgacgagtttcccgtcggaatgcgtgttctcgccgtcgacgatgatcccacttgcttattggttctggaaactctcctccgaagatgtcaatatcatgcaaccacgactaatcaagcaataaaggcgttggcgctgttgagagaacacaaagacaagtttgacctggtaattagtgatgtgcacatgccagacatggatggatttaagctgcttgagctagtgggacttgagatggatcttcctgtcataatgttatctgcaaatggtgatacgaagctggtgatgaaggggatttctcatggggcctgtgattatctgctgaaacctgtaagaatggaggagctcaagaacatttggcagcatgtaatcaggaggaagaagtttgactcaaaggagaagaacaaaacccgcaacatagacaaacctacttcaaacagtagcaatggactagggtcatcaggaacaggaaattctgatcacaatgagaagctgactaagaaaaggaaggatcaagatgaagacgaagatgaggagcaggagaatgatcatgacaatgacgacccatcagcccagaagaagcctcgggttgtttggtctgtggagctgcaccgcaaatttgttgctgccgttaatcagctaggcattgacaaggctgtacctaaaaaaattctcgatttgatgaatgttgaaaagcttacaagggagaataagtataggctttatctgaaaagaattagctgtgtggctaaccaacaaaccaatatggtggtggccttagggggtgccgatccatcctatttgagaatgaattctgtgagcggggttggacatatacaatcaataagtggttctggacagcttcataacaatgctttcagatcctttccacctagtgggataattaatagattgaatactcctgctggtttaaatgtgcatggatttccttctggagtacttcaattgagtcaatcacaaaatttaaaaaacaccaatgataatcttaagttccagtcagccattgttcctgctaatcagaatggtgttcatggaatgacagtatctgtagggcttgatcaactgcaaaacaataagggtgttatgtctgttcaaaacctgactactgtttttgatgccaaaacaacttttcccatctcgaataaactcccagatccaagaccaaaaataaccaactctggctctcacactccagatgtgagtttctcaaacaatgccttgatgttggaaccacgccctcaaggcacacaagggagtgtaagaattgaaactttatcttcttcagtagcctctcaacattcagaattttctttgtctttgctggatcaaggtagatatagtgataattgggcaagtactgtgcagccatctgtgatccagacaaactcttaccctccaagtgaatgttttggacagactaatatacctcctacagataacatggcttctgtacccttgcaaggtgggaatctaagtggtgcgtccatcacttcactgtccaggcaatcctatgattcaatgacagatatgcactctgaaggagtgacttttaccaacagacctgggcatataagcagtaatgtgccatatcaagggtggcatgacaataatcaggatgctactcaccattcaaatattttgtcaataaactcactgactccagtcaatggtgctgctgttccagctggccatgcagcaatgaactcagccttacacagaaacttggactttaattattgtgatcccttacaaatgaagcatgagggatttgtggagttaactgacgaggccttatcgaaacaacatcaggggaatatcatgaacctaccgaaatctcaacaaagtcatttctctaataatcttggttcactggaagacttggtcagttcaatgatgaaacagtaccatgttcatgccatgcaggaaaatgataagatgaaattattggatggaaacctcatttgcaataattactctggtgggttatctcgatgtgatagcagtccagcaatgcaatatggagtgttattgatcactttgtttaatctccttagatatgttggccttcaaattggacctagatcttctgtcacagccacacttgcagcgaggagagagacacaaggtcctggtggagcccatcacacaaatgggatccacttgaaccctgtgtctttttcatgccttgatgcttggtgtaggtgtggcagcttgagagagatcagggattgcaaatttaaatgttag

SEQ ID NO: 103142 - DNA, 669 bp, Glycine max
  Peptide Sequence Number=SeqID_219920
atgggtgatccaaaagcaaatgaagtaacaaatgaagaacttaaaagtgaaaccaaggctactaattttccaggtgataaattaggggacactgacacccaaatgattgatcaacttccgcaagtacaaacaatagcttcagaagaaatttcagctgaatgtgatagtgatcccactcgattggagttagttcgcctttacaacgagatgtgcaaggcagtggaggaagactccatggatttagttcaaacttctttggcaagagaaccggcagagctcaatgtagtgaagaatttccctccactagaaactctttgcgaagacattaacaaaattctaacacccacacaagaacaacctattgcagaaatgccaatatcgaattcagataacaaatcagaggctatgtcacatggtgaaaatttgggctccaaatcaccgccaatctctcaagactgcaagcctaaagattcagaagacaatgagaataaagatatgaaaatagaatctgaatctataaaagaaagctgttcaagcctgttagaagagaagaatgaaacaccgactcttccggataaagaggaaagtaaaacagaaatggatgaaactatgaatgatgctgagttgaatgaaaacccggagaaatctgacgctgtattggaaggttaa

SEQ ID NO: 103143 - DNA, 1140 bp, Glycine max
  Peptide Sequence Number=SeqID_219921
atgcagacagagacagacaacaaatttactcaaatccacaatgcgtttgatctgcttctgaaccaaagccctaagaaatcttcccacgatgatagtaacttaagcaaacaatcatttcgagtgaggaacattaaactcgaattccctcgtttcaatgacaaaaatgtcttggaatggatatttcgtgcgaaacaattttttgattattatggtacactagacctggatcaattaaccattgcttctgtgcacttggacaaggaagtagtcccttggttccagatgatgcagcgctctcacccatttcactcttgggtcgagttcactcgcgccttagagctggattttggaccttccatttatgagtgtccaagagctacattattcaaattaagtcagactggtactgtagctgattattatctgcaatttacctcattagctaacagagtttatggcttgagtaatgatgcattgatagactatttcattagtgatttaattcctgagatcagacgagaggatgcccaacctgaaccagaaaaaacccaactagatatgacctacactgaacctgacctagccacaaatgaccaccatctttctttgaatgcaatgaaagggaccgatagcataggtattttgcgattcacaggccaaattgggcaaatccgtgtacaagtcttagttgatggaggaagttcaaataattttttacaaccccgaattgctgaatttcttaaactcccagtggaaccaggtccttgttttaaagttttggtgggaaatggtcaatctatgaccgctgagggagtggtccctaatttgtccatcatattacaaggacatgagttgatagtacctgtattcttattgcctgtggcaggagctgacattattttgggatcttcatggttggctactttaggcccacatgtggcagactatgcagcttcgacactaaaatttttctacaaaggaaaatttgtgacattacaaggagaaaaaggcacaccacctaaactggctcaattcaatcattatagaaggatgcaaaatactaatgctattgctgattcatttaccgttcaactatttcagttccacactaaggatgatgttttgaaagatttaccataa

SEQ ID NO: 103144 - DNA, 1886 bp, Glycine max
  Peptide Sequence Number=SeqID_219922
atggattttatcactggcctaccaaattcgtatggcttcaatactattctagtagtagtagatcgtttatcaaaatatggtcatttcatagcactcaaaggggattacacgagcaggtctgtagttgagttattcatgactcatgtggttaaattacatggcatgcctaagtcaatagtgtctgaaagggataaggtttttactagcaatttctggaggaacttatttcaattgcaaggtaccacattggccatggagatgtttctcaggtgtttggagatgtttctcaggtgtttcacttttcacaatccaaaagcttggtacaaggctttaaattgggcagagttttggtacaacagatcatttcacaccagcattggtatgacaccatttaaagcattatatgggagagatccacctgctttgactcgatacaatccacaggcatcaaaccctgttactctacaggaacaattgatcaacagggataacattttacaacaattgaaacaacatttggaaagagctcaagtatacatgaagaaccaagttgacaagaagagaactgatgtgtccttcgcaatgggagatttagttctagtgaagctccaaccatataggcaacactctgtcactttgagaagaaatcaaaagttgggaatgagatattttgggccatttcctgttgtggccaaaataggtagcgtggcttacatgttacaactacctaatgacaacacaactccagctgaagccacatgggaggattttaatgagatgttagacaactttcttaacttcaaccttgaggacatggttgtcataaatggggatggtattgcaatgaaggaaaatagggaaggcatgttctcgaccaagtcagctaaaggggacccacatggagaaaaagggaataatgttgttagcattggtccagaaatgatggggcaaaggaaaggaatgaggaatcgcatgactaacaccaagttgagggactacgtaggtttcatgaatctaccgattacaagggcacgaggagagtactctgcaatggaaacactgagccacgagtctcccttctatgataataacctctccgctgaaaagactcctccaagtccaagcacaccattgcagaatccacaagagaagaaacaactatctgttaaggaacaagaagaggcaaaaacagatactttattggatctaaatgcctctggtgatgattctgctgttgggtgcagtccagtgctgaatctgatcacgtgtttggacacagatttgccaagcacttcctcagaaaaccaacatggctcagagccacgagtgttctcttgcaactactgtcagagaaagttctacagttcacaagctcttgggggacaccaaaacgcccacaggagagagaggtcaattacaaagagaggtcatcatagatcaggatcacgtggcatgatggcctcagcaacaacagctttcggaattcccttcctccataatcaccttcaccactatgccactatggcttctctccctctccatggtggttgtagtaataataaaccacttggaattaaggctcactccatcattcacaagccttcttcaaattcttctcatatttcattcaatgggtttggaaccacttttggacatcatggatggtcaagaccccttattgatcaacaacctagaatagggaagctaacgatggaaagttgtcacaaaacatcacgaggtaatgttggaaaattcgatgcggtgaaaacgaccatgattaattcagcgaccattgaagaaatcagtggatataatatgattagtggagttactcgttttaagactaatcaagaggaaatgaaacaccttgatttgtccctaaagct

SEQ ID NO: 103145 - DNA, 516 bp, Glycine max
  Peptide Sequence Number=SeqID_219923
atgatggactacattgccatcaagataacaacctgcccgagcaatttcactgctcagaattatccttgccatgttatgaaactcttagtagaggatcatagagattatccctgcctattcgatgatgaatacgaaagctgggatgtacaaggtaatacacaataccaatatagccttatgagggcacaaattcagggctatcaatggttcttctcagaagaggaaaaacgtgagtttgatctgataaaagaaactcatgacacaaagcttttcttgcccttatacaatggaaaatttttcattcccttctcggtggatcataacaacaaactggttcagttcttccagaaagagaaaaaagacaaggagatttatgaagcctgcggtcgtcatggacaagaggctcctcccaccccttctactgaaatgccaatggaagattcatctgacattttctgttctgggaatatccaagatgaagaagatgttacgatcacaaagtcaactaagagttaa

SEQ ID NO: 103146 - DNA, 258 bp, Glycine max
  Peptide Sequence Number=SeqID_219924
atgaggcttcactgtcatcaaccaagtcagagacccaacatgaccacagattcacctctactccttatggctcacatagacctgggcataaggcctaatatctcaatttgtcaactgtcacaacctacccttcggcgggagggtgacgcggggctcacgggtgcatcttccaagggaggagaacgcgcagagtcgccaccaacgtttattcgagaaaaacataaaaaaaaaccggaacgtgtggtctacaaactttaa

SEQ ID NO: 103147 - DNA, 174 bp, Glycine max
  Peptide Sequence Number=SeqID_219925
atgcttttgaaaggaaatgaacttgccattcagaacacaagaaataaatgtgggacatcccttttatccttgaaccactggccaaaccaacaccctgacatacatcatgtttggccgttctgcaagccttttgagccaagacctcaaaccaccataaaccttgacccaggatga

SEQ ID NO: 103148 - DNA, 687 bp, Glycine max
  Peptide Sequence Number=SeqID_219926
atgatgtcctcatccccgttcccttcttgcttccgcccctcccccaacgccgaatcccaccctcctccccctccgccgccgcactccacaatctccaacctcacaatctaccacaccgacacaggccccgtgtccctaacatggtcacgctccattgttggacgctccctccacattcagctccaccaaaaccccttagattccccaccctaccctaaccctaaccctaacccctccccctccaccaccctctccttccacctccacataagacccttcctcttctggaaaaaacacggttccaaaaaactcgcccccaacacccacctcttctggaacctctccagagccaaattcggcgccacccccgaacccctctccggcttctacgtcgccctagtagtccacaaccacatgaccctcctcatcggagacgccgccagagacgcgttttcaaagtccaaggcgcgccacccaaacacgccgcaactcctcctcctaaaaaaagaacgcgtctttgccgacaggctgtacaccacgcgcgccaggttcggagggaaagcgcgtgagattcagatcgattgcggctaccacgaccactccgagctctgcttcagcgtggacggggagaaggtgctgcagataaagcgcttgatgtggaaagttcaggaggaacgagcggttcag

SEQ ID NO: 103149 - DNA, 109 bp, Glycine max
  Peptide Sequence Number=SeqID_219927
ttctttatccaccctatggcaagacacttaaatgcgccagagatgtagtttttgtccccacagaagttagtcaaaatgaagcacatgcttggggtactgtacaaaactg

SEQ ID NO: 103150 - DNA, 696 bp, Glycine max
  Peptide Sequence Number=SeqID_219928
atgggagttgctggtgtattgggcgcggcactactatgcgctattcatggtgccaccgtagaaaatactttatttgaagatggtgatggcgcaaatacattccgtgcttttaacccaacccaagctgaagaaacttattcaatggttactgctaatcgcttttggtcccaaatctttggggttgctttttccaataaacgttggttacatttctttatgttatttgtaccagtaactggtttatggatgagtgctcttggggtagtcggtttggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaccttatattccctgaggaggttctaccacgtggaaacgctctttaatggaactttagctttaactggtcgtgaccaggaaactaccggtttcgcttggtgggccgggaatgcccgacttatcaatttatccggcaaactactaggagcccatgtagcccatgctggattaatagtattctgggccggagcaatgaacctttttgaagtggctcatttcgtacccgagaagcccattattgggctttggcggtatttatcatgcacttttgggacctga

SEQ ID NO: 103151 - DNA, 126 bp, Glycine max
  Peptide Sequence Number=SeqID_219929
ggttcaggcaaaggaatcctcttttcccctacctatgatgttcttctatttccaaaaataaaggtagcccaagctaatttgattggtaaggttcctgctaacttttgtgccatcccagggatgaag

SEQ ID NO: 103152 - DNA, 345 bp, Glycine max
  Peptide Sequence Number=SeqID_219930
atgaatctaagagggagacaagtagagataagtgacccaatgtgcccgttatgcaacaattcggaggaggttgcagcacaccttttcttcaattgtagtaaggtcttccccttgtggtgggagtcactctcatgggttaattcagtgggtgctttcccgaaagaacagaaagatcatttcatgcagcacagcagaaggaatgctacacgaacaaaagatataagatggagctattggtggatagccctcacaaggaccatatggcaacatagaaataaggtggtctttgataaccaaacttttaatgcaagcaagctgatggacgaagcgcttcttctagtctag

SEQ ID NO: 103153 - DNA, 363 bp, Glycine max
  Peptide Sequence Number=SeqID_219931
atgcaagaagaaaatgaagaagaagatgaagaagacttatcactctttgtgaagaagtttcaaaaattggtcaagaaaagaagaattgagaggcgtcaaaacttcaacaatggaagaagatctcaagaagactctcaaattcttagatgcaacaaatgcaatcaacttggtcacatcaaagcaaattgtccctcaaatgaggaatggcctgagaaaagtaataagaaaaggtatgaagaaagaaggaccaagaaggcatacattgcatgggatggcaatgacttatccgatggttcagagaaggagatcaaccttctaaccaaggactatgagagcgatgagaacatctctcaagaaaattaa

SEQ ID NO: 103154 - DNA, 225 bp, Glycine max
  Peptide Sequence Number=SeqID_219932
atgaccctcaggcgtaaggtgcaaggtctaattgatacgggctggctgaaatttgaggagaatcgcttgttgaatcataacattgacaagcaacaccatacatggggcaattctggaagctgttgttatgactcatcaggattttcaaaaagaagtgagttatcaagaataggatgttggacaaatggcctcagttatcttgagaagaagaggggattgaattaa

SEQ ID NO: 103155 - DNA, 423 bp, Glycine max
  Peptide Sequence Number=SeqID_219933
atgagctaccgcgtaatcgcccttgacctcgacggcaccctgctgaccccaaacaaaaccatcctgccagaatcccttgaagccttagcccgcgcgcaacaggctggcgttcaggtgctgatcgtcaccggtcgccatcactgcgcgattcacccgttttatcaggcgctgcagctgacaacgcccgccatctgctgtaacggcacgtacctgtacgattaccaggcgcaacgggtgctggctgccgatccgctggagaaaagtcaggcggcgcgggtgattgagatgctcgatcaggagaatattcacggtctgctgtatgtcgatgatgcgatgctgtaccaggaagcgaccggccatgtgacgcgcaccctcaactgggcgcagtcgctgccggaagcgcagcgcccgctgtttgtgcag

SEQ ID NO: 103156 - DNA, 297 bp, Glycine max
  Peptide Sequence Number=SeqID_219934
atgggggtgtatttagtaaaaaagggggtgcaaatagcagccaggcccacttgggccttccaggatgttcctccagaaggcggttgcttctggaggaagaaacctggctcgcctgggcgagcttggtggcaagctcctcccctatttcctataaatagggggaggagtgaaagagagagggaaaatccaagccgtggcgcttccgtaacgtttccgtgggtgatttcacgaagattttcaaccgttctccgtcgttcgtcgttcgttcttcgtcgttcttcggtcttcaactggtaa

SEQ ID NO: 103157 - DNA, 225 bp, Glycine max
  Peptide Sequence Number=SeqID_219935
atggtgccggtcgccacgctgcccgccgccgccatcttgatgggcgtcgggtactggattgaccctgttggttggggcggcgacaacgcgctcgccgctttcttcattaaatccggctccgctatcatcgacaacatgtcggtgttgttcgctatcggcgtggcctacggcatgtccaaagacaaggacggcgccgccgcgttgaccggcttcgtcggcttcctg

SEQ ID NO: 103158 - DNA, 339 bp, Glycine max
  Peptide Sequence Number=SeqID_219936
atgagacttatcccactgaaagataccgcacaagtcggcaaatgggccgcgcgtcatatcgttcaacgcatcaacgcattcaagccaaccgcagagcgcccgtttgtcctcggcctgcctaccggcggcacgccgctggaagcctacaaacatctgattgcgatgcacaaagcaggtgaagtaagctttaagcatgttgtgactttcaacatggacgagtacgttggcctgccgcaggaacacccggaaagctaccacaccttcatgtaccgcaacttctttgatcacgttgatatccctcgtgaaaatatcaacctgctgaacggcaacgccgcggat

SEQ ID NO: 103159 - DNA, 879 bp, Glycine max
  Peptide Sequence Number=SeqID_219937
gatttccagctagtgccgactgtggaagagtttgaagaaatcctaggatgcccgctgggaggaaggaagccatatcttttctcagggttctatccctccatggctagaatttccaaggtagtgaaaatcttggcacaagagttgaactgggtaaagaaaagccggaatggggtagtcggagtaccaagaaggtgtttggaggagaaggcaaaggccttggctaatcaagacgaatgggcttcttttattgaaatcttggcacttttgatcttcggagttgtcctctttccaaatgtggaagggttagtggacctagcagcgattggcgctttcctctcccttcaccatggcaaggagagcccgatcgtcaccattttatccaacatgcatgacgcgttcgatcagagatgtgaaaagagcggcccgtctgtccgctacaaggtcaccgctcgtgcactgagaaaggaaaggagaattgggactaactctttgctagtatggaagaggcatccgttaattggttccctcgctggaaggaaggaagaactgggattctgtcctcgtgcgaaaggagtgccatcaaaggaaagcatcacgcctttcatcgcacggggtttcaatgaccccaaagtgagggtagttcaaggagttcgcaaggcaagggatgcggtgcaaaggaaggacaaagagcttaggggaaacccacacgtaacggtttttctaacattttccacaaataaacgttggtggcgactccacacgttttcctcccttggaagatgcactcatgattctcgcgttgccctcccgctgaagggacaaagaaagcgaaagaccaccatggtcttcatgccatcgaacttggttgcctctggatag

SEQ ID NO: 103160 - DNA, 444 bp, Glycine max
  Peptide Sequence Number=SeqID_219938
atggcacctccatactctattcctacagtagagcagtttagtgagatggtagcctggcccaggacccaaccttctcttcataaggaagacgaaggtcccacagcccaggtacctcaacatatggaggatgagtcatctgaggccaccatcccaaagccatttaatataggagaagaggcagaagagacacaggtgagacaggtagctgctaccactcctgagcgatcccttgaggctacttcagagccttctgcactagtggtaaacctacccttacctcatcctgtagcagacccctccactcctcttctacagatgccagaggacccaactacaccagtcctagctgtagacacttctcctcccactattgtagtgcttcagttgacagatgaggaggatggtcagacacaggacacgcaggatcagtcacaggaattttga

SEQ ID NO: 103161 - DNA, 711 bp, Glycine max
  Peptide Sequence Number=SeqID_219939
atgacgcagttcttcgacaactatcactcggtgatgccatatttgcaaaaccacgacacccctccggaaaccgaacgcgtgcaaagcccggaagaccgtgccaagctcgatggtttatatgagtgtattttgtgtggcgcctgtaccacctcctgcccgagcttctggtggaacccggacaagtttgtcggtccggcgggcctcatgcaggcttatcgctttattgccgacagccgcgaccaggaacaggaagcacgcctggaaaatctggaagacccataccgtttgtatcgttgccacaacatcatgaactgtactgatgtatgcccgaaaaaactgaatccgaatgcagcgattgcggcgattaaagacctcaaaattgaaaaagccaaagcgcatagtgaagccaaacccggcaagaaaatttttggcatcaagattttacgtgaagcagaacaacggcgtctggcctggcgttgccgccggggcatgctggagcttgatattgtgttgcaacgctttgtcagcgaacacttcagcggcctgaccctggccgaaatggagcaactggatgccttgctggagctaccggataacgtgttctgggatttgatccagggcgtaaatccacaacctggcatggcacagtccacggccatcctgcaaaaattaagagcaagccgacccgcggcagaacaggaaacagcatga

SEQ ID NO: 103162 - DNA, 306 bp, Glycine max
  Peptide Sequence Number=SeqID_219940
atggggcagtccatcatcatgcaaaaccttcagggcttgggcttgccctccattatgagcatggaagagtttgatgctcaggtggcctggccaggagaccagccctcttcctctggagggggtggggcctctatagcccaggagcttgtgactgaggagccaccagcagcagcagcagcagaggaagagaccactctagatcagaccccacagccatctccatcctctgcacctgctcctgaggagactcagccagcagcactggatcttaatgaagaccagccacagaaggagcaggacgtttaa

SEQ ID NO: 103163 - DNA, 243 bp, Glycine max
  Peptide Sequence Number=SeqID_219941
atggagtgcagcatctgtggagtaaaaataaaatatgctagacctgcaaatactagagttggaaatggcatctttgaaggtgctggaggaatcattggaatctctgtggaggaagagggaggaagtgtagaagaaaaaggacttcctgtctctagtgctgaagtggaaggggcctcagatctctttcctctagccttcctaagtcctctcaaagttactattggatcatcaagattccaataa

SEQ ID NO: 103164 - DNA, 240 bp, Glycine max
  Peptide Sequence Number=SeqID_219942
atgggagatcgcttagaggatatgattggtgaccttggacaagagtcttttcagcaagcacatgcccttatgtatgatacattgcaaactgattcgaagaagcctttatatctgaggtgtaagaaggtagtgcgcgatatgcttctagaggtaaacacattgccaaaaagttatttatcaggcgaagaagattttgtgttcgatgggtatgaagtattagaaaattcatgcatgccctaa

SEQ ID NO: 103165 - DNA, 960 bp, Glycine max
  Peptide Sequence Number=SeqID_219943
atgcgccagggcatcagccgcgacggccatcatctctatccggcgtttccctacaccagctttcgccagctgagcgaaggcgatatgcaggcgttgtacgcctggctgatgtcgcagccggcggtacagcaggcaccgccagagaaccagatgcgctttccctataacctgcgcttcctgatggcgggctggaacgcgctctacctcgggcgcggcgaataccagcctgacccccgcaaaagcgccgaatggaatcgcggtgcctatctggtgaacggagccggacactgcggtgcctgccactcgccgcgtaatttgctgggcgcggaaaaacgcggggacaatttcctcgccggtggctgggtggacggctgggaagcgcccgcgcttaatcagctgagtaaagccccgcagccgtggaccgcgcagtcgctgtataactacctgcgtagtggttacgatgcgcagcacggcgttgccgccggaccgatggcaccggtagtaagccatctcgccaccctgccggaagccgatgtgcgcgccatggccagttatctggcggatatcaatggtcaggcagcgcgccctgtcgctgtgccggcggcaaaaccggcatggaacactgctgcgggggaacggctgtttaaaggcgcctgtcaggcctgccatagcgccagcgagggcggaccgcagttgtttggcgtcagcccatcgatggccaacagcagcagcataaccagcgcgacgccggataatctgttacaggtggtgctgcacggtatcgacaaaccggcaaccgatgcgctcggttatatgcccggctttgccgccagtttgtcggataagcaggttgcggatattgctgcctggctgcgccagcgctacgcacctgaccaaccggcgtggcagaatctgagcgaaaaagtggcgcaggtgcgcgctaatcccggcagccactga

SEQ ID NO: 103166 - DNA, 256 bp, Glycine max
  Peptide Sequence Number=SeqID_219944
atggacgatttaaagcaacgcgcgctggattaccaccagtttcccaagccagggaagctgagcgtggagtcgtccaagccttgtgcgacacaacaggatttgtcgctggcttatacgcctggcgtcgcggaaccggtgcgcgaaattgaggcggatccagccaatgcttataaatacaccaataaaggcaatctggtggcagtgattactgatggtaccgcggtgcttggactggggaatgtgggtgcgctggcag

SEQ ID NO: 103167 - DNA, 228 bp, Glycine max
  Peptide Sequence Number=SeqID_219945
atgtacagcatgtatgagtcgcagttcggtatccgcatgatccgcgctgaagagcgtattaaagcggtggctgcagatgcagaagtggccaaagccttagggctgaaagagggctatccattgcttagtatagagcgcgtgtcgtttacatatggcgataaaccgatggagtggcggttgggcttgtgtctgacggacgaccaccactatatgagcgaactggaatga

SEQ ID NO: 103168 - DNA, 1059 bp, Glycine max
  Peptide Sequence Number=SeqID_219946
atgagtacaaaaatcaacaccgggcgcttttttgaacatttcgtactgggtgaaaccatccagcacgccacgccgcgcacgatcaccgctggcgacacagcactttatattgcactgacgggcgcacgcaatcctttacattgcagcgagccactcgctaaatccctgggctatacgcagatgcctattgatgatttgctggcatttcatattgcttttggtaagacagtccctgatatctcagtcaatgccgtggctaacctgggttacgcagatgtgcgctttattcagccagtttacattggcgacaccttaagtacctctagtgaagtcatcggtttaaagcaaaactccaacggtaagagcggtgtggtgtgggtacgctcaactacagtcaaccagcaccaacaacccgtgctcagctgggtgcgctgggtgatggtgcacaaaaaaaatcaggaggctccagcccctgagaccgtgattccagagttaccagaatttgtcagccatgaatcactcgcggtaccggcgcatttcacacttaacagcgaccttggcaccgccacaggtggccagtactggtgggatgactacgaagtaggcgaatgtatgcgtcatccttccggcctgacgattaatgagagtgaccacaccatggccacgcatttataccagaacaatgcgcgcctgcattttgatgcgcacctgatgcaaagcacgccgcaaggtcaatgcctggtctacggcggcgtggtgatttcagcctgtcgtgcactgagttatgagggcctggaaaacgcgatctctatcgttgccattaatggcggcacacacgccaaccccagctactcaggtgacacgatttattgcatgaccaaggtgctggataaatggtccctgccccaccccgagctaggtgcattgcgtttacgcatggtcggcgttaagaatatgccgccagcgaccctggaaaacatcaaaaccacgcaaggctaccacccgcacgtggtacttgatcttgactataccgttcttattccacgcaaaggaaactaa

SEQ ID NO: 103169 - DNA, 1405 bp, Glycine max
  Peptide Sequence Number=SeqID_219947
atggtgttcgactcccacagcacccgctcgccgtcgatcagcaccggcaccaggccgttgggattcagtgccagaaacgccggctcctgcgtggagcgaaagccgctgccccagtcctcccgcgccagcggcaaccccagctcctggcaggtccacaataccttgcgcacgttgatcgatgaggctttgcccaataatttcagcattcgctttccttaccctctccagaacggtttatcgccttcgcgccgcgcatccgcccgcgtcaggccgatatccgccaattgcctgtcgttcagcagcagtaactctctgcgcgtactgcggcgcaacaaataccaacgccagcgtgaccagcctacccgtcgccacgtcgtcatgccatcaaacagtgccatcatctgtaccggttttttaatcctgcatcccgataagaggcctctgtatgacacgctacgccactctggccgccattctcagccaacgcattcagcaagggctgtatcccgccggccatcgcctgccttcggtgcgcgcgctgagccaggagcacggcgtcagcatcagcacggtgcagcaagcctaccggctgctggaagaacagcgcctggtggaggcgcggccgaagtcgggctacttcgtgcatacgcggcgcgcgcaggccgagctgcccgccatgacggcgccggtgcagcggccggtggacatttcgcaatgggagcaggtgctggagctggtgcgcagccggccgcgcgagggcctgatccagctggggcgcggcatgccggatatcgccgagccgacgatgaaaccgctgatcgtcgccctgcgcaacgccgcccgccacggcgatctgcgcagcctgtattacgacagcattcagggcgtggccgcgctgcgcgagcaggtcgcccgcctgctgctggattccggctgccaaatcggccccgatcagttgctgatcaccaccggctgccaggaggcgatctccgccgggctgcgcgccgtttgccaacccggcgacatcgtggcggtcgattcgccctgcttccacggcaccatgcagacgctgaagggcctgggcatcaaggcgctggaaatccccaccgatccgctcaccggcgtcagcctggcggcgctggagatggcgctggaacagtggccgatcaaagcgattctgctgacgcccaactgcaacaatccgctgggctacatcatgcccgacgcccacaaacagcggttgctgacgctggcgcagcgccacgacgcggcgatcatcgaggacgacgtctacggcgacatcgcctatcactacccgcggccgcgcaccatcaagtcgttcgacgaagacggccgcgtgctgctgtgcagctcgttttccaaaacgctggcgccggggctgcgg

SEQ ID NO: 103170 - DNA, 258 bp, Glycine max
  Peptide Sequence Number=SeqID_219948
atgaagttaattatatggggaatcagcccagaggcaatttcaacacaagtggatttccaagatttcagaacaaccaacagtatcaacagcagagacagtggcaaaatcaccctggtgggccagcttgcaaagcagttagctgaaagaccatccagcaactttacagcaaacacggagaaaaatcctaaggaagagtgcaaagctgtggtgactagaagcagaatggcgattcaagctgaggaaggaagagctgattag

SEQ ID NO: 103171 - DNA, 401 bp, Glycine max
  Peptide Sequence Number=SeqID_219949
atgcctgcgcccaggccgtagatggcctcgctgaactgcaggtcgtccagcatctgcagcttggcgaaaccgacgttgacgcggtctatccaggccaggatgaagagcaggaccagaaaagggatcaggcgccaggcgatcttgcggtaggtggcgtccatgtcgagggacgcggcctcgccggcgcctgtgctctgtgcgaggggatgtgcggcggatgccgggctgctcatggggtgtctcctgtcttcgaaagtgcagcgggcacacgggccaggccgctgggaccgggcccgtgtgtcgtgggaacctcaggcgtctggcgcttgcagcggttcctttggcggcagtatcgaaaggcaggacagggctgtccaacaagaaattatgagcaggcctga

SEQ ID NO: 103172 - DNA, 918 bp, Glycine max
  Peptide Sequence Number=SeqID_219950
caagatggcggccgacagcatcggcgcggccgagatcggtttctaccgctggctggtggcggccgtgctgttcacgcctttccttttgccgtccatctggcgccagcgcgccgacatccggccgctgctgccgcgcctcatcgtgctggggatgctgggcatggtgatctaccagagcctggcctattacgcggcccatatgacatcggccacgcacatgggcctgatcggctcgctcacgcccatgatggtgctgggcctgtccaccgccatgctgggccaggcgctgagccggggcgccgtgctgggctgcatgctggcgattgcgggcgtggccctggtggtgtcttcggggcagcctgccaccttgctcacccagggcctcaatggcggcgatgcgctgatgttcgtggccatgctggcctatgcggtctacaacatcctgctcaagcgctggcccatgccgcgcctggccacggtgcaactgctgtacctgcagatcctggtggccgtgatcgcgcagctgccgctgttcctgatggcgccgcgcacggggctgaacgcgaccaacctgccgctggtgggctttgcgggcatcatggcctccatcgccgcgccgctgctgtggatgatgtcggtggcgcgcatcgggccgggccgctccagcatgttcttcaacctggtacccatcttcacggccgtgatcgccttcatggcattgggcgagcccctggcggcctaccacgccgtgggcggcgtgctgaccatcggcggcctgctgctggccgagctgtggaagcagcccttgcgtgcgccgcgtgccgccgccaccgcatgaaaaaatcagggttttcccgagcgcaaatggtgcacgcatgccgcatgccggtgcggcgcccgcaccattgctgcccataa

SEQ ID NO: 103173 - DNA, 147 bp, Glycine max
  Peptide Sequence Number=SeqID_219951
atggatgcagaattcacaaagagatgtgtacctaagagcctacttgaatggtacacatggatgtttctcttaattagtgctttgaagggattcaacgacaatcaaggaagtaaatccaaggctgctgctagatggatcgtagttaaa

SEQ ID NO: 103174 - DNA, 413 bp, Glycine max
  Peptide Sequence Number=SeqID_219952
tgcacgatatgcttctagaggaaaacaagttgcctaaaagttactatcaggccgagaagatactgtatagacatgaatttcaagaaatgcccaagtgccctaggtgtggggtatcacgatacaaagtgaaggatgatgcggagtatagtagtcatgaaaactcaaacaagggccccccagtgaaggtgttgttgtatcttcccataattccaaggtttaagcatatgtttgctaatagagacgatgtaaaagaccttacatggcatgcagatggaagaaactgcgatggaatgctccatcatccggctgattcctcccactggaagaagattgatcgtttgtatccagatttcggcatagacgcaagaaatcttaggcttggactagccactgatagaggcaagaaatcttaa

SEQ ID NO: 103175 - DNA, 593 bp, Glycine max
  Peptide Sequence Number=SeqID_219953
atgaagcttcacgaagacacggaattcttatttcgtttgtcttattatcttgaactatatcctggaattattgaacaggcaatagcaatgagaggagtacacgaaagtaacagaattactaaagtagattccaataaaaccaagcctgcaatttcaaggactatcctctggaatgaaacttataagtgggcaaaagatgaagcaaccatatctgatgatattaaaattcatatcaagagaatgcagcgcagttttgaaattgctaatgcccctaaactaaaaaaatgggagaattacatctctcaagctgtgcaatcagctcttcagtttgaagaagtatttgaagtaattcttgtggaagataaatctccggataatgcattggtcgtttgtcaaagactggtggaagagcatgacagagtaaaattatatcagcaccctgataaacaaaatcatggtgccggagcatctagaaacctgggaatccaaaatgccacaggtgattttatcgcctttttagatgcagacgattattacttacccaatcgttttgatgcagaaaaagagctttttcaaaatcctgatgtgagggg

SEQ ID NO: 103176 - DNA, 842 bp, Glycine max
  Peptide Sequence Number=SeqID_219954
gaagcataaatgtggcaattgttaaagaattctatgcaaacctatatgtccctgaggaaaaaaaaccaaagcaagttagggttcgagggcacctgattaagttcgatgcggactccctcaacaccttcttgaagactctagtggtcttggaggaaggggagagcttaccctcttattctaggttctgcaggttgaggccagaccctcaagagctggcatctcggctgtgtatccctggaaggggattttttcttaacgctgagggcttaccgtggaagctcttgaggaaggatcttacaactctggctcagacctggaccctcatcgctgccttgtgcaaggctcgaggagtcacctcaaattctcttacctttgagtcactcagcccagccattaatttggcttatattaagaagaattgctggaacctagatgacccttcgatcatttttccaaggacccaaaaatcaagggctagaagatctgaggcccaatcttcttcagctgcccctgctccccctacttctgctttcccttcagctccaacagacccaattcttccagatgtggtccagcagcaactagttatgagcatagaggagtttctacaaaaggttgcctggctaggagtccaaccttctcctttgggagggggtgaagcctccgcagcccaggaacttcaatcataccaggaggatgactcttctgaagccactcccactccacctgagccatttatttttgaggatgatccagtgaccgcagagggcactcctacattggacttgaccgaggaggccatggatcaggacccaccaccaccacaggaccaagatcactga

SEQ ID NO: 103177 - DNA, 741 bp, Glycine max
  Peptide Sequence Number=SeqID_219955
atggcttatttggttttcttgaatggaggttggagactatggttgtccagtggagctttcattgctgtctatcggtatgcaagtgcaacaccattaccaccatctattcttagtcgcggcatcggttggcagggagttggcattctattatcaggattgtttggaactggcaatggatcctctgtatctgtagaaaatgctggtcttttggctttaactcgtgttggcagtcgaagagtggtgcaaatatctgccggttttatgattttcttttcaattctggggaaatttggagccgtttttgcatccattccacctccaattgttgccgcactgtactgcttgttcttcgcttatgttggagcgggaggtctaagttttcttcaattctgcaacctcaacagttttagaacaatatttgtattaggctactccatcttcatgggcttgtctgtgtcacagtacttcaatgagtacacagcaattaatggttatggtccagttcacaccaaagcaagatggttcaatgatataatcaatgtcccattccaatcaaaagcatttgttgcgggttgtgtggcatatttcttggacaacacactacacaagaaggaagctgctattaggaaagatagaggaaaacattggtgggacaagtaccgttccttcaagactgacacaagaagtgaagagttttattcactgcctttcaacctaaataaatacttcccatctgtgtaa

SEQ ID NO: 103178 - DNA, 417 bp, Glycine max
  Peptide Sequence Number=SeqID_219956
atggatgaagctttagacattggttctgaatcacctcttacaaatgcacttgttatttctgagtttatagcttgcttaccttctcttagtggggcaatcagggtaaacccatgggacattaatgctgtagctgatgcactgaatttggccatcacaatgcccagtggagagaaacagttgcggcatgagaagcactatcgatatgggaaaaccacgctgagtgaatggtttgatcagtgtgagactcttggtatagcagctgagcatggttattatctaaaatggagtcaacagtcagcttgggaaatgaaccatataagtactggttcttcttggaaagagattgttgaaccagtgatgagattgtatactgaggcaacaaatggctcctatatagagaccaaagagagtgccttg

SEQ ID NO: 103179 - DNA, 552 bp, Glycine max
  Peptide Sequence Number=SeqID_219957
atgccaggtcctggtcctcacctcatgtatgccatgggttctggtttgtgtctcacaagcatcagcaatggaaggttcggtccccaccacacactcttctacaccatcaacgccttctttggccctgatgttggttccttcacggagtggcttggttcactctttggtggttctgctcatgctttgggatcttcccttgaagatctcattcaccatcccttcttctacatccttcttttaggacttcctctctcttttctctattctcggatatcctcctatcttctccacacgcagcttcttgattctgtctccagagtgccccttacgaggatgcaatgctttttattgatttcagctggctcttttacccacttctttcttgatcatctgtttgagatatactggatcagtcctcctcgtccagccgttggtgaagaggccgatcttggtgttctcgtattcttagctatatactttttcctaccttatggtttgtgtataatgtccatgtccccaaaagatcatgatcctaatcagattcctctttag

SEQ ID NO: 103180 - DNA, 1716 bp, Glycine max
  Peptide Sequence Number=SeqID_219958
atggcagctcgcagtctttgcaggctactctctcgctctctctcttcttccaattcttctggagctgcttctctgcttcactcactaggaagaaaccctggagggtggagaaacattaacagatttagcacggctgcagcagttgaggaactaatcactccacaagtttcaatacgttacacacagaacctgataaatgggcaatttgtggatgctgcatcagggaaaacatttccaacatatgatccgcgctcaggagaagtgattgctaatgttgctgaaggggatgttgaagatatcaaccgtgcagtatcagcagctcgcaaggcctttgatgagggaccttggcctaaaatgactgcatatgaaagaagtcggatattgctgcgctttgctgatttggttgagaaacacagcgatgagcttgctgctctcgagacatggaataacggaaagacttatgaacaggctgccaagactgaattaccaatgttcgtgcgtttatttcactattatgctggttgggcagacaaaattcatgggttgacagtgccagctgatggagattatcatgtgcagacattgcatgaaccaattggtgtagcaggacaaattataccttggaactttcctctagttatgtttgcttggaaagttggaccagctctagcatgtggtaataccattgttctgaagactgctgagcaaactccactgacagctctctttgtagcaaaactatttcatgaggctggtcttcctgatggtgttctgaatgtagtttctgggtacggtccaactgctggcgcagctcttgcaagtcatatggatgtggacaagtgcattatatttgccagcatgattggtccagatcccatgtggttagcctgtttctgtatcaaagaacaggttggttggcagtctgtcaagctagcatttactggctcaacagataccggaaaagttgtactcgaactggctgcaagaagcaatcttaagccagtgacattggagcttggagggaaatcgcctttcataatatgtgaggatgctgatgttgacaaggctgttgaacttgcacactttgctctgttctttaatcaggggcaatgttgctgtgccggctcacgtacctttgtacatgagcgtgtctatgatgagttcttggagaaatcaaagaaacgggctttgagacgtgttgttggtgatccattcaagaaaggtgttgaacaaggtcctcagattgacgtggaacaatttgagaaagtccttaggtacataaggtctggaattgaaagccatgccacccttgaatgtgggggtgatagattgggctcaaaaggcttctttgtccagccaactgtcttctcaaatgttcaggatgacatgttgatagcacaagacgaaatctttggcccagttcagtccatcttgaaattcaaggacattgatgaagtaatacgacgggcaaataaaacacgctatggtctagcagcaggtgtgtttactaagaacgtgagcacagccaacacattgatgcgggcactgagagctggaactgtgtggattaattgctttgatgtttttgatgctgcaattccttttggtggatacaagatgagtggtattggcagggagaaaggaatctacagtcttcacaactacctgcaggtgaaagctgttgtctcaccagtgaagaatcctgcgtggctataa

SEQ ID NO: 103181 - DNA, 222 bp, Glycine max
  Peptide Sequence Number=SeqID_219959
atgtatcttgagcatacaaagcatatttacattagattggattgcattagagatgtggttgagtatggctctatgaaggtggtaaagattcacacatctgataatccaactgacatgattaacaaactaattccattggtgaagttcaagttctgtcttgacatactgaatgtaaagtcagtaggtgttgatgaaggagcagaacaagttggtggaaactag

SEQ ID NO: 103182 - DNA, 663 bp, Glycine max
  Peptide Sequence Number=SeqID_219960
atggcggaaacatgtatggctggtttatctttggatgaagacaaggaagatctggtggtcctagttgacactgctgaaggggaaggaaacaatactttcctttgtgtggttggaagattccttacttataagcctatacgtgttaaaatcatgaaggaaaggatgactgagattttgcatcccctgaaaggagtttctatcaaggaagtggaacaaggtctctttctctaccaatttttccacaagttttatgacttctgtggtagggcaaactattggcaaatacctgggagaatttctccaatatgtcgacaagaacaattcgagtttttggataaaaagatcagaagacctggaggagaggcaaaggaagtggcttttaagtatgaaagattagggcatttttgttacttgtgtggtatgcttggccacattgatgattattgtgaattgcttttctccatgaaggaggacaatggtgaacaaagatgggggccggaattacgtgcagagccaagaaatgtcgttgccagtagtggatcaaagtggctccggagagaaggtgcagtttggaaaacaccaacaaatgccccacaatcagttaccggaaatcaaagcatgggaataaatggcgatattatttccgatcaaaaaacggaatga

SEQ ID NO: 103183 - DNA, 232 bp, Glycine max
  Peptide Sequence Number=SeqID_219961
cttgcttctacaagaagaaggagtaggttggattgagaagcccaaggaaggtgaaaatgcaacaaaggcaactgaagaaaagccaataagtcctcttgagctgatgatgatgctaaaggtggacaagctcatgaggatgcacaaggaaggctatggagagctgaatgagtgttttgaaactatatcaaagagggtggatgatatgggagcatcacgtgcagatgatctttga

SEQ ID NO: 103184 - DNA, 705 bp, Glycine max
  Peptide Sequence Number=SeqID_219962
atgggtatacgagcccagttccatccaaggtctgatgataagaaaatatacttgcctccagcttgtcatactttgtctagatgggagaagatgagtttttgtcaatgtctacgccgtgtcaaagtcccacatggatactcttcaaatattaagagccttgtgcagttgaaagatataaagttagtaggcttaaaatctcacaattgccacgtcttgatgcaacaattgttagttgtggccatacgagacatttttcctaacaaagttagacatgccataactcggctatgctttttcttcaatgccatatgtagcaaagtccttgatcctatcaagttagataagctggaaaacgaggctgccattatattatgtcaattggagatgtattttcctctatgtgttcttcgacatcatggttcacttaattgttcatatgtacgtcacaaaggtttaatgaaggaaagtaatccaaaaatatcgaaaaatagggtgttgaaagagcataacaagactttcctaaattggtttaaagatacaatctttggtgacgataatgcttttgtaacattaagaaagctagcagatgggcctaaaagaaatgttataacttggaaaggatatggtataaacaagtattcattctatacgaaagcacaagatgacaagattacaatgcaaaatagtgggggtgggatcctctag

SEQ ID NO: 103185 - DNA, 252 bp, Glycine max
  Peptide Sequence Number=SeqID_219963
atgtcaggatttacacgcgattctcctcaaatttcagccagcccgcatcaattagaccttgcaccttacgcttcaaagccctacaatgctcaatggaacgcccaggggcttctccgtgacaagcacacgttgcgttcgagtcgtattctcggagaaatggaggttgatgaaccttggctagggttatggctaccattgaattatcaagtggtgttcgtcattggaagtgcggtagacagacttagtggttga

SEQ ID NO: 103186 - DNA, 444 bp, Glycine max
  Peptide Sequence Number=SeqID_219964
atgcgggcaacccaaggtgctcttattgttgcttcaactcttcaaatagtactaggctttagtggcctttggcgtaatgttgcaaggttcttgagtccactttcagcagttcctttggtatctcttgttggttttgggctttatgagttgggctttcctgggtttgtaccccatgtgctacatgcaggaaaacatgtctttgatcggttcgctgttttatttacaattgcaattgtgtggttatatgcttacctgctcactgtaggaggggcatacaatcatgctgcacctaaaacacagtcaacctgtcgcacagatcgagctggtttaatagaatctgccccatggatacgagttccatatccatttcaatggggagcacctacatttgatgcaggtgaagcttttgccatgatgatggcatcctttgttgctcttgtagag

SEQ ID NO: 103187 - DNA, 366 bp, Glycine max
  Peptide Sequence Number=SeqID_219965
atgtggagtgacatgcatgaagatgcctttatgatcaagtcagaaagtgaggggcatatttttagttcattgtgggttcttcattatctctatatgctcttgatgaatttcaagtgtggaaagagaatcaactggagtcacccttcaaaagtccctcgtcttcgtcttcactctagaaagaaaaatcacagactgaatctttcctacgtagatcctgaccgaactaggacaaagtaccataaaaataccgtggacaattttttgcttaaaaagacgccgattaatatagtccatcgtgcctttttaatttatttttacattggtaatgcatgcatccttatcccaaaaggccaaaggtgcgaataa

SEQ ID NO: 103188 - DNA, 534 bp, Glycine max
  Peptide Sequence Number=SeqID_219966
atggctgcaacagcttcaaggttcatcaagtgtgtgacagtcggggatggagctgtaggcaaaacttgcatgctcatttgctatacaagcaacaaattccccacggactatattccaacggtgtttgataatttcagtgcaaatgtggttgttgaaaacacaactgtcaatttaggcctctgggacactgctgggcaagaggattacaacaggctgaggccattgagctacaggggggcagatgtctttgtcttggctttctctttagttagccatgcaagctacgaaaatgtgttgaagaagtgggttcctgaactgcagcattttgctcctggtgtcccagtggtgctagttggcaccaaattggatcttcgagaagacaagcactatttggctgatcatcctggtctggcgcctgtgacttctgagcaaggtgaggaattgcgtaaactggtcggagctacgtattatatagagtgcagctcaaagactcagcagaagcattgtagcacattgtcaccagtgcattactga

SEQ ID NO: 103189 - DNA, 4284 bp, Glycine max
  Peptide Sequence Number=SeqID_219967
atgcagccaggtggtcgatctcctaagccagtgagtagtccaacatcaacatcacagctaaaatctggttcagatagtgtccagaacagtgtttcttccttttcttctcatgttaagggtaggaaaagggagagagtagataaagggcaagaatctgtaaagcgagatcgttcaaccaaaattgatgatggagattctggtcattttaagcaggatagcattttgaagacagagattgccaaagtaacagaaaagggaggccttattgatactgaaggggttgagaaattagtgcagctgatggttccagatggaaatgagaaaaagattgatttagctagccggtcaatgcttgcagctgtaattgcagcaacagataaatttgattgccttagtcggtttgtgcaactaaagggtttgcctatatttgatgaatggctccaagaggctcataaagggaagattggtgatggtcttgggtctagagatggtgataaatctgttgatgactttctttttgtattactccgagcgctagataagcttccagtaaaccttcaggctctacaagcttgtaacattggtaaatctgtgaatcatttgcgaactcataaaaacttggaaattcagaagaaagcaaggggcttagttgacacatggaaaaaacgtgttgaagctgaaatgattataaatgatgctaggtctggttcagttcagactgtcccctggccagccagacaacggctttctgaagttgctcaaggtgggaataaacattcgagtgggtcagctgatgttgccatgaagagctcagttacacagctttctgcatccaaaactgcctctgcaaagattgtcccaggagagaatacaagatctacatctgcatctccagggtctacgaaatcagtgccttcacctgcacccgcaactgcaaacttgaaagatggacagccctgtgttgccactgctagtggttcctttgatcttcctgtggcaaatgcaagggatgagaaaagtagcagttctagtccatctcacaacagtcaatcttattccagtgatcatgtgaaagctgggggtctctcaggaaaggaggatgccaggagctctactgcaatgagtgtgaataaggtatcgggaggctcttcacggcaccgaaaatctatgaagggatttccgggttcaactccatctagaaggcaaagggaaactgggtcgaggcagaattcctcacacaaaaatttaatttctgagaaaatatctcaatctggattaagggaaaaagcaaatgatggaactactcttgaggggcatactccgaagctgattgttaagatccaaaaccgaagtcgaagtcctgcacaaagtgccactgcaggttcttctgatgatcctgcaatcatgaacagtcgagcttcatctcctgttctttcagagaagcacgatcagtttgaccgctgctcaaaggaaaagagtgatttttatcgagctaatattggtgcagacatttatacagaatcgtggcagagtaacgatttcaaagatgtattgactggttctgatgagggtgatggatcaccagaagccattactgatgaacagtgtaggactggtgaggattgtaagaaagtattagatgtatcaaaggcagcttcatcatcatctgggaatgaaagtagagccaggaatttgcaggatgcttcttacagctccatcaatgctcttattgaaggtgttaagtacactgaagctgatgatgttggaatgaatcttcttgctaatgtggctgctggagagatctcaaaatctgaattgggaatgccagttggatcccctgaaaaagacaccactactattgaacagtcatatgcaggtgatgctgcagtagtcaagtcctctgaagagtatcttgttcaggataagtgctacactaatgttgaacattcgaagcaggattctagacctggtgatttaggggcagatgatgatattcttgcatctgaagggaaagctacaggagaacacaatacatctagtatggatttatgggttactgaaactagtttagaaagcaaaggaaaattaattgaaaaatcatctggtacatcatctgctggcattcctgaaagcaccattcaagaagtccgagatagtgactctagcaaactggtaaaggaaaagaaggttgttgtgagagtggatgcagttggtaatgttgatgttaaggtcaatgttgttgcaagcgaaagtgaaacagaggcaattgaaaatttttcgtgcacctgtgaagtagttgatgtcaagtgtgataaccgtgcttctgaaggactaagcggtgacaaagagacagctggcaagtctcctgccattcgcatgtcgtctgactatgtaatagcaacagatgagaatgcaccccaatcatctggtgacattgttgataaggttcttgaacacgtaaatgaaagggaatctgaaaaaaatgatgatatggttgctcaggatcatgctaaggagtccataaagcaaaaaaatgagtctgaaaatgatgctattatggtgcccaagaacagaggtttatgttcaggtgcgactggtcttgatgctgaatacgtggaagagaattcaggtacaaaagaggtttgtgaccaagttgcaggagcaggacagatagtgcacacagatttacctagctttccttcacgagaaatggatcagtgttcaggtcataaggattcaaaattgactgccatggaatcagaggaagcagaggaatgcacctctaccactggagatacctcttctgcgtctgttgctggtgtctcagaagtggacacaaaagttgaatttgatttaaatgaagggttcaatgcagatgatgggaaatgtagtgagatgcctgggtctacacctgctgcaagattggtcagtcctgttccattttctgcttcatccatgtcttttggtattctctcgatcacagtagctgctgctgcaaagagcccctttgtggcacctgaagatttattgaaaagtaaaaaggagcttggttggaagggatctgctgctactagtgcatttcggccagctgagcccaggaaagttatggaaattcctcttgatatgtcaactacccctattcctaatgatgaagctagaaagcagagccgggcaccattggattttgacttgaatgtttctgatgaagtaatacttgatgatgtttcttcccaaaattgtgctcgtcagactgattgtggaactcattcagacaatgggcatgatccaaataaatcaatggcctcacatgttagttgttctggaggtttaggtcttgacttgaacttagtggatggagcttctgatgtgggtaactgcaccttaagtagtagtcataaaatggatgtaccacttatgcaggtgaaatcagcagccagtggtcctccaaatggagagatgagtttccgcagggatttcgatctgaatgatggacctgtagttgatgaagtcacctctgaacctttgatgtccacacaacccgctaggaatagtgtaccatctcaaccacccatttctggacttaggatgagtaatgcagaagtaggcaacttctcttcatggtttccttccactgcgaacacctattcagcggtaacaatatcttcaattatgtctgatagaggtgataggtccttttcaattgttgcccctaatgggccacaaaggatgttgggtcctgcaactggtagcaatccatttggacctgatatttataagggggcagttttgtcttcttctcctgcagtgccatatcaatctgcaccatttcagtatcctgtcttccctttcaattccagctttcctcttccatcagcatcattttctggtggatcaactccttatgtagatacaacttcaggaggtaggctttgcttccctgcagtaaattcacaacttataggttctgttggtaatgtttcagtccattaccccaggccttacgttgttagtctcccagatggtagcaatagtagcagtgctgagaactgtaggagaaggacaaggcagggtttagatcttaatgctggacctggttcaaacttagaggggagagatgatagctcacctcttgtaccacggcaactttctgttgctagttcgcaggcccaacttgaagagcaagcacggatctttcacttaagcagtgatgttcttaaaaggaaggaacctgatgggggatgggatggctacaagcaaacatcatggcagtaccataatttgtaa

SEQ ID NO: 103190 - DNA, 1686 bp, Glycine max
  Peptide Sequence Number=SeqID_219968
atgggagataacaaacgtaagagaggacgcaaacccaaaacccccgccaccgaaaccctagaccaccccgccacctccccaagctccaccgccatggacgacgtcttctctgtcggcaacgtcgagctcatcgacaccacggcctctccccaccaccgccgcctccgcggccgccccaacaagccccacgctctgcccccggggcgccgccacgcccgccccctcgacaccaacggcggcggggacttctcggtccccggcgacgtcgtcggggtgtctcccgccgtgtcgacggaggcggacccggcagcgtgggaggcaagggtgctgccggcgatggactcggtggtgaagaggaagaggcaatacagctcgagcagcagcgggtttgtgattggcgggagaagggttctcaccaatgcgcattccgtggaacactacacgcaggtcaagctcaagaaacgtggttctgataccaagtacttggccactgtgctcgccattggaaccgaatgtgatattgccatgcttacagttgatgatgatgagttctggcaagggatgtcacctgtagagtttggggaattgcccacacttcaagacgcagttacagttgtgggctacccaattggtggagacactatctcagtgaccagtggtgttgtatcgcgcattgagattttatcttatgtccatggttctacagaacttctaggtttacagattgatgctgctataaactctggcaattctggtggacctgcatttaatgacaaaggaaactgtgtggggattgcatttcagtccctcaagcatgaagatgcggagaatataggttatgtcattccaacgccagttatcatgcattttatccaggattatgagaagaatggaggatatactggattccctattcttggggttgagtggcaaaaaatggaaaatcctgatctgcgaatggcaacgggcatgaaacctgaccagaaaggtgtgcgtattagaagaattgatcctactgctccagaatctaaggttttgaagccatcagatgttattcttagttttgatggggttgacattgccaatgatggaacggttccattccgtcatggagagcgcattggtttcagttatctcatatcacagaaatatactggggataatgcagcaatcaaagtactgcggaattcagacattttgaaatttgacatcaaacttgatagtcacagaaggcttattccagcacacagcaagggcaagcctccctcatattatattattgctggatttgtttttacaactgtttcggttccatatcttcgttctgagtatggaaaggattatgaatatgaagctccagtcaagcttttggataaactgctgcattcaatgccacaatcaccggatgaacaacttgtcgtggtctctcaggtgctggtggctgatatcaacattggatatgaagattttgtgaacacccaggtccttgctttcaatggtcaaccagtgaaaaacctgaagagcttagccactatggtagagagctgcaatgatgaatatctaaaatttgatctagattatgatcagatagtggtgcttcgcacgaagactgcaaaagcagctactcttgatattctttcaacacactgtattccatcggcaatgtctgatgatcttaagtcatga

SEQ ID NO: 103191 - DNA, 363 bp, Glycine max
  Peptide Sequence Number=SeqID_219969
atgggagtgagaagcaatttggtggaatggagtccattcatagcaatggtgactgtggagtgccttaacgtggggctgtccacgttgagtaaagcagccatgtcaagaggagtgaaccacttcgtccttgttgtctactccaataacaaggccatccctttctttctcgcttctctgcaagttcttcctcctcggcattctaggatttgcagcataactgtcatgcagaattgtgttttcatcggcattaactacagctctcccactcttggatccactatgagcaatttgtctccagcaatcacttttgtgctagcggttaccctcagaactgcggcacaacaagatacggagaaatgctga

SEQ ID NO: 103192 - DNA, 405 bp, Glycine max
  Peptide Sequence Number=SeqID_219970
atggagaagttgaatattggaagctcaataagccagatcaaggtcatgggcacagtgttgtccatcgctggagcattactcgtgaccctttacaagggaagtcccatcatcagctttcgaactcaaccctctccatcacaaccattgccatctttgttggctgcaaccagtaactgggtcattggaggtctcttctttgccactgccgcattttcgactgttgtcttccttggtgaaacactccatgttggcagtgtcattggcgcagtggtaatcgccattggattttacacagtattgtgggcacaatcaaaagaggaaaatgcaaaaggcctacaggttgatagactgtcatccccgtctgcccaagcgagtcctctactagagacagtcccaagaaagtaa

SEQ ID NO: 103193 - DNA, 481 bp, Glycine max
  Peptide Sequence Number=SeqID_219971
atgagtgattatgcagtggagactataaatgatggactcaatgagttcaatgtggagtttcatggtccaaaagaaagcctttatgaaggtggagtctggaaaattcgtgttgagcttcctgatgcttacccgtacaaatccccttctattggctttgtgaacaaaatattccacccaaatgttgatgagctggaaatgatatttcttagaagtatcaagtcacagaaacaacttgctattggttggtgttttgtgtgcacatggattatgactgattctgctctgtacggttcatcaactgcagatctggctctgtatgcttggatgtcattaaccaatcttggagtccaatatcttctaaatgtttttgaagtttttcttccccaactcttgctttatccaaatgcttcagatcctctcaatggtgatgcagcatcgttaatgatgaaggataaaaagctatatgaccagaaagttaaag

SEQ ID NO: 103194 - DNA, 960 bp, Glycine max
  Peptide Sequence Number=SeqID_219972
atgcgcagcattaatggaaacttgaagtactcatcatattatcctcaatctcccaacgacgttaacatgagcagcagcaacaataaagaagcaacaacggcatcatctctcagcagaatcagtccactcattctactagtcataatagttctagcagttatcttcttcgtctacgggctcgtccatttgattctatggtttttcatgaaaagaccattatcaccttcatctctctacaactccaacaggttccacgaatactccacgcgctcccgtgttcttctccaaaggcagcttcagcaactcttccgcttgcacgattcgggtctcgaccaagccgtcatagacgctttacccgttttctgttaccaggacttgttggggtcgaaggaaccgttcgattgtgccgtgtgtttgtgcgagttctccgaggacgacaagctgaggttgcttcctatgtgcacgcacgccttccacatgaactgtcttgacacgtggcttctctccaattccacgtgtcctctttgcagggcgtctctttccgagtacatggagaatcagaatccaatgtttaatgttggcaattccagttctttggttttgccaaatagattcagggttgaagaagagaataatgggtgttcagatagtcaaagggtgttttctgtgaggcttggaaaattcagaaatggagaggtgggaggggacggtggttgtagtttgagtgagaggagatgctactctatgggttcgtatcggtatgtggttcgtgatttgaatttgcaagtcgtgttatctcattctcaatctcaagatgatgatgatgatgttttggaaaatgggaatgtggaggggaagaggataggggactcaaccaaaggtgagagcttctctgtttccaagatatggctttggtccaagaagaccagatttcatggttctaatgcacctttcccttga

SEQ ID NO: 103195 - DNA, 3363 bp, Glycine max
  Peptide Sequence Number=SeqID_219973
atggggacgacaacgacacccctttcccacacggttcgcgtgtccaacatcccccaatccgcgaccgcgaaggacctcctcgacttcctcgaatcgacgttgggttcctccacggtgttcgccctcgaaatcttctccgacaaccccaactggaagtcccgcggcttcgggcgcgtccagttcgagaccctcgacgccaggtcccgcgccctctcgctctcccaactcaaccagctcctcttcaaccgccacttcctccgcctctccgaaaccgactccgacatcatcttccgcccccaacaccgcctccaaaacggcgtcctctacgccggcttcatgctatccgaccaccgcatgagcgtcctcgaatcgtgggagggcattgcggggtgggtcctgccccaaaggaagagacttgacttctgggtgtggcataatggtgactgttacagactcgagtttttgtttgaggatattttggagtctcatggctattgtttgggagaagatgccagactcaatgcccttctcttgaagatgaaatttgggccaaggatttataagaaaaagacagggacagatgtggcagccaattttaggggtgatagataccgttttctgaaggaggattttgaatttctttgggtgcggactactgacttctcgcctctcaagtcaattgggcactctacttcgttttgttgggaaattgtggaggaacatttagcttcggatgtttttacaagtttcccactctacaaggaaaatttgagagatctggctctggaagacagagaagaactctgttctttgacagaagcagttccgcttgtaaaacatgctacgcaatccaagttaccttatgaggctgttttccagctgaattctcttgttcatacccagaaaataagtcttgcttcggtggatgatgaattgattgacttgttagcagacttagatgaagaaactagagctgtggtttttcagaaattgcacaagatgagcttcacttgttatgagcctctcaaatttgtcaagactcaattgcatgtgctgagtaacaagaaaaaaggtctgctgcaatcgccgcagaataggctgacagatagtaatattatgagctgtcatagagccttgattaccccgacaaagatttattgccttggtcccgagcttgaaacctcaaatcatgtggtaaagcactttgcttcacttgcatcagacttcatgaggattacctttgttgaagagaattggaataagcttccaactaatgcagtatcaactggtgtgcaaaagggaatcttttcaaagcctttgaaaactgaaatatataagcggatattgactattcttcgagatgggatcgtaattggctcaaagagatttgagttcctggccttctctgctagtcagctgcgatcaaattctgtttggttatttgcttctaatgacaatctgaaagcagcagatatcagagaatggatgggatgcttcaacaatattcgcagtgtttctaaatgtgcagcgaggatgggtcagttgttcagttcttccatgcaaacttttgaagtggcctctgaagatgtggagatgattccagatattgaagttacttctgatggtgtaagctactgtttctcagatggtattggaaaaatttcccaatgttttgctaggcaagttgctcaaaagctaaacttggatcatactccatcagcatttcaaattcggtatggaggatttaaaggtgtcattgccattgatcgccattcctttaggaagttatcattgcgtagcagcatgcttaagtttgaatccaataataggatgctttgtgtcactaaatggagtgagtcaatgccttgctttctcaatcgagagattatatccctgttgactacgttaggagtaaaagatgaggtacttttggcaatgcaacaggaccaattggatttgttaggaaggatgttgactgatagtaaagcagctttggatgttttggaaagtttaaacggagctgattcaaagagcattctagtgaagatgttgcatgaatttaatgagccaaacagtgagccttacctatcgatgatgcttaaggcttattatgcataccaattatctgacttgaaaagtagatgccgaatatttgttcccaagggtcgggtcttggtaggttgcttggatgaaactggtcttttgaattatggccaagtatttgtccgcataaccgtggcaaaaactagggaaaattttggagatgaaaacctaaggaaagtggatggggatgatagcacacgtataatagtgggaaaggtggtggtcacaaaaaatccttgtcttcacccaggagacatcagagtccttgatgctatctacagtaaagaattagaggaaaacggtttgagggattgccttgtatttccacaaaaaggacataggcctcatccaaatgaatgctctggaggtgatcttgatggagatttgtttttcttaagttgggacaaagatctaatcccatgtcaaactgaggctccaatggactatacaggaaggaggcctcgtataatggaccataaggtgaccctagaggaaatccaacaattctttgttgattacatgatcaatgatactttgggtgctatctctactgcacatctcgttcatgctgaccgtgaacaagataaggccaagagtagaaaatgtctggaattggcagagcttcattccatggctgttgactttgcaaagactggagcacctgctgcaatgcctagagttctgaaaccaagagagtttccagatttcatggagagagttgacaagcctatgtacatctccaagggggtactgggaaaactttatcatgccataattgagtcacaaatgcaaataagatatagctttgtgtggtcagagaagcatgctgaagaagcatatgatcgtagccttgaagtgaatggttttgaggccttccttgagacagcatcaactcacaaagaaatgtatgcagagaagatgagcagtttaatggacttttatggtgcagagaccgaggatgaaatgctacttggtaacgtgcaaaaccgtgcttcatatttgcagcgtgataacaggagatatggtgatatgaaggatcggattctgctctcagtgaagaatcttcagcgtgaagctaaagaatggtttgaaactagttgccaaccgcgtgaatataagcctatggcatctgcatggtatcatgtgacctatcaccgcagccattattgccaggaaagcccatgttttctaagctttccatggatagttggtgacattttgctgcaaataaggtctgtgaactcctttgttaacagatga

SEQ ID NO: 103196 - DNA, 291 bp, Glycine max
  Peptide Sequence Number=SeqID_219974
atgttggagggggaagtaagagagtgtgatgatccttatggctttaggaatgatgtggttatcaaatgccattatatgatgacggtgccttcagattctaattgttgcacgaaattgttaccacggattacattggtacttatatgtaataatggtaaaatgtggaacccggagaagaagcctgagattgttataagcgatccattggatatgactgtgtcattagaatggtatgataatgctgtgaatgtatcacgtaaaaagggtgtacgaaaaaataaattgacgtga

SEQ ID NO: 103197 - DNA, 669 bp, Glycine max
  Peptide Sequence Number=SeqID_219975
atgacgatgtcgtcaaatctagacggtggtggtagtgtcggaggtgacccattggaagaggaggaggttgggccaggcgacggcgacagcagaaaaacagtgtcgcagagctttttggtgatggagttcaagataatcaaaattttcatgacaaatccacccacacatggacacgcaacaactccaacctccaaacttcgcctcaaacctctctcttctcccttttcaaccgccctcgaaaccctccagaaacaactcgggtacaccttcaagagcatcgatcttcttcgtcgcgccatgacacacgcttccttctccgaagaaaacaacaaagctttcgccattctcggcgccagcgtcatcgaaacctccgtctctttccatctgctctccagagacgttgatctttcttccaaagagctgaaccgtcgattgtcccaaatcaccaacgtcgattcctcctgcgccgtcgacggaacgcgattagggttgcacaaggtggttcgcgtctcgcccaagacaaattcctccgcccccgccgtcgtttgcggcgccttccgagcaatctttggcgctgttgctattgacaccggcaagtccgatgacgcaggcaacgttttctggaaccttcatggcggtggtgacctaggagttgccgtggctctttga

SEQ ID NO: 103198 - DNA, 396 bp, Glycine max
  Peptide Sequence Number=SeqID_219976
atgggaggaaggaagccatatcttttctctaggttctatccttccacgacaagagtttgccaaggtagtgaaaaatctcagcacaagagttggatccaggaaagcccggtcgtcgccattttggccatgtatgacacgttcgaccggggatgtgaaaagagcgacgcaagaattgtttgttgtgcactggctctctatgtgtggctggtttcacacctttttctccaacaaggtaggcccgtctatccgctacaacgtcaccgctcgcgcgtcaaacaaggaaaggcgaattgggaccaactcttggctagcatggaagggcgtctgttaattggttctctcgctagaaggaaggaagaatcaggattctatcttcatgcgaaggatgtcccatga

SEQ ID NO: 103199 - DNA, 177 bp, Glycine max
  Peptide Sequence Number=SeqID_219977
atgagtgaacagttttctcctttggttgccatagcccagaaccctggtaaaatccgtgatgatgctcttgttgacttttgtggcaagctgttgcatcatttcttggcatgtctccatatcattttgaagtacaagtgtggctacttctttaggaagaagtcatgcaacgagaagtga

SEQ ID NO: 103200 - DNA, 225 bp, Glycine max
  Peptide Sequence Number=SeqID_219978
atgacttctagaagaatgtgtcttcaatcagtcaaacttggacttggacatgctttgaagaatgttgctcttgaattcaccaagcttgtgttgcatgagtgtaaaactactacaaatatgattgagcagtttgctactttggctgccatagcccagaaccctggtaaaatccgtgatgatgatgttcttgctgacttttgtggcaagttgctacaccatttctag

SEQ ID NO: 103201 - DNA, 156 bp, Glycine max
  Peptide Sequence Number=SeqID_219979
atggggaatgttctcagcatcgacaccgaggagcttggtttccttgtggaggcgatcgagcgtgaaggagaggagtttggagatgtaggccagaaaaaatttactgtacaatttggagcaatcaagttgacaaatttgagaggaaatctactatga

SEQ ID NO: 103202 - DNA, 257 bp, Glycine max
  Peptide Sequence Number=SeqID_219980
atggataaggttcatcagagactaagtgcgtggaagtcaagaactctatatttcgagggaagagtcacgccagccaagtttgtgcttcagccactgcctacttatataatgcaaaccacttggctgcctaaatcaatgtgtgatgatattgacaagacttgcaggaaattcatatggggtgacactgagaatagcaagaagtttcatttggtctcctggggtacagtttgtactccaaaggctaaaggagaactggg

SEQ ID NO: 103203 - DNA, 351 bp, Glycine max
  Peptide Sequence Number=SeqID_219981
atgaagacctgcaacttctctatggatcaagctggtgaggaaagaaagttgcaactgagtgatttagatgagatctgcctagaagcctatgagaatgccaagttctacaaagaaaagaccaagaagttccatgatagcatgataattaagaagaacatcatggttgggctaaaagtgttattgtataattctaggcttggactcatgagtgttgagatcaaaagcgactccacaaacaagagctttaaggtcaatggacaccgacttaagccattcctcacaaacccttctttagtggacgtagttgatggaagcttgcttgtggggcttctatggaggctggatctttga

SEQ ID NO: 103204 - DNA, 678 bp, Glycine max
  Peptide Sequence Number=SeqID_219982
gtcgactctagaggatcccacattcgtcaggataatgagccaccggcggtcaaactgccctttttcaaagccctgaaaaccgtctccagaaacaagcgtttttacggtatcgccattcccgcttttatggctgaaccggcatggggcgtgttgagtttctgggtgccgctctatctggcaaaagacctgggaatggacctgaaacagattgccatgttcgcctggctgccgttcctcgcggcggatctcggcagtgcagccagcggctacctgacgcgcatctatacccggctgtttggcttcaggcaggtaaattccgttgtcgccagctcggtcaccggcgcctttctgatgctgtcgctggcgctggtggcgatgaccaaagacccctacgtcgcgattgccctgatctcgattggcggttttggtcatcagatcatttcctgcatgttgagtgcgctggtggtggaaaaatttgataagggccaaatggccacggtgaatggcatgcgcggctcgtttgcctggatctccagcttcctgttttcgctggtgattggcgtgacggctgacaaaatcggctttaacccgctgtttgtcgccatgggcttctttgacctgatcggtgcagtcttcctgattgcgtttattgctgagcgtcgttcagcgacccaatga

SEQ ID NO: 103205 - DNA, 1029 bp, Glycine max
  Peptide Sequence Number=SeqID_219983
caggcagggtttgatgttggccgccaggcgcaggccggcatcgtgaaacgcctgactcatcgcttctggctgcggcactttgtcgtagttccagttgaacacatagcgcttgttattgatggaggtatagcccgaagagagctggaaggagtcgcacggaatagcgtgctcttcgcacaggcggatgaagttcatcagttggttttgcgcgtccggcgcatcggtgtagtgcatggtcgagccgctgtatcccagactccatttggggccgaacagcgttttgccggtcaggcgtacgaaggttttggtgatatccagcacccgcttaccgacaaacaggtagtaatcaatatcgccactctccgcctgccagcggcgatacggctggtgatagttatccagctcgttacccagatcgaaccagctggtgctgaggttatcgtagaacaggccaaagctgacgtcgttacgccgcgtgagggtgaagggcacatgtttgtagagcggatcggtggaggaggcgttgtaacccatagcatccagattacgcatctcatagcgtttgccgttgcgttgcagatcgccggttttttcgcccagaccgtagtagcggtcgtccgccatgcggcgctgatagtgtgccacgccgtcgccgtgtgcgttgatctgataggcgctggtggggcgatcgccggtcagcagttgccagtggcctgcggcatcacggtactgccactccagcgccagcggctgacgcaccatcacgcgcagcgtgtcggtgctaatggtcagacaactggcttcttcctccagcgtaaagccgggcaggctaaacccggccaggctgtcgcgcggacgcccttcccatggaacatcctgttccggtgcaatgctccaggtgcggtccagactgtagttgccgtggcgcttgatcaccacgcggaacagacctttttccagcacgtacaggcacagatggtgtttgccatcgacgttaagcaccacatggtgatgatcagaatgggctaa

SEQ ID NO: 103206 - DNA, 1149 bp, Glycine max
  Peptide Sequence Number=SeqID_219984
atgacaaaagacacaaagtttgggttagcgcttagcggaggtggtgccaagggctttgcgcatctgggaattttaaaaacaatagattcactagggattaaaatagattatattaccggaaccagtatgggtggaatcctcggcggattatatgctatgggatataatggtgaagaattgaaaaaaatggtgtacggcatgaactggaaaaggatcctgagtaacaaaatcccctacaacaaggtcaatatcagcgaaaaagatgagtacaataaatatattcttgaatttccggtaaacgatggccggccttccctaccgggatcctttatagaagggcaatacatgggtgaagttctcaatacattaacgtttcctgcaaaacatatcaacgactttagtaaacttcctattcctgttcaacttacatcatccgatattgtgaatggtggattggttatgcagaaaaaaggttctcttgcactggcgattcgttctaccttagccatacctgccgctttcgcaccggtctatattgatggaaaacttcttgtagacggtggcctcgaccgtaattttccggtaaaggaagtaaaagatatgggagctgattatattatcggaggctatacaggattcaggcttttcacaaaagatgagatcaaaaatccgatgaaaatgatctatcagacacatgcattccattccgtacaggatttcaatgaacaaaagaagatgtcggatatcatggtggattttgtaactccgcttaatgattacaccactaaagacttcagaaaatacaaggaaatcataaaaataggagaagcagaagctaaaagacaccttcctgaatttatagccttagccaacgagcaacgcagactgggaattatttatgagcacaaacttgttgaagaggttaaaaaaccgaccatacagtttacttatagtgaagataatggtacaccgatcactaatccgtccgagattgaaactattaaaaacctgatgggattaaaggagggtgtatattacgatgccaaaactgtaaatgctgctatcgacaaggtttttggaattcgacaattcggaaaacggtttaattatgaacattttcgtaaagagatccacaccaagcatgcttaa

SEQ ID NO: 103207 - DNA, 210 bp, Glycine max
  Peptide Sequence Number=SeqID_219985
atgaggtcgagcttaatggtcatggtggatagattttgggtaaggctgcttcaaggcggtccatggaggtctggtgactgttgtgagcggtcatggttgaaggttgctagaggtccaccaaatacacgtggcaccccacctggcactaagatacatgcgtcaaccctccgtgtcagccctggcataggagcacggacatccatcccttag

SEQ ID NO: 103208 - DNA, 825 bp, Glycine max
  Peptide Sequence Number=SeqID_219986
atgccgactccgcctcccatggttttttcccaccttcatcctaggtggccaccactattgctgttgcaacctctaaaacccgctagccaccaccaaccaatggtccttttccatttgttatcgtgctcacacccgtcaccaccatctttattcatagcttattgtgacattgtgtggcatctatttgatggttgggtagctgatgcatgccaactatgtgatgatacaggttgggtaacagttgtgacatttgtgtgcacctttaactggaggttctattctggtgctacaaggagcaaaaatttgacacatgcccaacaaaatccacatgaaaggcataaacatcatcctgcattccatgattctgcatttcccaaaaggaagttggggtgggagtttctggtggtgaggaaggctttcaaatacatggaagatattcttctgaaggtggtagctcaagtccctaacagtggtccttgtgtgacttatattggtaaatgtggttctagtaaatttatgaagatgatccacaatggcattgagtatgctaacaggcaattgattgcagaggcctatgatgtgttgaagtcagttggaaagttgtcaaataaggaactacaaagtgtcttcttagaatggaacaagggagaacttttgagtttcctaattaaaatcattgcagatatatttggaattaaggatgataagggagatggatatcttgttgacaaggtcctagacaagactaacatgaagggcattggtaagtggactgttcaacaagctgctgaattatcaattgttgctcctactattgaagcataa

SEQ ID NO: 103209 - DNA, 738 bp, Glycine max
  Peptide Sequence Number=SeqID_219987
atgggggcggcagaaacgtctggtaacagggacgaatttgtcatacatgaagctagggtaccaattttgggtgatgttatcgatgctgacgatggcggcattggtgttgcagtgaaattgaagcatgtccttgacgagatcaacgatgatgacaccagtgctgtagcccatgtcaccaagattgaagcttttgatgttgtcacagagcttgtacttgttgaccatcatggcagagagggaaggggtagggttgaagaggctagagttgatgacgaggactctgatgtctttaagcttgtcgttggtgttggagaagaggttgtcaagggcgccaaacatgacctgctcggcctcttccctagcggtggccttgaaggggcgagtagggatggagtgcatggcttgggggacgtaggtgtgttcacaaaggccgaagcagaggagaatcttgcgttggaagtcaaaggaggaggggaggaagttgccgatgagggtggagtggtccatgaactggccaaagaggacgcgaaggtgctgagggggaaggtagcaagagtggtccaggagatagacgaggtgggcccagaggtgttggatgtcgtggcctttcatctaggaggcttggaggagaattatggacatgagagggagaaggcaatatgtgtgacatcaagtattgttaccctagcttcatgttctttcattaacggtaacgggcagaagttaactgatggataa

SEQ ID NO: 103210 - DNA, 231 bp, Glycine max
  Peptide Sequence Number=SeqID_219988
atggcaaaaggtgcagaagacgaagttagtctctgcgcgtcaatgggctcgattgccccctcgttgacgaaaggtgcagaaattgaccgtgcgaagaaattacttatgtatctccgcacgtcacctgacttcagggtcagtgtaacagaaagcataaaagacgacgtaaatctccgcgtgtcaacgagctcgttggctgcgattgacaaagggtgcagaagacgacgttag

SEQ ID NO: 103211 - DNA, 855 bp, Glycine max
  Peptide Sequence Number=SeqID_219989
atgcaggctggttcacctcacatgccaactttcttttccaccgtggaagtagagggtgtggaatttcatggaaagggaggtagatccaagaaacagtcagaagagaatgctacaaaaattgcttacattgcattaaaagagtatgaacttttggaccttgacttgaatgagacatcacttgctaatgtcaaagttagcaatgagatgcacaatccaccttttatacagtcacctgaggaagagatgatgatcaacaggagctcgtcttcttgtgaaccggtattcggttcttcaccaaaatcatctccactttcacaaattgatgtttcttgggaatccaagaggtacaataatatacccagaggacaccatcatttgacaacacagaagaaacaggagattagggaagcctttgaattattcaatactgatggctcaggtactattgatgccaaggatctgaatgttgccatgagggcccttggatttgaaatgacagaagagctcattaatcaaatgaaagcagatttggacaaggatggaagtggagcaattgattatgaagaatttgagtacatgatgacaaccaaaataggagagcgggacagtaaagagggaaagatatctgcatcagacatcaagtgcattgcgaaagagccaggtcaaaatttcactaacagagacattcaggagatggttgacgaagcagaccaagatacgagggtctgccgtgccgtcgtcaaggtcgcttccaagattggtagtggtagaggcatcgacctcaacaaagatgcaatggttggcattggagagcatggcacgaagatctttgttttggcgatggctacactttag

SEQ ID NO: 103212 - DNA, 627 bp, Glycine max
  Peptide Sequence Number=SeqID_219990
atgttggacactgttcccatcttcgtaaaccctaaatccccttttatatatgcagttggcgaagaagcgagccgacaaccgcgctctgatcggcgagtccggagcggtggcgactctaattccgctgctctggtacagcgatttgtggacgcaggaacacgcggtgacggcgttgctgaacctgtctcttttggaagagaacaaggcgcttataacgaatgcgggtgcggtgaagtcgctaatatacgtgctgaaaagagggatgaagacttcgaagcagaacgagacctattagctgagctagctcgaagggaaaaggaagctgaaatatttccagaggcagaacttgaccttttcatgaaggcagttcgcattatcctgacaactgataatgatccactaggtcaagctttagcggaagagctggcacggcgccttgggcgagaaaggttgtatatcctgtcatctagtgaccatgtcaaacagtctgtttgcaatgcttttactgatatggaaaacccttcaccttgtaagtgtttacctgatggctccaaaagggttcgggttcctcatttagttaataccaagagcgaagaaggcatagttattcttgaagaagctcaatga

SEQ ID NO: 103213 - DNA, 336 bp, Glycine max
  Peptide Sequence Number=SeqID_219991
atggccgttgacatgggaggtatgatatttaatctggtttttgcatatttctttgcgctaatcttcgttttaacccttaggtacccatacgtgactggatcctctgtagtcgctatcaaatacaaagatgggattctaatggccgctgacatgggaggtcaaatatttaatctggtgggttcgagacggctggagaaggagttgttaaaatttgtcgggccctctttatattttggaaatttttgttgtgcatggaaggtgcaagatgtggaatctgaatgtaaccataataatgacgatggtgcatgtgaacaatttgaatatttagtaatataa

SEQ ID NO: 103214 - DNA, 1506 bp, Glycine max
  Peptide Sequence Number=SeqID_219992
atggaccaaaatatgttactatttattcttttagcttttcccatcttgctgttatttttctttagaaaacacaaaacatctaagaagcaatgcttaccaccaggccctagaggccttcccttcattggcaatctttatcaattcgatagttctactctctgtttgaaactctatgacctctcaaaaacatatggtcccatcttctcccttcaacttggttcaaggccaaccctagttatttcctcaccgaaactcgccaaggaggtgatgaatacccatgaccttgaattctgtggtcgaccctccctcataagctcaatgaaattttcatataacgggctagacatggcattttcaccctatagagattattggagacacacaagaaaaatatccattatccatttccttagcctcaagcgtgtgctaatgttttcctcaacaagaaaatatgaggttacccagttggtaaaaaagataacggaacacgcttcttgttccaaggttaccaacttgcacgagttactgacgtgtctaacaagcgctatagtgtgtaggactgctttgggaagaacgtacgaaggggaagggattgagacaagcatgttccatggcctgcttaaagaagcacaggatttgatatcttccactttctacactgattatattccatttgttgggggagtgattgataaactcaccggattgatgggtcgtcttgagaatttgttcaaggtgttggatggcttttatcagaatgttattgatgaacaccttgatcctgaaaggaagaaactcacggatgaagaggatataattgatgccttgcttcaattgaaggatgatccttccttctcaatggatcttactcctgctcacatcaaacccttgatgatgaatataattttagcaggaacagatacaagtgcagccgcagtagtttgggctatgacggcactgatgaagagccctagagtaatgaagaaagcccaagaagagattagaaatgtgtttggtgagaaagattttataggggaagatgatattcaaaagcttccttatcttaaggcagttataaaagaaacaatgagaatgtacccaccactgcctcttcttatacatagggaaacgattaaaaagtgtagcattgaagggtacgaaattccagagaagacattggtgtatgtgaatgcttgggcagtgcatagagacccagaaacatggaagaagccagaagagttttatcctgagaggttcctagacagcaaaatagattttaggggatatgatttcgagtttattccatttggtactggacgaaggatttgcccgggtatcaatatgggaattatcacagtggagcttgtgcttgctaatcttctctattcttttgattgggaaatgcctcaagggatggaaaggaaagacatagacactgatatgcttccaggacttgtccaacacaagaaaaatcctctctgcctagttgctaagaagcgagggtga

SEQ ID NO: 103215 - DNA, 1200 bp, Glycine max
  Peptide Sequence Number=SeqID_219993
atggagtttcctaaccctgccaagttgcataaccaacacgtgtcactttttgcgattttatccattgctaccatagtaccaaaccctgcgtttgcaaccaaagaatgtgttttccctgccatcttcaacttcggtgactcaaactcagatactggtggcttggctgcttcccttatagcaccaacgccaccatatggagagacctattttcacagacctgcaggaagattctctgatggccgtctcgtcattgatttcatagcaaagagttttggtctcccttatctaagtgcgtatcttgattccctggggaccaacttctcacacggtgcaaactttgcaacatcagcatcaacaattagactcccaactagtattatacctcagggtggatttagtcccttctaccttgatattcagtacactcaattcagagatttcaagtctagaacacaattcattagacatcaaggtggcgtatttgcaagcttgatgcccaaagaagagtattttgataaagctttgtacacgtttgatatcggtcaaaatgatcttggtgctggcttttttggaaacttgactgtacaacaagtcaatgctactgtacctgatattgtcaatgctttctcaaaaaatattaagttcattattctggtgatcaaggacatatatgatttgggagcaagatcattttggatacacaacacaggacccattggctgcctcccttacattttggccaattttctatcagctgaaagggatgcctatggttgtgcaaagacatataatgatatagctcagtatttcaaccacaaattgaaggaagttgtggttcaacttcgcaaagaccttcctctggctgcaattacatatgtagatatttattctgttaagtactctctattcagccacccaaagaaatatggatttaaactcccacttgttgcttgttgtggttatggaggggaatacaactacagtggtagtgttggatgtggagaaaacatagagggcaatggaactgaaatttttgtgggttcatgtggaaggccatcagctagagtaaattgggatgggatccattacacggaggcagctagcaagttcatctttgatcaaatttctactggtgctttctcagagacagccattcctttgaatatggcatgtcacagaagttatacaaaaagttattga

SEQ ID NO: 103216 - DNA, 690 bp, Glycine max
  Peptide Sequence Number=SeqID_219994
atgctcaagtttacagcagtgcaacttgttgacgatgaagacgtcagaggctcacgaacatttgcaaatactgaggatcaacctcacccatacttgagtacccttgtagtagagcctacctcatcaacacaaccaaatgggcctgagtttgcagtagagtctggcttacctaacgaagaactcaatccctttaatgaggatgaggacaaagttctatacaatcaaccccaggaggaagatcatgaggaagttgagcttgtttcactaataacaattgtaccaccatattacataccacaacacatgcaaaattttaaagaatctaattttcaagattttgaatacggtcatagcttggatcatgaagaagtccaacatctggtagggactctctttgaagtgtcagccttgatagcacacatcaaaagtgctaaaggatacaccacgacgtaccacaaagcatggttggcaaagcaaaaggtcattgacaacatctacgacaactgggaaagatcgtaccacaatttaccgagattgttgagactacaaacccaagagaggtttggtttgcttaagatttcacagtcaagttggatgaaaggcggtgtgactatggcaacttctaaaaattatagaggccttgttctcatgttgttgctacttgtaaggatgctcaccatgagtatatga

SEQ ID NO: 103217 - DNA, 861 bp, Glycine max
  Peptide Sequence Number=SeqID_219995
ggcaatctgggtgtagcagggtctggggttaaaggggtggtggaaccagaggggctcatggtggtgcttttgcacgaaaactgcaatggtggtccgtcaatttatcttcctagaatttggccaacgccactacttggggaagagataaaggctacaaagcctgcacctcgcagcccattcgaattccgtaaggtattcgttcacagtgccacgctgctggagcttgaacaaggcaccttgtgggtcatcgtagaaggaggttggtccctccatgtagaaggaggccactgtgagcctctggtggtcaagaatagcctggtaatcgaaaactgggggggtggggtagatatggttgatgatttgggggaaaaagggattgtggtcacgattgtgagatgttcgagtatggaatcaattttggaagagagggaggactatgtttgggttaaattggcttgtgtttgggctagacaaaccatcaatgatataacttattctcatcataataagaaaaaatggagtgaagaaacattaggtgaaattgagaaattaaagatcagtgagttctcagagagtagcgtccttctaggtgtaaatttggacttcgtctttgggctctttgcctctgatgacaaagtcttccatggaatgggtgaaagggaggaggaggaagagggcctcttggtggtggaggcaatgctcttccaccttgtcattttcctctgtcttcttcttcgtcaaattgggattaggattggaatcggcgaaagcagcaatgatgaaaggcgaggtcttgagagtggtttcggcatgacaacaacggtaacaatagtgatgacaatggcagggatgagaggctag

SEQ ID NO: 103218 - DNA, 360 bp, Glycine max
  Peptide Sequence Number=SeqID_219996
atgaacaatacaattcaagagacagtgaaggacagaaacaatttcattgtgaatgatgcaatacaattaatagccaaacaactgaccaatttcaatgtatctatatacataacattcaacgtcaattgttttcaacaaaggaaggatctccaagctcagcttgaagacaaattcaccattgtttcctctggccttgctacattgaaagagcatgttcacctttactctgttactagtcctcgatctgttcctgtgcaagcagctaagatcaccctttctccttctgatggctccaatcatcttgattggatctttaaggttgagcgttactttgaactcacaaaaactccttctatctag

SEQ ID NO: 103219 - DNA, 279 bp, Glycine max
  Peptide Sequence Number=SeqID_219997
atggcgcaaacctcgtttgcagagcttgcagaaatgttggccatgattactggagtggagttggaaggaatgggtatggagttggctatggaaggagaaacaggggtaagacgggtgaggatgtcgtccagtttcagagacatggtgtgcatggtgtctcctaaacgagcgaggacatcagcgagggacctccagcacaaagataaaggaaaaggaagaagacagcttaagaggaagacacctccagttcctagatatgatcattcagctgctatttga

SEQ ID NO: 103220 - DNA, 203 bp, Glycine max
  Peptide Sequence Number=SeqID_219998
gatgggaagggaatgtgcaaatgcgtacgagtggagtgacggcagctccggcagtggaaggtggcatgagccaccacaatcaagccaaggatattctagaagctggcctcactacaccttcctcacacgtagtcgttgaggttcgtatcatcccttggcgcttgcaaagccaccttgtcctcaaggtggtagttttggcatag

SEQ ID NO: 103221 - DNA, 1530 bp, Glycine max
  Peptide Sequence Number=SeqID_219999
atgacaagcaacgctcaatttacatcatggccaacatttctgcaagctctgcaaacgaggtttgcgccatctcagtatgatgatccaacaggcacattgttcaagttaacacagaagggaacaatagcagaatacctatcggagtttgaggacttggcgaacaggattatcagcttgccaccgccattcctcttggcttgcttcatctcgggcctgtcctcggaaatccaccgagaggtacaagcgcatcagcctctcaccctggttcaggccgccgacctggctcgcctccaagaggaaaagcttttggactatcgtccaccctcccgcccacgtcctccaccacttccccttccgccaggacatccccccgcgttaccaccacttttgccatcgcctccccaggaggacgaaccctcgtgggttaatatagaaccaggcgacccgaacccggctcctgacccgcccgatagcccatcacaatatcaggcccaaatcaacctgaactccctttcaggctatttggccctagaagctttgcgattgacgggccttatcttcggccaccacgtcactgtccttgttgacggcgggagtactcacaactttgttcaaccacaggtggcgacacagttgggcttaccttgccggcaggcagagtcacccctgcgggtcatggttggcaacgaccaatacttggagtgcaccaaccattgcgaagatgtttcagtcgtgattcaggacacttattttaccctccatttatacatacttccaatttcaggcgctaacattgttttcagtgtgcaatggcttaaaacgttgggtcccgtgcttaccaattataacacattggccatgcagttcttttatcaggactgcctcgtggtgctccaaggtgaacatgaaacacagtcaggccgtctcacccacaatcaacttcgtcggatttgccatcatcagtcaaacacatcgtacttccatataacgatgttgactgaccctttgtcaagccctaccaattataacaccttggccatgcagttcttttatcaggaccgccttgtggtgctccaaggtgaacatgaaacacagtcaagccgtctcacccacaatcaacttcgccggattttccgtcatcagtcagacacattgtacttccacataacgatgttgactgaccctttgtcaagccttaccaattctgacctaccaccggagattcagcaccttcttcataagtttgagctcctcttccatcaacctcaaaccttgcctccggcgagaacgacggaccaccatattcatcttctgccccactcattgtcggtgaacatccgcccatatcaatatccccactatcagaagcaggagatagaagctcaggtggactccatgctacaaaaagggctcatccaacccagcacaaggcctttctcgtcatcagtgttgcttgttcataaatctgatggcacatggcagttctgcgtggattaccgctctctgaacgtggtcacaattagggattga

SEQ ID NO: 103222 - DNA, 1620 bp, Glycine max
  Peptide Sequence Number=SeqID_220000
atggcctcctccatgatccaccaaggcagtaagaagtttcctcggactcgccggattttacaggaaattcattcaagggccgctttcgacaacctcaaacaagctctgtcaattgcctctgtcttagctttgccagacttcacaaagcccttcatcgttgagaccgacgcctcgggagtagggatgggtgcagtcttatcccagaaaggaaaccccatcgccttcttcagcaagtcgtttacctccaagctcttgggtgcctcaaccaatgttcgtgaattatgtgccatcaccatcgccacgaagaagtggagaatcagagtcatccctgtccatcatcctctcagtgccatccttaaacttcctggaggaacttcgtcagtagttggacaacaaccaggagtatcgcactctacggatatcccaattgctcctctattgcttgctgaataccataccactccgacaaggggccacaccgatgtcactaagaccctggcacacatatcggaaaacttccattgggcagggcaacgtgaagatgttaagaggtttgtggcaaattgtatcgattatcaggtcactaagtatgaagctcagaagatggcggggttgttatgccccttgccgatgccgcaccggccgtgggaagacttgtcattagacttcatcgtcgggcttccaccataccaatgcaacactaccattttggtggtagttgatcgtttctccaagggaattcacttgggcacccttccaactgcgcatacggcacacatgattgcttccttatttgtcaacatcgtagtcaaactccatggaattctcagaagcttggtctccgatagagatcccctgttcattagtcacttctggcagaaactctttcgtgtgagtggaaccttgttgtgcatgagctcttcatatcacccacaaagtgatgggcagaccgaagttttaaatcgtgtgacaaaacagtacttaagggcctttgtccaccatcgaccaagcttatggggcaaacttctgccgtgggtcgggtggtcccataatacatcttggaatgttgacactggagcaactccatacgaagtcaccttcggccggaaaccctttaattttccagaatacattgtaggctcttctaacattgcggcggccattagaaacaagctcctaaaggcacaagccaatatgaaaaggcaagctgatgcaaaacagagggaaatgcaatatgagattggtgattgggttcttctgaaacttcgaccctatcggcagactttagcaaagggagcgaaggtgttgaccggcaaactggcccaacgttactataggcccttccaagtcatagagcatgtgggcccagtagcttacaagctgcaacttccagaaggggtgaaaatacaccatgtgtttcattgttctaagatgaaaccatttaaggggtcacctgatagtatggcagggatcgaattgcccactgattgtctcaatgaccaaccacttgtgtatcccttagccatcctggattatcgaagagcttctcaaaaggatccatgggaggtgctggttgaatggaatggactttctcctgatgacacttcatgggagagctag

SEQ ID NO: 103223 - DNA, 429 bp, Glycine max
  Peptide Sequence Number=SeqID_220001
atggatagatgtttgatgatttggacagcatgctgtggcacttgtggttatgagctgaacctatcctcctcaaaccggaacactgcatccattggatctaaatacgggaagtccataaagcgaggtattatatcattcttcagcattgatcttagcagatttactcaggttgatgaaattcagtgtgtgccccattttgataagcactcatggggtttgtttcgccgaagaaccaagcttctttgtcgcaagtgtggcaaccatattggaaatgcatacaatggttacacttcgtcctttcctcttgtgtcagacggagcagaatcatctcctagttccaaagtggtcagtcatacaaaatatgacattcgcatttgtgccttacaaccttcatcttctgaagaatctggaatccccgtgtttgcttga

SEQ ID NO: 103224 - DNA, 939 bp, Glycine max
  Peptide Sequence Number=SeqID_220002
atggtgttgctgagagaagaaatagaacaattcttaacatggtcagaaggaataacacctaaagaagcttggccagggaacaggcctggtgttagccactttcgtatatttggatctttgagctttcggcatgtacttgaaccaactagaagaaaattggatgattgtgctgaacaaatggtgcttcttggatatcatccaactggtgcttacaagttgtatgatccaagaataagaaaggttgtcattaataaagatgttatggatgaaacaaggtgttggaattgggaaacaaatactgccagaagcattgaaaagactgtggttgtgaatcttaaagatgatcaacacaaagagagcgatgtaaaagttggaaatcagcctagaaggataagacaaggacctgatgaaccattgagagagtaccttacaaagttcaataaagaagctaggttggtggggaatttgcggccagaagtggtgcagatgttagcaaagcacaacatgaaggaaggatctcctttatacgtatctatatccaagactctattggcaacgttggaagaattcttgaagaaggcagaaaaatatattaactatgaaaacatccttgaggtaggaaaaatgaaggcgataaagaataaggctagtcaaaagaaggaaataatgccaaagttagaaagatcacctcgagttgatagcagagaccaatacaggcctaggatggaagagttagacactcccaaatccattaggtcagaacaaggaggaagagatctatctaagtactgcaggcttgacatcagggtagagacaaagattgacccctttaatgacttaaaagatctccataatgacaagttaaggagggatatgctggagggaggccctcaaacaatgctagaagaaggcatgccaaggaggtacttaccatcttga

SEQ ID NO: 103225 - DNA, 225 bp, Glycine max
  Peptide Sequence Number=SeqID_220003
atgagaatcatgaaagactatgagttaaggatgccatacaggactgaactcatctgtgacaagttgaacttgttctcaatgcgtgtgcccatgttcaaagatatcctcttgaagctcttggaagaaggcgaagataacaagggtggacaagagttcaaaatgatgctcaagaaatgggagagggatgagatgctttctactttaactcctagattgatcatctaa

SEQ ID NO: 103226 - DNA, 192 bp, Glycine max
  Peptide Sequence Number=SeqID_220004
atgtcagtgaaaaacctcgtcgggcgcctaggagtacatgataagacaaaccatacactagcaagtcaggtcactcttactagcacaagcttaaaggagcactcaaaccaggtgacccccaaggccaatactccgaagagtccattagggcctttccctcctgatttaggtccaacccagaaaacattttag

SEQ ID NO: 103227 - DNA, 393 bp, Glycine max
  Peptide Sequence Number=SeqID_220005
atggagcagtacatcaaagatttagtgccatatcatttctcttttataaacaacaagaaggatgaaaccccaagggaaatcttcgaacaaaatcacaagggcttgatgaaagagagttatgagtggataaaggaaacatcaaatccatgctcagttgtagctgctctcattggtagtgtttgccttgcaacatcaagcactgcccctggcagtacgaataagggtaaacctaaattggaagggcaacctgcattcgatgcatttgcgattgcttcactaattggacttagcttctccatcacgacactcacaatgtttcttgcaataccaacttctagaaaacaagttgaagacttccgcaagagcttgtcattgaagcattttttggcctaa

SEQ ID NO: 103228 - DNA, 273 bp, Glycine max
  Peptide Sequence Number=SeqID_220006
atactaaccctgtggtatagagctcctgaagtcctcttgggagctacccattactcaacagtcaacaagtggtccgttggctgcatatttggtaagaacatgaggattcaaggatcttctgctgaatttgtcaccaaacaaccactctttctaggtgatttcgagctgcgacaactccttcgtatattcaggtgttcattcagttatttctttgattcttgctttcattttggaccgtgttgctcatcatcgcagaaaatcgatcttaactaa

SEQ ID NO: 103229 - DNA, 522 bp, Glycine max
  Peptide Sequence Number=SeqID_220007
atgggagtcaaagaagaatgttcaaaggtggcagcagattgctcaccagggaagaagccaaaaaaagaacatgatgttaacaaaaaggagactgcatttttggcagcagcgaaaaatggcattatcgagattgtgtttgaacttcaaaaagcaataccaagtaccatacatgaaactaactataacaatgaaaacgtattacttgtggcagtgaagaataggcaaaccgaggttattgaggtgttgcagaagaatttggaaaaagaactctttgatagcctaatttttgatgtggataacatggagattactgtgttacacttagcaccaagcaagagggaaaggacttggcaaatagctggtgccatgcagatgatgtgggatataaagtggtataagagaactacaatcaacattgaatgtcaaaaaaacagcgaagacaacgaaatatggaacaactatgatcttgggctcatccacgatcgtcaaccagcaacggaatcacttgagaagaatgggtaa

SEQ ID NO: 103230 - DNA, 2991 bp, Glycine max
  Peptide Sequence Number=SeqID_220008
atggctcacaatccgcaatgcaagggagttaggcatagcacgcggttgaggagagagaatataaggctgaaggattacacgttttcgaatacttctcaacctactggaagtccttcaaacaatggctccctattggtgccaccgattaatgcttccttgcctattaaggagatctcacttggatttcctcatttcgatggaacgacgccagtgatggagtggatcttcaaggcaaagaaatttttcacttattataatactcctgatgcatctagagttgacattgttgtgatgcattttgataaggattctcaattcggtccttcaccttttgattgtccaatggctgagctcttcaagcttcaacaaacagattcggtgtcagattattacctcaagtttatgtctctagctaatagatctctaggattaagtcctccacttcgatcctcgaatgtgaagaggattactcctgttgaaatgcaattgagaagggaaaaaggattgtgttatttttgtgatgagaagttatcttttaatcatagatgccctaatagacactttctgttgttgcaaatgaaagatgataatgaggatcctattagtacaactgtatctcagggtgctcgagaagatgagatagtagaacctaaagatcatcatttgtctttcaatgctttgaaaggtggtaggggagttggtactatcaagttcatagcttatattgaaaagttacatgtgactgtgttgattgatggtggcagttctgataattttttgcagccaaggatggccaagtttttgaaattacctatggaaccaactactcaatttagagtaatggttggcaatgataattatatgtctgttgaaggattggttaagcaattgaagactattggctctcacattgctgattatgatgctttgcaactgaagtttttgtggaaggtttatactctacagctgatggagccaaatgttgttcctaagtctatgcttgacttacctgttaaaatggagcctaaattagctttagtgttgcacacttacaaagtggtttttgatactcctagcagcttacctccacagagatcccatgatcactctattcccttattgaagggttcacaacctgttaaggttaagccttacagatatcttcatggtcaaaaggaagaaattgagagactggtgttaggaatgttggatgaaggcatcatacagcctagtaagagtcccttttcttctcccattatattggtgaaaaagaaatatggttcgtggaaagtgtgtactgattataggactcttaatgcaattactatcaaggacagcttccttattcctactagtcttaagaatgacatttttgctagactattaagaaaacttgtactggttttctttgatgatattctggtgtataatgctaattggaaagatcatttacaccatttggaagtggttttaagtatcttgaagcaacatcagttgtttgcaaggttttctaaatgttgctttggagttcagcagattgattacttgggacatacactatctggttcaggagcagctatggaggaaactaaattggaagctattcaaaagtggcctgagcctagtaatttgaagcagttgagaggatttttaggactcataggcaaaattgtgttacctcatgatgttatgttgcttcatcagatcatggaggaatttcacagttttaagattggtggacattttggagttaatagaacaacgactagaattggtgctcaattttattggaatggtatgagaagtgatattagtaaatttgtgagggaaggcgtcatatgtcaacaagctaaggttgatcatgttttgccagctgggttgttacagcctcttcccatccctcaacaaatatgggaggacatagcaatggactttattgttcaattgcctccttcacaaggatttaccaccatttttatggtagttgataggctgtccaaatttggttactttatccctataaagtctgagtgtaataacacggttatggctaaagctttcattactaacattgtcaaaattcatggcacaacattggccatgagctcttcatatcaccctcagtccgatggccagactaagaattttaataagacccttgagatgtatctaaggtgttttgtatttgaatatcctaagagttgggttgctatgcttccttgggctcaattttggtacaacacttccttccatcaaagcttgggtatgactccttttcaagcagtttttggtatacctccaccatcggtgatgcactatgaggctgatcctaaggatcctggtccactcaaggatttattacaactacgtgatcaacttttaatcaagcttaagggtaatttactaaaggctcaacaatacataaagatgcaagctgataagaaaagaagagatttgcaatttaaggttagtgatttggttttggttaagctacaaccctataagcaacattcggtggctttaaggaagcatcagaagctaggcatgcgttattttggtccatttccagtgattgagaggattggtaaaattgcatataaagtacagctgcccgagtctgctaaaatacatcatgtatttcatattgctcttttgaaaccatttcatggcaagagtcctccaccatatcttccttttccactaacttatagtggattgggaccaatgctttatccatggaaggtgttggatgttcaagttgtcaaatgtttagaagttactgtgttgcaattgttgattcaatgggaagctactgaagctaaagatgctacttgggaagaattgcaggatatacgtgaatcttatcttcagttcaaccttgaggacaatgttgtttttgatggggagggtaatgtaacgtgcataaagaatgaagaagttttggcatcaaattctattagtagtgagggacatgtggctcacgatccgtaa

SEQ ID NO: 103231 - DNA, 153 bp, Glycine max
  Peptide Sequence Number=SeqID_220009
atgggatgttcatctcgatttgatgtttgcatttgtggtagctgtgaaggtggcgtaaagggggatgaaggatggttttgtttgtcaaaggaggcggtagttgtagttgtggacatgagggttgtggagacgatggttgtggttgaggaataa

SEQ ID NO: 103232 - DNA, 507 bp, Glycine max
  Peptide Sequence Number=SeqID_220010
atggtagagtccggtggatggagtatgggagtcaaaatggagatggaggtggcgtatatttcaatgggaatagaaactagtggaacaggtggaagaactatcagtgaaatcaacttcaattcttcaaaaaaaatgtgggtaaaagtggtatcttggaaggaacaaatgtttgtgtggaagggaaaggatgtatgtgacagagtagtagaatgtagaagctactacgtacccattaatttgttctttgaatgtacagtggctacaaaagtgtgggaatcttgcttgaaatggtattggggaattactatggtgagacagagacatccaaataagtttaatttctttgatttatggggttggtggattgtgagaaggaatactggaagtgttccctccaaaaactcaaggctctcaccccttcctccagagccttatgattgtggggcaactattgacatcccccttgataatgcaaaggtaggctggattatgaaaagtttgaaataa

SEQ ID NO: 103233 - DNA, 234 bp, Glycine max
  Peptide Sequence Number=SeqID_220011
atgcctcttactcaagttttatttggaggggagcctatccaaggagagtctccagatgagaatggatacaaaggatggaacatgcatgtcccaaaagcgtttttcaacaaaatacgatcctcctcgtgttgcctcaatgagatcttatccaagtcaaccaagaattctttcaccaagggtaattcccactcgagccaagccctcctccacacaagatcctcaaagataccatga

SEQ ID NO: 103234 - DNA, 475 bp, Glycine max
  Peptide Sequence Number=SeqID_220012
atttattggaggtctcactagaaggatcagcaccaatctgtgcctgttcctcctctaccagctcaatatctttcgtttcacctttgcttttgtaaactacactgtaatttacaaaacaaaagttgaaaggaaagatattgagctggtagacgaggaagaagcacagattggtgctgatcgttctagtgcaacctctaataaatctgagatttataaggaggaagcacggaatgcaacacagaagcataaaccaaagagggtggagagtgtcaatgctgatgcagaagcctttgctgaagcactagaacatacgatgaaaagagatacaagccatcaaagtgtgtcattagagaataagacaggagattcaactgtgctgaagataggaaattcggctaaagttgtgataaaacaagacatgaagggaagaaggcataaatatgggtttaacaacaacaaacgtgagaaggcatag

SEQ ID NO: 103235 - DNA, 144 bp, Glycine max
  Peptide Sequence Number=SeqID_220013
atggagggtataagggacagtgttcaagaatgtggccataaccatgacaataccctcattctacatgttaattgttgggttttcaatgtgaggatcgagaagttgcaagagctgcaccaaattgaggaattttatccagattga

SEQ ID NO: 103236 - DNA, 858 bp, Glycine max
  Peptide Sequence Number=SeqID_220014
atggccgcagcgaaaaacggcatagtcgaaattgtgtttgctcttcaaactgcaataccaagtgccatacatgaaactaactgtaacaatgaaaacgtattgcttgtggcagtgaagaataggcaaactgaggttgttgaggagttgcggaagagtttgaataagaaactctttgttagcctaattttagtagtggataacaaggagaacactgtgttacacttggcggcaggtacaacaagcaacagccaaatgacttggcagattgctggtactgccatgcaaatgatgtggcatataaagtggtatgaggatggcgaaaccccatgggaaatcttcgagcaaaaacacaaggacctgataaaagacagttcggagtggctaaaggagacatcaaattcttgctcggttgtggcagctctcattgctggggtttcctttgcaacatcaagcactgtccctggaggcaccgaccaaggtaaacctacattggaaggccaaccggcgtttgatgcatttgccattgcttcgctaattgggctttccttctccgtcacggctctcataatgttcctcgccatactcacttctcgtaaacaagctgaagactttcgcaagagcttgccattaaagcttctctttggcctaacttctcttttcgtgtccattgcttcaatgctagtttctttttgcgctgctcatttctttgtgcttaaggataagtacaagaacatcttattccccatttatggtgccacttgcttgcccgtgaccttctatgcagtgattcaatttccgttgtatgttgatctacttaaagctatttttaagaaggtgccacaacgcgccaaaagataa

SEQ ID NO: 103237 - DNA, 715 bp, Glycine max
  Peptide Sequence Number=SeqID_220015
atgactacaactgaatcaacagcaacaattattgaaggaacggaagttgacaatgtgaatcgggactcgttgttccgacggtgcgtgttgcaaggggcatgggaagaatacgtcattccggcatataaaaacaacagcgacttccacaaaataaaaatcaacgaaagcagaggcactgcacttcacgtggcagtgaatgatggcagaatggaacttgttaataaacttgttggtgcaatcttggagcacgaaggtagggaagtggtgagcgatgaaagtgcactgaaatcaaccaatgagagaggggacactcctttgcaccttgcagcatcaagagggttcattgatatgtgcaagtgcatcatagggaaacatggggaaaggaaggaattgatcaaggtaaagaacaacaagggtgagacacctctcttccgtgctgtggccacataccacaaaaagacctttgtgtacctctatcatgcttccaaggatttagatgtttcacttacaaacaatgagggtgataccatccttcaccgtgccatttggggtgaattattcgatttggcaattataataactcattgctatcctggtcgacttgttgacacacgaaacaaagacggagccactcctctcaaagttcttgccagcaagccttcggccttcaagagtggaaggagtctcccatggtggaagcaaattctatattatt

SEQ ID NO: 103238 - DNA, 237 bp, Glycine max
  Peptide Sequence Number=SeqID_220016
atgtctaataatgaagactatatagcagagtattccaatgacgatgaatctcgcctaaagcccagacaaagaggtaattattttcattcaaagtactatcgaagaataagccttgctcctaacaaaacttttaaaattcaagctgaaaggggtcctcctcttgagtcttcatcctctacaacagccgtcactagccccgatcaaacatgcgaccaagaaaaaggaagtcagacatga

SEQ ID NO: 103239 - DNA, 384 bp, Glycine max
  Peptide Sequence Number=SeqID_220017
atggcttccaaacctggcactgtagaagagatcttcaaggactatagcgcccgaagaatcgctattatccgtgcactcactcatgatgttgataaactttacgggctctgtgatccaggaaaggagaatttgtgcctctatggacatccgaataaggcttgggaagtaactctgccatcagaggaagttccaccagagctccctgagccaactcttggaatcaattttgctagggatgatgtgagtcgcagggattggatttctttggttgctgtgcatagtgattcgtggttgctttctctggccttttaccttggaattcgtcttaaccacaatgaaaggtattatcttaattactttgatggagatgcatatattttgtaa

SEQ ID NO: 103240 - DNA, 1035 bp, Glycine max
  Peptide Sequence Number=SeqID_220018
atggcctcggcgtgtgtgatgaacgctacccgtgcaacggcgtgcagggataacatggtggtggcacacctaaaagtgatgttgatcttcgtcgtcttcgtgacgagcatggctgggatgtcgtcgctagcgatcctcgtcgaaatcttccgtgggaagcctctctacgacaaggccatcattgtaatcaactatttcgaggcggaagtgatactctcaacctcgccagtgttgtcactcccgtccgccaccgatgtcgaacctactgtcgtcgccaaacccattggtgtcaaacgttctcgctctcgctctgagaagccctcactccaatcccccgacgacgtcaacctcgagcttctctgctactttgacaagctcactgttcctctcaataagcagaagcatctcgccaacatcgccgtcgatgttgtcctcgacaacgtctccatcgccacaacgcaccgcaaaaccctagaaaaggacgatgtcattttctgctccatcttcgaggccattaagaagttgttgaaggagcaaaatgaggaaagcggacattttagacaaagcattgcttcaagagttttacatcaaggctcagcagaaattcccaacaagagctttagccttccatggcaagttatcacctttcagctacaatatggggttttggaagcaaaattcagattacacagtggtggggatgtctcctccacctctaggaacctagaaatcactctaaaacctagaatcctcttgaaagctgagatctttggtgctttcttgccctggctttctgtcctcgaaggctcgcttagcgccattttcacgctaagcgcgaattctcttccagattcttccaacccgctaagcgagcagagtgcctcgcttagcggatgttactcgctaagcgcatatgcctcgcttagcgagacaccaatcataagtattcttgaagtggttgctgggataagcttgatcatcttcaggggcatggagcgtcctgcttctcatgaggagagtttctccaactggtaa

SEQ ID NO: 103241 - DNA, 294 bp, Glycine max
  Peptide Sequence Number=SeqID_220019
atggttaatgcaaaagatttatgggcgatgagatacatggttcaacttattctgttctttataatgcaaatacctaagaattctactcaacaatcagcttcaggagaaatctctgctcaattagattcacatgcatgcaagattttggtaggtgttgttgtagttattgctgatttatatattgtgctttggggtaaagccaaagagtttgctgagaataaaccagaggtggcaccacaatcatcaaacttacaagatgatcatgatataagtagtaggatagatttggaataa

SEQ ID NO: 103242 - DNA, 1395 bp, Glycine max
  Peptide Sequence Number=SeqID_220020
atggatgaatcattgttgagcatgaaggaggtaagggaagatttcatggtttcacctattggtgacagtgaaccagttttgagaagtgcctattttctgaaaccccttgcaaagtcccttgatggaccagtttctgaggtcctttcatcttctatgactatgccactgccacctgtgtttgaaccaaaggactggcctttggtaatccatttcaactggaggtgccacacaaaaaagaaatgcgttgaatgggtggattcccttcaactcaggtatgaatcaatgtggaagaaaattggcatctttgaagccgtcatgagcaccaagtgcaacgatcacgttggaggatgtgatggtgttgggggttaccctgttgttggtgatcctgtcttagccccacttcaaagccaggaaatgagagaggtaaagaacaaattgattcttgcaagagaacaaccttggaggaggacaaaagctaaggcttctttatctgcatggatggatgttttaatcaatagtgggagtgaagttgagcacgaagcattccttgcaacttggttgtcaatgattggtttttcttccataggtttggtgagtacgttggttttccctattgcagttcatcttggtagaggaaatcccatagctttgggaccagcagttttggccagcctatataaggatttgactttgttgaagaacacagtagtcggtatgacagagcaactagtacttggttataaattggaattggaggtaactcttcagtcacccttttacttggtccaaatttgggtgtgggagaggttcaagaatttgcaaccacagcccaggttgaacaaccatgaagaccctatgatgtttaggtgtcacaaggttaaggccttgaaaattgacaatgtgagattggcactagactcggcgatgaagaagtacgccggcaagttcaaggtatcaaaagcaaacaaaaatgggaatgatgctgatgttccacctggttctcctcctaaacttggtaccactgtgtgtcttggaaaatccggtgatgatgattcaaatgctagaaaatgtaaaaatgatgttgatgtaccttctggttttctttttaaaagtttgaaaactgttcattctagaaattctgctcaagatgattacgaaaatgttaaaaggatatcaccattgacaaaactggttgcaaaagatacggttgaaccattgatgggaggtttggaggaagattttgaagatacaaataggagcaaagattcaaggctgtctagtgacagagtaagcctatctggtactcaaggtgaaagctatacctttgcatctggaataaacgtaatggatcttgaacagataatctacagactggagacagtgattaaaaattaa

SEQ ID NO: 103243 - DNA, 840 bp, Glycine max
  Peptide Sequence Number=SeqID_220021
atggcaggagaagacgatgtgtacttttcctttcttcctattgctcatgtatatggccaaataatggagacctattgcatctccaagggctcatcaataggatcttggcaaggcgatgtcaggttcttgctggaagatattcaggaactgaaaccaactatattttgtggatttcctagagtttttgactctatttatgtagatgtaactcatctagaatctggagaggacccttgtccatccattgctactgactggctagaagtaacaaaatatgtaggattggtatgtgctcagcctcatcgtgaggaacttattcaagacctttttaaatgttggaaggatcctcatcatggtatagtttatggtggcgtgataagaagggaatgcttagtttgtgctatcattatgtgcaaaatactagtatatgggtaccaacctctgcaaccacctgcagcacctccagctcctcctcctactttgcagactgctgattcttacttttggattatctcccttattgactcagatatacacaaacgtaagaagccatcttcttcttacatggataatgcagtcaaagctgcatgcactaaaccatctaaaccacaaaatattgttgaggtatatgctttagtttctggcctactgcgggaggagacaaatagaattcaagatgttgaaggaagctttattgaatatgttgaaggtcttacatatgaactttcctcttcttatgtttgcttggaaagttggaccagctctagcatgtactcagtcaaatttccaatcatcaaaacatcacctgaacactcgttagttgagcttgtcatcgcttaa

SEQ ID NO: 103244 - DNA, 273 bp, Glycine max
  Peptide Sequence Number=SeqID_220022
atggaaaagcagaagacactgatgagtttgattctgttgctgttgttatttacttcggatgtgagtgcttggaccggtgaaatccatggaagagttgtttgtgacgtttgtggggattcttctcttggacctgaagaccatattcttgaagccttgtcattcttcgccaattgttcaacatggttgaaaaccttgtgtatgtatgtatcgatggcatggttactgtctgctagacctggtggcacatgggatggaacaaggaagatgttttaa

SEQ ID NO: 103245 - DNA, 372 bp, Glycine max
  Peptide Sequence Number=SeqID_220023
atgctgcttaccattgcctcagctattggtgcaccaatcaaggtggatcaaaacacgttgaatatgaatcgtggtcgatttgcacgagtgtgtgttcaaataaatttgaacgttcctatagagggaaaattcaatctcaatgggagttggtataaagtggaatatgagggtccacatgttctttgtgttgcttgtcgttgttatggccatgttgctcgagcttgcccaaccataccgctatctcagtgggttgttgataatcagggaacgcaaatcaagcaaggggcaggggtgactcctaatcctaaccataatacggagaaggtgtcaccaccagctacagagtttcatgaagttgcaacgcatgggtag

SEQ ID NO: 103246 - DNA, 327 bp, Glycine max
  Peptide Sequence Number=SeqID_220024
atgaagactacacaagttgggatctctcttactgcacagggagactccatgtgtgataataatattgtgaccctgcccatgactatgcatgccccgcatggtaattctgatgttagtggtcaagaaatcatgaatgtggatccaagggcaaaaccaaatgttgctagtatcacgtcgatggagtcgtcgcaggtcccagatggggctcctcttcacgatggagctgtgaatgcgaaagggcggcgtcgtatcaaggaattggtaaggcatttggttgaagcttcgggacatgttgcaggccatgaattgaaatgcattgcagtatga

SEQ ID NO: 103247 - DNA, 234 bp, Glycine max
  Peptide Sequence Number=SeqID_220025
atgcagcattcagctgcttcgtccatgcgatcattgtcgacacaaaacctccctctttggaaccctttttacgacgatgatgctggtgtttttggagaagggacaacaatttccgctttccctcccaacggtttcgacattcgtcagtgcgggagttattctctttttgacggttttctcccttcctcgtacggtctcgatgttcgctgcaatggaggttatttccgtcattaa

SEQ ID NO: 103248 - DNA, 150 bp, Glycine max
  Peptide Sequence Number=SeqID_220026
atgtctgcatcttatagcactgaaatgaagattggagagtccaaatcttcaaaggttttaaggtcagacataattaatctgtcttacttcagtattccaaccagcaacaaacttgtccttaatgccattctactgcttacacagaaatga

SEQ ID NO: 103249 - DNA, 139 bp, Glycine max
  Peptide Sequence Number=SeqID_220027
tatctgaacacaaatcttgatctatatggtcaggtgaagaaagctgagcaagaatgtcatatgctttctgaggaagctcaaaggggagttagaaacttacgtgttgactttgaaaggggtggaattcatctttgccctg

SEQ ID NO: 103250 - DNA, 755 bp, Glycine max
  Peptide Sequence Number=SeqID_220028
atggcagatgttgttgttgatgcaatgatagctgaggcatctgtgattaagtacttgccgtgttggtcagggcatcatttgcaggagatctccagtcgatatcttggtcttctatggctttgggaggaatatgtgggagaaaaatctgaaaataccaaagctgaaccagaggattcaattgtaagggattcacatatgaatggtagtaccctagatgaagatagtcctttaagcaaaaagtcccacagtagcacaagaagaagaaagaagggcaaaaagaacgcaaaaggtagagcagtaaatagcagcaaatcaaagatttataagaaaggagactccctggcattaaagtggttccattctttgaaagaagcaatttatgatttatgccgtgcatttagacagccaatgatttggagacctatgtcttggtttttccttgcccatgttacgattccaaatctttcaaccgtcatcttctattacgaaaccgaggttttaaagctagaagcatctttccttgggacttcacgggttgttggttggttgggacttatgatgggcaccttcatttataatcgtcacctaaagtatatgaccctacgaaaaatcctcatgtgtgcccatattggtttggcattcttgaatcttctgcagattgctgtagtgtcaaggaaaaatattgcctttggcatctcagacaagattatggtcctttttggctcggctcttgctgatggaatcaatcaattcaa

SEQ ID NO: 103251 - DNA, 327 bp, Glycine max
  Peptide Sequence Number=SeqID_220029
atgacacaaaaaactgagcaaaggacatgtcactcgtcaactggtgctgaggttgctgttctttgcatcaccaagtctggggaagttctaaattatcaggcattcactgatgctaaggggatatacacggtggccgaaacaatgccggaaagtgatcgctgggatgcgtgtcttgcccgaccaatcagtagtttccacgagcaatgcactcaacttggtgaaggcagcataggggttaaattcagttacaatcatccatcaggacattcacacactgtcaggacctttgtatatcgacccaccagtgttccaacttactgcatttga

SEQ ID NO: 103252 - DNA, 174 bp, Glycine max
  Peptide Sequence Number=SeqID_220030
atgtggtggggaaaagggatgcgtgttgttatcgaattctcaaagaaacttggagaaaaattggtatatttcagtcccgaaagcatccagcttctgaaagcaactaatagaggccgttcacgacacggtaggtatatggtaaggactaaggagattgagatggaggtggtttga

SEQ ID NO: 103253 - DNA, 123 bp, Glycine max
  Peptide Sequence Number=SeqID_220031
atgcagggtgccagagatatgtttgctgcaaccgatctgcaacgtcagatcttctatgctcttgttggagagcagccattccctcatacaccggggaattctgttccaaggcagcatgtatga

SEQ ID NO: 103254 - DNA, 267 bp, Glycine max
  Peptide Sequence Number=SeqID_220032
atgagggaaaaaataagaagaataaaagggggggggggagaaaaagagtgggaagaggaggaggttgatgaaaattttatcagacaaagaagtaaagaagagaaaacatggggagaaagagagaggcctttggttccatggcttgtggtgggtctgagatcccacaagacaatatggttcttcgtggctccagtgacaagactgtactcttttctcatcacggaattcccaagcgcaatagcgttggccttaacctgcttggcgtag

SEQ ID NO: 103255 - DNA, 390 bp, Glycine max
  Peptide Sequence Number=SeqID_220033
atgtatgtctaccaaaaagggatattagatcaagtgatctgtaaactattttttagtatttacggatcacctgatcccctcttccagatcaacttgatccgtaagaggcttacagatcaggtgatccgtaaacagcccagcaacttcccgatagcggtttccgccatcgctggcaacaatggtggaagaagaagaaacgcgaaggagaaacgtacctcgaagaagaagaagaaacacaaagaagaagctttccacttgatcccgacaacaatggcggcaatgaagatgaggaagaagcagaaacgcgaagaagaagacttcacttgggaagaagaggcagcgcgaagaagaagaagaacgaagaagatgcagaatgaagcagaagaatga

SEQ ID NO: 103256 - DNA, 269 bp, Glycine max
  Peptide Sequence Number=SeqID_220034
tggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 103257 - DNA, 300 bp, Glycine max
  Peptide Sequence Number=SeqID_220035
gtcaatgagggatactcaagttgctctcatggacaccatctacgagaagctggagtgtagtcttcgccggtctccaggttatcaacaagataagacctatcacatggctacgagctctttccttactcagacagaccccaagcgggcacaatggcaagactttgatgtggggaacgcggagaaggggtgcctcctcatgaagggggttgtagtgactaggccggtgcgactgtttaccaaaagcacaggtctctgcaatgtcgtaagaccatgtatgggggctgacgcctaccaagtgcc

SEQ ID NO: 103258 - DNA, 111 bp, Glycine max
  Peptide Sequence Number=SeqID_220036
aagctaagcagtagcaggaatgggttatggtggctggagaggctgcaggggtttaacccagaccaccttacgccagcttctgtcgaagctacttatttttcaatcattaat

SEQ ID NO: 103259 - DNA, 1509 bp, Glycine max
  Peptide Sequence Number=SeqID_220037
atgaagatgttaaaggggtataccaaaaatctacgctgtcctgaagcatccgttgttgaaagggacattgctgaagaagctattgagttttgttcagggtacattgaaaaggtgaaacctattgggcttctcgagtctcgtcttgacaagagagtgggaggtaagggttcacaaggactgaatgttataagtctttgtgtaaaggaattgaatcaaggatacgatatcaacaagtatttgttcaacaaaaaatcacaagatgacaagagtatagtgcaaaatagtgggtgtatgtgggttgatagtaatatcgatgggtggattgatgatttcatatttacttggttagatcttaagaagctaagttataagaatgagtttttcatcatgcaaaacaagctaaataggcacatggctacaccattgagctctccttctcccaagttagcacattcaccacctatgtctgagaagactagaaaagtcacacagcttagatcattgtctgccagacttgtgggtttggagagaccactagttcatgtggatcctaacaatgggaaagttgtcagtccatacagaaagaaattaaggacctatttgggggtcatagctcaagacaaagttgatgttacatatattaactataaacagactcctgcatctcagaatgatttgatatgggaggacattcaacacgaatttgatattttgaaagtgttcgataaaaggatgaagaagaaaatactccaggctattggtatgagatggaggcaatttaagtcagatttgacctccaaatgggctcttgcaaaaggcaaggatgatgatgatgatgagacagtgtgtaagaagtacggtattagcaaagacaagtggaaccaattttttcaaagttatagagacccttcatgggaggatgttaaaaagaaggcgcaatccatccaaaaacaaaacattgcccctctcgtgttgtctagtgggggttatgactttcttgatgagaatttaatgaataaaaaattaaagaaacaattggagcaagcaacccaatatgggagtagtgatgcaattgttgatcctccatctcccattagacgacacgtgaagtggaagctgactcgcacaaaaaaattgggtcagatgacatctaaggtgacataccaaattgttgatagaattgtaaagattcgctggaagagcagtccacacaaggttgctttgttgcctatgaacgtccgaatgtgctggctactgccattggctcctttcggtgcctgtgtgagcacaaaaggaagttgcattgatccctcgggggaggatcctgacactgatacatcagataggtgtgttgatgacaatcctcctcgcctggtttcccttgggagagcttatgaggggtcgtcaactgtacatcatgtgcctttggccaatgatacgtggaaggtgggtgttaaagaagttcgagatgcagatgctcgcgtccttgtacttattgaagaggtttag

SEQ ID NO: 103260 - DNA, 1497 bp, Glycine max
  Peptide Sequence Number=SeqID_220038
atggcaaatggcaaagtggttggaccggatgttatacttattatggataagaatcatcgtttcatggctttagattgtcttcatcgagttttaagattttacttgagtgtccatgcggcaaaccaggccccaaatcggatatgggacaacctagacagtgtaacttcacaacttttagcagttctaaggaaaggattgcttactcaggatgttcaacatgataaactggttgaattctgtgtaactatagctgaacataaccttgattttaccatgaaccatatgatactagaattactcaagcaagacaatcctagtgaagcaaaggttattggtcttcgtgcattgcttgccattgtcatgtcgccttcaagtcctgatataggccactatattccaaaagtgaaagctgcaattgagtcaatattaaggtcttgtcataaaacgtatagtcaagcacttttgacatcatcaaggaccacaataggctttcgcgctaagcgtgcctttaggcttcttcgtgctaagcgtgagttagctgctaagcaaaacgcgctgaacttgtcttgcgcgctaaatgctgtaaccaaggaaaagtctcaagggtatctattccgttctgtgctaaagtgcatcccaaatctaatagaagaagttgggcgaactgataaaattactgaaataataccacaacatggaataagtattgaccccggtgttcgtgaagaagcagtgcaagtactaaaccgcattgtgaagtacctcccccaccgtcgttttgcagtaatgaagggaatggccaacttcatattaagacttcctgatgaatttcctctgctcatccaaacatcattagggcgcctgttggaactcatgcgcttctggagatcttgtctaatagatgataggatacaacttgaagcagatgtaaaatctctagggcatgaaactgagagattcagaaagtcttccattcaacaatcaggcgaagcaattgagtttcgcgcatcagaaattgatgcagttggcctcatattccttagttccgttgatagtcaaattcggcatacagcattagaattattgcgttgtgttcgtgcattgaggaatgatattcgggatctgaagatgcatgaacaaccaaatcatactttgaaatatgaagctgaaccaatatttattattgatgttctggaagaacatggggatgagattgttcagaactgctattgggactcagggcgaccatttgatttgaaacgagaacctgatgccattcctcctgaagtgacacttcaatctataatatttgagagccctgacaagaacaggtgggctcggtgtcttagtgagctagtcaaatatgctgccgaactttctccaagctcagttcaggaagctaagaaaatcatgggcaaagagatccagagagcaatcgaaaggggactggtctttttggttaagccaagaaaagatactaaatttctttatgtttga

SEQ ID NO: 103261 - DNA, 3894 bp, Glycine max
  Peptide Sequence Number=SeqID_220039
atggctcttggccgctcacacttggaagcatgtgaaatcatgttcagtgaactttcatcttttattgatgaggtttcttctgagacagaaggaaaaccaaagtggaagagtcaaaaggctcgccgggaagaacttcgtgtccacatcgcaaatatttatcgtactgttgcagaaaatatatggcctggcatgctaacacggaagccagtgttccgcctccattatcttaaattcattgatgagacaaccagactaatctcaacatctattgaaagttttcaagacatgcaaccattccgctttgcacttgcttgtgttctacgatcattagcccctgaatttgttgattcaaaatctgagaaatttgatgttagaactagaaagcggcactttgatcttcttctctcctggtgtgatgatacaggcagtacatggggtcaagatggtgtcagtgattatagacgtgaagttgatcgttataagtcttcccaaaatgcaagatcaaaagattctgtggataaaatatcatttgacaaagaattgaatgaacaagttgaggcaatccaatgggcatccatgaatgcaatagcatcacttttatatggaccatgttttgatgacaatgcaaggaaaatgagtggacgtgtgatatcttggattaatggtttgtttttggagcctacaccaagggctccatttggtttctcaccagctgatcctagaactccatcatataccaagtaccagggggaaggtggccggggaaatgctggtcgtgacaggcttaagggggggcatcaccgtgtttctttagcaaaattggctttgaagaatcttttgcttacaaatttggacttgttcccctcctgtattgatcagtgctaccactctaattcttctgtagccgatgggtacttcagtgtactggctgaggtctacatgcgccaagagataccaaactgtgaaatacagagattattgagtctgatcctttacaaggtagtagacccatcaaggcaaattcgtgacgatgcccttcagatgctggagacactttctgttcgtgaatgggctgaggatggcattgagggctcaggaagttatcgagctgctgttgttggtaatcttcctgattcctaccaacaattccaatacaagctttcctgtaaacttgccaaagatcatcctgaattaagccaacttctttgtgaggagattatgcagaggcagttagatgctgttgatataattgcacagcatcaggtcttaacatgcatggctccatggattgagaacctgaatttctggaaactcaaggaaggctggagtgaaaggttattgaaaagtctctactatgtaacatggcggcatggagaccaatttcccgatgaaattgagaaactttggagcacaattgcgagcaaaaataagaatatcagccctgttttagatttcttgatcacaaaaggcattgaagattgtgattcaaatgcatcaactgaaataagtggtgcttttgctacatacttcagcgttgcaaaacgggtaagtctatatttagcacgaatatgccctcaacggactatagatcaccgagttttccaattgtctcagcgacttctagaggatagcattgagccggttgcaagtaagggtgatgccagtgcaaattttgtgctagaattctcacaaggtccggctgtggcccaaatgacatcagttatggataaccaaccacacatgtccccattgcttgtaagaggttctcttgatggtccactaagaaatgttagtgggagcttgagctggagaacaacaggcatgacaggccggagtgtatcaggcccattaagtccaatgcctccagagttgaatattgtcccagtaagcactgggcgatcagggcagctccttccagccttggttaatatgtcaggacccttgatgggtgttagaagctcaacagggagtttgcgtagccgccatgtttcacgagacagtggagattatcttgttgacactccaaactcaggtgaagatggagtgcatgctgggagtgctatgcatgccgtgaatgcaaaagaacttcaatcagctctgcagggacatcagcagcactcacttacgcatgcagatatagcacttattcttcttgctgaaattgcatatgagaatgatgaagatttccgccaatacttgcctctactctttcatgttatctttgtttcaatggatagctcagaagacattgtactagagcattgccagcatttacttgttaatctgctatattccctagcaggccgccacttggagcagtatgaggtggaaaataatgatagggagaacaagcagcaggttgtgagcttaattaaatatgtacaatcaaagcgaggaagcatgatgtgggagaatgaagatccaacagttgtcagaactgggcttccaagtgcagcacttctttctgccttagtgcagagcatggtggatgccatcttcttccaaggagaccttcgggagacttggggagaagaagcacttagatgggctatggaatgtacatcaaaacaccttgcctgtcgttcacatcagatctacagagcacttcgacctagtgtaacaagtggtgcttgtgtatcccttctacggtgcctccatagatgtctgggaaatccagtacctcaagttttgggatttgttatggaaattttgatgacattgcaagttatggtggagaatatggagccagagaaagtgatactctatcctcagctattttgggggtgtgttgctatgatgcatacggattttgtccatgtctaccgccaggttctagagcttttctctcatgtgattgatcgtttatctttccgtgatcgtacaacagaaaatgtactcctttcaagtatgcccagagatgaacttaatactagtgatttaggagaatttcagcgcacagaatctaaaagtggctatgaacctctacaagaggggagtttgccgacatttgaaggggtgcagcctcttgttcttaaaggacttatgtcgagtgtcagtcacagtgtctcaattgatgtcctctctcgtataacagttcattcatgtgattctatatttggtgatgctgagactagactcctgatgcacatcataggattactcccttggctctgtcttcaacttagcaaagacatagtgataggtccagcttctccactccaacatcaatatcaaaaggcttgctccgttgctgccaatgttgcaatctggtgtcgagcaaaatcttttgatgaattagctactgtatttatgatttactctcgtggtgagattaagagtgttgataattttctggcttgtgtttcaccacttttatgcaatgaatggtttccaaaacattcaactttggcttttggacacttattaaggcttctggaaaaaggaccggtggagtatcaacgtgtgattctacttatgctcaaagctctcctccagcacacaccaatggatgctacccagagtccacatatttatgcaattgtatcccaattagtagaaagcactttgtgttgggaggcactaagtgtgttagaagcccttctacaaagttgcagttcattgactggttctcatccctatgaacctggttcgttggagaatggaattggtggaactgaagaaaagttgcttgctccacagacttcattcaaggcccgcagtggccctctgcaatatggtttcggatcaggactaggctcagtttctactcctggacaggttgggtcaactgagtctgggatgtcaccaagggaggttgctctgcataatactcgtctgataattggtcgggtattggacagaagtgtgttagatgtagggattgctacagggtag

SEQ ID NO: 103262 - DNA, 279 bp, Glycine max
  Peptide Sequence Number=SeqID_220040
ggatcgcgcccgcaagaaacccagtggacccgaagaagtccaacagggtcttggagttgccaagctctaattacgggactctgtcagttctacggagtgcctgtcgcccccagcaaggtcatcaggccctctactaatcgagctttcatcaagaagtactgcgtccccaggcaagcgcagggcgaaacaccacagcaacctggggatggccggcaatgggcaacagatgcaccgccatcacttctagagttcacctcagctcatccacaaaaaggttag

SEQ ID NO: 103263 - DNA, 237 bp, Glycine max
  Peptide Sequence Number=SeqID_220041
atgggtttggtaattccatggagcataacattgttggtggtagatgcttactctgtcttcatacagtatttaccggttcaacgaaggctcataatgattatcttttttggagacatgctgcagcatgttctacagccagcatcgcagatcttctacttgatgctggaggatcacactgtccaccaaagctatgtgataaatgaaaagggtgcaaatgacaaagtcatttgttcttag

SEQ ID NO: 103264 - DNA, 516 bp, Glycine max
  Peptide Sequence Number=SeqID_220042
atgaaggcagggagtgccgccaagttgatcgtcgacgctctgcttcagcgcttcctccctctcgcacggcgtcgtatcgaaaccgcgcaagctcaggatgggcaatacctgcgaccatctgatccggcctacgagcaagtgctggattcgcttgctatggtggcgcgccacactcctgttccgctgctggaagccttattgagatggagagagagtgaatctccgaagggtgcaaatgatgcatcaacattccaaagaaagcttgcggtggagtgcattttttgctcagcgtgtatccgctttgtagagtgttgtccacaagaggggcttactgagaagctgtggtctgggcttgaaaattttgtttttgactggttaataaatgcagacagggttgttagccaggttgaatatccctcactggttgatttgagggggcttcttctggacttagttgctcaactcttaggtgctctatcccgtatcaggtatccgacttatcagagttgtatttaa

SEQ ID NO: 103265 - DNA, 1344 bp, Glycine max
  Peptide Sequence Number=SeqID_220043
atgacttcagtagtttcggaggctcgtgttcttgaagcatactccgcacaccctagccatgtcagcatcgttaagggaaacatgctccccatcatcaatgacattatgaccgttgattcgatcgccgacgaccttagcaccgacaacctcgttccgttgctgggttctgcgattcgaataagcttcttgaaattgaaggaggacgcgaataaggacgaggtcttgagcgcggtgaaaggaattcttgagaatttcaagcagattagtgaaggtcgaaagttagatttgatgttctccgctttgaaactgaaacctgcgagcgttggttcccgccttttttgtgttggctctctacaaacaaaaatcaacaaaatcatatggcaccagttgaagtcaccaagtcaccaaacccttcaccatctcttggaccaatgtttctccatgagacaactcaagcttgtccatgcccagatcatcctccatggactcgcagcccaggttgtcacactgggcaagctagtttctctttgcgttcaagcgggagatctccgttatgcacacctcctgttcgatcaaattccccaactcaataaatttatgtacaatcatttaataaggggctattcgaatattgatgacccaatgtctttgttgctctactgccagatggtgcgtgctggccttatgccaaaccaattcaccttcccctttgtcctcaaagcctgtgctgccaaacccttctattgggaagttattattgttcatgcccaggctattaagctcggaatggggcctcatgcctgcgtgcaaaacgcaattttgactgtgtatgttgcttgtcgtttcatactaagtgcatggcaagtgtttgatgatatttctgataggactcttgtgtcctggaattccatgattgctgggtattctaaaatgggcttttgcaatgaagccgttttgttgtttcaagaaatgctacagctcggagtggaggctgatgtattcattttggttagcttgcttgctgcttcctcaaagaatggtgatttggatttgggaagatttgtgcatctttatattgttattactggagttgaaattgattcaattgtgaccaatgccctcatagatatgtatgccaagtgcaggcatttgcaatttgctaaacatgtttttgatcgaatgctccataaagatgttgtttcttggacttgtatggttaatgcttatgctaatcatgggcttgttgagaatgctgtgcaaatttttattcagatgccggtgaagaatgtggtttcttggaattcaataatttgctgccatgttcaagaagagcagaagctgtga

SEQ ID NO: 103266 - DNA, 480 bp, Glycine max
  Peptide Sequence Number=SeqID_220044
atgccttccaattcctcctcacttcactgcaaattccagaccttagcgtgccaaacaaatcccaaccttgatcaaaaggatacccctaccacggctctctccaatgggaagcccactgtggtggagttttatgcagattggtgtgaggtatgccgggaatttgctcctgacgtctacaaagtagagcagcaattcaaggatcaagttaattttgtgatgttgaatgttgataatacaaagtgggagcaagagcttgacgagtttggcatggagggtattccacactttgcattccttgataaaataggcaatgaggagggcaatgttgtgggtaggcttccaagacagtacttgcttgaaaatgtcgatgcccttgctcgtggagaaacatctgttcctcatgctcgtgttgtaggtcaatattcaaatgctgaggcaaggaaggtgcatcaagttgctgatccaagacgtcatggttag

SEQ ID NO: 103267 - DNA, 546 bp, Glycine max
  Peptide Sequence Number=SeqID_220045
atgaatgagatcaagctactttcttcagtgagtcgcccgaatttagtttgcctcttaggttactgcatagagaagggagagcagatccttgtttatgagtttatgcaaaatggaacactttctcagcatttgcgaagacagaggagtaaaggactaccatggacaataagactcgccattgctactgaaaccgctaatgctatagcatatctccattctgcaattcatcccccaatttaccacagagacataaaatctagtaatatactcttggattatggcttcaaatataaaatagctgattttgggctttctaggcttgcattgacagaaacatctcatatctcaaccgccccacaagggactccagccagtggtgttttgaatcctaagacattagccactagaactggaagagagtccaagcaaaaggaagatgcaaatattgtagaaaacatcaaagataaccacaatgttggatccagacttgcgtcgggtaataatgcaaacaacatatgtcagtttaaatttcttagtcgtgggtaa

SEQ ID NO: 103268 - DNA, 561 bp, Glycine max
  Peptide Sequence Number=SeqID_220046
atggagggaagagaagacacagaggagaggaggagggaggcggcggcgacagagggaaaccgccactggttgccaccctccattgctcaacttgggaacctagaaattcttgatctcaaagcatgccacaatttggaagcattgcctagtgacattgcatcaatgagaagtctcacacaccttgatgtatctgaatgttacttgttagacagcatgccaaaggggattgagaaactaactcagctccaagtactcaaggggtttgtaataggaaattccagcaagacaccctgtagaataacagatcttgcaaatttgaagaaactaaagagactcagcatacacattggaagtgaggctgtcattttcccatcaagtttggaaaagttggaacttgaaggctttcccggattcacaattcctgagtggttgaagcctagcaggcttcctcagaagttgaagaagctgtatatcaagggaggaaaactcaagagcttggatcatggtgagatatgtcataagtggcatgtggagattctgcgtctccagtacctaaatcag

SEQ ID NO: 103269 - DNA, 411 bp, Glycine max
  Peptide Sequence Number=SeqID_220047
atgttcttcctggcttgtctacaccgatgggattcttgccactatgtcggatatcttgtggcaacgctacatctagtgtcaatgatgctgaatactttgccgtggtgccaaatctgttgccagtggtgctacatcagtcgtgatggtcttgaacttgaagcaaagaagatgagggccactgaatctgcctcccaaatttcagatttgaccgtcgaaggagacgaggccattgtacacggagtcaatgatggggggaacataatggggtgttgtcaccaccaagaatcgtcaaaggaagcacatggcaaggagttcgcaattgcaaatgttacagatgttggtggttgcaatcattgcatctttacatctacaaaggtggttgcggatgttagcatcaatgcaatgatttga

SEQ ID NO: 103270 - DNA, 1695 bp, Glycine max
  Peptide Sequence Number=SeqID_220048
atgtcaaagagtcgaaagcttcagcagctaatagctgagcatgaaacaaatcattcctcagaagctgaagagaaagaaaaacaccgtcacttggtgttcacagacttcccaggcggctccgagacctttgaattagccgcgaaattctgtttcggcgccaaaatcgatttatcctcttccaatgtggttcctctacgctgcgccggagagtttctcgaaatgacggaacaacactccaaagaaaacctcatctccaagacggagacctttctctctcactccgtgctcaacagcatcaagaactccatcatagcattaaaatcctgcgagcgcttactgcctctcgctgataccttagccatcacgcggaggtgcgtcgattccatcgtctccgaaacactgttcaggttgccggtgagcgattccgcttctacgctgcttctccccaccggcggaagaagaagcagaagaaccggtgaagatgattcctggtttgaggagcttaggcttctaggcttacctatgttcaagcaattaattctcgccatgaaaggatctgattctgcgctaaagtcagagataatcgaaacctgccttttgcaatacgctaaaaaacacattccagctttatcgagatccaatcgtaaagccttgacgtcatcatcttcttcagaagcggaacagaaagagttactcgagattgtgatcacgaacctctcatccaagcactccacgcctgtgaggtttctcttcggactgttacgaaccgccaccgtactgaaagcttccgaagcatgcaatgatgtgttggagaagaagataggttcgcagctcgatgaagttactctggatgaccttctcatacctagctattcctacctaaacgaaactctgtatgacattgattgcgtggcgaggattttaggttattttttggaagaagaacgaaacgttgctgcaatcgacggccgcgctccgagatcgccggggctgatgctcgttggaaaactcatcgatggttatctctcggagatcgctaccgatgcgaatttgaagccgtcgaaattctacgatctagccatctcagttcctgatcgagcgagactgttccacgatggtctctatcgtgccgttgatgtctacctcaaggcgcatccgtgggtttcgaaatcggatagggagaagatttgtgcagtgttagactgccagaagctgacgttggaggcgtgctcgcacgccgcgcagaatgaaagacttccactgcgagcggtggttcgggtgctcttcttcgagcagcttcaactgcgacgcgccatcgccggaaagctgggggcagcggaggagccatcgaggcattcggcggcgatggcggaggaagaggaggtggaggatgataataatacgtggcaggtgacggtgagggagaatcaggtgcttcgcttggacatggatagcatgaggacgcgggtgcatgagctggaacgcgagtgttcttcgatgaaacgagcgattgagaagatggacaagatgggcccacgaggaggtgggccctggcgggcctcactcgctctggggaggaagttcggttgcaagttcaaaacgcagtttctccatgctaaagcggagacccaaataactggaagtacttgtggtcggcgaaagaaaggaagccgcaaaggcttcttcctttactga

SEQ ID NO: 103271 - DNA, 552 bp, Glycine max
  Peptide Sequence Number=SeqID_220049
atggtgtgtgcaatctcatcatcaccgttctcaactctctcgtttcggcgtctcgtcgtgagcaatgcgacggtgtctccgtgcaagccgcgtgccgtgaaactcttaacggcgcttccgagcgcggggcggaggcagttgctgttttttctaacggcgacgacagcgttcacggcgagggaagcggcatccgtggcgcaggacattcccttgttcgggatacggaagagtctaaagaaggtggaggaggaagcggaggagattgtgaaggagggatttgaggctgcggacaaggggttggtggcggcggagaaggggctggagacggcggagaaggggctggtggcggcggagagggagattgaggaggcggtgagttttggggggttggcgcaggcgggagcagtggcgggagcggaggtttttgggattttggttgcaacggcggtggtgaacgatgataatttactatcggaatcactcgcatctggacttggatttttaagctatcatgtctatgataatcccgtgtggacttggatttttgaatga

SEQ ID NO: 103272 - DNA, 384 bp, Glycine max
  Peptide Sequence Number=SeqID_220050
atggaaaaggagatcataacgatgatagtagacatcttaccagtgttctactatgagaaaatggtgggttacacgccttcaagctttgcggacttagtttttgtcggcaaaaggattgaagtgggtttgaaaagaggcaaatttgatcatcctgctttgacaaataaaaagcctggggcaaatagagaggatgagaaggaggaaggaatccatgttgtgactgtcgttgctacatggccaaatttcccattagctcaacaatgtcattactcagccaatattagaccttctcattacccaccacccaatcaaccacaaaggccacccctaaatcagccacaaagcctgcttgtcgcacatccaaataccaaacaccacccttaa

SEQ ID NO: 103273 - DNA, 165 bp, Glycine max
  Peptide Sequence Number=SeqID_220051
atggcttccattctatacaccaatgaaaatggcgttgccccagttgatgtgcgtaccgagattggtagcattgtccatgataatcttccttggcaacccataccggaagattatctcccgtttgatgaacctaactaccacgctcttcgtgacactggagtataa

SEQ ID NO: 103274 - DNA, 2565 bp, Glycine max
  Peptide Sequence Number=SeqID_220052
atggagagctctgctgctatggagggtggtgacaggatttacgataatggtaaagaggatgcgagtgtgagcaatcacattgacatacttaaggaaatggactcctttctggaggacattgatgaggggttgattatatctaggatggtgggtgactctgtcattaagggcatggttaatgctgttgaggagcaggcggctgagcgaatcgctcagaaagaattggaggtggttgggctaaagaaaattctagacgagtttcgtgtgggttcggatgaaactaagacattgtggtctttggtacatcatcgtgaacccgatgaagttggtatgcatcaatttccagatagtgttgtagggcatgatagatgtataatgtctgtagatagttttcaaattgcagtacatgaacagttaaatcagctcaggaaggaagtaaataaaattaggggggctagttctatcagaagaattagttcaggttctgatttggtgggtttaggtggtattctgcaggagaatatgccggaaaaatggatttatgtcaataaagcttttgaaagccttaaagataccctagacactttctgcagaaggatggaggatatggatcatttatcaaaggcatcactttctgaatggcagcaggagcaggacttttgttcagaaattgaacggatggtgatcagcaattctatctggggtttgcaacagcagtttgaacagaaattgttggacctctatgactctgaaagtagaaattgttttaaccaatataaagagatctcaagtttgcgtcaggaattggatgcaatttttaaaacactatctgtttctgaaactgggcaccttctttctcatggatccttggagaataccgatgaatggtgtcataataagagggttgaccattttcacgtgaagctttcaacagatcccttatcaccctcaactatggaagaaaatggcaaacaggaggagtcaaagattaacaagcctgagaatttggattcagcctcattaaagcacatgtctaaagaagatttggttacttatattactaaaatgagaagaaaccatgaatctcaagtgcaagagaagactgaagagaattttcgccttaggcgggaacttttgaatttgaaagaaagaggttcttcttttccattgaagaaggacaaggagtttgagctgttgaagaaaaaaatcccagatgttatctcaaaattgaatgaaatccttgatggaaacgagaaagtacatcaattcagtgaaaacattgaatctcttagcagtttgaaggatagattggacttcttacaattggagaatcatcaactgaaggacacactatcagatatgaagaaggaatttaagagtctatcttcccagctttctgcttctgtggaaaaattgtcacagcaacaactgacacagaaaaatttgttacaaaccattcagaagcttgaggatgacataggggatgcacatactcaagtttcagttattcaagatgtatataaatgtttctttgaagatattgtgagtgagtttagatacagcaccgaagaattacatctgaagaatagtttcatgcaagaaatatatgaagtaatattcaaagaagcttcccacagtgctcaagcttctagtgggttgggaattgaggaagctgaaatggagtcaactattatgcaagggcaattggatattaatcatattatatttaaagaaacattgatgaatgcagatgaagcattaaaattcgaaagtgctgagaaagagacactaaaatatgaaatgcttatgttgaattcagtagtggaggaaaaggaaaagttaatccaaggagcagcagatgctttggttctagagaaacaaaaaacggagtctgcctctgaacagcttaacagtttaagagctgagatagttcagcaacataaattaattgcagagaacagtaaagaattgaatgtcaccaagggtaacctggtggcagctttgaaggaaattgaacaatacaaggagcaagtgcaagagctacatcaaaatcttgaacaaagaatgaacaagcttaaagaaactgatgaagaaaaaaaagtgctttgtacgcttacacaaaagcaacaagaaacactaaaactgattgaggaaaaagaaagggaaagcaggaagcaaatggaatcaaccattaatctcatctataaattgttggcaatggttactgattttgaagctagagtaaataaagatatttcaagaaatcgtttgagtcttgaaaacatgagatctgagttccattggatcaagaacaaagccaatgtacttaaaaccatgggtttggtgcacaagcaaaggctagaaacaaaatcttctgatctcttgaaggctgaagcagaggttgatcttttgggggatgaggtagatactcttcttagcctccttgaaaaaatatacattgcacttgatcattattcacctatactgcagcattaccctgggattattgagattctggagcttgtaagaagagaactgactggagattctagaaaacatgtttag

SEQ ID NO: 103275 - DNA, 588 bp, Glycine max
  Peptide Sequence Number=SeqID_220053
atgggtggagcgcaaagggccgggttggtcgcgcgaggacaagatcgcggcgatcggcgtcaaggtccgcaaatgggtcaccttccatgggatcagtctgaacgtcgaaccgaacctggatcatttcggcggcatcgtgccgtgcggcattcaggagcatggcgtgaccagcctggtcgatctaggcgtcctggccacgctggacgaggcggacgcggcgctgcggcgcagtttcgtttcgctgttcgggcccgtgacgatcgaattcctgcagcccgggggatccactatgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 103276 - DNA, 1146 bp, Glycine max
  Peptide Sequence Number=SeqID_220054
atgacctcaccttcagaggactacaggtccttgccttcagaggacaacacgtcctcacctttcgtagggatacacgtcctcaacttcagaggactacacgccctcaccttcagaggactacacgtcctcgccttaagaggactacacgccctcacgtttagagggctacacgccttcaccttcaaaggactgcacgtcctcgccttaagaggactgcacgcccttatcttcaaagtgctacacgccctcgccatcagaggactggacgtcctttccttcggagggctacacgctctcacctttagaggactacacgtcctcgccttcagaggactacacatcctcgccttcagaggactacacgtcctcacttttagaggactacacttcctgacctttagagggctacacgtcctcaccttcagagggctgaatgccctcgcctttagagggctacacgtcctcgccttcagaggcctggttgcacgccccctcgcctttagagggctacacgtcctcactttcagtgggctccacatctgcacctttagaaaatttaaggtcctctgccctgaaatgcttaatcgagacttgcactcctgggaggctatcacgcagctactatgcataccgagacaagatttcacccgtgccactgcaaagagacgagtgcggatcatgcacaccaacatgaccactcttacacagatatggatgacgttgctacttagcaacgttccgtccagcgaccatgatgccgatctccccctgcggaagcatcagggtcgcgcccacaagacacctagtggacctagaggagcccaacagggccctggggtttccagctctggttacggtcctttgtcagtcctacagagtgcccgtcccccccagcaagggatcgcacccgcaagacacccagtggacccggagaagtccaataaggtcttggggtttccagctctgattacgggcctctatcagttctacggagtgcctgtcacccccaacaaggtcatcaggcccctttctaaccgagctttcatcaagaaatactacgccccccaggaaggcgcagggcgagacaccacagcagcctggggatggctggcagcaggcaataaacgcaccatcgccacctctaga

SEQ ID NO: 103277 - DNA, 710 bp, Glycine max
  Peptide Sequence Number=SeqID_220055
atggacacctcagagccctacactggggcaatgaaaggcaccatgcataaacctcaagcgaacctaggggcagatcagaagttctcacccaataggttccctgctacaagaggccctctcgatgagtcaatctcttgctttctcataagggtggacccttgggtactagtacctatcgccttccgagggctgcacaccctcaccttcagagggatgcatgtcctcgccttcagagggctgcatatcctcaccttcagagggctgcacgccctcgccttcagagggttgcacgccctcaccttcagagggttgcatgtcctcgcctttagagggctacacgccctcgcctacaaagggctccacatccatgccttcagagaactcaagggcggccaactgtgcgagcacaaccagaggagggggcgggtcttcggctttgataaggagactatcgcacagctactatgcataccagggcaagatttcgcccagccactggatcacgcccacaagacacccagcggacctaaagaagtccaacaaggtcctgggatttccagctctgattatgggcctctgtcagttctacagaatgtccgtcgcccccaacaaggcacaaggcgaggcaccacagcggccttgggatggctagcagcggctgaagcgttgcctacgacacgtggccgaccagcaggcggccaaccattggg

SEQ ID NO: 103278 - DNA, 177 bp, Glycine max
  Peptide Sequence Number=SeqID_220056
atggagaattggcgaacagcactacacataacttcgcaggactccagactcgatgcgctaggcaataacattcatggggctccgaaaaaggtggagaatggagaattggcgaacagcgctacgcataacttcgcggggcttcagactcgaaggtggaggatgcatgaacagcgctag

SEQ ID NO: 103279 - DNA, 557 bp, Glycine max
  Peptide Sequence Number=SeqID_220057
atgccgatgcgtactcgcggatccgatggagctgggacatcccagggaggggatgatatccccaaccctccacctgctccaccttctttggctgacgccattgctgtcctgctaagtgccacaactgacaacgctcgcttgctgcgcgagctagcccagcgtcaaccacaccctgctccaaacttcagagcaccgcgcaacggggatggagaggctcggtatgtggattttaccgagaccaggcccccggtgttcactaaggccgatgagcctttagaagcggatgactggctccgaactatggagcataagttcagtttaattcagtgttcagaaactcagaaacccttatttgcagcccagcagcttcggggagctgcaggtgcatggtgggagaacttcttagctattcaagctcccggacaccaagttacctggaccgagtttagggacgcgttccgcgcccactacatccccgaagggctcatggccatgaaggccgaagagtttctcgccttgcagcaaggcgataaaagtgttatggaatacgtggcaag

SEQ ID NO: 103280 - DNA, 162 bp, Glycine max
  Peptide Sequence Number=SeqID_220058
atggatggcgaagagctaccttcgcctgggcaggatcatcttgagctaccttctggggtggggacaaaacatgaacagcagaaaccaaccaaggtacttaggaacggatgcaactggggatggggtcacgaccgactgatcgtcaccccttctctgcgctaa

SEQ ID NO: 103281 - DNA, 297 bp, Glycine max
  Peptide Sequence Number=SeqID_220059
atggcagtggaagtggataatcaaggtaacaacattctacactttgctgcgcatcttccagttgaattccaagaattgtccagtttaagagcaagcattcaaatgcaaagagagctccaatggttccagttcgtggattggtatgttcctcgtgaactaagaagaatgagaaacaacatgggcaagagaccaattgatgtattttatgaagaacacaagacgttatccgaagaaattaaagatgcaggcaaaggaatagccgaatctggcaatgctcgtgcagcacttgttgctacc

SEQ ID NO: 103282 - DNA, 177 bp, Glycine max
  Peptide Sequence Number=SeqID_220060
atgaacaacatagttgaagggtcacttggtaaatttgttgatgaaaagaaaactcaactgctcaaggacaaaggtttgcctattgaaggttgtgctattgttgctggtcgtacagacaaaggagtgacaggccttcaacaagtctgttctttctgtaagtcatttccctgttcttag

SEQ ID NO: 103283 - DNA, 270 bp, Glycine max
  Peptide Sequence Number=SeqID_220061
atggagaagatgaccgaacaaaagatagaggaagcaaaagaacatcacctagatgaagatgctctgataccacataatgtagcttcatctagagcttgcaggcctttgatcttcttcatcaatgtagtcttttccttcttgaagatcaatggtagtagaatggagaaggaggaaagtgaatttcagctatggttcaacccactaatccaagatcaaatccaagattcttcactaagtgagcttaggcgtcatgaggcatgtaaagcatga

SEQ ID NO: 103284 - DNA, 213 bp, Glycine max
  Peptide Sequence Number=SeqID_220062
atggcgtcagaagacatggagaagactatgttcgttaccctttggggaacattctattacaaggtgacgtcctttgagctcaaaaatgctggggcaacctatcagcgggctatgattgaagtctacgtggatgacatgattgccaagtctagaactgaggaggaacatctcatcaacttgtggaagttgttcgagaggctgcggaagtactaa

SEQ ID NO: 103285 - DNA, 295 bp, Glycine max
  Peptide Sequence Number=SeqID_220063
ggatcgtgcccgcaagacacccagtggacccggagaagtccaccagggtcctggggtttccagctctgattatgagcctttgtcagttttacgaagtgcccatctccccaacaaggtcatcaggcaccctattaaccgagctttcatcaagaagtactgtgccccccaggcaggcacagggcgagacaccatagcagcctggggatggccggcagcgggcaatagatgcaccgccaccacctccagagcccctcagctcatctacaaatgctggagtgttgcctatgacgcatga

SEQ ID NO: 103286 - DNA, 339 bp, Glycine max
  Peptide Sequence Number=SeqID_220064
atggcccatgttgaatcaacaccccaaatccttatagaagagcttttgagagaagaaccgcaccgggtacaattgggatttgaatctctattttgtgaccatggttggataaaccccttgtcgcaacctaccgttttgcgggcgagcgaggcgaggctcacgggtgcatcttccaaaggaggaaaatgcgcggagtcgccaccaacgtttatttgtggaaaacgtcggaaaaaccgaaggaaaccggtcatgaagaatattccagattcgggagttgtatttacgtttgaggaaggtattagcacctctcacacttgtcccaaaggacaacagccttag

SEQ ID NO: 103287 - DNA, 111 bp, Glycine max
  Peptide Sequence Number=SeqID_220065
atggtaacgcggccacagtttgccgcgcaatgtcgtttcctactttcaggaattaatgaaacattgggcttaatccggattttggttatggacttgaagagggcaaattaa

SEQ ID NO: 103288 - DNA, 324 bp, Glycine max
  Peptide Sequence Number=SeqID_220066
gatgagtatattaaggcttattatgctgctttgcttaaacaacaacatgaattggaagctgctagtaaacaagaattgtcaaatacactcactgcaaatgatccttctagcagtgcttctaatcgtcaagttggcatgaaatcaaaacttgaggaagatgatgatggtactgaatgggaggaggctccagttgcagaaggctccttgctatgcgaaggtatggggggaggtactggaaatgaaaattacaaggtcgatttgaatgttcaagctgatgatgctccagcagatgacgacgaagatgtggactgggaagaaggttga

SEQ ID NO: 103289 - DNA, 219 bp, Glycine max
  Peptide Sequence Number=SeqID_220067
atgaagcagctgatctccagagagttctggaaactattaaagcactctcatgggcctggtttggctgcagaagtacactctcggaaggactgtcatgcgcaaactgatgacagtttaagaaccagaaataaggattcaggtgttggatctatgtcccacatcgagttgggatgcttgagggagtatctaagtgcttggttctccccccttaacaactag

SEQ ID NO: 103290 - DNA, 117 bp, Glycine max
  Peptide Sequence Number=SeqID_220068
atggtggttggggctactactatcaaacctgttggaggtgctgctattatcctggtgaacatgttgatgtgcgtactgatgctcaacctcgcaactaaacatgaacattgtgcttaa

SEQ ID NO: 103291 - DNA, 1050 bp, Glycine max
  Peptide Sequence Number=SeqID_220069
atggcaatgccatcgggaaatgcagtaatgccggaaaaattgcagtttccgggtggcggtggtggtagtgagatccactaccgccagcagtggtttgtggatgagagggacgggtttatcggttggcttcgcagcgaattcgcggctgcaaatgccatcatagactctctgtgccaccatttgcgttgtgttggggagcctggggagtatgacatggttgttggggcaattcagcagaggaggtgtaattggactcaggtgctgcttatgcagcagtacttttctgtgtctgaggtggtgtgtgcactgcagcaagtgtcatggaggaggcagcagagggttgttgatctggcgaaaaccggtgcaaaggagtttaggaagttcggttcggggattaggcaagggcagcacaggcttgaggctgccaaggatggttataattctagtgtagagtctttttgtcatgggacaaatgctgtggtggttgctggaggtgtggagaaagggacccctttgaccgagaagaatggagaaattaaatctggtggcaaggttgggaccatggataacaagagtttagcatctcctgaggagaggaaagatactattacaaatcatcaatctgatggtattttgaagggctctgggaattctcaaggatctctgtccacctctgaatgtgaagctgtgggtgtaaatgaagaatgtgtatcaaattctaaagagaatgattctaccatgggaaaaacttttattggcaacgagatgtttgatgggaagatggtgaatgtggttgacggactgaagttgtatgaagatttattggataggactgaagtttcaaaacttgtttcattggtcaatgatctgagggttgccggaaagagaggacaatttcaaggcaccaactctgagattccaaggtgcaatagaagacacttggttattgatatttggttaaaagaagacacttggttatcaacagagatgactaattcaaaaccgaagaataacaaatcctcccaatgcaaagaaataataggaggttaa

SEQ ID NO: 103292 - DNA, 465 bp, Glycine max
  Peptide Sequence Number=SeqID_220070
atggttgcagatgaacactttgttgtcagcattccaagtgacctacctcttgatattgctgctcctctcctttgtgcagggatcacagtgtatggtcctttgagatatttagggcttcacaaacctgacatgcatttgggtgtggttggccttggtggactaggccatctagctgtcaagtttgcaaaagcccttggcttgaaggtcactgtcatcagtacctctcctaataagaagaaagaagccatacaaaatcttggagctgattcctttgtggtcagtagagaccaagatcaaatgcaggctgcaatgtgcaccttggatggtataattggtactgtttcagcagtccatcctctcatgcccttgattgatatgttgaagtgtcatgggaaacttgtaatggttgggacacctgagaagcctctagagttgctactcccgtctttaattatggccgggtaa

SEQ ID NO: 103293 - DNA, 990 bp, Glycine max
  Peptide Sequence Number=SeqID_220071
atgtcaggaaatcagacatttgtggtttcaaaaaggcccatgaaaggacatggaagggaaatgattcagttgggtgttcccattgctgatgcaccaccagatgtggacaatttccaccaattgaatctgacagataagaaagtagaatctatcccttctttgttccaagatattatcaagcgcttggttgcctcgcaagtgatgactgtgaagcctgatgcttgcattgtggatttctttaatgagggtgagcactcacatcccaacaattggcctccttggtttggaagacctctttatatgcttttcctgactgaatgtgacatgacttttgggagaataattgtctcagatcatcctggggagttcaggggtgctgtcacgctttctcttgtacccgggtcccttctggtgatgcaagggaaatcaactgatttcgccaagcatgctcttccttctattcacaaacaacgcataattgtaaccttcacaaagtcccaaccgagaagttccctgccaaatgattctgaacgacttgctccaccagcagcgccccattgggccccaccaccgagcagatctcccaatcatgtgcgtcatcaattaggccccaagcattatcccacggttcaagcaactggagtactgccagctccgaacggtatgcagccgttgtttgtgccggtgccggtgccagttgcatctcccatgtcatttcccacacctgtgccaatcccacctggttccattggatggacctcagctcctccgaggcatcctcctcctcgaatccctgttcctggcacaggagttttcctccctccacctggctcaggtaccatacatgaagtgaacccaagtgtggaaacttggactgtgtcgggaaaggaaaatgggaaatctaatcacagcaagacaaattctgaagctgaagaagctggtgtagagaaagaacacgaaagcaacgacatgacggctgcaagccattga

SEQ ID NO: 103294 - DNA, 276 bp, Glycine max
  Peptide Sequence Number=SeqID_220072
atgtcaaatggtgacatgttccagaacaaccatgatgagatagactttgagtttttggggaacattagaggcaaagactggaggattcagaccaatgtttatggcaatggaagcaccagcattggtagagaggaaagatatggcttatggtttgatcctgctgaggatttccatcagtacagtattctttggacagattctaagatcattttcttcaactgttctattattgccttttatactctaacaatcccttgctttgatggagtggtttga

SEQ ID NO: 103295 - DNA, 297 bp, Glycine max
  Peptide Sequence Number=SeqID_220073
atgacatgcggcaataccgtatggttatccgcatcttttgtcaaccaagggcaaacgagcccattgacgtgtgccgcaacgtgccctttcgcgggcgagcgaaggcgaggctcacgggtgcgctttccaaaggaggaaagatgcgcagagtcgccaccaacgtttatttgtggaaaacgtcggaaaaaccgaaggaaaccggtcaaaatgaaaattctaagttcgggagttgtatttacgtttgaggaaggtgatcattttaaggcgttggaccttaaaaatgatccatttacttga

SEQ ID NO: 103296 - DNA, 342 bp, Glycine max
  Peptide Sequence Number=SeqID_220074
atgagaacaaagtatgagccacgaaaagataatgcagccaaaaccaaagcaaacacacaattagcaatagccaatagaaccatccaccaaacaacaggacatcaccattttcagagatgcacagaggcttcagtattacacatggcagatgggcttgaagaagctcaagagttacattcaacaattgagtccaagaattttcaactccaaattccctcattagccaaacaacaaaatgggttctccggtgaacatgagaaagacacaagcagcctttcaataccccaagttcagggccacggggaacttgagaaagaccattcggcatcagcaaatatttga

SEQ ID NO: 103297 - DNA, 216 bp, Glycine max
  Peptide Sequence Number=SeqID_220075
atggcgtttggtgccgtggttgaggtggatggcatggcagctatggaagcaactgtagaaggtgctgctattatcctggtgaaaatgttgatgctcatgctgatgttgaacctcgctactaaacaggagatttgtgctaagttagctttaattatagacaagtctttaaatgagagatttacaagaggagatttcatggcagaacctgagaactag

SEQ ID NO: 103298 - DNA, 402 bp, Glycine max
  Peptide Sequence Number=SeqID_220076
atggctcgtggcttccaagttcgagctacttcagttaccatatttgctcatttgttgttcatagcaatagcaacccttgtgttagtttggttgctacactttcgagaaggtgtggccttcttcagctcttccaacccagtcaagattttcaacctgcatcctcttctaatggtaattggatttattttagttggtggagaagcaatcatgatatacaagtcggtgcctgaaaaaaggaggtcagtgaaggtggttcacctcctattgcatctgatagctttagtggctggaattatagggattattgcagttttcaaatctaagaaagaggcaggtcttgctgatatgtatacattacactcttggctaggcatgtcagcaatctcactatttggcttacag

SEQ ID NO: 103299 - DNA, 303 bp, Glycine max
  Peptide Sequence Number=SeqID_220077
atgacgaacgcagagggagaagagaaagcttttgtttgtcagtcagcagagcgcgcgggggaaagagggtttttggcctttgggttttataaagaaagcgtcggtaaagctggtggtgacaaatggaaatcgctgtctgatgctgaaaaggcccccttcgttgctacggccgaaaagaagaaacaagagtatgagaaaactattttggcttacaataagaaattggggaagaattcagaggaagacgagtctgacaagtcaaagtctgaagtcaatgacgatgaggaagatgaggtagattga

SEQ ID NO: 103300 - DNA, 2497 bp, Glycine max
  Peptide Sequence Number=SeqID_220078
atgattggaggcaaagatcttgttcccaatggcgttgactccgagagtgagaactcaaggaacaaggtgcaacaacatcagcagcatcatggttttgctcatgctaacaaggaacaccctcaagagaaaaaaccgagttttgatgagtttcggtcaacaacaccctcaaagtttgccacttctgggatgcaagaattgaccctcagctatctctgtgagaatccaaaattgggtcttgctgagagagaggttggtgatagaagcttggtgaagggcaaagaagttgttgtttatgggaattcagatcaagatgagaaatgccaatctgggttgggtctgacagaaggggttagtctctcgcagcgtgacgaattaagatttaaaacgtcgttgggagaggtgtccccgtttagtgtgcaacagtacttcgaacagaattgtcttcgaaggaagatatccgtgggaaaccaaaaccaaaagcaagatcaagatgagaaatgggtagagagggatttcttgagtttgagtgagacaagggagaattcttcaaagagatccatggaggaagagtgtgaaagggagacgaatggtggcagcaagaagcagaagcttgagactcttagcctctctcttgctttgcctgatgtgtcgctctctctcacagcctccaacgctttgcaaaatggcgaccaactcgttaggccaaagcctagtaagccatccacaaggaccacaactactatcaattcatgttcaaatgattacacagcagcttctgtgtctcactcttactctcaccctttctcacacaaccaaagttgctcactcacccgaaattcgaccgagaatttcgagtactcacacagcaaagatgatcaaatttggcattgtggggaggggactaatggctcggttcatagcaggttcaagccaattggagatggggttgctttggtcaatcattccttcatgcaagggaatagtcagtataaggctactagctcagaaaaccaatctgttttcccttcagaattgcctgcaagaatgagatttgaagccaagtcagagggctcaagaggaaagaattctgggaatttaagagggttggaaggtgtggatggtgggaaaatgaaattttctacatcagagagagttctaagagagattgtgtctgagtctatcccagccatggcattgacatttcaggagttcactgaagaagtcataacttcaattaaggaatacctgaaaggtctcattgaaatgccagagaagaaaggagaactagagagcctccagaaccggctcggccgaagatctgacctcaccagagagactctttcaaagtgtcataagcagcagctggagattttggctgctatcaagatggggcttgggagcttcttgtccggtaagttccaattcgcggagacagtggatgttttcttgtacatgaggtgtagaaatgtgaactgcaagagcttgcttcctgttgatgactgtgactgcaagatgtgttcaggaaataaggggttttgcagttcttgcatgtgtcctgtttgtatgagctttgattatgcaagcaacacttgtagttgggttggttgtgatgtttgttctcactggtgtcatgctgcatgtgccattcagaggaatctaatcaaacctgggcctagtttgaagggtccttctgggacctctgaggtgcagtttcattgtattggctgtggacatacttcagaaatgtatggttttgtcaaagatgtctttgtgtgttgtgccaaggattgggggctagaaaccttggcgaaagagcttgactgtgtgaggaggattttccggggaagtgaagatcgcaaagggaaggaattgcatattaaaaccgaagatatgctgttaaagcttcaagctaaactggtttctcctttagatgcctgcaaccacatcatacagtttttcaactacgtggatggcgtgtcagactttcctgcttctgctatatcctcaaaggatttgtcaacatctaaggctaaccttgcaatggacacaacaacatcatctcttccacaatctacttctctaatacaaaaatacacttatgacatgagctacactaggtcaaatgatcttcaacaaaaagacctcaaatcctccctcttaagtgaacataaaaatgagagtgatttccacttagaggctctattagggaaaggaggagggcttgaaagcttggagagcatcgtgcggataaaagaggccgaagcgagaatgtaccaaaacaaggcagatgaggcaaggagagaggcagaagggttccagaagatgatcaagacaaaggctgcacagatggaagaagagtatgcagaaaggattggcaagatttgcttgaatgaggcagaggaaaggaggaagaacaaatttgatgaactcaatgtcttgcaaaattcccactacgattacttcaacatgaaaagcagaatgcaagatgagatccatg

SEQ ID NO: 103301 - DNA, 2469 bp, Glycine max
  Peptide Sequence Number=SeqID_220079
atggcagaaaataaaaagcctcataccgatggtaccaagaaaacaccttctccttatgatctaaactcaaacgacaaccctgggaacttgatcacacaagtgcagctgcggggtgagaactatgaagaatgggcccgagcaatgaaaatctcgttgcgtgcccggagaaagtggggcttcatcgatggaacctatgaacagcctgacgatggctcaccagaaatggaagattggtggactgttcaatccatgcttgtgtcgtggatattgaatgccattgaacccaccctgcgttcaaccgtgacatatgcggaaaacgcaaaagatttgtgggaggacattcgagatcgtttttcagttgtaaatggtccgagaatccagcaattgaaagcggaattggcttattgcaagcaacaagggatgaccatggtttcctactatggcaaattaaagacactttgggacgagctcgcgaattatgagcagatccctcggtgttcatgtggaggatgcaaatgtgatattgcatccaaactcgaaaaacgaagagaggaagagcgggttcatcagttcttgatgggcttggatgatgcgagttatggtactgtgcggtctaacatattagctgccgatcctctaccttcattaaatcgagtatacgcaattctagtgcaagaagaaagggtgagaacaattagcagaacaaaggaagagagaggagcagtcatgggtcttgcagtacaagcaggacataaaagaaagcaggacatgatgataagaactgcttccaagtcgtcggatatcctgactggtagggtgatcgcccacgaagtgaaggcggatctagtggcaaaaatcagcaacgaaatgggacttcagctggactggcaaactcttgttgagatgctgaacaaccgtaagacagatgagactgagaaaatgactgggtatttgaagaatttatgtcaacaaagaacaatacgaggatgtccggtgggattgcgtgatggagaaaaagtaattgccaccaaagaagggacggtgattcttgatgggggtctcaaacttgaaaatgtcctttatgaccgcactttgaagacgctgattggagcgggtgagcggaaagatgggctttatttgtatcatggtgttcgaaattccaaggcttatcataccagtacaaaatatgaccttgatatcttgcacaaacgcatggggcatccatcctttaaggttgttaaattgatccctaatgtaactagtagtggtaagcattcgaataaagtctgtgaaatatgtgaaagagcaaagcagacaagagaaaaatttcccttgagtacttatcgtgcatcaggaatttttgatttaatacattgtgatctatggggtccttatagaactccttcatcatgtggtgcatcctattttttaacattagtagatgattattcccgttctgtttggatatatttgttgagtgaaaagagtgaagtgtctcaaacaatgataaatttctttgctctaattaaacgacaatttgataaacacgttaaagtgattagaagtgataatggaactgaattcacttgtttgaaacaatactttcttgaacatggcattctccatcaaaaatcatgtactggcactccgcaacagaacggaagagtcgagcggaaacacagacatattttaaatgtagcaagggctctaagatttcaagggagacttccaattcgcttttggggtgagtgcattttaaccgcaggttacttgattaatttgacaccatcgcccatccttgatggaaaaactccatatgaactcgtccatggaacctctccttcctatgaccacttgcgcgtgtttggttcgctttgctatgcacacaatcaagatagaaagggagacaaatttgatagtagaagtcgtaagtgcatttttgttggctatccatatggtcaaaggggatggaaattatatgatttagagagagaggtcttctttgtctcacgagatgtaaaatttgttgaaacagaattcccatttgaagaatcaatcaataatccttccccaacatcactggtgcccctcattaatccatgtatggatggggaatgcatggttgaaaatggccatgataatgacacaaatgctgacgtcagggggggtgctagtgaagcaagcaatgaaccccaaagctttgcaccaccactagaaacacagaattgcatagatgttgtacaatgtagtagtgaaggaccggaaacaagaagcaacattcctcccacctctccacttggaaaaggtcatcggatcaagcgaccgtttgtgaagttaagtgattatgtgaccaacaccatgatcaagttgagcccatctacctgttcctccgcttcatcacatgattcaggtgcgcgttatcttatagctcactatgtaaattgtgatagattttcaacaactgattga

SEQ ID NO: 103302 - DNA, 831 bp, Glycine max
  Peptide Sequence Number=SeqID_220080
atgtcagcatccaagctcctcgtattcagcagtgctttgaaaggacttgatgatactccacaacctaaatctaaggttgcttctaggtggattgttgttaagatccatataaacatgatgactccaaacttgaatctggaaccagaagatgattttaaagtcctcatccaagtaggttctgataagtcgatacgagagacatcacatgatcttaccaaggccgatcctgacccaggtcctgtttccctggacttgtccctcaacttcaatcccggtgatgaagagttgaaagttacaagtgacactaactgtgaagtaggacctgaaactcatgcctcagcatcagcaattcctagagttttctcttgtaattattgctggcggaaattctttagctcacaggcattaggtggacaccagaatgctcacaaaagggagaggacaatggcgaagcacgcaatgcgaatggggatgttcgctgaaaggtacacaagcctagcatctctgcctcttcatggttcctcttttcagtcgctcggacttgaagctcatgctgcaatgcaccaaggacatgtgcatcatcattcaatgagggctcctgatataagagctgcagcaaaattcggtaaagactattttcggatgccgatcttcttggaagatgatgatgtcggtctattttggcctggaagtttcagacagactgatgaaaggggtggtgttaatttggggcatggtgagcatgctcataattcaaatacttgttttgtagtagcaactgcacctccagcacaaacatctgcatctcctgatctcactctgaggctttaa

SEQ ID NO: 103303 - DNA, 1248 bp, Glycine max
  Peptide Sequence Number=SeqID_220081
atggatgttgaatctaatttctcacaaattgctcatcttgtctttgatgggaagagttatgacctttggaagcatcgcaagaagattaaaaccaagaaggtgaaggtaaagacatgcctatttgctagtgtttctcaaacgatcttcacgaagatcatgaatgtcaattcacccaaagaaatttgggattatttaaagaaagaatatgaaggatatgaacacgttcgtggcatgcaagtgctaaacctgatgagggaatttgaggtgcaagagatgaaagaattcaagataattaaagggtactcggacagattgtttgacatcgctaataaggatcaagttcaacatcaaccaatgcaaaaggaaattagaagaaatcttatccgtcttgccaacattgtggaaagaaagggcatcctctattcagatgttggaaaagacctaatgctaagtgcaataagtgtaatcaaatggggcacgaagcttacagtggcaactggtcagctgtttcaaatggagacggtggtggctgctgctgatgccttattgctctctgttgctcctcacatcccttggatgtgccttcaccaaccatgttgtaatcacaagagactgaaacaagaaaaaatggccgtgatcagctgccaccttctaaccagattaaggagaaaaaaaggcgcggtagcaaaggaatcagagtcgaggagctatggggttgttgttaatagcttctacgagcttgagaaggcatctatagatgagcatgagtgcctaaaatggcgtgacacaaagaaacccaattcagttgttcacgtatgctttggatgcacagtaaagttcaaaagagggtgggtgcctcaagtgttgattcttgaacacgaagcgattggcgtgtttgtgactcattgcggatggaattcatctttggaagcagtgaatgcaggggttcccatgatcacttggcctatgggtgccgaccaaattttcaatgagaagttggtgactgaggtccttaaaattgggatgcctattggtgctagaaaattgtttcgattggagggagatagtattacatgtgatgcagtggaggaggctgtgaagaggataatgattggtgaagaagccattgaaatgaggaacagaacaaaggtgccttcgcagttagctaagcaggccatgaaaggaggaggatcatctttcactgagttggaagctttagttgaggagttaagttcattgaactactaa

SEQ ID NO: 103304 - DNA, 387 bp, Glycine max
  Peptide Sequence Number=SeqID_220082
atgttttggtccaagcctgaactcgtttgtcaggttcgaggactctggtttcaagatctgggggatgtgagatttgggtttgggaatgtgagcttgattaaggggaaatctagaagcttttgtgaaaggaagtgtttgagggattgtgggtgtggtggcttgagttttgacgaagggagtgggggttccaaagagggatcgggtgggaggaataaggggtttgataggaaggttttgagtggggttgttgtggttttgggggtggtggtgatgagtttgttggtgatggtgaagaagaagaggggtggtggaaaaaatgggttggaggaggaggaagatgagtttgtgcttgtgttgaatttgaaggatgtggtaagaagtttttaa

SEQ ID NO: 103305 - DNA, 2223 bp, Glycine max
  Peptide Sequence Number=SeqID_220083
atggcaggagtccccgctacggacaccttccacctttatggatccatcaacaaaactcgcgtcaccatactgataaatagtgggagcactcataatttcattcatccccgcgtcgctaagttcttgaacctgcccgtcaaagacactgtacctctaagaataatggtaggtaatggctccgtaatggactgtaatcaactgtgtgccgacatgaagctcttcatccaagaacatacattcacggtgacactacggatacttcccctaagtggagctgaagtcgtcttgggcgtagaatggcttcgaactttggggcctgtcatcaccaactgcgcctccttcataatgcagttctcgtactcgggcaaatccatcaaccttcacgccgatgttcagactgattctagtccagcctcagctaaccaggttaaacgcatgatttccactagttctacttcaggtctgttccatctttctcttatacccatggattcgactgcaacaccttcacaccctttccattccatcctcgccattaacgagctcctgcttaaataccaatctctatttcaacaaccctcatccctacccccttcccgacaacatgatcatcacatcaatatcctccctacagctaaccccatcaacaagacagagattgaacgccaggtctcgaccctactcgactccggcctcatccgaccaagtcgaagtcccttctcttccctgatattgttggtgaagaagaaagatggaacatggtggatgtgtattgaatatagggcgctgaatacgatcacagttcgagatcattttccactcccaacgatagatgaactcctcgacgagttagggaaggcatcgtggttctccaagcttgatctatggcagggattccatcagattttgatggcagaagaagatatcccgaagacagcctttcgcactcaccacgatcactacgagtactgggtgatgccttttggactctgcaacgcgccgtcaacgtttcaggccgccatgaacgctttactcagcccattcttgaggaagttcgcgtcagttttctttgacgacattctgatctacagtgcaaccttcaacgatcaccttcatcatctcgaatgcgtcttcaattctcttctgcaggctcattattacctgaaacaatctaagtgcttaattggtcaacgccagcttgactatctaggccacatcatctctagcagcggcgtcagacctaacccgactaagattcaggcaatcgttgagtgggctacgccgcgatctccgaaggatcttcgtgccttccttggcctcacaggattttatagaaaattcgtgcagggatacgccgccattgcagctccactaacgaaactccactgcaaaaatgcatttcagtggacctcggagtctcaagatgccttcgataaactgaaagttgtcatgactgccgcgccaatactatcccttccagatttttctatcccctttgcactcgaaataaaagcatcaagcacggccataggtgttgtccttcagcaacacaaccaccccatagcttatttcagcaagccattttgccagcgccttcaacatgcttcagcatatgttcgtgaattgcatgccatcatcaccgtcattcgcaagtggcggcagtacttacttggccttaaattcaccatatttaccgaccatcggagccttcgaaagctcatgtctcaggtagtacaaacgctggagcaacaattttacctggccaagctgcttggatacgactacaatatccaatataaagcaggatcttcaaatatcatcaccgattcactctctcgcagggataatcactcccctggccaatattttatcctctcagctcctcaccctgagtttatgattcaattaaagggcacactcctggctacctcggagtttcagaagcaacaaaaggccatacattctcagtccgaagcgtatcctgagtttttgatttcagatgacttcatcattttcaagggcgctatatggttagactctcagaacccattcatcccatctttattacatgagtaccatgcgacacctgttggcggtcattttggagtgaaaaaaactttgcatcgtcttcaatctaacttccgatggcctgacatgcttaaggacgttaaaaccttcgttcgacactgtgcattgtgtcaacaaatcaaacatatcacatga

SEQ ID NO: 103306 - DNA, 162 bp, Glycine max
  Peptide Sequence Number=SeqID_220084
atggttggaacattctctcaaaatagcgtgaccctgattggtctccctatgattttacctactgagagtgacctaacttaccagtgtgtgatgattaggtggatggctatggagaatcttatgctagagaacgctggaacacaatgctctgataaaatgtga

SEQ ID NO: 103307 - DNA, 249 bp, Glycine max
  Peptide Sequence Number=SeqID_220085
atggcagagacagtggctataatggcgatgatattggtgacgatgaccatgttgtgtcgtattagtggtgatgctggtggaggtagtaacaatgttggtggtagatgtagcaacaatggtgatgatgatgcatgtggaagtagtagtggcgatagtagtagtggcgaaggcattggctataatgacgatgatagtggtgacggttaccatgttgtgtcaacgatgggggtggccatgttgtgttggtga

SEQ ID NO: 103308 - DNA, 246 bp, Glycine max
  Peptide Sequence Number=SeqID_220086
atgcagaaaggtggatttagaggcattgtgggtcacaaaagattcttcccacttgtggttgtgagagcttcagaaatgaggttgacaatgaaatcttggattgtctcttactctataaggaatgcatcacaagaaattggagttgagttacaaggaattccagatctgataattggaaactacagtgatggaaatcttgttgcaaccttgttatcttataagctaggaatcacacaagtgcactaa

SEQ ID NO: 103309 - DNA, 357 bp, Glycine max
  Peptide Sequence Number=SeqID_220087
atgtcgttcgaaaagaccctagccgttgtcggccaaacaaattctagccggcgttgtattaacaacaacaaaaatgttagtaaaggtagtagtgatgatgataacagtgatgatgttcatgacaacattggtagcggagtcaatgttgttggtggtagtagtagcaacgacaacaccaataatgatgacaacaacattgtggtagtggtggtggaagtgcaggtggagtgcaatgatattagtactagtgatgataatggtggtgatagtgacgatgacgacaatgataatgatggtggtggcgacaatgtgctagtagtggtggcaatgctagtagaggtagtaacaatgttgatg

SEQ ID NO: 103310 - DNA, 390 bp, Glycine max
  Peptide Sequence Number=SeqID_220088
atggccggcgaggagctcgccggagaccacacgccggagctgctgtgtctggtccatgacatcgccggaatgtgctcggcgttatcctcctccgccggctccgccggcgccatgttccgcaaggactgcaccgatctggttcgccggatctccctcctcacccacctcttcgaggagattaaggaactcagcaacaacgttgtcggtggttcttcttcttctccttctccttcttcctcggcttcttcaaagtggtcttctgatctggtcctcgcgcttcactccgcaagacgcttgctttccgtcgctagaaacttccgctccaattgctcctctgtgagtttcacgatccatttccaaacgacgtcgttttgttcggtttttgagtag

SEQ ID NO: 103311 - DNA, 1620 bp, Glycine max
  Peptide Sequence Number=SeqID_220089
atgggagctgcaaagaccattgtcttccaatttcagtgtgtgacatggaaattggagaaactgttgagcaatttgccatatgacgatttggacatctcggaggaagtcaaggagcaggtggatttggtgagaacacaattgagacgggccacggataaatatgggtttatgatttcaaagatgccatctcatgaattatcccagccactggctgaagaaattagtcaggttcttggcaaatctgtgagtaggttgcacaaacaacaaagctgccctgaaaatttatcagaactagacagcattcctatcaacgatgaagggaaatgctgcagcacaaatcctgccagatctcgcttggaaagaacaaggagcatccctactgaagttgaagtttccttaaatgcaattgaacctgaaagtcaagaaatttctgagacaaagagtctacctgaggttaaaaagactgaaggaattgtgatccctgaagattttctttgccctatatccttggaactaatgagggatcctgttattgtagccactggtcagacatatgagagatcttacatacagagatggatagattgtggaaatacaacatgtccgaaaactcagcagaagctccaacatttgacccttacaccaaattatgttttaaggagccttatttctcagtggtgtatagagcacaacattgagcagccaacaggactaaccaatggaaaattaaagaagagtgatggatcattcagagatgttacaggtgacatagcagcaattgaagctctggtatggaagctctccagccgatctgttgaggagcgtagatcagctgttactgaaattcgattgctatccaaacgaagtactgacaataggatactaattgctgaagctggagcaattccagttctagtcaaccttctaacatcagaagatgtactgacacaagacaatgcagttacctcaattctcaacctctccatatatgaaaacaacaagggacttataatgcttgctggtgccattccatccattgtccaagtcctccgagctggaaccatggaagcaagagaaaatgcagcagcaacccttttcagcttgtcacttgcagatgagaacaagataattattggcgcctcaggagctataccggctttagtggaattgctccaaaacgggagtcctagaggaaagaaggatgcagcaacagcattgttcaatttatgcatttatcaagggaacaagggcagggccattagggcaggtatcatcacagcattgttgaagatgcttacagattcaagcaaatcgatggttgatgaagccctaacgataatgtcagttcttgcaagccaccaagaggcaaaagttgccatagtaaaagccagcactataccagttttgatagatcttttgaggaccggattgcctcgcaataaagagaatgcagctgctattctacttgccttgtgcaagagggatgcagataatcttgcttgtataagtagacttggtgctctcatacctctctctgaacttgctcgaaatggcacagagagggccaaacggaaggctacttcattattggaacatattcataagttgcagcaactttga

SEQ ID NO: 103312 - DNA, 243 bp, Glycine max
  Peptide Sequence Number=SeqID_220090
atggatccaaatagaaacaggaggttgcatgttggggactacttggtgattcatgcttccaaggatttgaaggctggtgcggaggaaatcataggatgcttaaggttggaggagttaaagagaaatggtggagttgttgaaaaagagaaacttttcaagacggaagagaagtgttttgaaaggaaatggaaaaacaaacaaagaatatggagattgaaagccaacataatgcctctttcctag

SEQ ID NO: 103313 - DNA, 114 bp, Glycine max
  Peptide Sequence Number=SeqID_220091
atggataggctaaacatgcagattatcattgttgctcttgtgactagtgggaacaaagaaacatacatctggttgttggagcaattcaatgatgcaatgaaagaatgtgattaa

SEQ ID NO: 103314 - DNA, 1170 bp, Glycine max
  Peptide Sequence Number=SeqID_220092
atggtagccacggcttaccaaacctcccatgaatgttcggaagaaaccattatagatatcttagtggcaggattttccggacaactaaaaggatggtgggataattatctcactaatgaagagaaatcaaaaatttacagcgcagttaagacggatctcaatggaaaagtcattactaatgacgatgataaagagattcctgacgctgtgaacacgttaatttttacaatagcccaacatttcattggagacccatccttgtggaaagacaggtccgcagaattattatcaaatcttaagtgtagaaccttagcagattttaggtggtatagagatactttcctaactagggtttacacaagagaagatagtcaacaacctttttggaaagaaaaattcctagccggtcttcccagatccttaggagacaaagtcagagataaaatccgtagtcaatctgccaatggagacattccatatgaaaacttaagctatggtcaattaatttcctatgtccaaaaggtagccttaaaaatctgccaggacgacaagattcagaggcaattagccaaagaaaaagctcaaacaaagagggatttaggttccttctgtgaacaatttggcttgccagcctgtccaaaacaaaagaaaaaacaaacctccaggaaagaagcccaggatcataagccagccaatagaagaagattttcaaaacgaagatactctcaaaaaccctcaaccagtagagaaatggaaaatcctaaacaaaaaataaaattaaaaataacgtgctacaattgtggaaaacaaggccacattagcaaatattgtagactaaaaaagaagttaagaaaccttaacctagaaccctcaattgaagagcaaataaacaatttgctcatagaaacctcgaaggaggaaacagaaacagaaacttcatcctctgtgctttccgatgaaaacctaaatctaatccagcaagatgaccaactatcatcaacaaatgatgatgggcaaatcaatactctaacgagagaacaagatctcttgtttgaagcaatcaattccatacctgacccccaggaaaagaaggttttcctggaaaaactcaagaaaacattagaggtaaaacctagacaaaaggattttatcacgaacaacaaatttgat

SEQ ID NO: 103315 - DNA, 275 bp, Glycine max
  Peptide Sequence Number=SeqID_220093
atggtgaaaaaactcattgtgaaggcttgtgaggagtatggtttcttcaacgtgattaaccatggcgtcccccgcgacaccatagccaaaatggaagaagcagcttttgatttctttgccaaaccaatggcccaaaagaaacaagttgccctttatggctgcaagaacataggcttcaatggagacatgggtgaggtcgagtaccttctcctcagtgctactcctccctctgttgctcacttaaaaaacatctccaatgtgccatcaaacttcag

SEQ ID NO: 103316 - DNA, 261 bp, Glycine max
  Peptide Sequence Number=SeqID_220094
atggtagagcattcccatagaggatttgatgttgttggagaagagtttgatgttattagaggtgagggttcttcgatcaagaacaacacaccaaatggagaacaagagtttcatcttattagagatgagggttcttcaatcaagaataacacaccaaatggaactccatgtagagcttgtaggccttggatcttcttcacaaatggagtcctttgcttcttgaagatcaatgacaacggaatggagaaggatgaaaggtga

SEQ ID NO: 103317 - DNA, 194 bp, Glycine max
  Peptide Sequence Number=SeqID_220095
atgggtgccaagcacctcacaaggaccaaagaatggttgcatgtcatcaagcaaaggtccccggatgaaaatcagtgtatgacactaatttcgctcctctcggttgacgagagtcgcggtccacccggttgtgcatgtaatagccctcctcccataggtgatcagcctgggagcccaaaggtgttccctaccag

SEQ ID NO: 103318 - DNA, 312 bp, Glycine max
  Peptide Sequence Number=SeqID_220096
atgagagaactagaaaaatcaaattcaagcctaattcaattgagagaatggaaaaagaaatcggcttattctaaaaaattgtacaagaattatactattccagggatttcagaagcacatatagcattcaaattgaacataattgatagtgttattgatcatggtatccagggatgggaacacaagcagtcaaggaaggggcaaaaagagagagaagtacttggtactagcagccaatgggttgcactgagtggtcactgtccctctgcaactgtaagcaacgtcaaaggtggtgaattggtgatggagtag

SEQ ID NO: 103319 - DNA, 312 bp, Glycine max
  Peptide Sequence Number=SeqID_220097
atggattctgaagctgaagcactagaacatatgaagaaaagagatagaggccatcaaagtgtgtcattggagaataagacaggagattcaactgtggtgaagatgagtgagaaaaataataatgctgatgccgacgactgcatgattcttgatgaccatgaaggagaagagcattattgtggcaaaggaacaaatgcgaggagtgtttcttttttgccaagaagccaagagaagataggagattcggctaaagttgtgatagaacaagacatgaagggaggagagcataaatatgggtttaacaacaataac

SEQ ID NO: 103320 - DNA, 615 bp, Glycine max
  Peptide Sequence Number=SeqID_220098
atgtggactccaccaacgagtctagagccccgcgaatcattgcctagcgctatttgccaattctccattctcaatcttattcggagacccatgaattcattgcctagcgctgttcatgtggactccaccaacgagtctggagccccgcgaattcattgcctagcgctccccgcgaattcattgcctagcgctgttcgccaattctccattctcaatcttattcggagacccatgaattcattgcctagcgctgttcatgtgtcctccaccaacgagtctggagccccgcgaattcattgcctagcgctgttcgccaattctccattctccaatcttattcggagacccatcaattcattgcctagcgctgttcatgtgtcctccaccatcgagtctggagccccgcgaattcattgcctagcgctgtttgccaattctccattctcaatcttatccggagacccattaattcattgcctagcgctgttcatacccatgaattcattgcctagcgctggtcatgtgtcctccatcatcgagtctggagccccgcgaattccttgcctagcgctggatgcccattctccattctcagtctttttcggagacccatga

SEQ ID NO: 103321 - DNA, 298 bp, Glycine max
  Peptide Sequence Number=SeqID_220099
atgaagaaggcattcgacaagaaggtacacttgcgcaagttccatgagggagaccttgtgctaaagaaaatgtcccatgctgtcaaggacaatcgaggaaaatgggccccaaactacgaagggccttttgttgtgaagagggctttttccggaggagccctggtgcttaccaacatggatggcgaagagctaccttcacccgtgaactctgatgtcggattccccgtctactgggcaggatcatctcgagctaccttctggggtggagacaaagttaaagcagcaggaaccaatcaag

SEQ ID NO: 103322 - DNA, 453 bp, Glycine max
  Peptide Sequence Number=SeqID_220100
atgactacaagagattttgatgatgccaacagtcaagtgttcttcgtggataattcaagtgaacttcaagaaatccaagaaacaaaagttacatctacaactccctttgctgctattaaccggttcttctttcgaaactctgccaacttcagtgttttaaaggctcttggactcttcggcttccgaaggctctctcagcgagcatggctcgctgagcgagagttagtgaattttcgcttagcaagaatgggcgcgctgagcgcgagaagagaccacgacctcgctgggcgggctggctgtgggctggatgtgcagatctctgaattatcctcttctaggatttcttatccgctaagtgagctagatgtctcgctaagtggatgcatctcgctgagcggatctgcctcactaagtgagtcatcaacagctttaaccttttcttctttagcctaa

SEQ ID NO: 103323 - DNA, 240 bp, Glycine max
  Peptide Sequence Number=SeqID_220101
atggaatcaattaaaaatgaattctgtgagacagttagagtgagactcaaatggatatggagacgaaacggaaaagggggtgtggcagcgcgtttgttggaaaaaggtgatgcatgcggagaaatggtggcacaatgggcaaagatgcttcgcagtagggacgagttcttagacatggattatgacgaaatggttatggagacgaaggcagcatatgttcaacaaccaccaagaaagtga

SEQ ID NO: 103324 - DNA, 1353 bp, Glycine max
  Peptide Sequence Number=SeqID_220102
atgccattaggggctcaacttccctttcctgcaaaggtcttcttttgccaggcaaaatctggcatagatggatcgttgaatttaaaagtggtgtctcccactctattagtagcagaaaaggaagaagccaaggctgtgttgaccttgtttttgaagaaacaaggtttgagcaatgcaattgctgctagaaccagcaagaagtcagatcattttattgatcaccttgtctcaaggcttcactctaaacacaaatcttggtatctcgcagggagagagcttacaactctagagatcagggatgcacttatcccttatcttgaatctctttttgaagagcatggagacatcctagtggatgtagtggaaaactatccaaatcctcctggtaaggataaatcggctgtgctggttcctccttctaatccagtgttagactctaagaagcttaaagctgtgtctcgagtgagtgagacagaccccgatggtggaaatcttcgccctcatattgtctatctcatggaacttggtatggatattgagcagattaggagtatcacacgacgattcccatcttttgcctactatagcttggagggtaaaattaagccagtggttgagttttttcttgaacttggagtgccaaaagagaacattcccactatcctcactaaaagacctcaattatgtggaatcagtctatctgaaaatcttaaacccaccatgaagtttttcgaatctttgggtgttgacaaaaaccaatggccaaaggtgatctatcgcttcccagcactgctaacttatagcaggccaaaagtgatggaaagcatagattttctccttgaattaggcctctcagaagagggtataggtaagattttaactcgctgccccaatattgttagttacagtgtagaggacaatctccgacccacagctaagtacttccgttctttgggggttgatgttggcattcttctcttcagatgcccacagaattttggtcttagcattgagaccaacctaaagcctgtaacagaatttttcttggagaggggatacactttggaagaaattgggaccatgatttcaagatatggagccttgtatacattcagcttgactgaaaatttgataccaaaatgggatttcttcttgaccacaggttacccaaaatctgagttggttaagttcccacaatattttgggtacaatttagaggaaaggattaaacctagatttgaaattatgacaaaatctggagtgaagttactgctgaaccaggttctttcactgtcaagcagcaactttgatgaagccttgaaaaagaaaatgaagaaaatgcaagtgagttag

SEQ ID NO: 103325 - DNA, 558 bp, Glycine max
  Peptide Sequence Number=SeqID_220103
atgagtacttcagagttcagccacgacacatggaaagagaaagagagagaattggtattttacttaaagggaacaaatgtggaacagtggaagcacaaaaacatttcaatgaaatcagaaaccataaaaccaggcaagcatcaatggggaaacaacagaggcgagagagaaaccaaaagtagcaagcagcaaagaaggaaacggaggcgagaaaaacgcaagcagcaacatggagcagatgagaaaactcagaaaagaaagaagggcctacctgcaaagggggaaatggaggcggtaagcagcaatggaggttcacttgcggcaaggagaagacgtgcagaaacggtttttgttttagttggttgggccgtgtttggacgcgtgtgtccacttgttgggccgcgtccaatcacgcgtctcctgcatataactgtgtccggcgatggcagcgacaacagacaccgcatcgcaccggagttgtactcgtttgtgtgtccggtgcgtctccgatgcgggacgcggcacttcggcggcgtgtccgtacttcatagactctga

SEQ ID NO: 103326 - DNA, 210 bp, Glycine max
  Peptide Sequence Number=SeqID_220104
atgacgaagaacgaacgaagaacgacgaagaacgatgaagaacgatgggaaatcttcacgaaatcgctcatggaaacgtctcggaagcgttacggaagcgcctcggcttggattttcttcacggaaataatttttctcactaatttcaagggaaaagaggcaggtggttgccgcccagctcgcccaggcgagctcagctcgcccaggtga

SEQ ID NO: 103327 - DNA, 198 bp, Glycine max
  Peptide Sequence Number=SeqID_220105
atgtattggaagcaggttgctcaaaagcatttgatatggttcaagactactttggataatgtgtgggttgtctcaaaagacatggacgacagcttgaagggcaaggaacaggttaatgagattatggccatgatctcttatattgtagggattttgaataatgcttcagctaatgtaatccttagttattataaatag

SEQ ID NO: 103328 - DNA, 243 bp, Glycine max
  Peptide Sequence Number=SeqID_220106
atgtataattatgcatccactttagaacagagagacaagaagctcaaggtggtcattgtagcacctactccaagcaaggaaaggaaaaacacaaattgttgtataacaaaatctgtgattttgggagtaggatttgaagcaatggattacaagattacttggaagttttctgataggaaaaggaagataatggctcaacaaccacaacgaaaaccacctcagtacttgaaggattatgtttaa

SEQ ID NO: 103329 - DNA, 225 bp, Glycine max
  Peptide Sequence Number=SeqID_220107
atgaatgatgatagctctgatgggttgtcaaatcacaacgactctccaagactgatctgggataggagaatagggtgggtctataagcccaaaggttcccaagagcctgacaaggaaagggatgaagaccaaagccttgttagcccaaaggagggaggtaataaaattgatgatccaataagaggaggggagattgttccttttgaagctgtcccttcgaaatga

SEQ ID NO: 103330 - DNA, 288 bp, Glycine max
  Peptide Sequence Number=SeqID_220108
atggagagcttcatggaccaagtgaagttggttctaatggtttctccactgctgcttctgcttgttgtgcacttcctttgcaactatggaagtgctggaggggtcatgtctacactgattcctttgccagagagagagtcactgcacagagcaggtggaactccttggggtgttgggttggttcttgttcttcttctcttcatggtctcttaccagtcttctttccaagaacgttggtttcctatcctcacaagggatatggtgttcttgcaatatatgaagatgtga

SEQ ID NO: 103331 - DNA, 510 bp, Glycine max
  Peptide Sequence Number=SeqID_220109
atggccaatctttggcctttacccatccaatctcttgcttcatttgttccaatggtctcaaatggatcacttattgatgaccatttctcacatgtggagcaattcatgctgggagatattccttttgatactgctatgttgaaatcacagctaaggctattgttggctcataaatccacatatactaccaatttccaagccgttgaagttgaacaacaagctgatttgttcgatcaagccaaacaagatttaatcgcacctccttttgctccttctactttgactaccccatcttcagttatttctccaacaagaattatgtatcatattgtggaagttgttaccggaatatctagtgctcttgctactaatgttgctcataatattttcgttattacaactagtgttggtgttgggcttgctgatccatataaggatgatattggctgtaatggtacttcttcaaccgaaccaatcgatatgacaattggtttagctactaatccttaa

SEQ ID NO: 103332 - DNA, 588 bp, Glycine max
  Peptide Sequence Number=SeqID_220110
atggaggttcaatctcctgcagcaaaacgccactatgacatcaccatgtcaagaagaacaaggaaacaacaacaacaacaacgacaacaacaacaacaatttccagtgcaaggcaacgagaaaaccaaatcaacaatggatgatgatgaagcaacaccaaaggatgctgatgttcatgtcacagtggaaacaaaagctactcaaactgtttctgttgctggtgaggtgaaagagggtggtgagagtgaccacaaaagcttgaagcaactcatcataggagatgatgatcacaaagaagcaaagaagggtagtagtaataataatagtaataataataatagtgatcatgagagaggtggcaaaggaggatcaaggaactcacttggtgaacacttcacagaggaagagaagcagcataatcttcagctggttaggatgcaacagaataaggacaacctccaaggcttgaagttgaagaagttggtgcgtcgttacgccaaagttttggggcatttgatgaaggctaagcgtgatcctcatctaggtggtgatgctgggaaaaaacctgttttcaagttatcagcctag

SEQ ID NO: 103333 - DNA, 294 bp, Glycine max
  Peptide Sequence Number=SeqID_220111
atgacgatggtggtgacatcatcagcaacaatgatgtatgagtatgggttcgggttttcctcgataactaaaagtcgggtacgggtacggatacggatatggggacatgttggagagttgggattggggattggggagacaatactcatccccgtcccgccccattgccatgtctggatgatgttagagataccggtggtggtctcgatggtaatgacagtggcagtggtggttgtgatggaggtgacattggtggtggcggcaatgcaaatggtgatggcagtggcgatgtga

SEQ ID NO: 103334 - DNA, 654 bp, Glycine max
  Peptide Sequence Number=SeqID_220112
atggcgtccctgaccccaggcgttctctcgaagctactcgacaacgccggctcgaaggtaaccgccccgcaccggcaagcccttcttcaggtgacggagatcgtgccgcgcctctcctcaacctccccattacaaagccgcggctacttcctcaaactctcggactctcttcactccgcctacgtctccgtccccgacgccgacgccgacctcatctccgccggcaagctcaaccttggccagttcgtctacgtcacccgcctcgacgccgcctcccccgtccccctcgtccgcggcctcaaccccctccccaagcggagaccctgcgtcgggaaccccattgagttggtaccaagtgagaggcttcgcgttaccaccaccaccaccaagaagaagaagaagaaagtagaggtttttaagagagggaagggttctcccgaatggaagaaggagaaggggttggagatgatgaggaggttgagtttggattcttctagaagggtttgggatcatagtccggtttctgaagggataactgcttctgcttctaacaaactcaaggccaagaaatctaaccccactttgcctaacgtctgttactgttctccttttctcccttttgttttcctttgtacaaaacttgcatgcatttaa

SEQ ID NO: 103335 - DNA, 165 bp, Glycine max
  Peptide Sequence Number=SeqID_220113
atgtctaaggggttgggtatatgtgcgaaagaggccgagttggattttattatgagccaaagaaagaagaggaaaagtgtggggatgagatatatggtggaagttaaacggaggaaagggaggtgggaccgtgctggcatgaaaagtgaaatggacgttatataa

SEQ ID NO: 103336 - DNA, 933 bp, Glycine max
  Peptide Sequence Number=SeqID_220114
atgttaaaaaaccaaccacaaccagattggcctgagcccattgtccgggttcagtccttatccgaaaactgcgaagattcaatccctgaaaggtacatcaagccttctactgatagaccatccataaaaagttgtaattttgatgatgccaatattccaatcatcgaccttgggggactatttggtgctgaccaacatgtctcagcctcaattcttaagcaaatctcagatgcttgcaaagaatggggcttcttccaagtcactaatcatggtgtcaaccctgatttgatggacaaggtcagggaaacttggcgtgaattctttcacatgcccatggaggtgaagcagcaatatgcaaactcgccaaaaacctatgaaggctacggaagcagacttggaattgagaaaggtgctattcttgattggagtgattactactttcttcactatcttcccttttcactcaaggactataacaaatggcccgcctcgcctccctcttgcagggaagtgcttgatgggtatgggagagagttagtgaggctatgtgggaggttgatgaaggctttctcaataaaccttggattagatgaaaaaatccttcaaaatgattttggaggggaagacataggggcatgtctaagagtgaatttttaccctaaatgtccacggccagagttgacgttgggtttgtcatcacactcagaccctggaggaatgactatgttgcttccagatgatcaagttcctggtcttcaagttcgaaaatgtgatgattgggttactgtgaagcctgcaaaacatgctttcattgtcaatatcggagaccaaatccaggtgaataatcttcctctcatacatgccgtactattatccctatgcacaaaattgtacacgtggtgggacccgtgtgaagttgaattgctagtttag

SEQ ID NO: 103337 - DNA, 420 bp, Glycine max
  Peptide Sequence Number=SeqID_220115
atggtggaagaacaaaatgacaaaacgaccctcactccaaacgaggatattctagtgaaaggtcttccggagaaaagggacggctatggcaagaaggaagtgtcgctagaggaagcaagcgagttcctccacattattcagcaaagcgagttcaaggtcattgagcaactcaacgaaaccccagccactgtctctcttttggaacttctcatgagctctgaggctcatcgggctttgcttgtaaaggtgttgaatgaagctcatgtggcccaagatatctctgtagaaggctttggaagactcgtcaataatatcactgccaacaactatctccccttcgccgaagaagaagtccctgccgaggggagagggcataacaggctttgcatgtatcagtcaaatgcatggaccacgtcatga

SEQ ID NO: 103338 - DNA, 333 bp, Glycine max
  Peptide Sequence Number=SeqID_220116
atggtttccggggcttccggggacttccgtaatacttcctttaaaattttcgaaaaccttgggggaggggggagctgtttcaaaaatgttcaagacccctttggctatgcattcggctattttttgtttactaaaacacgttttcgtgaagaaaaatcaagtcgaagttgtttctgtaacgcttccgtaagcgattctgtggaaattcttcatcgttcttcgtcgttcttcaccgttcttcatccgttttcgttcgttcttcgttcttcaacggttttcttttcttcccttttgacgtgcttaagccatttatttaagtcatttctcgcttaa

SEQ ID NO: 103339 - DNA, 350 bp, Glycine max
  Peptide Sequence Number=SeqID_220117
gtacaacgtgataatggattttccattaaccattgatctaaacagacttcttagaagaggcccattaataaagtataataaggaggaatatgcaaggattggagtaatgccacgctatggtgatgccaactcaatcaaatggtttgaggtggaacctaattgcacttttcacatgatcaattcttttgaggatggtcacgaggcaagttacctggaagttgtagtgaggggctgcagatctcttgattcattaattcctggacctgacccgagtttgaacgaatttgagtggttatctcgttgtcacgagtggcaattgaatatgcaaacgggagaagttaaggagagag

SEQ ID NO: 103340 - DNA, 1662 bp, Glycine max
  Peptide Sequence Number=SeqID_220118
atgggtaattgccttaccacatgttactgtgcagggaaagtcattcagaaaaaccaagctctccccattaataccatattcaagcttcctgtacatgttacaaattcttggcctccaggtggtaattttgcaagtggaacaattgatcttggtgggctgcaactgtatgaagcatcaacattcaacaaagtttggggcacctatagtggtggacctgatgatcgaggtttctccatttttgagccatcaggaatacctcaaggcttctccatgttgggtagctacagccagcccaacaacaagcctctttttggatatgttcttgtggcaaaagatgtgtccacaaacaccagcaaccctagtctaaagcaaccacttgattacacacttgtatggaacagtgcatctttgaagattgaccaagatggtcccatctatgtttggctaccaacagcacctcaaggttataaagctgtaggctatgttgtcaccacaacaccaactaagccttcacttgacaaaatcaggtgtgctaggttagacctcactgaccaatgtgaggcaaattcattcatttggggttcagacaacttcaatttttatgatgttagaccaagcaatagaggaactcaagcacctggtgttagagtaggcacctttgttgcacaaaatgggagtcctaaccctccatctattgtttgtttgagaaacaccaacgctataccaaaatacatgcctaatctaccacaaatcaaggcaattctccaagtttactctccagtcatgtccttgcaccctgatgaagaattctttccatcttctgtggagtggtttttctccaatggagcacttctatataagaaaggacaagagtcaaagcctgtgtcaatatcaccaaatggggctaaccttcctcaggatcctaacattgatggtgcctattgggtggaccttcctgctgattcaaccaacaaagagagggtcaagaaaggagacttgaaaagtgccataagctatgtgcatgtgaagccaatgcttggagggaccttcactgacattgcaatgtgggtcttctacccattcaatggaccagctagagccaaagttgagttcttaaccgttaacttggggaagataggtgaacatgttggtgactgggagcatgtgacactaagggtgagcaacttcaatggtgaactaaagcatgtctatttctctcaacacagcaaaggcgtatggtttgattcatctcaattagagttccaaagtggcaacaaaccattgtactattcttccttgcatggccatgcatcataccctcatggtggccttaacttgctaggggaagacaagattggcataaggaatgatactgctataagtgacaatgtcatggatttgggggcatttcaattggtttctgctgagtatttgggttctgatgttgtggagcctcctccatggcttaattatttcagggaatggggtcctaaaattgattataatgtgaatgatgagttgaggaagcttgagaagttcttgcctgggaagctgaaatctactttggaaaatattgtgaagaatttgccaagtgaagtgttgggagaggaaggaccaacgggtcctaaggtgaaggataattggagtggagatgaaaggtga

SEQ ID NO: 103341 - DNA, 1374 bp, Glycine max
  Peptide Sequence Number=SeqID_220119
atgtcagttccttgtgtagcaggccggcagagagacaaagatctcatcaaaggcaagaagaagaacaacaaagcaagagaaattggaatggaaggcaaaggtggaggagaagtgagaaggcttcacatcatttacttccttagtcagataggtggtcgtgcagatcatcctcatctaattcgtgttcttcatcttgcccgaaatggggtttatcttagagatgttaagagatggcttggggaattgagaggaaaagacttgcctgatgcttttgcttggtcctacaagagcaggaggtacaagagtggatatgtgtggcaagacttgttggatgacgacctcataacccccatctctgacaatgaatacgtcctcaaaggatcacaaatccaccctaccccatttacaacaactccttcacttgcagaaaagaaaattgcggtttgtgatatccatgctgagaagaaatgtactcaagtacaacttgtagaggacgaaaaccagcagccacagcagcagcctctagcggaagaagaacctcgaattcaacaagacttgaattcgaaaatagatactctgacaaaagggtcatcagaaatcagccaggactcatcattggtcttcagctcagacaggtcatctgtgacagatgatgactcttctaaggtcgaagaagagaagcatatagaggctacaggcaaaaagggattcaacgaaatcaaccaagagaagttagagacttgctcattgccttccttgtatcacaatctgttgattacgaaggctagccacaaagatgacttgaataaaaccagctcacctgagtcatccttctccactatatcatcatcatcatctcaatcctcttttactaagatcagaagcaattctactaaagtttctaatgtgttccgcaattggattacctgtggcactgtggaaacaaaggatgcagcactggtcctgatgaacccggctcaaaagaatttatccaaggaacctatcaacatacctgaaagaagggttgagatttgtaagggagacaaattgggaggatcagccaggtgttttagaacttcttggggccctcatcaccagaaacaacaatatggggcaagaaaaagctttgaaggaaatgaaactaaccggagcaggaaaaagttaggggagttgctaaatcaaacttcttccaaaccatttggtggaccaacttgctcgcaatgcgggaagtcgtttaagcctgagaaaatgcacaaacacatgaagtcttgtaaaggaatgaaagccttgggaaagtcatccacaactgttgaggaggcacagcttcagggatcatcatcttcatcttatacagattactttttgaccaactaa

SEQ ID NO: 103342 - DNA, 1557 bp, Glycine max
  Peptide Sequence Number=SeqID_220120
atggcgagttctcttggccaattcaagaaaaagcaaaatccacgcattgaaaccacatttaagcttcctgctgatataccagtctggccaccaggtggtggatttgcaaccagcatcatagaccttggtggtgggttgctattgtcacaaatttcaacattcaacaaggtttggactacctatgaaggtggaccaaacaatctaggggccactttttttgaaccaacaggtctatctgaagggttctttatgctgggatgttactgccaacccaacaacaagcctcttcatggttgggttcttgtggggaaagataactcttcaaccttaaatggagctttagccaaaccagttgattacaaattggtatggaacaccaagtctctaaaaataaagcaagatggacaaggctacatttggttaccaatagctcctgagggctataaacctgttggccatgttgtcaccacctcaccagagaagccttcccttgacaaaatcaggtgtgttagatcagacctcactgatgaatgcacaacatgtcattcaatgaagctttggagaacagaaaacaagaggttcaatgtgtatgatgttaggccaatcaagagaggcattgaagctcaaggggttagtgtaggaaccttcctagctcaaagtggaggagggactaattccaaagctttacctatttcttgtttgaaaaataccaagggtagcttttcttacatgcccaatttatcccaaattaaggcaatgatcaaggcatattccccatatatgtacttgcatcctatggaggagtacctcccttcctctgtggattggtttttcactaatggagcagtactaattgagaaaagaaagggtgtcataagggagagttcaatagaaccaaatggctctaaccttccacaaggtggttccaatgatgatgatgatgttacctattggttggacctgcctttggatgaaaccaagagagttagtataaagaaaggagatttggcaagttcacaagcttatgttcatgttaaacctatgctaggtgggactttcactgacattgtaatgtggattttctacccatttaatgggggtgcaagggcaaaagtggcatgcaccaacattccactaaggaccaaaggggaacatgtgggggattgggagcatttgacattaagggtaagcaactttaatggagaattatggagggtttatttctcacaacatagtgagggtaaatgggtggatgcatctgagcttgatttccaaaatggtaatagacccgcggcttattcttccttgcatggccatgccttgttcccaaaacctggccttgttatgcaagggatgagagggttaggtgtaaggaatgatgcagctagaagtgatgcagtcatggatatggcaacttggtttgaaatagttgctgctgaatatttggggtcacaaattagagagccaccatggttaaattattggatgaattggggtccaaaggaagggcccaagggtccaaagcagaaggatatgtggaaaggagatgaacggtaa

SEQ ID NO: 103343 - DNA, 240 bp, Glycine max
  Peptide Sequence Number=SeqID_220121
atgaagcatttagtgacatcaacaaaagggtacaaattcaacattaagctgctctctattagttgtggcagtgacactgatgatggtggcaaggttgcaaagcttgttgatgaggtcattagcgctaaagagatcaccatagaggaaggaggagagggtggaggtggcgagaaaagaagggaaaaaatggagtggtgcgtaccatcagaaatcacctccgatggtggcaaaagtgattga

SEQ ID NO: 103344 - DNA, 1104 bp, Glycine max
  Peptide Sequence Number=SeqID_220122
gagatagacaagaaggttttttctgtcaaaccagattctccactaaaatcgccaacatcaagtatctcacccttgaagaataaaaacgagaacctttgtccaaaatcattgacaagcacaccctgtggtggcactgttcatagccaacttgttaaagtgccactcaattgcaagagttggcggcatgatactcctgcatgttgtgaagatgtctcatcccccatgtgtgatcttggaaaacaagttgtagctcatagaaatgttgcttttttggcagctgtgcggtctcttgaagaagcatcagctacagatactgtgatccaatgcatgtgcatgtatgcagaactttgccagtctggtcaaacacattctcctggatcacttgtgaagcagtttttggagcttcacctgagtttgcagagagtaacagtgctgattgatttgttacttaacccatttcctgaaacaaagtcaagcagccactctaccctacagtgtctaacagaagatgcatgcaaagttcccgctcggaagaatgctatatcttgggtacaagctgccataggtaccaatctttccaaattcaatctattcaaaacacaggcaaaaagtgaggttctaaatggcgagaaatgtcattatgttgtcattgagagttctcctgaggacatcaataccgagaattcacctgctcaaaacaagcaaaatcgtgtaactcaagcaaaccacttgccaaattcaactgctaaaaaacttccttcttcaaagcggaatctcttggcagccaagaacaaggatgctgacaaacatgatcgatcaaaagaaatcaaattaaaagaggttgcgagtttggcagaaaaactgcttgaggcatctagcgaatggttcctgaagtacttggaggagtctctgagtaatgaatatgggttgaaaaatgaagggaacattgaaattgcaagtcttcttggccagctcaaacaggtgaatcactggttagataatttggctggtggagataaggttgatcacagggtagagaagctaaggaaaaatttgtaccggtttctacttgagcatgttaattctgccgttacttgtaattag

SEQ ID NO: 103345 - DNA, 210 bp, Glycine max
  Peptide Sequence Number=SeqID_220123
atggttggagaggttgctgggagggggttaagtgttgctgacaaagagaataagaagaaggacaaaaaggctttgttcatgctgcaccaccagtgtattgatgtggccaatttcgacaagattattggtgctacttttgcaaaacaagcctgggaaattcttgagaagtctcatggtgatggagaaaagttcaagatggctaggctttag

SEQ ID NO: 103346 - DNA, 249 bp, Glycine max
  Peptide Sequence Number=SeqID_220124
atgggtgtcaatgtggggattatttgtgttttgtttctcttggcaacacaggcaataggggttcctgcatttgcaccatggaagaagctgcaattgccatggaagaagccttctaaagatgaaaaagcaatcataaccttaataattgttggaaaacggaggaaaatatggtatagcctttcacaattacttgagtatgaaaaccatgtgctggccaaagtgataatggaagataagtttaaaagttaa

SEQ ID NO: 103347 - DNA, 285 bp, Glycine max
  Peptide Sequence Number=SeqID_220125
atggctgcagaacagatgcggacagaaaatcgggaaagttcaagcactgggagttacttacaacttagagctgcaaaatttcacatgagaccaatttctggtagttcaattctttgtccttcttctggtttaagaggagagaagttgcaattttcaagtgtaaggtttggtcttaagcataaaatttcctgcaaacttactgatgtgggaaatgatttaagctcatcaaaggagcttggaaagtgtcaacctttggttacgatgtgtggcattacatcaggttaa

SEQ ID NO: 103348 - DNA, 303 bp, Glycine max
  Peptide Sequence Number=SeqID_220126
atgtccttaaccatagttaagaggtggaaaaaaaaccctttatatgcaaaatttaggaacaagagactttcatttgctcacaagttgactaaattttttaaggatgtaattgctaatggagaatttcaacgaccaccctcatctaggattttgccagttggtgttgaggttgatatgaataatgtgtatcgcccaagtcttgatggcattggcataaatgtagaggaaagtttaggggatagtgaagatgcaagtgttagtgcaaccaatgggatgattggtccttatagatgtgaacattaa

SEQ ID NO: 103349 - DNA, 282 bp, Glycine max
  Peptide Sequence Number=SeqID_220127
atggctaatagaaatggcctcaaggcccaaataggacacacagcacaaccaacacctccacagcctctcctacctcccggagccatggccgccgccgactcctccgccgctccatcgcaccagttgtcgcagagggagacggacatccagatgatgctcgccgccgacgttcacctcggcaccaaaaactgcgactttcagatggaacgctacgtcttcaagcgcagaaccgatggtcactgctccattctcaatttctcctttttatttattttatgttga

SEQ ID NO: 103350 - DNA, 264 bp, Glycine max
  Peptide Sequence Number=SeqID_220128
atgggggagggatattgtacgcagccttacccttgcatacgcagccttacccttacttatgaaaaatcttccagaaatgagataaggtttaggaacaaatatggttttcaaagtctagatactatatgcattggaaacattaagatgcatgtgaatctacctaggtttgttagaggcggtggaagggaggatgtatcaaaaggtgtcgggagaaaggagtgtgtgcttggagcaagtggggaacaacacaaagttggaggatga

SEQ ID NO: 103351 - DNA, 363 bp, Glycine max
  Peptide Sequence Number=SeqID_220129
atgcaggtggacttattcttctatagagaacctgaagaggccaagcaacaagaggaagatgaagcaccacctgcccaagattatgccatttcagacttcaatgccgctggcattggcagcttccctgcttctgatggccaatggcctgctgcagtcgaacaaccttggactgaagaagcaccacaaccaatctcagcagctcctactaacttgacaccagaagcagctgtcacaatttgtttgactgaagttcctcttgcagttgcaggcgattggggtgaggctgttccagctccagttccagctccacaagctggtgtgcctccagcccaagcttttcctcccgctactggctgggactag

SEQ ID NO: 103352 - DNA, 375 bp, Glycine max
  Peptide Sequence Number=SeqID_220130
atggagatcaaagtggcagaggttaacaaggacttgcttgaacaatgtttagttggaagggagttctccaacagtgaagttaattctatgggaagtgagtttgggagtttgggaataactcttccatctcttaatgtttggaataagtataccaagaaaggattctatatattggcgatgaagtggggaggcaagagggatttcaacaagaggaaacctaggaggaggcagagatggatgctagtcattgtcctgtggataatggctctgaaagggaccaagatcataggcgacattgaaatgtgcaagggggaacaagtggataggaaagtgactaccaaggacttgatgctagctaaaggagtcacttcataa

SEQ ID NO: 103353 - DNA, 177 bp, Glycine max
  Peptide Sequence Number=SeqID_220131
aacttgcaacaagcccagatgtcgatgttaggcgttgttgcttctcctgcacctcatgttgttgcccctgcacctcctgctattgtccaacctccgccaactactgttgaaccaacacctcctcctccaccacctacgcagccttcttcaccaccacaagttcaagagtggcaatga

SEQ ID NO: 103354 - DNA, 309 bp, Glycine max
  Peptide Sequence Number=SeqID_220132
atgacactgccagacataatcaccacaacacagtcatcaattagagatgatggtgttacgtctataatcactgcactttggtatcattgtcctgtgtaccaattcaatggtcatgttgagtataagacaattcaaattattgacgaagaagtgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 103355 - DNA, 387 bp, Glycine max
  Peptide Sequence Number=SeqID_220133
atgggggatgagttatatgacgagttactaggtgaagttcctccagataatgcacataaggaagtcacactcaagctgacatggttgcttagcatcttgcgtacatcattacctgaagaaccaacaatataccaactacaatgcatgtgtagagcttacataatatacatgattgttttcttggggcatatagaaaatttgaaaaacacccaccaagacatgcacacagagacagggacatttgttgtatcaatccacactgaaaaccctaagacagaacaacaacattatcatcatgagggagaactagtgatacatgagagaagaaattcacgacgtaatcgacatccaccgccctatgggactggtcatcatctaggtcattaa

SEQ ID NO: 103356 - DNA, 360 bp, Glycine max
  Peptide Sequence Number=SeqID_220134
atggaattaagaattgtcgcaacatgcccttttgcgggcgagcgaggcgaggctcacgggtgcgctttccaaaggaggaaagatgcgcggagtcgccaccaatgtttatttgtggaaaacgtcggaaaaactgaaggaaaccggtcaaaaagaatattccaagttcgggagttgtatttacgtttgaggaaggtcgacaaaagcggggctcttgctcctacgtaccctccatcgaagaggaaatcagacctacgtagttcttttttaagagtgaatcaagcgattctttttacttggaagatgatcattttaaggcgttggacctcaaaaacgatccatttacttggtaagaaaaactga

SEQ ID NO: 103357 - DNA, 411 bp, Glycine max
  Peptide Sequence Number=SeqID_220135
atgactcttgaacttgttgggattcttaaagtccatgagaaagagcttgctcaagatgaaggaacaaagaaagggaagtcactagcccttacgatgcaaagactaaaatgcaactatgtttctaaagagttcatcggttcatccaaaagatccttcagcaagaaagagaaaagtccaatcattttctataagtgcaataagtcagggcacttcatgttagaatgtcctgaccttgaaaaaccaaagaataaaaagaaaaaattattcaagtccaaaaagaaaagtctcatgagcacttgggaagacttggacgattcatcgtttgacgaggacaatgaggaagaagccaacttgtgtctgatggctaatgtgtccacctataaagttgaaccaacactggatgcaagttaa

SEQ ID NO: 103358 - DNA, 362 bp, Glycine max
  Peptide Sequence Number=SeqID_220136
atggtagcacctttcccaatttccactcgaagcgaaaagattttacccattgaccttcccgtggtagacctaaccgcggaaagatcaatggtgacaaaactcattgtgaaggcgtgtgaggaatatggtttcttcaacgtgattaaccatggcattcctcgtgacaccatagctgaaatggaagaaacagcttttgatttctttgccaaaccaatggctcaaaagaaacaacttgccctctatggctgcaagaacataggcttcaatggagacatgggagaggtcgagtaccttctcctcagtgctactcctccctctatttctcacttcaaaaacatctccaatatgccatcaaaattcag

SEQ ID NO: 103359 - DNA, 1686 bp, Glycine max
  Peptide Sequence Number=SeqID_220137
atggagcacaagttatcagaagcggcacaccctagtgctcatagtagtagtgcaaattcaggaaacaactcaccaactcatcccaagaatgtgaaccaagaagcaaaagacaccagcacaacaactgtccactactcaggaaatgaaactggacatatggaccaggcttccaaaactgaagcaaatttggaaggtaaatccagaccccagaacttactgccaccaaacaggaacttatctgacttcaaccctcaacaacaccaaagtccaagcacaaagaagcctaattcaaattctgatcatcatgcaaaggcaatgtctgtgtctacccctcaaacaaagaccagtaccaatcaaggtcaagggagtggtgctagttctcggagtgatagcttagagagcacaagtgcacctattaggccacacactgggggtgatgtgaggtgggaagctatcaacatgatttcaagggttggctctctcaatctcagccatttcaggcttctcaagcgcatcggttacggagacattgggagtgtgtaccttgtggaacttaagggaactaggacctactttgctatgaaagttatggacaaggcagctcttataagcagaaataagcttctgagggcacagacagaaagggagattcttggactccttgatcaccccttcctccccactttgtattcttactttgaaactgataagttttattgcttgatcatggaattctgtagtgggggtgatcttcattctctaagacaaaagcaacctaacaagtgtttcactgaagaagctgcaagattttatgcttcagaggtgttgttagctctcgagtacctgcacatgcttggcattgtatacagagacttaaagccagagaatcttctagtcagagatgaagggcacataatgctctcagattttgatttatcccttcgctgttccgtcagtcctacactagtcaagtcttcttccgcccacgcaggcaacagtagtagcagtggcaacaatgatgttggaggcatattaactgatgaccaagcagcgcaaagcactactcaggtatcaagttttttcccgcgcattttgccttcaaagaaaaaccgcaaggcaaagtcagattttggcctattggttggtggaggacgccttcctgaactgatggcagaacccaccaatgtgcgttcaatgtcatttgtagggacacatgagtaccttgctcctgagattatcaaaggagagggtcatggtagtgcagtagactggtggacttttgggatcttcttgtatgagttgttgcttggaacgacccctttcaagggttcaggatataaagccacacttttcaatgttgttggacaaccacttaggttcccagaaactccccaagtcagtgctgtggctcgtgaccttattagagggttgttggtgaaagagcctcagaagagaattgcatataagagaggagctacagagataaaacaacacccattttttgagggaatgaactgggctttagttagaagtgccacccctccccacataccagaggctatagatttctccaagtatgctagcaaagacacagcaaccccggcagacaagaagatggcagatattgctaatgataaacacagcaacagtgctactgattcttacatagattttgagtatttttag

SEQ ID NO: 103360 - DNA, 198 bp, Glycine max
  Peptide Sequence Number=SeqID_220138
atggtgggttattgtatgagaaaggaggtagagagaatgagaaagatgatgaagggaaggaaggtggggaattctaacaactatatgggggtatttataaggaagaaaaagtatcatgtgaaagatgagcgtcttatattgagacttcaagtgttgaaacttgcaagtgttgagtatgccagtgttactttcggctag

SEQ ID NO: 103361 - DNA, 222 bp, Glycine max
  Peptide Sequence Number=SeqID_220139
atggagactcctagcactctgaccacaacaatggctcatggatcacggccatggtcatcactatgggcacaccggccgaaccacaacctagagtggattttctacaaagttttaaaaagaaaccttgatcttttttcctctaagcatgttttagatattttgaagggagaagagcaccatgaaagcgttttgggctatgaaggagcgttgagatcacaatga

SEQ ID NO: 103362 - DNA, 1830 bp, Glycine max
  Peptide Sequence Number=SeqID_220140
atgaagtatgtgttggtgactggtggtgttgtgagtggacttgggaaaggagtcactgccagcagtattgggttaatcctcaaggcctgtggtcttagagttacctctatcaagattgacccctacttgaacactgatgcgggaactatgtctccttttgagcatggagaggtttttgtcttagatgatggtggtgaggttgaccttgatcttggaaactatgaacgtttcttggacatcaaattaacttgtgacaataatatcactactggaaaaatatatcagtctgttattgagaaggagagaagaggagattatcttggaaagactgtacaggttgttccgcacgtaacagatgctatccaagagtggatagaacgtgtagcaaagataccagttgatgggaaagaagggccagctgatgtttgtgtcattgaattgggtggaactataggggatattgagtccatgccttttattgaagcacttggtcaattctcataccgtgtaggccctggcaacttctgtttggttcatgtcagcctggttcctattctccatgttgttggtgaaccgaaaacaaagccaactcagcacagtgttcgtcaacttagaggattaggtttgacccctaatcttcttgcttgtcgcagttcgaaggaacttgatgacaatgtcaaggcaaaacttgctcaattctgtcatgtgccgttgtcaaacatacttactctccatgacgttccaaatatttggcacattcctttgctattgaaagaccagaaggcacatgaggcgatcctgaaagcattaaacttgctaggtgttgctgcagagcctaatttgaaggagtggacttcaaggacaaaagtttatgacagatgtcatgaaattgttagaattgcaatggtgggaaaatacactggcctttcagatgcatatctttctgttctgaaggcacttttacatgcttctgttgctcgaaaccgtaaacttattgtggactgggttccagctggggatcttgaagatgctacttataatgaggatcctgaggcatataaagctgcttggagtcttttaaagggtgctaatggggttctagttccaggaggttttggtgatagaggagtgcaagggaaaattcttgctgctaagtatgctcgagaacataatgttccatttctcggcatttgcctgggaatgcaaattgctgttattgagtttgcacgatctgttctcggtctgcatgatgctactagcacagaattcaatcctgaaaccaagaccccttgtgtcatatttatgccagaaggctcaaagactcatatgggaggaactatgcgtcttggctcaagaagaacttactttgaagttgctgactgcaaatccgcaaaattgtatggcaatgtaagctttgttgatgagcgacatcggcatagatatgaggttaatcctgacatgatatcaccgctagagaatgctggtctatcttttgttggcaaagatgaaactgggaggcgtatggagatagttgagttgcctagccatcctttttttattggcgttcagtttcaccctgagttcaagtccagaccagggaaaccttctccgctcttctcaggattaatagcagcagcaagtgaatctaggaggacaatcatggtgccaagtaatggtcacgccaagttaactaatggaaatggaatgtgcaatggacactcaccaaaactgaaagcacaccaaaagggaaatggcttcaattcatccaatggttccttaaatggtatatataccaatggcaatggggtgtatgtggatggtagttgttag

SEQ ID NO: 103363 - DNA, 417 bp, Glycine max
  Peptide Sequence Number=SeqID_220141
atggaggtcttccggatatttgcttccatttttggtcagtttatgagactcaatgtcgacggcagttcgcttaggaatccaagtccattaggctacagaggtttcattcgtaactccttgggtgaatggatcactggattttcagggttttgtggtatagccactaatctatatgtggagctttttgctatcttacaaggtctcaagatagcttgggagtcaagttgtcatgatatcatttgtgagtcaaattctacattggctctgagtaagcttactcagggaaatgttctttttcacccatatgttgttgtgatcaaccaggtcaaaagctacatgtcttgtgcttggaacctcaagtttattcacattcttaaggagggcaacaactatgccaatgagcttgtgaagatgtga

SEQ ID NO: 103364 - DNA, 162 bp, Glycine max
  Peptide Sequence Number=SeqID_220142
atgcctatatctcttggttttaacaattggtcgggtttgcgtggagagcaatcttgtagtggtggtgggtctttcagtgctagccagtgtgccacaactcatatgcatatggctttgtgttcatcgacaaccctagatggttacctatcatatgatggttga

SEQ ID NO: 103365 - DNA, 1434 bp, Glycine max
  Peptide Sequence Number=SeqID_220143
atgggtgagaaagactcagagaagctcatttgggaacagatgagaaccccgacagctgccactcccattgctgcaccccaacagcaccgcacattaccaaggcttcttgtccttctcatcctcttcgtctccgtcacctacgtcgtctacacgctcaagctcgtctccacctcacgcgcctgcaacaacgacgcccctttctccaccgacaacttctccaaaaccatcctctccgtcaatgccaccgccgcagttctccgccgaggctccctcgagacgaatcccgaggaccggacggacctccgccacgtggtgttcggaatcgcggcgtcggcgaagctttgggagcagaggaggagctacatcaagctctggtacagggcgagggacatgcgcggcgttgtgtggctcgacgaggaggtgaaatcggaggagagcagcgacgcactcccgccggtgagaatctccggcgacacggcgaggttcaagtacacgaacaggcaggggcaccggtctgcgattaggatctcgcggatcgtgtcggagacgctgcggttggggatgaaggacgtgcggtggttcgtgatgggcgacgacgacaccgtttttgtcaccgaaaacctaattcgggttttgagaaaatatgatcacaatcagttctattacattgggagtttgtccgagagtcacttgcagaacattttcttctcttataacatggcctatggcggaggaggttttgcaattagttatcctctcgccaaggctcttcagaaaatgcaggaccgttgcattcagcgttacccgggtctctatggttccgatgatagaatgcaagcgtgtatggccgaactcggtgttccactcaccaaggaaaccggttttcaccagtatgatgtatatggaaacctgttcgggcttcttgcgtctcatcccgtgactccattggtgtcactgcaccaccttgatgtggttgagcctatctttcctaacgttacccgagttgaagccctacaacggctcactataccaatgaagtttgactctgcaggactcatgcagcaatccatctgctacgacaaatcaaagagttggactgtttccgtttcatggggttttgctgttcagatatttcgcggcgtgttttcaccacgtgaaatggaaatgccttcaagaacattcttgaattggtatagaagagcagattacactgcatatgcattcaacacacgtcctgttagccgaaatccatgccagaagccttttgtgttttacttctcaaaggcaaaatacaattctacaatgcaacaaatagtgagtgaatatgaaaggcaccgcgtccctcatcctgattgcaagtggaatatggctaatcctgcagctcttaacaaagtggaggtatacaagaagccagatcctcatctatgggataga

SEQ ID NO: 103366 - DNA, 1215 bp, Glycine max
  Peptide Sequence Number=SeqID_220144
atgaataaccctgtccgacgacatgccccagctgctgcagtagttgccaacagaagcacgttcacgggcacaaagtcacttccaaaaagagggcagattaagtccaagatagtggcagggatatgttggaaagtgtccgacacggcggatttcgcttgggcttcagtgtcgcagcacccaaacgctccaaccgcgactctaaaacgcaacgtgaccgaggtcttcgtcgggcctccgctccggccgctatttactactgtggacagtgaatttggaaaattctcactctcgacggaggcggatcttcgtgctctcgacgcggagcctcgctcactcactctcgaatgcgaagcctcactcttgaacttctctctctgctgtataaacattctagttatggaagattctgatcaaccagccaaatctgctgaaaaccagcaaactgaacaagataatgaggaggactcaaacaatgaaacttctctgttgcatattcagaagaagaccttaaagcctgataataagttgtacttttccactggttcttcaaaaagctctgcatctgctgaacccagtgaagaaccaggaaaaccagtctttcagttcgagtcttcaaaagagattcaagttcagcatgatagcaaagcaactgcaacactagagaccgagactgagttttcaaaagatgctcgtgccatccgtgaaagagctcttaagcaagcagaggagagtctgaaagggaaaagcccaagttctaagaatgaaaaattatataagggaatgaacagttacaaagactacaaggctggctttcgtagggagcaaacaattgctagtgaaaaagctggcgggtcacatggtcctcttagggcttcagctcatataagagtttcagcgaggtttgattatcagcctgacatatgtaaggattataaggaaactggttactgtggatatggtgattcatgtaagtttatgcatgatcgaggggactacaagtctgggtggcagatggagaaggaatgggaagaagctgagaaagcaaggaagatgagattggctgcaggagaggatgcagatgaggagggtgctaatttgactgatgaagatgatgaggattctttaccatttgcctgtttcatttgtagaaacacttttgtggatcctgtagtaaccaagtgcaagcactacttctgcgagcattgtgcattgaag

SEQ ID NO: 103367 - DNA, 378 bp, Glycine max
  Peptide Sequence Number=SeqID_220145
atgaagtggaagaacacgttttttgggcacgaggagtggcggaggacggagtgcactgcggccatggagccgcggaggttgacgaaacgggcaacccgccctgttttggtacaccggcgcctcggtgtagtggaagaatacgttgtcgtctgcggtgaagaagcagagaatgagggaggaaacgacgatgctttggcggaggagaagcatttggaggaatggattggtggcaaaatcgattcttggtggaaggaaataaaaggggtgttgttattgttgggtgctagaaggaaaaaaatggcattttctctggaaccagggtggaggagagggaagttccagagcgagaaagagagagagctggagttccgagagtaa

SEQ ID NO: 103368 - DNA, 1914 bp, Glycine max
  Peptide Sequence Number=SeqID_220146
atggctcgacaattgtgtgaagaaaagtccaaggacatggcttcatcaagtcatgggttgttctactcagatgtatcatccaataacccaactatccaaccccatctgatgaaccacatccaaggctttgtgaccgacccggacatgttcaacctcaccacaggtatggatatgatagggttttcaaagaaccttcagcaacacagcgaaagcaacggtgtcatgatgtggaaaagtttcttcggcaaaccaggtcaactcgcgggttcttcctcttccaaaacgatgaacgggtcttgtagcaatttttataaccagcatgctgatgcgtataatactaataagcaagacttcacatcagggatttctgagacaagtagcgagaacttagttgtcggtggtgcccatgattctgccccgtggcaagagaacaggctaatggttgatgattcttccttaaggtgcgtgttcccttgtgaaggtaaccaaaggcccagtcaaggcctttcactctctcttagttcaaccaaccctttaagtattggcttgcaatcgtttgagctaagacaaacaagccatcatcagcatctttctgattttgtttcaagagagggttttttcggaaaaccagtcaatgctcaacagcagcaacaacaaatgttgcaagatgggtatttgagtcctagcaaaggtgcaaatatttatcagggacattttctaatcaagaactccaagttcttggtgcctgcacaggtccttctgaacgagttttgtagcctagggacaaaggaaaatgatgtactaccaaagcaaaagtgctctcaaaagaacaagcagtgggaagaaggtaatagcggtggtggttcctcaaagaaccattctcttagctctctagagtatgtggaattgcagaagagaaagacaaagctgctcgcgatgctggaagaggttgatagaagatacaaacactaccgtaaccaaatgaaggctgtggtgtcctcctttgaagcagtggcgggtaatggtgcagccactgtttactcggctctggctttgaaagccatgtcaagacattttaggtgtttgaaggatggaattatggatgaaattgaagccacaagaaaaggcatgggagagaaagaccacgtagcggcagtacccggcacaacaaggggcgaaacaccaaggcttagaatcgttgaccaatcgctgagacaacaaagggcctttcagcaaattagcatcatggaaacccatccttggagaccccaacgtggccttcccgaacgttccgtttctgttcttcgagcttggctttttgagcactttctccatccgtacccaagcgatgttgataaacatatcctagcccgccaagccggtctctccagacgtcaggcacgtgtttcgaattggtttattaacgcgagggtgaggctatggaagccgatggtggaggaaatgtatctggaagaagagaaggagcaagaaaacgacgtagcatcatcggatattaatgttcccgaagaggatgagaagccaacgcaggaggctccactccttcgaattgactcagagtgcatgtcgtctatcgtcaacgacgtcacaaagagcggcaaaaccatccaaaacgacaaccaaatggacgcattcgggtcggtggagcttgacttttcgtcctacacgcatgcgcaccattcttccggcgtgtcgttgacgctggggttacagcagcacggtgaaagcggggtaagtttagcgttcctgccagcggcaacacagagctcgatgttttacccacgggatcagattcaagagtgtcaaacagttcagtactctcttttggatgccgaaggacaaaacatgccgtttaggaatgtcatggggacacacttgcttcatgatttggtatga

SEQ ID NO: 103369 - DNA, 579 bp, Glycine max
  misc_feature (13)..(13): n is a, c, g, or t
  Peptide Sequence Number=SeqID_220147
atgaagcaccccngagaccacaatctagtcgacttcgagcctcacatcggatatgctgctgagaggcaggcattttatggcgtacccataccaaacactttgggggtccttcagtatcgcccacaaccacaacccttgcattttacagtgggaagagtccctcttgctatagtggaaagggagagatttgatcatatagaggagaggctgagggctattgaaggaggcagagattatgcctttgttaacatggtagaactgtgcctagtgcccgacatcgttatccctccaaagttcaaggtgccggatttcgataaatacaaagagactacttgccctaagaatcacctaaagatgtacaataggaaaatgggggcatactcaaaaaatgaaaaattgttgatgcatttcttccaggaaagtcttactggggcattcgtcacctggtggagggatctagcagctcaagtagcacccccaatgatggagagggagatgataacaatgatagtagacacgttactggtgttctactatgaaaagatggtggttacatgccttcaagctttgccgatttag

SEQ ID NO: 103370 - DNA, 1695 bp, Glycine max
  Peptide Sequence Number=SeqID_220148
atggcaaccctcgaagtccaaaagcagcccaaacgacccaagtatcgggaaagcagcgtctctccctctgtaaacccgcagcggcgcactcccgaggccgaatctccctccagctacagccacaggacccgcttctctccaataatggacttttttcattcttcttctcccacatccaaccatgactctttcccttctagcttctccaagttcaactccgccctcaccgctggcctcttaaacccattgtccccccctcccgacaagacccgatccagccctaccctcttcgaaatcatggccagcgagcccgacgtcccccacaggcccacccctctcatccctccaacccccaacccctaccccaacaagccccttattcttgatcctcatgccctcttgatgcagcgcatatccgagctccttgtttctcgcagccccggtaatcagttcaacgacgccgtttccagcgacatcaagctcactctcacctccaaagacggtacttgtgtctccatgaacttgcatcgccaaatcctcgttgctcacagtagattcttctctgtcaagctctccgatcgctggaccaagcaccagcaggagctgcagcgctccccggtgccctacgaagttgaaatcgccgactgcgacgatgttgaggtttacattgagactttgaggttgatgtattgtaaggatcttaggaagaagctcatgagggaggatgtctcccgagttctcggcattttaaaggtttcagctgcgattgggtttgatgctggggttttgtcttgtttggagtacttggaagcagcgccatgggcggaggatgaggaggagaaggtggcatcgctcctgtctgagcttcgtcttgaagcagttggagctggggaggttttgaagagggtttcgactggtgttgccaatggaaatgaagaggggagtgataacgaggaggttctacttaagcttattcgtgtggttcttgaagggaaggatgagaaggccaggcgcgagatgaaagggttagtttcgaagatgctgcgtgagaattcttctcagagtgatcttcggaaagagtcattgtacttggcatgtgacgattgcctgcagttacttcgtcaccattttttgcaggctgtggcttcggatatgcaggatttgagtcaaattgcaaggcaagcagataatttgcattggattttggatattttagttgacagacagattgccgaggatttcctcaagacgtgggcatctcagtcagatttagctgaagctcattctaaagtgccggcagttcacaggtttgaggttagcagagttacagcaaggttgtttgttgggattgggaaaggacaattgttggcttctaaagatgtaaggtgtttgcttctaaaaacttggctggtgcccttttatgatgactttggttggatgaggagggcatccaaggggcttgataggcacctaattgaggatggtcttagtaacacgattctcactctgccgctcccctgtcaacaggatattttgcttgcttggtttaatcgtttcttgaattctggtgaagattgcccaaatattcaaagagggtttgaagtttggtggagaagggctttctggaagaggaatggagagcaagaacggacaagacaatttcgaattgcaactacatcagttgagaacccttga

SEQ ID NO: 103371 - DNA, 234 bp, Glycine max
  Peptide Sequence Number=SeqID_220149
atgtatagcagttcgagctttttgggaaatggggttgttcagaatggtacaaaaaatggagaaagaaagatagtgcttggaagaaatattcacaccacgtgccttgaagtcactgagcctgatatagatgatgaggttactggggaaagggaagcttatatggcaggcatgttggctaaatacaaaaaatctctgaaaggaccaactatcattcaggatactcctataatttga

SEQ ID NO: 103372 - DNA, 858 bp, Glycine max
  Peptide Sequence Number=SeqID_220150
atgattgtgggaagcagtgaaattcaagaggcttctcagctgctgtcttgtttggctgactttgtgtactgcacggtctgtgcatgcatgcagactcagcacaagattgagatggacaagcgtgacgggaaatttggaccccaaccagcaatggcagtgcctcctgttcagcagatgtcacgcattgatcaacaagttcctccttttgttgggtttccaccacaaccagtttatggacagcctgctcaaggatatccccccgccggttaccacccccctgctacatatcctccaccagaatatccccccgccgcaccaattgattggttcatagaacaagggtacatcccagagtctctgaataaaagcaccttgcatttcgtccggtataaaggccgttctgcaaagagggcaggttctctgatcgtaccccatccaacggtccaaacatcctcggtggaatatgtgacgacaattcgccagccgtctgatctcatcgttttcctcgaactcgctcagacacaccgcgcacgtctccgggggatccaccagctcccggaacttcaccaccggcaggatttcccggatgagcgtggccgacacggattcgaactcttcgggcactcgggtctgggtttcggcccaggcaatgtcgggctcgaggaagtcgtggaggcccatgaagcggaggaggctgcaaatcagcttcctgaggaggcccaggagggagaggatgtgaaggagaagcttcgggaagaggagctccgagtaccccactgggaaacccatcagaattcagatgttgtttctttccgtgtcaagagaaaaagtgagagagagagagagagagagaagtga

SEQ ID NO: 103373 - DNA, 936 bp, Glycine max
  Peptide Sequence Number=SeqID_220151
atgtcttctgatctctatgcttttgacactaccttttacacacattcaaactcagactcggtttcctctgatggagttggagaccttccttttctctcggaatcttttcctttcttcgccaattctcaagagaattccaatgctctttataattccctcgacccgttttccccttcttttttctctttctcacctccaagttcccacttggaaagccttagcctttaccatgctaaccacgtgcagcctctgtcaaatggccaaaacttggcaaatgaatttggaagcttctcagcttttgatgggtctgaagtgaaaactgaggaatgccaaatgggtgttgattatgtctacggtcagcaactccttcctcacagtcacagttatagtggtgctgagaatttttccaagtacatgctgaggagcttcagcagcaactcctacgaagggaaaccttacagtgacactcgcgaggattctacaaaatttcaaagccatgagatgagttcccctgaagacactgtctttggtggacaaatgagaagggtttgcagcacaggagatttgcagaacatgaagggaaatcacatgtctccaacggaggcgccgttgttggaggaatcgaacttcaaagtagggcgttacagtgccgaggaaagaaaagaaagaatttctaaatacagagccaagagaacccagaggaacttcaacaaaaccattaagtatgcatgccgaaagacacttgcagataatcgaccacgcatacgtggtagatttgcccgcaacgacgaggccagcgaaactcccaaggtttcatgttccacccgagatgaagatgatgtcgatttctggatggaagaattgcgattgcatgaagagcaagacgatgtaacagtggtaacagaacagtatttaattgagaaattatggagctag

SEQ ID NO: 103374 - DNA, 237 bp, Glycine max
  Peptide Sequence Number=SeqID_220152
atgaatcataaaattactaatagtgatagtgactcctggccacaggttgttgctttggatgttgatctaccagtgaaacaggcatttcatatattgcatgagcagggagttttcatggctcctctttgggacttctgcaaggggcaatttgttggtgttcttagtgcttcggattttattttaattttaagagagtttaatctcaacttgttcgatcctgcagagatcaatttatga

SEQ ID NO: 103375 - DNA, 114 bp, Glycine max
  Peptide Sequence Number=SeqID_220153
tgctgtcaaatctttgctcaaaatgatgatttagcacacagcaaactcaagtgcggagtggaggacaaatgtcctatagccataggttctgctcaacacaaagcgcgattctga

SEQ ID NO: 103376 - DNA, 2712 bp, Glycine max
  Peptide Sequence Number=SeqID_220154
atggacccatctatagtgaagcttctggaagatgacgaggatgaaagtatgcactcaggggcagacgtggaagcattccaggctgcattaaatagagacataggaggagatacttcgacttctcagttgtctggttcagacacaggaagcaataattcattaagccagtcattaccaaagcagccaacttctacccatgacaagcaaagtgactgtcaaaatcaagagcctaaagttgtgcagcagcaagagcaacaacattcgtctgaaatggagcagaagccacagcaacctcttgttgaacaactacagaatgctgcttctcaggatgccaataatctcccttcatctcagaaacaatctcaagatgaaagtgctcaaggccatactgcacaagctccccaccaaaattctcaaacaaatgtaactcagaattctgaaaaagatcctgtcttcaaccatgaggcagtcaacacacataatcctaaccatgaatctcagtatgcaaagctgcagcaaatgagtaatcaacaggccactgtcaaggaacagcctggaagtcaggtcgatcggaataaacagaaagatgaaatgcccaaagatcagtttgtgcggcttatgaaaggtattgtaggggatcagatgcttagattagcattaacgaaagtgcaattacagacaagatccaacccagcacccactgggcagcagcatcctcatgtaaggacgccaaatgttaattcaggtgcaacaaaatttaatgatccccatgcattagcccatctgcatcagagaagtatgaatgctgctgcagatcaatctaataatacttcttcagccgtccaagtaaagaatgaaccaacctatccaactatggacattaatgctaaaaaatctcgggaactggatgttcaagtagaatctcaaggagcgcaactaaatcagttaccatcatccagttctaatgctgttagtcaagaaacggaaagatcctcacttcacttacaaggccttaataaggagcaacaacagcatctacatttcccttcagcatatggtaacagtggtggtaattataaccctttttcgggctcaaccagtagttccacatcatctatcagaccacaaccttttgattcacacatgaggcaaattccacatcagagcatcagtccaaatcaattaggtgggtcaacacagggtttgattggtttgacaaaacttgatcagcaaaattctttcaatgatcccaagagaatgcctggtggatttgtgtcccctgtggcaaacaatacaacatcacaacaaacatcaaattcttggcaaccatcagcaaacaaagaacaaagttcaggctcgttttcatctgttccatatgtaaaaaaggagcctaatgacctgtctaccgagcagcaacacaggcataatttgtctaaattgcacgggctgcattctgttaattctgtgcaaaatgaacagggtagcagtgccaatcaaggcaccctaaaggaggagttttcaagaggctttccagcatccacaagtatgccgcatacaacatctagcttgctgcctctcaattctgcttccccttctgtatctcaacttgaccctagtgccactttaagccctcagatcccatcaaacacgtctgttataaatgcaaggacacctctgaaaaagccttctcctggccagaagaaaccaattgaagcacttggttcttcacctcctcctccaagtaagaaacaaaaagtgtctggggcatctcttgagccaagcattgaacaacttaatgatgttactgctgttagtggtgttgatcttagggaggaggaagaacaattattttctgggcccaaggaggacagtcgagcttcagaagcatctcgcagagttgtgcaagaagaggaggaaagtctgattttgcagaaagctccattgcaaagaaaactgattgagattataaatgagtgtggcttgaagggtgtgagtaatgatttggagagatgcttgtcactgtgtgtggaggaaagaatgcgtggagtaataagtaatgtgattagaatgtcaaaacagcgggttgatttggagaagacaagccatcggactgttgtcacttcagatgtacggcagcaaatcctaacaatgaataagaaggcaagggaagaatgggagaaaaaacagtcagaaacagagaagctccggaaactaaatgatgtagatggtaatgctgggattgatggtgacaaggagaaagatgagggtcggactaaagcaacaaaggtgaacaaagaagtggatgacaagatgaggacaaatgctgctaatgttgctgcccgagctgctgttgggggagatgacatgctgtcaaagtggcaacttatggctgagcaagccagacagaagaaacgtggtgggggaatggatgcttcatctggttctcaaccagctaaagatgtgagccagaaatcttcatcaacatcaggaaggagtacaaaagataatcaggcaagagagaaaaaaggtccaacttctggggctggtagaaaatttgggagaagtcatgccacgacacctcaaaatagcatagctcgaagcatatctgtcaaggacgtgattgcagtcctggagagggaaccccagatgtccaaatcatcactcttatatcgattgtatgagagaattcattctgacacctcaactgaataa

SEQ ID NO: 103377 - DNA, 146 bp, Glycine max
  Peptide Sequence Number=SeqID_220155
gtgttgttggggtcgaatgtctcatggaggatggggtgagaaatttggtagttcccgtgagaaggaaaaatttgcagtccctcaaattgtttgaaagcagtgggtgcacgtttgatggcctggtggctcgggttaaaattttgtga

SEQ ID NO: 103378 - DNA, 1803 bp, Glycine max
  Peptide Sequence Number=SeqID_220156
atgggacctgtggcagagacatacttcaccagactttgttgggtcttattttcttctggaaatctcgatcaccataatgctgcttttcttcaagctgatctgctggaggtaatggactttataaatgatgcaattgtatcaatggactcttttgttagtgcatacgaaccagcagctgttttcttctcttgcccagttgaaatgagttatgggaatgaggaactgctgagcctccttgcccgattgcatgattcacttattccatcattgcaaaagggattccgtatgatttttgctgacaaacaagatggcacagtatctaatatcttagtaagtttgaagatgttaaaaattagattggtaaagtttggttggcaactattgcacttgtgctatctaagtgatgaagtgttcagagatagcatccctcttctagctgccacaaagatgtttcctgccaatgtagaggacccagtcatcagagctgatattctggttcaaacatttagagagatcaattcagtatcagtacattctcaggaaagccatcagaaggaaacatttcttcaagatgttgaaagaaatttcaatatactaagcaggattgagagattaaaggatagcggatggatattcattgatgatgaacagtttcaatatatatctgggatgttgagttctgtttataaggagctgtattctgccacaacccctgcgccaaaccaaacattgctgatggatgaaaatgctgcaattacagagtcaaacatcagtcagattagggacctgttccctgattatggtaaagattttttagctgcgtgtcttgaggtctatgaccagaagccagaagaggttattcaaagaattttagagggaacccttcatgaagatctgcagaagctggacacctcgctagagacattgcctccagccaaggctaccactgtgggtggtaatgataaaggaaaaggtaaattaattgattctacgtcagcatcctcaaatccagttgttagggggaaacacccggcagaggggacagtgatgtcatcctctgcttcactaggaaaatttgtgaggaaatctagagctaacttgcctgatcgcagtattctggataaaaaggatgaaaaagatacatcaaaaactgctgctatgattttacaatatgaatatgaagatgagtatgacgactcttttgatgacttgggtctaagtgtagcagactctggagtagaagaaaatgagacattgagcgaccaaataaacgcaaagtcagggaattcgtgggcaacagggggtaactctgtcaaaaatgcccctgattcaaaatggggctccaggaaaagaccgcagtactttgtaaaggatggtaagaattacagctacaaagtggctggtgcagtagcagtggcaaattctgatgaagcttcgctagtaacgcaagctcagaaagaattgatacatggccttggatgtggaggcaaccttcctcttggcgcggtaaagaaagtgatggattcctacaaggaggatgataaccaatcccagtcttctgaaatggaagggagagggatttcgggcaattcgtttggtaggggaaggaaggaaagtggaaaacaaattgcatctcatcagcagcaggagaaacaatctgatgattccgaggtggatggcaataatcaaagggggagagggagaggaagtggcaggggaagggggggaggaggaggaagaaacaatcattaccagaaggaccgagccatgaagaagcatttctctggaatgagtggttattaa

SEQ ID NO: 103379 - DNA, 852 bp, Glycine max
  Peptide Sequence Number=SeqID_220157
atgtcgaatcgatccagtcagggtagacaccatgacaacaacaataaccataacaagggtttctccaaaacccatagtcagaagaaattcgcccccaaaactcaaaatcccaatcctaaccccactccaaccctctcaacctccctcagacaaacacaatcatctgtctcttccaccagtagcagaggccagaatgggaatttcgttaaatacttgccacaagacgaggccgtggcagcgggtctcggcgccgaagatggagcattggatcccctcgaatctcagagagtcgttgatcttttgaacacacacttgtcactcttgctcaagttcaaacccaaggaattctggacacaagtggctactgacacctccctgcatgagtttttggacagcttcttgcagttcaggagcaggtggtacgatttccctcatcgcggggtgagagggattgttgccggtgttattgttggagagctcgagttgagtcgccgcgttttcatggtattgtatcgaatttcttcaaataaagaccccggtgctcgaccagctgatgccctcagtttgagagaccatgaagttcttttgcaggagaagaagttgcttgagttgccgaagttgttggatatatgtgccatatactatcatgaaaatgaagaactgacaagatcactggtatatattataacttatgttggatttataatccttagaatagctgctgtcccaatatttgctatagtgcttttgggactagcttctctgctgctatccaagattgataactgtggtaatagaaaagggaatttgcattatttcacctacaggtgcataatcagccaactgatatga

SEQ ID NO: 103380 - DNA, 462 bp, Glycine max
  misc_feature (76)..(76): n is a, c, g, or t
  Peptide Sequence Number=SeqID_220158
atgcgtaaggagaaaataccgcatcaggcgccattcgccattcaggctgcgcaactgttgggaagggcgatcggtncgggcctcttcgctattacgccagctggcgaaagggggatgtgctgcaaggcgattaagttggaggtcaatttaatggatcacaaaccatcagttattgctgtggcagctactttggtggcaatggatcaacaattaacgagagacgcggtggagttgaagatgagttcaattccacaacataggcttctagaatctaaagatgtatttgagtactacaatctaattcaaagattatacgaggagaataccaaaagcgacacccatacgccaattgagatgacagagagctctcgagttacttcttctgctgcaatgacaaagagaagacgactcacattcagtgatgatgaaggaagtagtcatgggaagggaccaccgggctag

SEQ ID NO: 103381 - DNA, 315 bp, Glycine max
  Peptide Sequence Number=SeqID_220159
atgggaatggtaacaaaaaacctcgtgattcaaaagatgggatcagcaacagatcctcaaagcctttatgcaaggaaaagaagacttagaataaatgagaggctaagaattctgcagaatcttgtccccaacggaacaaaggtagatagaagcagtatgcttgaagaagcagtccaatacatgaaatttttgcagctccagatcaagcttttaagctctgatgatttgtggatgtacgctccgatagcttataatggacttgacctcgtactcaatctcaatcaccaagagttccccacctttgtgaccttataa

SEQ ID NO: 103382 - DNA, 1071 bp, Glycine max
  Peptide Sequence Number=SeqID_220160
atggtgccgcatccataccataagggacacctgcttctcttttattacagcactctcaaaacacattataggaaactccaaagaagaacccttccttattcagaaacaacaataatggaccctagaatatggagcaaactacctcctgatgttgtagaacacatacttttgttacttcctctcaaaacactcttgaatctcagacccacttgcaaggccttcacctgtctcctcttttcaccttcatttgtttccaaacactcttcttctttatcttcttcctctttatcacccttctcttcctttctcttactctcccatcctcaattccctcactatttccgtctctacgattccaacctttgctcttggcgaaccctctctctctccctctccaactctctacccttctcttcttccttcactcttgtttcctcctctggtggcctcttttgtctcttcaaccccacctcttctacctttcttgtgtacaacctctttgtcaagtccttcagaaaaatcgaatccccaacaagtctttctctttatttgggacatgtcacttttgttaccacccctcttggctactacatagtacttcttcgttcaaagtcaacttccaacactagtgtctttgtttatgattctaacgaactctcttgtcggtcttttgagggtttcaatgctgttctcagcggcagtattcaccagcagggtactttcttcgatgggggcttgtatttcacaaccccggaaccattttcagtggtgcctattgatttggatagtggaagatgggagagacacgttgctgagttgccacaacaagtcactttcatgaggctggtgagtgatggagaagggaagttgtacttgcttagtggtattgggaacgatggaatcttgaggagcatcaagttgtgggaattaacaaagggtgaaagggtttgggtggaagtggtggtgttgcctgagattaggtgtaggaaatttgtgtgggtgcagtgcaggacttctgattttgctctggtggcttactgcaagcaattaagaagctatcgccaaccataa

SEQ ID NO: 103383 - DNA, 984 bp, Glycine max
  Peptide Sequence Number=SeqID_220161
atgttcaaccatgattccttctccgctttcagcgactgcaacagcgacagatccgccgaatttcccacgccgtcttctgagaattccgacgaactcattcggcaacttgttctcaaattggtctcctgttccattgaggaacaaaaacaagcgacgatggaaatcaggttactcgccaagaacaagcaagagaaccgccccaaaatcgcaaaagccggcgccattcagcccttgatttcactcttaccatcatcagaccttcagcttcaggaatacgtggtgaccgcgattctgaatctctccctctgcgacgagaacaaggagctcatcgcttctcatggagcggtgaaggcgctggtggcgccgctggagagagggacggcgacggcgaaggagaacgcggcgtgcgccttggttcgtttatcgcacaacagggaggaagagaaggtggcgatagggagggcgggggcgattccgcatctggtgaagcttctagaaggagggggattgcgcgggaagaaggacgcggcgactgcgctctacgcgctgtgttcggccaaggagaataaggtgagggcggtgagggcggggattatgagggggctggtggagctgatggcggacttggggtcgagcatggtggacaaggcggtgtacgtggtgagcgtggtggtgggggtggcggaggcgagggcggcgctggtggaggaaggagggattccggtgctggtggagatagtggaggtggggacgcagaggcagaaggatattgcggctggggtgttgttgcagatttgtgaggagagtgtggtgtaccgtactatggtgtcccgcgaaggagccattcctccattggttgctttgtcccagtcaaattccaatcgcgccaagcaaaaggctcagaaactaatacaacttctaccacaaccaagatccgccaatggcgctgctcccacctcggaaatgccaccaatccaacactga

SEQ ID NO: 103384 - DNA, 480 bp, Glycine max
  Peptide Sequence Number=SeqID_220162
atggatgatgatctttcgtccagccttctgtgccatgaaaacgaaacgtgtttgaaagaaggaggtgaagagttagaataccaattcgcaggatcacagcatgattgtggggtttcggaggatgaacgtgtgggaattttgatcgagagagagatcgttcttgggttcaaaagggacgaaagtatggtgtttggggactgggtgaaacgcgcacgcgtggaagcaatcaattggattctcaaaacaagagcaacattgggttttcgcttcgaaacggcctatttgtcagtcacatacttcgatcgatttctttccagacgttccattgatagtgaaaagagttgggcaattcggttgctgtcaattgcatgcctctctctggctgcaaagatggaggaatgcaatgtgccagggctatcagagttcaaattggatgattattcctttgagggaaaagtgattcagaaaatggagcttttg

SEQ ID NO: 103385 - DNA, 318 bp, Glycine max
  Peptide Sequence Number=SeqID_220163
atggatctggggatcccacggtcatgtggctccgcatgccactggactcttgggtcacgcacttcgtttctaaacgaccatttagaggaaacactgggtccaacaaagataggagaaaatcactcaaagtgtatcaatctcacacagggcaagaaagtcgctagcgcacaggattttggttggcaatcaaagggagaggaccactttaggtcgtggtttcctttttcttgtttacttggtgacaattctatattattccgatattggctggtccaaagacctttctggatgtttcttctgttttcttccgatccttga

SEQ ID NO: 103386 - DNA, 258 bp, Glycine max
  Peptide Sequence Number=SeqID_220164
atgaagaggcaggatgtcaacattcagcttttaaatgaacattcaggggaaacatgggattttagcattcgttatttgctctcccttgaggagattctgctgtccttttcttccggggaaaagatgaggattcttttcataggcaaggttcaaagtagcctaaggttgtgtctcaacatggtcttttcatcgtgggagcctgatcttgatatctggggcaaaacaaattcgtgtgtcaaggtgtcggtctcgggttga

SEQ ID NO: 103387 - DNA, 840 bp, Glycine max
  Peptide Sequence Number=SeqID_220165
atgcacaagcaaacgcatacgcatgtgtggaagcggatcagagacagggaagctgggaaactgcatgcaagccatttcgccaaccgcataaaatggaatcgcatttcgcaactccaattatccaatcacaaagacatcgtctcacctcacaaaggcgccatcaactcccttcagattgattccacggagggaagatatttgctatccgccgcctccgatgcctcggtagcagtctacgacgtccaacgacccaccgtttacgaagccggcggcgtcatttcgaaacacagctctatatttgtcgttgacaagcagcaccagcaagcccataaatatgcggtttcctcagctatatggtatcccattgacaccggcttgttcgtcactggctcatacgatcaccacattaatgtttgggataccaataccacccagggtcttgctatcttccttatgatactgattaaagaactaaaaggtgtggtggtaaatttcaaaatgcctggaaaggttcatagggctgcaatgtccaatttatcaacatctcacatgcttattgctgctgccactgaggatgtccaagttcgcctttgtgatattgcttccggagcctttgctcacactttgtccggtcaccgtgatggagtaatgactgttgaatggtctaattcaagtgaatgggtcttggttactgggggatgtgatggtgcaatacgattttgggacatcagacgcgctggctgtttccaagttttagatcaatctcggactcagcttggaagacgcccaaccatactcaatcactccatgataactaaggttttcttcttcattttttag

SEQ ID NO: 103388 - DNA, 1662 bp, Glycine max
  Peptide Sequence Number=SeqID_220166
atggctcctcctactaagcctcctccgatcaatattgaacctgaaaattgccctgaagctgtgatgaattggtacaacatcacttcacgtttgaatattgaacctgaaaattacaagcgccaatgtacattaagtagagacctctcctcccaagccaagaagcatctttgttttctgggttggaggttttggcacgctgacaagaaaaacaagtgggagcttcgttacacttcacccatcactggcaagaactacatttcactcagaagggcatgccatgcttgcatacaagaaggaggctgcaacaatggaaaccctcaaattaatcttcaacaacacaacaacaacaacaatgttgatcagaacccttcaccttctgcaccaaagaaaccaaggaagtccaccaacaaaagaacgagggtatgcaagaaaagacaaaagagtgatgacgatgatgaattgggagaagcctctagttctatgaataataataattataaaaaaatgatgcgtgaggccgaggcaacaaatgtttctgatcagtctttaaagcagcagcatcgtggagcaattatcccttggttgatagataacaatgtggtggctttgtattcattggtattctgccgtgatgcaaataacgtggtcaagaaagggaaactatggcgtagtggcatagcttgtgaatgctgtggcatgtttttctctcccactcgctttgaggctcatgctgggtgccacaagcacagaccaaacgccagcattttcttggaagatggaaggtcgttgttggattgtcaaaaagaagccttgagttctcagcaaaacaagcatgttcctgatggcgattggttctgcccagcttgttgttgcaaagtatgcaaggggcccagatgcaatacagaagaaaattgtgatgaccatgtggatgctaatagagttctggtttgtcatcaatgtgaggggagataccatattgggtgtttgaaagctctaacttataccaagatgggaaaggatcaagatcatgttgataatgagaatgagaattggttctgcagtggagactgtgagaatatattcttagctttgcagaagctggtgggaaaagccattaatgttgttggtgaggataatgtaacttggacgttgttgaaggcactgaaaaaaggtgagagcaagcttagtgaggcacttaatgttttgcgtgagtgttttagtccagtcactgatgctttcttcgggagagatataatttctgatgttgttttcagtagaggttcagaactcaatcgtttgaacttttgtggtttttatactgtgattttagagagggagggggaagtagtttctgttgccactttaaggatttttggcaagagggttgctgaaataccctttgtggctaccagggtgcagtgtagaaaacaaggattgtgtggcattttaatgaatgagattgagaagcagttgacttacttgggagtagaggagattgttctgccttccacgcctaaggtgatagacacttggacgaactcatttgactttgaaaagatgacactctcagttaagtcaaagtttcttgatcatgtttttctggacttcgaggataccatcatgtgccacaaactactagtggtgaaacaaactgttatatga

SEQ ID NO: 103389 - DNA, 1338 bp, Glycine max
  Peptide Sequence Number=SeqID_220167
atggatgagaggtttcgggtgtcaattctgattagtttggtgctttctcatttgctagaggctgcaaaggagtgcagaataattttggatacggttgaatctgcccttcccaatggaatgcctgagggtattggtgaaggttgtaagttgcaagagatgtttcataaagcattggagttgtttccaagcctttggatcaaggcagggtttcttgatgaagctgtcactgcatatcgtcgtgctcttgtcaagccttggaatttggagccaagaaagttggctgctgtagaaaaagatttagctatgatactactctatggtggtgttgaagtaagcctaccctctcagttgcaggtgtggggtaaaacagcacccaagagtagtgctgaagaagcaatacttttgctattaatactcatgagcaaggtggcaattcgggaaatagactgggatgctgaaataatggatcatcttacttttgcactttcagtgactgggatgtttgagttattggcagatcatgtagagcagatccttccaggtatttatggtcgagctgagaggtggtactttcttgctctgtgttatagtgcagcaggacatgatggggtagcattgaaccttttgaggaaggcttgtggcagttctgaagcaaaccatagaccccattttccttcatttttgtttggagcaaaactctgttccttggatcctcaccatgctcatgaaggcattaaattttcacgtgaagttattgttatagctaagcaacaaaatgaacattttctcagtcaaggtcataaatttcttggcatctgctacggggctgctgctagaatttctgtactggattctgaaagaagtatatttcaaagagagtctttggactctctaaactgtgctgctgtaaatggaagtgatgacctggaagcgatagtcagcctcggactagaaaatgccattcaaaggaatctggatgcagcttacaacaatataatgatgtactcagacatgactgttggcagttcaagaggttggcagctattagcactcataatatctgcacagcagcggtttaaggatgctgaaactatagttgattttgctttagatgattctggggggatggatcaacttgaacttctaagattgaaagcagtgcttcaaatttctcagcagcaacccaaggaagcaatagagacatataggatcttgctagcactaattcaagcaaaaaaggagcttttgcttcaagataaaaacattgatcaagaacaagcattcaggcatgaggtgtgtagtactttccaaggaagaactctaacatcccttgtatag

SEQ ID NO: 103390 - DNA, 210 bp, Glycine max
  Peptide Sequence Number=SeqID_220168
atggggttatgctttggttgcttcgacggaggcaacaagcgtatgacaaaagaagaagagcgattggcctctgaagaagcgcgtgctagagctgctgaagccgcccagaaaaagcaagagcagcaaggagaggcaaagcaaccagaaacggttaaggaacctgaaaactccaacaatggcgaagcgtttgtaaagtggcagatgggttga

SEQ ID NO: 103391 - DNA, 644 bp, Glycine max
  Peptide Sequence Number=SeqID_220169
tttccatcaccaagaagaagatgtaccatgttcaagccccaagaagtactccaggagaaaagaaagtaggaatattaacaaaaacccatactccaatcgaggcttagacaagttttctgcacttttggctgatcttgacgagagaaggcaaaaggtttactcacagatgagtcctcaggacatatcttttgttcggtttgcgtattccagcaatgatgatttcgttcccatagtggtcaaagtgaaaaaaaataataaggatcagaagaagcacaagagtgaagaactcaaagcaagacacataacatctttctcggagcaattggagaaatcttctgaagaaacaaccttggaagaaaggaagcaaaaactcaataagttggaagctcataagaagaagaatttgagcttttcttggaacgtgttgaagagaccatctttctatgtgccagcggttgtgatgttgattttggtttttttggttgttcttgggagatcggttgctacactttgcacttgtgttgtgtgggggtggctgaatgatgtgaagatggtgaatcctgaagatttagcttctccaagaagtggtgattccaaggcttattcaaatgacaataattcagggaaacatggccaccagaaaa

SEQ ID NO: 103392 - DNA, 315 bp, Glycine max
  Peptide Sequence Number=SeqID_220170
atgttggaaatggttattaaggatggtttaaatgggtcagatggaaagaaaattttaaagctcacaaaggaattatgtgatgttattgaaaacttcagtcttgtaagcttttcaaccttagatattcaggacaaagagagtgtagggaatttagtgaagctgatagacaaaagcaatgggtacatatttgttgggatggaaacaagtgcagttgaatttagcaagattgcggttggtcctgttgattgggattattatagatatcctttttttcctcatgtgtatattctgatacctctggatgatttactatag

SEQ ID NO: 103393 - DNA, 402 bp, Glycine max
  Peptide Sequence Number=SeqID_220171
atggtgtttgggcaaatagtggttggtcctcctggctctggcaaaacaacttactgcaatggcatgtctcagtttcttagtcttattggaaggaaggttgctgttatcaatttggatcctgctaatgattcgttaccgtatccttccctttacctctttcagacatcatttttctcaaagttgtatagttcaattattattgtttcccctaataaagaatatagatatgattgtgctgtgaacattgaggatcttgtgaaactaagtgatgtaatggtggaacattcgcttggaccaaatgggggtcttgtgtattgtatggattatcttgagaaaaatattgactggttggaagcaaaattggaacctcttctgaaagttaactgcagtgcatttgattga

SEQ ID NO: 103394 - DNA, 231 bp, Glycine max
  Peptide Sequence Number=SeqID_220172
atggcatttgcaggaacaactcagaagtgcatggcttgtgacaaaacagtttatctggttgataagttgacagcagataaccgagtgtaccataaggcttgcttcagatgccaccactgcaaaggaacactcaagatatatataataataatgataattcttcatggttatgtagcgtttgactctagttgttcagatctttctgtacctggatctggtgtctctagttga

SEQ ID NO: 103395 - DNA, 327 bp, Glycine max
  Peptide Sequence Number=SeqID_220173
atgtctgtgtctttcggccgaaactacgaaaaagtctcatttgctatccgtaagactcaaagcccgatagcatgcagtggcttacgtcatcacttgcagcttccccggagatatcagggtcttccgaccgagactgcgaaaaagtctcatttgctatctgtaagactcaaagcgcgatatcatgcggtggcttacgtcatcacttgcaccttccaaggagatcgtgttccggccgagactgcgaaaaagtctcatttgctatccataagactcaaacccgcatcgcatgcaatgactaacgttgtcaccagcaccttcctaggagat

SEQ ID NO: 103396 - DNA, 156 bp, Glycine max
  Peptide Sequence Number=SeqID_220174
atgatcgttgtcgtcttcactagcgccatctttgatgatgacgatgatcatggcggtggaggtggtgaatatagcaacgatcataccagcaaaggtggtgacaatcatggtgatgctatagggaccagggttagaatcaacccttgcaagaagtaa

SEQ ID NO: 103397 - DNA, 1003 bp, Glycine max
  Peptide Sequence Number=SeqID_220175
atggcaatggcccagctccctcaggacctcatagaagaaattttgtcatggcttcccgtcaaatctcttatgcgtttcaggtgtgtttctaggacttggaattccctcatcttccaagcacactttgtcaaattgaaccttcaaaggtcatctagaaacacccatgtcctattaaggtgtcaaattaatactgtgtttgaagatatgagggatctcccaggcatcgccccatgctctatatgtagtttacttgagaacccatcatccactgttgacaatggttgccaccagctagacaacagatacttatttataggttcctgcaatgggttggtttgcttgattaatttggttgctagaggtgaattcagtgaataccgggtctggttttgtaacctggccacaaggatcatgtctgaagattcaccacacttatgtcttcgctcatgcaattataaactttggtggtatcaagtgaagtgtgggtttgcttatgatgatcggagtgacacttacaaggtggtgttagtcctttcgaatattaagtcacaaaattgggaggtgagagttcaccgcttaggtgacactcattggagaaaggttttaacttgtccagcattccccattttgggagaaaaatgtggacaacctgtgagtggcactgttaactggttcgcaattcgcaagttgggttttgattacgaatgggaaactgtcaccgtcgatcaattagtaattttttcatatgatctaaacaaggagacattcaaatatttgctgatgccgaatggtctttctcaagttccctgtggccctgaacttggggtattgaagggctgcttgtgtctttctcatgttcaccggagaacccattttgttgtttggctaatgagggaatttggagttgaaaattcttggactcaattgttgaatgtaactcttgagcttcttcaagcccctctgccctgtgtaatactgaagcctctgtgcatctctgaaaaag

SEQ ID NO: 103398 - DNA, 250 bp, Glycine max
  Peptide Sequence Number=SeqID_220176
atggcggttgtgctgtcgctgtcaggtgcatctgcagtacatgcagatacgggtaaaatcactttcgaaggctctgttatcgatgcgccatgttcaatctctgcagactctcttgagcagacaattcagatgggtgcaatttcaaacgtccagctggcaaaaaataacaataccggcgaatccgtcccgaaaactgtgactatccagcttgaggaatgcactgtttcgactcccggcacaaaagaacaaa

SEQ ID NO: 103399 - DNA, 288 bp, Glycine max
  Peptide Sequence Number=SeqID_220177
atggcggcgaaggttaccccagctgcagctatcgagggacacggcacccagcatccccgcaacgatgccgaggaacgaggccatggtctgccggctgcggggcgaattcagggaaagaagataagcccgggcgggactgaccgggccttcaccaccggacagcgccggcaggaattcctcaccgggtggaatgacggctgcgggcagactcagctccggttcgtcgtcgggtatcaggatcatgtcgggctccggcaggggccgggatgggaccggcgcgctgcgtga

SEQ ID NO: 103400 - DNA, 177 bp, Glycine max
  Peptide Sequence Number=SeqID_220178
atgaaaaagaagaagattgcaatttacgggagtcgatttgatgaagaaatgagtgagataggaaggtttggaggtttgggaatggaggaacatcgcaaggaggaaggggctgcgcagagatttctggaaaatgtgatatttataaagcaggacgcgtggccatctgttctagtgtaa

SEQ ID NO: 103401 - DNA, 704 bp, Glycine max
  Peptide Sequence Number=SeqID_220179
atgcgatcagagaagaaatcatgttcgccactcctctatgacgaactcatcaaggaaatcttgtctcgtcttcccgtgaaaactttgatccaattcaagtgtgtgtacaagggatggaactccctgatgtcagatccctatttcatcaaattgcaccttaacaaatctgctacgaaggacgatttggaacaccttcaactgatgaaaaatgtctgcctcggatccatccctgaaatccacatggaatccgaaataccagaaggataccgtgtttgtttctggaacaaggagacaagggtgatatccagacaattgccaacgctgtctttttccccgggcattggtcgtagaacaatgcttgggtttggctatgatccgtcaagtgacaaatacaaggttgtagcaattgcattgactatgctttcacttgacgtatctcaaaagaccgagatgaaagtttatagtgcgggtgacagtagttggagaaaccttaaaggttttcctgttctttggactttacctaaagttggtggagtgtatctgagtggaacccttaattgcgttgttattaagggaaaagaaaccattcattcggaaatcgtaattatttctgttgacctggagaaggagacttgcagatcactgtttcttcccgacgatttttgctttgttgatacaaatattggagtttttagagactcgct

SEQ ID NO: 103402 - DNA, 138 bp, Glycine max
  Peptide Sequence Number=SeqID_220180
atgaaaaatgaccgccctccattgtctcacggcactgccacacccacggaaaaaaatcccaaacatgggtacttgaacatgaacaaagaaccggggaacgggactaatttttttgggttctttgacgtccaaacatga

SEQ ID NO: 103403 - DNA, 225 bp, Glycine max
  Peptide Sequence Number=SeqID_220181
atgaagaccgaagaacgaagaagagcgatgaggaacggtggaaaacctttgcgaaatcgcccacggaaacgtctcggatgcgttacggaagcgcctcggcttggattttcttcatggaaacaatttttctcactaattttaagggaaaagagggtggtggttgccgcccagctcgcccagaagcaccgccttctgttggaagattctggaaggccaagtggctga

SEQ ID NO: 103404 - DNA, 267 bp, Glycine max
  Peptide Sequence Number=SeqID_220182
atggaagagaatatgttgacaatcattgaccagtataaagagaagctaaatctaactactagccatgagcagagactagaggatgagcatgcgaaggtatcggctctattcactctcactctaaatgggagtcaagagcttccaaggttgttagccagagcccaggcaatggcggatgtatactcagctcccaaggaagttcatgggctcttcgattattgtcaaaacatggtcgagttgatgtcccacataattaggaatcactaa

SEQ ID NO: 103405 - DNA, 699 bp, Glycine max
  Peptide Sequence Number=SeqID_220183
atgatagaagtgtctgttgaagccattgcatccctcgttcaatattatgaccagccgttaaggtgcttcacgtttggggactttcagttattaccaaccgtagaagaatttgaagggatcttgggacgcccgctaggaggaaggaagccgtatttgttttttgggttatacccctccatggtgaggatagccaaagtgggcaaagtctcaattaaggaaagtccgatcgttgctgtgttggttgatgcctatgacacatttgacagaagatgcgagaagagtggagcaaggattttctattgcacacccgctctttatgtatggctggtctttcacgtttttcgtcatgaaagtaggctcgtttgtcccctacaaggtcaccgcatgtgtgccaagaaagggaaagcaaattgggagcaactcttggctggtatggtagggacatccgttaattggttcccccaatggaaggaaggaggggccagagttttgtcctcatgcgaagggttcccaaacatccccttgatggggatgaggggttgtatcaattataatcccgtacttgccataagacaacttggctgccccatcagaagagcgccatcggaggagagtatcacgcctttcatcgcacgaggctttagtgaccccaatgcaagaatgcttcaaagagtccaaaaagcatggaatgtagtgtag

SEQ ID NO: 103406 - DNA, 261 bp, Glycine max
  Peptide Sequence Number=SeqID_220184
cgcttctttaacgtcttgagctggacgcctaatgatttgtcggtcatggaccaagtgaactctagaggtggtggcggtgcgtctattgcccgctaccggccatcccaatgctactgtggtgtctcgccctgcgcccgtctgggggcgcagcactccgtagaactgacagaggcccgtaatcagagctggaaaccccaggaccctgttggacttctttgggtccaccgggtgtcctgcgggcgcgatccctgcaaacaatag

SEQ ID NO: 103407 - DNA, 164 bp, Glycine max
  Peptide Sequence Number=SeqID_220185
cttgagaggattgatggggacccggtgttgagagaaacgaggatatgggctacgtgggagtacgtgagctcagttggaggtgggcaacaggggatggaagtgttgaagggtgaacttcctgcttttattgtgaccacagagtgtacctggagatatgtcgcggg

SEQ ID NO: 103408 - DNA, 447 bp, Glycine max
  Peptide Sequence Number=SeqID_220186
atgatgacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatttcttagtttcaataggactccttacgagtgttgtttctatctactattatttaaaaataatcaagttattaatgactggacgaaaccaagaaataactcctcacgtgcgaaattatcgaaggccccctttaagatcaaacaattccatcgaattaagtatgattgtatgtgtgatagcatctactataccaggaatatcaatgaaccctattatgaaattgctcaggataccctttttagcttctag

SEQ ID NO: 103409 - DNA, 2292 bp, Glycine max
  Peptide Sequence Number=SeqID_220187
atggttgctttcttccggtattcccctattgatattctttctgtccatctacctccatctgtgttggaatttggccacatccaagaggagtggattataaaggaggcaggagagctttttattaaagtggaaaccttgtatgtggagatatctaacgtgcttgaacggctggaaacaaagattgtgtctcctggtattggaaatgagtcggcggatacatgtgacattcaaaactacatactggatctgaaagatatgcttcaaagagaaagaactgattatcattgtttgctacagtcaggctcagtggccacacaaccagggatgatgacattagacattctggaactaaatcggttgaggcgttctcttcttattggttcacatgtttgggatcaccgactattctcattggactctctcattaaaagaagttttagctccaaggttaaacaagaaaatgaattatgtgcagatgttaaagagttaagagttgactcacttcacaaggagcagaattttgattgtggacttgagcaaaataatactcgcctttcaaaattgcatgaatctcatgagagtcatatgcttgcagagccagatgacacacttgaaccttgtgcttcgggatcatttacatgttatcttgagggagagaaagtacattcagatggtgaacttaacagaacattatccgagtgtttcccatcaaatgagtccaatctttctgagagaatagattctgcatggactggaactgatcaacctcaagctaatgccgtcccagctggaagtattcagcggccgaatcaacatgatagtcctccttttagaagggtgtcacaaccagtgagagttcattcttttgattcagcagtaagagttcaggaaagaatcagaaaaatcttgccctcatctttacatttatcgacacttagatcttttcatgcttctggagattacgggaatatggttagagaccccctctctaacatattgcggtcttactttcaaatgttgccatgggagactcagaaactaaatctgattctgagctccacaccatcattcatttcctctgtgtcaggcatagctgaaggtgctcgattgctactttcccaaacatatcatggtgatagagttattgcggtctatgacaatgattactctagcataatatcctatgcccttagttccaaggaatatgaagattgggtgtctggtaagtcagatatgcaagagagtaggattgctcgtgagagaagcaaagaagatttagctacttctggcttttctgcatggggtagtctggacttggattatatcaattatggtagttatgggtctgaagatgttccatcttctgttggttctcttctcagggactccaaaaaatctttacacttgcaaatttcctttggtgatgattctgtgggagctggaggtaaagtgaatttttctgtcacttgctattttgcacagcagtttgaatcacttagaaaaaaatgctgccccaatgaggttgattttgtgcgatccatgagccgttgccggagatggagtgcacaaggagggaaaagtaatgtatatttcgctaaatcattggacgagaggtttattattaaacaagtgacaaagacagaattggagtcctttgaaaaatttgcacctcagtatttcaaatacctgatggatgccctcaactcaggagggccaacttgtcttgccaaaattcttggtatttatcaggcgccagactggtgtataaatgtcactgtcaaatacccaaaaggtggcaaggaaacaaaaatagatctgatggtaatggagaatctcttttacaagagaaacatatccagggtatatgatctcaagggctcagaaagatccaggtataatccagacacaaccgggacaaacaaagtgatgctagacatgaatttgttagaaacattgagaacaaaacccatatttcttgggagtagggctaagagaagactggaaagagctgtatggaatgacacatcctttttggcgtctgtttatgtgatggactattctttgctggttggggtggacgatgatagcaaagaactggttttggggatcattgatttcatgagacaatacacatgggacaagcatttagagacatgggtgaaggcatcagggatacttgggggtccaaaaaatgctgctcccacaatagtttctcctaagcaatacaagaaaagattcaggaaggccatgactacatactttctcaccttacctgatcaatggtcatcctga

SEQ ID NO: 103410 - DNA, 180 bp, Glycine max
  Peptide Sequence Number=SeqID_220188
atgcttagaatttcaactggttacaattttataggtgtctgtatattagttttcatagaacagaagaatatatatttagtgaatgttcaatctactatgatcgatgaacatactatacaagacagaaattcggatgaagaggaggtgggtctcgagagtgcagatggagattttgattaa

SEQ ID NO: 103411 - DNA, 2699 bp, Glycine max
  Peptide Sequence Number=SeqID_220189
atgtgttgtgagtgcaatagaaatcttggtgaaatgaatcagcagcagaattacaattgcaaaagctgtggccgttggttgtgtgggaaatgcatccggggttgtgacctgtcgaatcgtgaatctgataacactggaattaaggaaaccattcgttcaagcaagttctgttcagatgccaatagtaggaggatgtgttttgagggtcagaagaagtgcagtgagaaagtgcacccttctgtctctccacaagagagtccaagacaaagtcctgagccaccttctccatgctttagtgttgagagtgatagactcggttctcctctcaatgctgaactgaatcagggaactcacttcgatagctgtttccacgatctggattatggatgttatccttgttctgtggtcaacaagcgtgtgaactcatcttgtactcacccttcttcggtatctactcatccacctaccttcaggagtgatgaagaggggatggaggaatctaggaagctccttctcagcccatcgtcacgtacatattgtgatacttattcagatatagattcaagtagcgttagtgctagacatgacacttacaactataattctgtggggtcgagtccttcagatagcccttctaggattggttttacttctagtagggctgggcttcctgaacagaaggggcaggagaaaggccacatccctcagaatgatggtcccttgggtcaacaaagtatggctgttttaagaaagcctgaacaagggactgaggatgcatatactactgcttatttttctgacgacttgtctattttccggaaccagaatgagaattcgcagaggccattggattttgaaaacagtggtcatatttggttccccccaccgcctgatgatgagaacgatgatgcagaaggtaatttctttgcatatgatgacgaggatgatgatattggtgactcaggtgccttgttctcatccagttgcagtctatctaatatgtttcctggaaaggagaaacataatgacgaaaacaaggaacctttaaaatcagtcatccaagggcattttagagctcttgtttcacagcttttacagggagagggaattaaagttggtaaggaaaatgattctgaggactggcttgacatagttgcaacagtagcgtggcaggctgctaactttgtgagaccagataccagcaaaggtggcagtatggatccaggtgattatgtgaaggtcaaatgtgtggcatctggaagcccaagtgagagcacccttgtcaaaggagtagtttgcacaaaaaatattaagcacaagcgcatgacctctcaatacagaaagcctagactactccttttaggtggagctctggaatatcagaaagttccaaatcaattggcttcttttgatacattgttacagcaggaaaatgatcatctgaagatgattatttcgaaaattgaggctcttcgaccaaatgttttgctggtagaaaaaagtgtagcttcatgtgcgcaggaatatttgctggcaaaggaaatctccttggtgttgaatgttaaaaggcctttgctggagcgtatagctcggtgcactggcgctcttgtcactccatcagtggattgtttatctaaagcacgattggggcactgtgagttgttccggttagacagaatgatggaagatcatgagactactcatcagttgaacaaaaagccaaccaaaacattaatgttttttgaaggttgtccacggcggttgggttgcacggtcttgctgaagggcacatgccgtgaagaactaaagaaaattaaacatgttgtgcaatatgcagtttttgcagcctatcacttatctcttgagacttcattccttgccgatgagggtgctaccctacctaaaatgatagtaaaaaactctactgacatgccagagagtgcaactgctgacactgatatttctatgatacctaactccttttctacaaccatgtgccaatcagaggttgacgatgcttctagagtgaaagactttgctggccttgatttaaagcttgaaaatttgggatcagtgccagagcatcttgatgaccttagttgtcattcatatacaggcaccatggcagaatcagattatttacatcagtgcaatgaatcagacggagagactatatttagtacaagagaccttttgcaatcagaattgcaacaagccatggttcaagacgagagggagtgtggtgaagttgctgactcaaaagacaagcctaatgaggatgagctttctggtgaattcttttctgccactgatggtcatcagagcatattggtgtacttttccagtcattgtgtatcaaaaggaactgtatgtgaacgtactaggttgctgcgctttaaattttatggatcttttgataagcctcttgggagatatcttcgtgatgatctgtttgatcaggcatgttgctgccagtcttgtaaagagccagcagaggctcacgtcctatgttttactcaccagcaaggaaatcttacaatcaatgttcggtgccttccctctgtgaagttaccaggggaaagagatggcaagatttggatgtggcaccggtgtctgaggtgtccatttgaggatggagttccaccagcaactcagagagttgttatgtcgaatgctgcttggggattatcttttggaaa

SEQ ID NO: 103412 - DNA, 255 bp, Glycine max
  Peptide Sequence Number=SeqID_220190
atgggggtgcaaataacaattttcaaatttttgaatttggcccttccagaaaaatttcgaatcagggttgcttatggaggaagcaacccagctcgcctgggcgagctgggcgacaacctcctgcccccttttcctataaataggcgaagagaggctgttccaaagatccctaacccccttggctatgcatttcaggttttccgtcgttctacaccgttcttcatccgttctgcgttcgttcttcgctcttcaacg

SEQ ID NO: 103413 - DNA, 531 bp, Glycine max
  Peptide Sequence Number=SeqID_220191
atgtggagtgtcctctcatactccaacttggcccccacatcacacacttctgacttgacagtggatagagctatgctgatctttggcctagtctctcgcatggatatgaacataggagcgttgatctctggccagatgacctctatagcccagtctagcacttctagacttgagttccctgctctgatcaccgcattatgtagagacagaggggttgtctctgatagcctcacttttgagcgtctgagcccgttcattaacttggcctacatcaagaagaactattcgaaccccgaggatctaacagtttctatccgaggggttaggagggcgagggctaggccaactgagctcccttccacttctgcggctcctactctagcatccacgtcagtagctccttctattccagcccagacagattctcagcgctttgaagccatgcttcatagtatccatcagggacaaattattcttttacagagtttacaggtggtggcgtctccaggatctattccctcagtcgagtag

SEQ ID NO: 103414 - DNA, 351 bp, Glycine max
  Peptide Sequence Number=SeqID_220192
atgggcactccaaaaagttcaattgcatttgtcaaagaagttgtgtgccgtaatgtgagagccgccgaacaagtacggtgtggttctaggacgaaccgggcggaagctggtgggcatgtaacacccggacgaatcacaccagaaagagagggatccaaaggctatgtaggccctggtctgcataaagatctggcttggcctgaatccctgtatacaagacctgatctaatcaaatacataaaaggcctgaaagcctatgtgagtcacgtgacagaccgagtccaagacatgtccaccattgaaagaaggaaactatggaagtatgaatgtattcaggctgtaggaatgtag

SEQ ID NO: 103415 - DNA, 741 bp, Glycine max
  Peptide Sequence Number=SeqID_220193
atgaaggcgaggactttgagtcctctgaaggcgaggactttgtgtcctttgaaggcgaggactttgagtcctctaaaggcaaggactttgggtcctttgaaggcgaggactttgggtcctctgaaggcgaggactttgagtgctataaaggtgaggactttgagtcctgtgaaggcgaggacattgaaacctctaaaggtggggactttgagtcctgtgaaggcgaggactttgagtcctctaaaggtgaggactttgagtcctatgaaggtgaggactttgagtccaatgaaggcgaggacattgggtcctttgaaggcgaagactctgagtcctctaaaggcaaggacattgaggcctctaaaggcaaggacattgagccctctgaaggcagggacattgagccctctaaagtgtggaagcaatgacttccaagattattttgatgatgccaaagaatcaagagttaagcaaatcccaaagattcaagaatcaattgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 103416 - DNA, 990 bp, Glycine max
  Peptide Sequence Number=SeqID_220194
atgggtgccaagcacctcacgaggaccaaagaatggtcgcacgtcatcgagcaaaggtccccggacgaaattaggaacaagagagggtacatctcttatggatcagttcaagtggagcatccacttggtttttcaaagagaacaagggagggtacatcccttgtgaatctttggcttgtaaaggtttttacaaggttgaaagaaatctcaagaattggtggttgcttggggactggatgccacttgatccaacataaaggcgaggactttgagtcctgtgaagatgaggactttgagtcctctaaaggcgaggactttaagtcttgtgaaggcgaggactttgagtcctctgaaagcaaggactttgagtcctctgaaggcgaagactttgagccctctaaaggcaaggactttgagacctctgaaggcgaggattttgagccctctgaaggcgaggacattgagccctctgaaggtgaggacattgagccctctaaaggtgaggactctgagtcctgtgaaggagaggactttgagtcctctaaaggagaggactttaagtcctatgaaggcgaggactttaagtcctctgaaagcgaggactttgagtcctctgaaagtaaggactttaagtcctctgaaggcgaggactttgagtcctgtaaaggcaaggagattgagccctttgaaggcaaggacattgagccctctgaaggcaaggacattgagccctctaaaggcgatgactttgagtcttgtgaaggagaggactttgagtcctctaaaggcgaggactttaagtcctatgaaggcgaggactttgagtcttctgaaagcaagtactttgatttctctgaaagtaaggactttgagtcctctaaaggcgaggactttgagccctctgaagacgaggactttgagtcctctaaaggtgaggactatgttctctctaaaggcgaggactttgagtcctatgaaacaagccaaagg

SEQ ID NO: 103417 - DNA, 462 bp, Glycine max
  Peptide Sequence Number=SeqID_220195
atgaatttcccacgtgcttggttcttgaatcttctatgtgtaatctgccaattgttgttggcgtatgtgagtataccacgctatgaaggcccagagttggatcatataatagtccaggaggatgcaaaacaactctataaatcaggggagaaaaggataggaactgatgagaagatgtttataaagatttttagtgagaaaagcagcacacatttggctgcagtcaattctgcttacatagcttcatatggacactcactagaaaaggcaataaagaaggaaacatctggctcttttgggagtgccctcttaaccatactacgttgtgctactgatcctgctatgtactttgccaagattctacgcaagtcaatgaagggtgtgggaactgatgatagtagactaataaggaaaaatttactcattggagctaaactctttatacaagtggtattggcttaa

SEQ ID NO: 103418 - DNA, 183 bp, Glycine max
  Peptide Sequence Number=SeqID_220196
atggcttccccatcatctccccttcattcagcagcaattttatgcatatattttgtgctacccgcttttgcagagcttcagaggttccaacatcaaccaaaacatgatggatccctcaactttctagtcattggagattggggtagaaaagggcattataatcaatcccttgtagccacacag

SEQ ID NO: 103419 - DNA, 816 bp, Glycine max
  Peptide Sequence Number=SeqID_220197
atgggagacaaacttgatttagattttgttgtatcaactggagacaatttctacaatagtgggttaaaaggtgtaaatgatccattatttctgcagtcattttccaacatttacactgctaagagccttaggaagcaatggtactctgttttgggaaaccatgactataggggtaatgcactggcacagttaagtccactcttgaggaagattgacaggagatggttttgccagagatcatttattcttaatgcaggagttgctgaatttttcttcatagacacaaccccgtttatgagaaaatatttcaacaattcgaatcgtcactatgattggcgaggcgtgcttccgaggcaaaaatacctcaaaacccttctgaagattttgcaaaacttttgtgacaaggatcttgaggaagaattgaggaaatcaactgcaagatggaaaatcgctgtgggtcaccatgcaataagaagtattggccatcacggtgatagtccagaacttgtaaagcaccttgtcccagtacttaaggccaacaatgttgacatgtacataaatgggcatgaccattgcctccaacatataagcagcacagatagcccacttctatatttaacgagtggagcaggatcaaaggcatggagaggtgatgttaaagaaacccactttgatgtgaaattcttttatgatggtcaaggtttcatgtctgttcaaatgactgaaaatgacacaaattttgctttctacaatgtctttggtgagaagatacaccattggaaagtgactaagtccacgatgcatccttctatatga

SEQ ID NO: 103420 - DNA, 504 bp, Glycine max
  Peptide Sequence Number=SeqID_220198
atgacaatgaagaagaagaagaagaaggaattgacggacaattgcgaaagaaatgaaatgaaagaaccaacctgggcagagattacaggtgaagctgtcatggttgtcaataacagcaatggggttgttgttggacttgttgttagccaaaatgccctcaacggaattcaaggtggcctttgccacaaacccaatcacccttttggccacagaacccccacctgcaatcaaaatccaaaatttgcaacaaaaggggataattacagtggtgagattgttggagaagtaacagaggtgggaagcaaagtagaccagttcaaggttggagacaaggtggctgtgggatgcttggttgggtcttgcaaatcatgccaaaattgtgtcaacaatgttgagaattattgccaacaaaatattcccacttatggtgccaagtatgtggatggcaccatcacatatggggggttctctgacttcatggttgcagatgaacactttgtttaa

SEQ ID NO: 103421 - DNA, 300 bp, Glycine max
  Peptide Sequence Number=SeqID_220199
atgtcttcaaaggaatggatgatgactgctagcagtccattatcaacaagggcagcttcatcactagataacaacacttcagtgttgcagaagaaactggccaaggctattgctaataaagacaaggctttggaaacttttggccttgctatgaaggttaaaaggatccttagggagcagaagggaaaggtccaaaccaaaaagcctgcccatcaacaaaaggaggaggaaaaaattgttatagaggagcaacggatgaagaagaaacatgaagtgcccagaccctctcttccagtgtag

SEQ ID NO: 103422 - DNA, 1281 bp, Glycine max
  Peptide Sequence Number=SeqID_220200
gtaactggcatcgctgatggtcagacgatggccgcaatcagaggcgcggaagccgatttccgtctgatagttattagcggtcttcagaatataggcttcaacctgcgcataatttttcatgtgcagcaggccgaggatcacatgcagcttattcatgaactcgtgcgagcgctcacgcagggcatcaacatagtttaccatgcccgtcagacgctgcatcagctggctgatttcggtcttgtccctgaaggtgcagactgcgccgataatacgtccctggctgcgcaccggcacggtgttgctcagcagcagacgaccattgacgttgagctcctcatcgcgccgcgcacgaccgctgtgcagcacttcctgcagatgctggtcgatcaccgaggcatcataaatgcgcgcggtactcactacgctgctgcccattttatcgctcagcagctggcgcgccgtctgattgaccagcgtcacctcgccctgatcgtccatcgccaccacgccttccttgacggagttaaggatcgcctggcgctgctcaaacagggtggaaatttcgtatggctcgaggccgaacaggatacgcttcagcacgcgcaccagaatgaaggtgccaaccgcgccggcaaaagtgccgatcagaatggtccacagaatgctccagcgactctggttgatctggtcggtgaccgcctccagcgagatgccgatagccaccacgccaatctgccgctgctgggcgtcgtacaccggggtaaacacgcgcagcgatttggccagcgagccctgattcacggagacattctcgttgccgcgcagcgccggttcgatgtccgggccgataaagtgtttgcccaccagctccggattgcgcagatggttgctctcttccaccgctttggcgatgggctggatagcggcccgcgtgcgcgccactgccatggctttatcctccagctggctgcgcgtcgcggcgccaatctggaagaaataaaacatgtgtacgctcagcagcaccagcacaatcaccgcgctgagcatcagcatcaccagggtgttgagcttcatcggtcgcctgcgcactggcgtggcttgctgtggaaggccgtcagcgatgacgaccttccgtgggggagtgcgggcgggttaaccctgtttcacccggttagcgaagcttttacgcagtttctgcagcttcggcgggatcaccgccaggcagtaaccgttgcgctggccggcaccgtcccagtaatcctgatgataatcttctgccgg

SEQ ID NO: 103423 - DNA, 204 bp, Glycine max
  Peptide Sequence Number=SeqID_220201
gttatgcgggatgctaccatgtttggggtgtttaatgagaacttccccttgtacataaagcatgaagatctgtcaaaaatagtacacggtggtcaatgtctccgcatctttgttatacagttgtggatttcgcatatgactgagacaagtatgcgagcggggaatgtcgatatgtatggattcctcgagccacagtccatctag

SEQ ID NO: 103424 - DNA, 1130 bp, Glycine max
  Peptide Sequence Number=SeqID_220202
caccatggacaatttagaaccaacaggagcgtttgcctgtgcggctgccggcgtcagccggcctgtgctacactgcgcgccgcaagaagagggtgataaagctatgcgagttctgggtattgaaacgtcctgcgatgaaaccggcatcgcgatttatgacgatgcgtccggtctgctggcgaatcaattatatagccaggccgcgctgaaacaggcgagcttacaggccggagagattgacgccgtggcgtacaccgccggtcccggcttggtcggtgcgctgctggttggcgccaccattggccgcgcgctggcgttcgcctggaacgtgccggcggtgccggtgcatcacatggaaggccatctgctggcgccgatgctggaagacaacccaccggcattcccgttcgtggcactgctggtctccggcggccacacgcagctgatcagcgtcaccggtattggtgaatatacgctgctgggcgaatcgattgatgatgccgccggggaagcgttcgataaaaccgccaagctgctggggctggattatccgggcggcccgatgctgtcgcgcatggcacagcagggcacgccggatcgctttaaattcccgcgtccgatgaccgatcgtccggggctggacttcagcttctccggcctgaaaaccttcgcagcgaataccattcgcgaacacgacggtgacgaacaggcgcgtgccgatatcgcccgcgcctttgaagatgcggtagtggacacgctgatgatcaaatgcaagcgtgcgctggagcagaccggctttaaacgcctggtgattgccggcggcgtgagcgccaaccgcacgctgcgtgaacgcatggcaaccatgatgagcgcgcgcggcggcgaggtgttttatgcccgtccggagttctgcaccgacaacggcgcgatgattgcctatgccggcatggtgcggctgaaaggcggcacgcgcgccgctgagcagtaccgtcagcagccaggtgccggtcatcaggccggtcaggtcccagccaatcggcgcgatggcgccaaacgcggtggccacacctttgccgccgcgaaagcggaaaaacaccggatagatatggccgaggcaggcggcgatggcc

SEQ ID NO: 103425 - DNA, 189 bp, Glycine max
  Peptide Sequence Number=SeqID_220203
atgaagattctgtacatgtgcagtgcgaggtgtcgtgcgagatgccatgtgaggtgctgtgcgaggtgtcgtgcgaggtgcgctgctaggtgccatgcaaggtatcgtacggtgcaaggtgcggtgctaggtgccatacgaggtgttgtgccatgcgaaaacacacctgagcgttttacgtgcaagtga

SEQ ID NO: 103426 - DNA, 1273 bp, Glycine max
  Peptide Sequence Number=SeqID_220204
gagtgttagaaatgctaacatccttgatgggctagctgtttattcatcagaaatgccaaacttttctacctcttcgtcgaatcctaatttgtctgatgcaaggaacgcgttggagtatcaccaagaacaaggtgcagcagctgaaccgagtaataggctgatgatgaatcaatatggttcatttccccattccatgtctgcaattcattcttcccataaagaacactgtgagcttcgtaatttgggaaattggaggaacagtgccccccatcaggggtctgattggtttgtgaattatgcaagcaatgccaattcttttttgtctgctgacctcaacaacaacgtgtctgcttacaacgaacttatggatgtacactgtagcaatgcatctggtgaaatcagtggtagagaaattcagaagcaattaggtgtactgcataataatcctcctccttctccgctttatcagaatgctttgcaagatattgtgaagtctgcttctttcagttctcacactaggcaagacatgtcttcactgatgcaacaaaatgaccacagtatttgggtggggaatgctggtgaagctgagcctcaacaaccaagttatgaaaaccagccaaatcagttgcattttgggtggacaaatcgaacaattgctaataccctgagtgattcaactcctcagagcttatccttgtcactttcatcaaatgcacaacccaaaccttctgtttctcaccttgaacaagggtctgcatcagatgatcctcaatgtttgacgaatatgaaatctattgtaaaaccatctattgtttctagagatattgggaaatcagttcaagaaacggtgggaatgccttcaaagagtactattacttatcgaagtgtgggtccccttggccctttcactgggtatgctactatccttaagagttcaaggttcttaaagtctgcccaacaattgttagatgaaatttgctgtctatctggtgcaaaatttgcgaaatcatatgatgtttccaagagggtttctccagaagttagtgcctctacttctgctgatactgttactggggttgctgcaaaaggtagtaactcaggttcttcatcatctattttgtatagtgtttcaaaggaaaatagggctgatccaggagttagaagtagctttggtctttcctcgaggccagattatcaacataagaaagcaaagctactgtacatgcaagaggagcttctagctttctggacttacttgctatggtacctatga

SEQ ID NO: 103427 - DNA, 924 bp, Glycine max
  Peptide Sequence Number=SeqID_220205
atggttgtttcatcgttcgagtcagtggcgggtcttggttctgctactccttacatccccatggctctcaaatcagtatcaaaacacttcaggtgctttaaaaattctatctcagaacagctcaagcttataagtgaggccttgggagaggatttgtccaaaccctccaacaccagtacttgtagtaataaagctgacactactactactaaggcaaggataagatgcagcatcgaccaaagctttctgaagaacaaatctgtaaagggtaccacggaacttcttgaacagcatgtgtggaggccccagagagggttgccagagcgtgcagtggcaattcttaaagcctgttaccctacagacactgataaacacatgctggctagtcaaacaggtctttcacgaaaccaggtatcaaattggttcataaatgctcgagtccgagtgtggaagccaatggttgaggaaatacacacgcttgaaacaaaagcaacaagctccaagggcaattgtggtaaaaacgagggaacttcttctggcactgaaggtgataccagcaaccctagagctttgagcaatattggtatgaattcaatacctgaaaaccaatttcagggtatggatatgggatcatccattattgctgcaaatgctgaggaaagtgggttaaattcagaacaatggagtcaagagaagaggtctaagttggaatgccaaatgactacttcaaacatggatggaacactgatgggttttgtgccataccgacgcggcggtggcatagaggttggtgggctagggtctgtgtcactaacattgggtcttaggcatggtgttgaaggtgtacagcaccaacaacaattgcaagaggagcaacttagacatcaccttggagggcacatgatccatgactttgtgggctga

SEQ ID NO: 103428 - DNA, 787 bp, Glycine max
  Peptide Sequence Number=SeqID_220206
atggagtattatcaatattttcgtagttggatgtatgatagaacgtttccgggaagaacaggactaaaaccgcattttgtgcaaggagttgaaggatttatttcatgggcatgggcacaagaaatttgtacaacagagggaggaattagatgtccgtgtctgaaatgtaagtgcagatatataattgccgaccctggacatgtgaaccaacacttaaagagagttggttttatgcctgattattggatttggatttataacggcgaaaagtttcaaaattttggggtagaggtcaatgcacaagcttctactagccatggtggaacaaatgtggaatataacgaagaagaaggcaacagagaacaattcaacatgatggatgatatggttgcagatgctttaggggttgaattgtcttacggtgatgatgttgaagatgatcaagaggaacaactcccgaatgagaaggcgcaaagattttaccaattgttgagtgaatgtaatacaccattgtatgaagggtcttcgcactctaagctatctatgtgtgtgtggcttttagctcataagtcgaattatggtagtcctgatgctggtgtggatgatgttacgaagatgttgaaggccgcgactctgtttaaagataatctgccagctagttattatgatgcccagaggttggtgatgaagttgggattagcagttaaaaagattgattgttgcagaaatggatgcatgctgttttatgacaatgagtttgggattaatgatggagcattggaggaat

SEQ ID NO: 103429 - DNA, 249 bp, Glycine max
  Peptide Sequence Number=SeqID_220207
atgcatcaaatcattgttggggcacctccgatcatggaaaaatcctcccctaaaacacaaatacacaaaaagcataataagtttgacaaaaaggctagagaactcaaattccaaaagggggcacttttttacgtgaaaagcgtgccatgcaggacccaaatcgccattgccaatggcgagtttggtgtcagtgagcaactcgcttatggcactggtgatacgtgcatgcagaccctaaatcgccattag

SEQ ID NO: 103430 - DNA, 258 bp, Glycine max
  Peptide Sequence Number=SeqID_220208
atggattattcaacggatgactcctcaaccattaaagaaattgaggaagttaaggaagcctttaatgaaatgcatcaagaagcgcaaaagcttactattttgaacaataagcttagaagcaatctaaaatgggatctcactaaattggcttcaacacaaagtgagcttgataaattaaagcaagaaaatgaaaaacttttttcaagttataaagccaccagttgtgtttatgctagatctcttaatatggatgattaa

SEQ ID NO: 103431 - DNA, 708 bp, Glycine max
  Peptide Sequence Number=SeqID_220209
gttggtgttgaggaggttaaagatgtagatgctcccattcctgtacccactaaagaggttaaggtcatagggcagacacttaacaccttccttacttggtcgacacatcttgtcaagtgtatatcaaaactggatgctaccttgtttggcctatttaatgaagactcccccttgtacataaagcatgaagatctatctgaaatagcacaaggtggtcaatgtctcagcatctctgttataaagttgtggattctgcatatgactgagacaagtatgcgagcggggaatgccaatgtgtatggattcctcgagccacagccagacaactacctcaaaggcataattaacagtgctttgaaaggacttgatgatactcaacaaagtaaatccaagcctgctgctaggtggattgttgttaaatatttcactgatgctagaccattggaaccagagagattgaaggcgcttcgcatccagtgggcaaagtactatttgaaaggacttgggtattatggtgtgcctatgagacctagatacgagatacaacatgaaatggatctaggaataggggttctattccatgtaagagatggccatgagaggccaatgactggtgaagatgttgttgatgttgttgttgctactgttgaaattgcgattggggcagtagtgcttgctaaaaaggttgtgactggaggaactgttgtt

SEQ ID NO: 103432 - DNA, 405 bp, Glycine max
  Peptide Sequence Number=SeqID_220210
atgttccctaagcgttttcgggaccccaaaacaggttttcatctgctgagttcaatgcatgctaagaaatacctgaagaatattgggttggaaagcgaagactaccactttttcaaacgtgttgggaagggcttactttgcacctatgcagtacttggggctctgtggctctacaataacaattcatcactggggtgggagaaactgaagccacggctgaaggagcacgaagaagcattgaaggggttcatcgccgagggagggatgattggaacatctactagtccaaaagggatggctgagagtgataaggagaattttgatgaggaagctcagaagctgtggttgaggatgaagaatgaggtcaaaactgaacttagggagaagggttttgatgttgaataa

SEQ ID NO: 103433 - DNA, 1341 bp, Glycine max
  Peptide Sequence Number=SeqID_220211
atgacttccaaaacgcaccgtttcactacctgtcaccgtcacccttccacacccgtcaccggtttctgtgcctcctgtctccgtgaacgcctcgccggcatcgattcctcctccgccgaatcgccggagctccgccgcaccaagtccttctctgggcgcaccaccgacgctccctcctcctccgccgccccggagccccgccgcaggtcctgcgaggtccgactgccgccgttgggaggctcgctgtcggacctcttcaacgttgacgacaagaagaagaagcctccgaatcggaatgctgagatctgttccagcaccaccggcggcggaatcggagagaaagagcgcggcgacccggttagggtttccggcgatgatgacggagagggtaagacgatgaaggagttcatagatcttgaattgcggagcaaaaagaacacagggagagatttcagagacatcgcggcaagttttcgcgaggctgcttccgtattcagcaaaaggttgatgaaatggcgacggaagcagaatgcgaagagaaaccgctacaacgacggcttaggcgccggcgccggcgttggtccggtcgaaaagctagggctaaggacattgcatgaggcccaatctgaggtcggagaatacggcatcgcgttaggtagaagatcgtgcgacactgatccgaggttatccgtggacgattcgcggttttcgttcgaagctcctcgagcttcatgggacggttatttgataggcaaagcgtaccctggggtttcccgaatggttcgtgttggtgatagggttttgcttgaagaagaagaagaagaagagggagaagagagtttggagaatggtgaagagtgttgtcctggtggttcagctcagactaaacattactactcgaattggcataggaggaggaggagtttcgataggtcgaattcgcgtaggaagtcgtcaatgggggaagttgatgaattgagagcgatatctaatgctaaggtttcccctgcgaccactgagttgttctatggtgcaaaggtgttgatcactgagaatgatttgagggatgcgaatttgaaaccaattaatagtgttcaatctgataatgtaatgggttctgcttccaaggatgatgcttgtgatgttgcaattggggatgatcaaaagggattgaacaggtttcacaaatggggtaggttgtggagtaagttggggttaatgcagaagagaagggaagataggttggaagaaggagagtatgctggtggtggtggtggtgatgtggttgataagccaattgcagagtcttggcagaagctgaggagggtagttaatggacaa

SEQ ID NO: 103434 - DNA, 264 bp, Glycine max
  Peptide Sequence Number=SeqID_220212
atggcacgaacaaaaaatgttggtggtgatctcgatgaccatgtcaaacttattgcatctaatcgcaggaggcctagggagacttacatcttccatttgcatgaaggagagataataggtgatgtcttatcgttactgcatattccattaatggaactttttagaattatgagcatatggataaggatgcggcaattgccatgcttatggagggagaaacagttacctttggaggcatgggcaaaggaaatgttactagtatag

SEQ ID NO: 103435 - DNA, 585 bp, Glycine max
  Peptide Sequence Number=SeqID_220213
atgctatgggacatgcttcattcgactgataagcattgggtcagagttttggaagacaagtaccataatggcaagtttatactctcaatcacactaaaaccaggatcatcgtacatctggaggagtcttttagaggctcgggacagtctgctaaagggatttaaaccacgcttgagagagccacaatcttctttttggtactcaaattggaagggtaaaggccagttgtgcaatcagggggactcatttacattaacttctgccccgagaatgggtccagcatattttgagtattccagttccccaaaatccgatgggaaaggatactatttgttgggagtgtcatgcaacaacatcaagactggtatggatgcccacacttgggttgctcaaatcttgaagcataaggatgtgaccttaatgatcacggtgtgctggtgggcttggagatggagatcaaaattcatttttgagtcccaacactggcatatttcccacatatgtagtatgatcaggtctcatgtagttgatcccttgcaactaagaatgtgtttcgctgaaaatatcccatgcagtcacaagtga

SEQ ID NO: 103436 - DNA, 522 bp, Glycine max
  Peptide Sequence Number=SeqID_220214
atggctcaattgttccttgacatgttttgcaaacaccattgtttacctcacaatttggtgtttgaccatgatcctatttttgttaccacctccttccattcctcactacttgatgggttcttcttccgtagaagcggtagatcaactcctcttagatcatcaataaatgattacaagcctcaaactttaacctctagccatcctacaatccaagtgggattcttccacactttgcctcctcactgtttggttttagttcagtggatggggttgtctccagaggattcgagctgggagaagtgggataatattgctacaacttttcaccttgaggacaaggtgaatttatcaaggagtggtattgatagtgaatctcataactttgaggagcgcccactagtttggacaccaacaatgaagagcctaagaggaacatgtccagaccaattcattacagggattgacttagtgttaattctctttttctgttacagtgttgagaatgttgcaagtgccttttga

SEQ ID NO: 103437 - DNA, 210 bp, Glycine max
  Peptide Sequence Number=SeqID_220215
atgaaagcaaggtgtagaaaatgcagggaaggaggagatgctgaagagagtggggtggtaactgccaaagcgagcagctgtgctaagcccaattcgaaagaattgaaatctagagaagtttttaggcttagcgcagagcacgcacttagcgagaccactacagccaatgatcaggggttaaggcgcttagcgcaatcacagctcgcttag

SEQ ID NO: 103438 - DNA, 797 bp, Glycine max
  Peptide Sequence Number=SeqID_220216
atggctccccgtaaaagaaaaaccacagcttcattgtcccaggccaataacatcctcggccggaacattctttcggagaggaatgtgaagctatacattactgattttgatgactttagaagagaagtcgagaggaggaacatgcacacggagctaactaatttttctgaaggaagcataaatgtggaaactgttaaagaattctatgcaaacctatatgtccttgaggacaaagaaccaaagcaaagcttaccttcttactctaggttctgcaggttgaggccagaccctcaagagctggcagcccggctgtgtatccctagaaggggatttgttcttaacgccaagggcttgtcgtggaagctcttgaggaaggatcttataactctggcacagacctggagtgttttatcttattctaacctagccccaacttcacatacctctgatcttaatcttgacagggctagtccaactcctcaaggcttggatttccagccctcatcactgccttgtgcaaggcccgaggagtcacctcagattctctcacttatgaggacccaaaaatccagggctagaagatctgaggcctcatctccttcagctacccctactccccctacttctgctctcccttcagctccagcagccccagttcttccagagcctgcaccagggccagctcctgattatgcagagcttgcaagatgtggtccaacagtgaccagttatgagcgtggaggagtttttgcagaaggttgcctggccaggagtccagccttctcctttgggagggg

SEQ ID NO: 103439 - DNA, 144 bp, Glycine max
  Peptide Sequence Number=SeqID_220217
atgtctctattcaacagagattcccaacaaaggattttagccctccattacaagggagcagctttcacagataggagaagggtttcagagaaaatagcagattacaaagcaatggggattcctcctccacctctaaaaacctag

SEQ ID NO: 103440 - DNA, 570 bp, Glycine max
  Peptide Sequence Number=SeqID_220218
atgttgacatctccagaaagggcgcagacgaccacattggtctccgcttgtcaatcaaacttggggtctccaaatgacgaggatggggtggtcgacaaaagcggggcttctgctcctacgtatcctcaatttgagatgaggaactcagacctacgtagttcttgcttttgtgagacaaatagtctcggcctgaagatgctgacatctccggaaagggtgcagatgaccacattggtctctgtttgtcaatcggacttggggtctccgaatgaggagatgcggataaccataagggcatctccacgtgccaccgatctcacaggtcatgatagcaaaagtttcggcctgaagatgctgacatctccgaaaagggtgcagatgatcacattggtctctgcttgtcaatcggacttggggtctccgaatgacgaggtgtggataaccgtaagggcgtctccgcgtgccactggactcacaggtcatgatagcaaaatgtggggtggtcgacaaaagcggggcttttgctcttacgtatcctcaatttgtgatgaggaactcaaacctatgtag

SEQ ID NO: 103441 - DNA, 300 bp, Glycine max
  Peptide Sequence Number=SeqID_220219
atgccgatctttgacacaaatggggttgtaaccatgatgggtatgatgaaagttagcatctttgtgtttttaaccctgatgatcacaatgggttgttatggtgtcacaaacccgaataatctcagaattctgaatgatttcagaaaagggttgaagaatccaaagcttctcaaatggccagacaatggaaatgacccttgtggccctccttcatggtcttatgtgtactgttctggagggagagtcactcagattcagaccaagaatctaggtcttgaaggatcattgcctccaaaatag

SEQ ID NO: 103442 - DNA, 771 bp, Glycine max
  Peptide Sequence Number=SeqID_220220
atgatggatgaggagtctgagtatgaaatagaagctttgcaaaaagctaattgccttcttgttgagaaggagaaagagatagaagagttggaagctaagcttgagttatataggaagaagttccctgatgaatcaatgctggaaaacatggtggatacaaactttgaaatgaaggatgaaagtgtccttggaaagtcagtttctgaaaatactaatatatctgacaaatatgaagttctacccacatctctggaaaaacagaatgttcaatctgtaaaaaattcaccattggagtttcaagatgaaaggttatatatttcccaacgtttgaagaagttggagaagcaagtttactttttcctgaatattcatcaatctcgggataattggctaaattctgaaaaagatgaaaaggaatctctggaaaattgtgagaagttggataataatattctaatgcaagaaactatttgttctcctaaattaaattcagatgacatgggtgatgattcctcatccaaggaacctccagtttgcaagcaaaatggtgaacttggatacaatggacataactcccctgcgctctgtaggaataatgatttatcttctactggtagtttggtttcagattttattggaaggttgcaagttcttgaggcagatttgagtttccttaagcatagtatcaacttatcgagcaatggagaagaaggacttaaattattgcaggaaatagatgatcaactacaacaaaacgccagattgggataa

SEQ ID NO: 103443 - DNA, 234 bp, Glycine max
  Peptide Sequence Number=SeqID_220221
atgtgggtgtcgaggaagcggtttccgacagatttcaggcgggaggagaaagagaagagcgatttcaggcaggaggatgacaaagagaagagagagggcaagcaaactaaaaaaaaccgcatgactaaccttagcctcaaatttggtatggatgaaggattttcttgcgaagggactaaagtgagaaactcatgttgccaacatggattggttcctggaatgaaacccaaatga

SEQ ID NO: 103444 - DNA, 825 bp, Glycine max
  Peptide Sequence Number=SeqID_220222
atgaggcattgggtttggcttagggtcaacactaaagaagttagtatcattttcatagttctaaaccgtattgtggcagcaggggcatgttggtacttgctagggatacaaagggcagccaagtgtctcaaagtgcagtgtgagaaaacaagtggttgtggcatgaaaatcttgtcttgtcaaacacccatatattacggaagcaacagttttctagttagggatagggcaaggttggcttgggcagagaacagggaagtgagacacacatgcctaaatggtcctgacaactacaactatggagcttatagatggtctgttcagcttgtcacaaacgataatcgattggagaagatacttttccctatcttctggggcctaatgactctcagcacttttggaaacctagagagtacaaccgaatggctggaagtagttttcaacatcattgtgctgaccagtggccttcttcttgtcactatgttgattggaaacatcaaggtatttttgcatgcaacaacgtcaaaaaagcaagcaatgcaattgaagatgaggaatattgaatggtggatgaggaaacgacgcttgccgctagggtttaggcagcgcgtgcgtaactatgagaggcaacgttgggctgccatgcgtggggttgatgaatttgagatgactaaaaatcttcctgagggattaagaagagacattaaataccatctttgtctagacttggtgagacaggtgcctctatttcaacacatggacgatctggttctagagaacatctgtgaccgtgtgaagtctctgatattcacaaagggagaaaca

SEQ ID NO: 103445 - DNA, 263 bp, Glycine max
  Peptide Sequence Number=SeqID_220223
ggagtggaaggtggaagagaaacatctgggttaattgtgaagacgaagacacctctgataaaatattacacacagcaggcaaatgtggctaaccggaaagactctgcaatgaggaaacaaaacattcacagggatgagttcctgcgttgcaagagatgcgggaaggagcgcaggttccatctcaagagcacaccagacattaagaactaccatgatgctttaaacaacaaatgctggacttgttctctttggccttatcaaaa

SEQ ID NO: 103446 - DNA, 219 bp, Glycine max
  Peptide Sequence Number=SeqID_220224
atgcacaaaacacaatgtggaccactacgggtacatagaatgaatcgaaaagcttggttcgagcaaaataggggaggtggttgccgcccagctcgcccaggcgagctcaactcgcccaggcgagcagggttgcttcctccagaagcaaccgccttctggaggaatattccggagggcccaagtgggcctgggtgctatttgcacccccatttttactaa

SEQ ID NO: 103447 - DNA, 139 bp, Glycine max
  Peptide Sequence Number=SeqID_220225
tgacaaaggtagcgaggtggaagtggtgacaatgatgatggtgacgatagtgatggtgctggtgacgacgatggtggggtggaatactggcggtggtggtgaaatggtgatagtgacggtagtagcagtagaatggtga

SEQ ID NO: 103448 - DNA, 258 bp, Glycine max
  Peptide Sequence Number=SeqID_220226
atgattggggggattcgcttggagaaagggtcttttgcagctcagcaacataaacaacacgatcaagaagaaagcaatttgttgaaaaaaactaataatggtgctaacaaggaagctattgtctgcaaagatgaacaatattgcacgggtacactgaagaaaagagcctctagagtatccagaaaaccaaagaaccagttaccccacattcatgaagattatagtggaccaagacatcatagacctaggcaccattag

SEQ ID NO: 103449 - DNA, 279 bp, Glycine max
  Peptide Sequence Number=SeqID_220227
atgcaaatcaaaagtgtgttgaacacagtgatgttgaggatgcacgacaacacagatggaggtgcaagggttgtgtatttgtgttgtggcggcatagtggtggctaggtcatgggggttgcatgcgcatggatttggagttagaagcggcacgcgaagttgtttagactatggtggtggtgttgttgctattgggacaattttggtggtgcgcggatctagtcgaagtgagaagaaggtttgggggcacaagaaaggtgaagaggaagagggagggtga

SEQ ID NO: 103450 - DNA, 264 bp, Glycine max
  Peptide Sequence Number=SeqID_220228
atgagaagtgccaagaaggctgaaccccttttcttcttcactcctccccctatttatagcaaaataggggaggagcttgcccacccagcttgcccaggcgagcatggttgcttcctccagaagcaacagacttctggaggaagaatctggaaggcccaactttcgaagaagttatggaaactcacggattgtgcagaaacgcatcttttcgatttccgccacatcacagaattttacggatcgcgcaagcctgcttccttttga

SEQ ID NO: 103451 - DNA, 327 bp, Glycine max
  Peptide Sequence Number=SeqID_220229
atgtctcctccacctctagaaacctcacaatcactcaagatctcatccaaagctccacaagatggcttcctcgtcaagctcagctatctctcagtctctccacagccaaaaccaaaagctaactctctaaaaagctcacctcccttccaatttcaagatttcagctttaactcatccatcttccagattcttctctacgctcagccaacagtggtcgcgcttagcggattgctcgctcagcagaggatttggcttagcgagttgacaatttctacacttcaccaatctttcctatttcacctgaaattgagatggaaggatcattaa

SEQ ID NO: 103452 - DNA, 279 bp, Glycine max
  Peptide Sequence Number=SeqID_220230
atgacgaacgatcatattggtatgatgttagttatgtcgtgggtggcagtgatgattgtcatgggctgggtgcaaagtgcttgtcatgggctaggtacagaggttggcggatggcttttgagtgtagaacagttaaagaaagaaaagaaaagggtgactattaatcaatgtgacaaaattgatggtaaaggatgtccattctcttctactaagaaacttgaaggcatttccaacatcatcttaactatcattataacttcccaacctaccatcacctag

SEQ ID NO: 103453 - DNA, 241 bp, Glycine max
  Peptide Sequence Number=SeqID_220231
atggctcaacctccacctcgtgacaggactcttagggagatggctgcacctaatttcacttatgaaagcttgtgcattcaatatcctgatgagggtgaagatcctcataagaatcttaaggagttccatattgtttgttacaccatgaagcccccggatgtccaagacgatcatatctttctaaaggcttttcctcattctctggagtggcaaaagaatggctatactaccttgctcccag

SEQ ID NO: 103454 - DNA, 195 bp, Glycine max
  Peptide Sequence Number=SeqID_220232
atggaagtccacccgtaccttaaattcgaagccccacaatgtagaggtgtgcttcacgacttcgaaaatggcttctccttgcaatttggagtagaaatggagaagaattttggagcttcaatggaggcttcaatggtggagaagaagaaagaagaaaagcaacatggaagggaggaaaagcttatgaatttctga

SEQ ID NO: 103455 - DNA, 246 bp, Glycine max
  Peptide Sequence Number=SeqID_220233
atgaatttgattgtggctttgttgaattgtctacattcttacattgtgtgctttgaatttttggtattggaatggggaaatgaattaatttctgagaatgataatgctaaatttggtttcaaggcactaggggtagcaattggagaaagagtaatgtgcgtattgttgatagccatccgagggtgcaaagtgaatcttcaagggctagaaggaaatagtgccatgagtggatctgatcgttcctag

SEQ ID NO: 103456 - DNA, 387 bp, Glycine max
  Peptide Sequence Number=SeqID_220234
atggcgatgataaatttgagagtgagcaacatattgctgttgatgcttactagaagaaacttgaaccaattgaggggcatagttgtggcagattcagctgcattagccagctgcactgacaagttgtatggtgatggagatgttgggtatggagttgttgctgacatacaggatagtatgaggcggggattggcacagaccctgaaagggtatggtgaattaaatgtgtgttgtggatatactgctgtggttgatgctgctgctgcggcggctgagtctgatgctgctgcggcagtggcagttgatcaaattgtggctgcaaaacatatccagcttcctgcacatgctgctgcatctgaatccaaccttgttgatcagtcacattaa

SEQ ID NO: 103457 - DNA, 237 bp, Glycine max
  Peptide Sequence Number=SeqID_220235
atggtgcttggatgtacgataggtattggagggatcaaatgcccatgccttaaatgcaattgttgtgccattctaagggatcagatggtgaaggttcacctttacaaagttggcttcaaacctaattattggatttggattgatgacggtgaagagacgtcacatgttgatttacttgttgaagataattgtatgggagttttaagcagtggagcagatgtgactcaagtggaataa

SEQ ID NO: 103458 - DNA, 146 bp, Glycine max
  Peptide Sequence Number=SeqID_220236
caaatacaaatggtaatgatgttgatgttgcacctgaattttctcctttgaaaactgttcattttggaaatccttctcaagacactgttgacccaagagatggaggctttggaggaagactatcgagatggaaatgggaaaaatga

SEQ ID NO: 103459 - DNA, 263 bp, Glycine max
  Peptide Sequence Number=SeqID_220237
gatgtttctactctacagcagttggaggattaagatgctatgagaatccaaagaataagattactgcagtacctgccgaggaagagcaaatttggggtgcattcttcaagaacagagaatcagtgatcagtctcaacagtaatataaggttaatgtcagttgagactgcattaggtacaaagggaaaatgtgaggtaatcttagagcttaagaagttagagttgaatatcccttacgtaactaggattgccagttgcaactaa

SEQ ID NO: 103460 - DNA, 402 bp, Glycine max
  Peptide Sequence Number=SeqID_220238
gttgctgtttgcttacgtcgcgcgtgctcacagatggatttgactccaggacttaaatgtttcgctacggctgatattaaagaaatcgcgaccaatactggcaatggcttcgccattactgatgagctgaatgaccttcttttctcgctcggggtcgatctggcgggaatgcgtaacattggcaaaatagctatcgctggtgaagaaaacatgctttttgcgaaagcaactttctggcagcgcgcgcagaataaggctgatgccgctcagaagatagtggttgtcaatccacaggtcatagcgttcggaacaaatgtgcgtgtgtttactgaacattttggtctccacgaagcggatggacgaattaatgacgaataccacagcgcagaatatccagcgcct

SEQ ID NO: 103461 - DNA, 269 bp, Glycine max
  Peptide Sequence Number=SeqID_220239
atggaagacgagtgcaaaaatgtgctggagttaggtacacagcaggatcatgcaattgaagcagacatctttgcttgccctgtatgttatgaaccattgataagaaaaggtccttctggccttaacttacctgcaatctacaggtctggtttcatgtgtaagagatgtaagaagacatattctagcaaagataggtatctggatctgactgtaactgctggattgagagactacactgaaattcaacctgctcggactgagcttttcag

SEQ ID NO: 103462 - DNA, 579 bp, Glycine max
  Peptide Sequence Number=SeqID_220240
atgaagcaacaaaagctcatattcttgctaaactccaaggctaagaatgcgatgttgtgtgctcttttagaagaggagtacacaaaggtaacagtgctgagagcattaaagaatcttgagtctatgtctcttgagaaacttgttggtaccctcaaggttcatgaacaagagctccagcaaggcaaagcgcttaaagtaagtgattcatctaataatgaatatgaaaaagactcagatgaggatgagctcgccttcatctctcgcaaaatttgcaagatgtggagaaacaaaaataggtctaagtggacaaactcttcaagaaggatgccctgggacaagaaggacaaagacaaaagctccatagtctgttatgagtacaaaaagcctcgacacttcaagtcgaaatgcccatatttggtgaaaagtcaaaacaagaagaaattctttaagactaaagcaaagaaggagattatgaacacgtgggaagatttggattacacctcgtctaatgaagacgatgaagacgcaaacatatgcctgatggcatacacaacttctgaaggatccaaatcagactag

SEQ ID NO: 103463 - DNA, 306 bp, Glycine max
  Peptide Sequence Number=SeqID_220241
atggacaaacgtggttggtgtgttataatcaaaacaaagccaaggggtgtcatagaatctgatgatgtggaagaagatgagcttgttaggaatatcacccacaactatagagaggatgctctgtttcaacctagcgtccaaaatgctatattcaaaaaagacaacatagaagagactagaagacctccgaggaatatgccctggaaggttgctttcacaaaggtcaaaaagcacatgacgttgtctatacttcctataaatcctcgcccttcagagcttgacacattgaacaattcctctatgtga

SEQ ID NO: 103464 - DNA, 1233 bp, Glycine max
  Peptide Sequence Number=SeqID_220242
atggaaagaagggttgcaattattggggcaggaacaagtggcctggttgcctgcaaataccttatagagtttggatttaatccaattgtctttgaagttgatgatggtgttggaggactatggagacataccatagagtccaccaagctccaaaatactaaacaaacgtaccagtttatagattttccatggccttcttcagttaaagaagataatccaagtcacaaccaagtgctagattatcttaaatcctatgctgaacatttttccctcatttcttacattagattcaactccaaagtaatcaatatagattatgttggagagtctagtgaagaaatgaaatcatgggaattgtggggttgtaatggcaggcccttttgctccaagggaacctggcatattgttgtgcaagataccaagaatttatccatagaggtgcacaaggctgactttgtcattctttgcattgggaaatatagtggttttccaaacattcctgaattcccaccaggaaaaggcccagaagtttttaatggcagggtcatgcactccatggactactcaaatttggacaatgagactgctgctgaattcatcaaaagaaaaaagattacaataataggctcacagaaatctggtcttgatctagcagctgaatgtgcaaatgtaaatggagtcatgtatccttgcacaattattcaaaggaccgcacactggattcttccagattttgacctttggggtgttattgttggattctttttcttaaatcgctttgcggagcttttaattcacaagccaggagaacccttcctacttggccttgtggccactttactttcaccactgagatggggaatttctaaatttgttgaaactattctaaaatggaagctgccattaaagaagtatggattggtacctaatcacagctttcttcaagatctctccacatgtctgcttggggtgtttcctgataacttctttgacaagctaaaagaaggatccattcttatgaagaaatcgcaaagctttagcttttgtagagaaggtgtaatcattgatggagaagctaagcccctagaaacaaatatagtaatttttgccactggatacaaaggtgaccaaaaaatcaaaaacatattcaaatctccaatctttcaaaattacatcattgggccagcaacctcaacacttcctctctacaggttggttgtggaagaaaaatga

SEQ ID NO: 103465 - DNA, 198 bp, Glycine max
  Peptide Sequence Number=SeqID_220243
atgcttcgtcaatgttatgatttcattgagaaagatgacacactttcaacaaataatattgctcttgtaagggcagatgtttctagacttcccttctcatcaggttcggttgatgctgttcatgctggtgcagctttgcattgctggccatctccctccaatgctgtaagtgctgtgtcagtgtgtgatgaacagtag

SEQ ID NO: 103466 - DNA, 315 bp, Glycine max
  Peptide Sequence Number=SeqID_220244
atgaagctcctctcgtcccaaggaagggcaaaggtcatactcaaccaactcttgttgtctagaagaagtagaggttgtgaaggaatagagaaaacaagggcaactcatgccaacaaagcgttcaccggaaaagaagtaactccgccatctccatctcacagttcaagcaactccgagagtgatgatgaaacaacaactcacatctcacttgtgcgtcctcaatctcctcctcacaagtgtccacctctttctcctctaaatctttctagttcaagcgtcacgctttttgcctggaaagttttatggagaccttga

SEQ ID NO: 103467 - DNA, 312 bp, Glycine max
  Peptide Sequence Number=SeqID_220245
atgaagggtaccaactacacaagaaacaagaagaccttgtctagaaacaacaagttagtaaggaggctggatagccacaatactcgcatttcatggtaccgaactgttaggttagatacaaagaaagtgtccacttccaattttgcagatatgtccattgatgatcatagggattcgatacaagtattgcttttaactaaggcctttctgaagcaacaagaagagacaaaacaagagttgttcaaccaaagagaggagacaaaacaggaactacaagcttttgttgaacaacaaaagttggagaatgagtag

SEQ ID NO: 103468 - DNA, 285 bp, Glycine max
  Peptide Sequence Number=SeqID_220246
atggtgaaaggttttggacgatggaggtgtatgggtcaatttgtggaatcaatagtgatgataagagtgagggaaatgtgtgaacataagggtaaagaggaaaaaaggagggaccgatggggtttgctaatgtctttgggagtgaagaagaaggggtttgtgaatgttagtattgttattgagaggaaaaccatgggtcttgaggaggtggagatgatggctgttgtggtggccaaaaataacagtgatggcatgcatccatgggaggcgagatcgaactattga

SEQ ID NO: 103469 - DNA, 222 bp, Glycine max
  Peptide Sequence Number=SeqID_220247
atggcacagattgctgatgtggagaggcttgggaagttgggaacagctggttcccagctggcctcattggggataggaaaagtaaggtcaagatggaagaaatccaacggttgggatgaagcttgggaaaatgaaggcattggggatacatgtttggcaggggagggaataaaagtagatttgggattagatatgggtatgctactctacttcaactcctaa

SEQ ID NO: 103470 - DNA, 444 bp, Glycine max
  Peptide Sequence Number=SeqID_220248
atggcggcggggtggaactctcagctcgtagtggagacatggtcgcaaggaggacgtattaccaccagcgtggggttagcagtggcgaggtctcacacgtgcggaagacacgtgtgcgtagtttccaatgagcgggtgagatcaaagtatgtagagaggataggcaaggtgggcgtgatgatggatattatgggccttccaggagcatatactgaggatgcagctttgaaagcatatccaaaatgtgagacagtgccatgtgaggactttgagacttcattcaaggctgttgaatcgtggttagtggataaagttgttctacccatcaaaagttctattggtgggagcatcaaccgtaattatgatttacttcttggacacaagctatacattgttggggaagtgcagttgctaattaaccactgcctcttaggattacctggt

SEQ ID NO: 103471 - DNA, 126 bp, Glycine max
  Peptide Sequence Number=SeqID_220249
atggtgattttcaactatggagatgcaacggaagataaaggagaagagcctaggtcactaactaatgtgaatctaagaggaatattccaaggatatgccaaaggcatcttagcatattccctttag

SEQ ID NO: 103472 - DNA, 225 bp, Glycine max
  Peptide Sequence Number=SeqID_220250
atggaacacaacattaggagagaaaatggagttaggctttttgtttgtcagcgggagaggatgcagacagaggtggtggtgaggcatatggggcgagcatgggtgtggatgcattcaaatatagtattggttatcggtgtgggtgagggaagtgtgatcgtcaccactaaccacacactagtggcaataagtcctccctgcgaccatgtctccactacgagctaa

SEQ ID NO: 103473 - DNA, 528 bp, Glycine max
  Peptide Sequence Number=SeqID_220251
atgtttcaatctcagggcataccttgtagacatatactttgtgtcctaaaagggaaaggtttaactgagataccgagtaattataatgtgaataggtggattaaattggcaaatagaaaacttgtttttgatattgctgacaatgtcctagacacattttctaagccagaaaatgagagggattctaagcaaacaaagacaaagatttacaaacctttgttggatcaagcattcctaaagaagtgggaattcttccaccataattttcaaagacaaaaggaagtggtaaacgaatcaaaagcggcaaagagaaagctattgaacaacaacaaaaaagaatgtgtctttgtaaaacatgtggccaataagcatttcattatagccgtaattgtccccaaaaattatctccctaattttggattggcaaaggaagaaaatgaagaaaaaattgtagaaaaatggagcaaccaagcttcaatgtttttgctaatatcaagtgaaaatgcacatgttgagttaaaagtgtaa

SEQ ID NO: 103474 - DNA, 155 bp, Glycine max
  Peptide Sequence Number=SeqID_220252
cccaggagcctcagccaaagccagaggttgcacgtgaggccactccagaggctactccacggacttcaccagtcacttcaccaattttggaggtctctggggaggaggatggcgctgttgatgcggattatgcagctgatatgaccgcagcatag

SEQ ID NO: 103475 - DNA, 660 bp, Glycine max
  Peptide Sequence Number=SeqID_220253
atggccaaagactatggagaagttgagttgtttggtgtaggtggaagcccttttgccagaagggtgcagattgccctagaactgaagggagttcaatacacttactttgaagaagatcttaggaacaagagtgctcttcttctcaaatacaaccctgttcacaagaaggtgcctgtgcttgtccacaatggaagacccttggctgagtcccttgtgatccttgaatacattgatgagacatgggagaaccaccaccccatcttgcctcaacaaccttatgatagagccttggctcgattctggtcaaggtacattgatgacaaagcagcatttactgtagacaaggaggaacgtgacaagggcactgaggaatcactcgagtctcttcaaattcttgagaatgagctcaaacacaagttctttggaggagagactatagacatagtggacatagccgctggtttcatagctttctggctccctgcaattgaagaggctgttgggttgaaattgctgaccaatgagaagtttccaaaactctacaaatggggtgaagactacaccaaccaccctattgtgaaaaagaatcttccccaaagagataggcttgtggggttcttcaaagctcgatatgcatcatccaacactgcttccaaatag

SEQ ID NO: 103476 - DNA, 243 bp, Glycine max
  Peptide Sequence Number=SeqID_220254
atgtctgatcacgggaacggatttttgcagctaagtttaggcgatcctgcgattccatgtactgccacatgcacagcacatagcaccaaggacaatctttgctgctgcggtatgggtcgaataatttgtacgtcaagaatgggttacctactaggttggaccttggtaggaattattgccaagctaggtagcaatttgtggcagctaaagaaacaagacaaatgtctacttggtgggggctaa

SEQ ID NO: 103477 - DNA, 557 bp, Glycine max
  Peptide Sequence Number=SeqID_220255
atggaattgcagctgggacaccaaaaaccagcatggttggaagctctttacgcacaaaagttctttgtggggtgctctcaccatgagaatgctaaaaaaaacgagaagaacatatgctgcttagattgttgcaccagtatttgccctcactgtttgccatcacatcgctgccataggcttcttcaggttcgccgttacgtttatcatgatgttgtcagattggaagatcttcagaaactcatagattgctctaacgtgcagccttacaccatcaatagtgccaaggtggtgttcatcaagaagagaccacaaaacaggcaactcaaggggtcagcaaactactgcacttcatgtgatagaagtcttcaagaaccttttatccattgctctctaggatgcaaggtggattttgtgctgaaacactacaaggacctctctccctatttgagaacatgcaagtccttgcatctaggtcccgatttcctaatcccacaagagatgggtgatgatgaaacaactcgttcaaccattgtggattttgatgaaccaatgagctc

SEQ ID NO: 103478 - DNA, 687 bp, Glycine max
  Peptide Sequence Number=SeqID_220256
atgctaaaagaagctctcgttttatattctctggcgctttgtattcttaatctccttctcactctcaatccctctcaagggttcccaaaatgttgcgagagagccgcacctcttcgtcgaaaccatgatctccgtgcaaggcgaccaccaccaccactaccaccattagctgcagctttctggcttcgtcgaccttttctctcactagccggtgtagtgttgatagtgatatacatattcagcaaaccgattctaatattccttggggaatcagcgagaatcgcattggccgcaagactctttgtgtacaggttgatccctcagatattcgcttacgcaacgaacttcccgatccagaagtttctacaagcgcaaagcatagtggcacctagtttgggtggcggtgtacgagattgggttggggctgttgggggcgtcgttagtgctgagcctgtcgtggtggataatcatgattggtcagtacgtgtacattgtgaagagcaagaggtgcagacggacgtggcaggggttcacgtgggaagtgtttatcggtttgtatgggttcttcaagatctctgctgcgtccgcggtcacactgtgcctagagacgtgctagataatttggaacttgcagttaatctggctaatagaagaaacctccctggtgcagaagaattggtaacttga

SEQ ID NO: 103479 - DNA, 204 bp, Glycine max
  Peptide Sequence Number=SeqID_220257
atggagcggcggtgcaagtaccgcaggtggccagaatggctatactcgtggatgataaaagacttccgctcgagggggaggctaccatgtggaagagactcacactggttagagtgtggtgtcaggtttccttatgtggtggctcgtggtccacaggaaggtgaggccctaactgattcttcggagtctaggccttggggataa

SEQ ID NO: 103480 - DNA, 264 bp, Glycine max
  Peptide Sequence Number=SeqID_220258
atggtacggatgcaatcctaccccccaaggcatttggatagaagactccaagaagattgggccagagatgcaagagaaggcattagggttcacatgagccttaggataggaagagaaattacatcaagagaagttagctgccaagtttccatcaaagggggtttagcctctcattgtcatggaggatttaccattacaagaggcgaatatttagtaaaggggaagaagataagaaagggaatggcgggaaggaatggctcctaa

SEQ ID NO: 103481 - DNA, 171 bp, Glycine max
  Peptide Sequence Number=SeqID_220259
atggcttccggggcttctgggacttccatggaggtgataagagcaattttcaaattttcgaatctgggcccttccagatcattttggaagctgggttatttagggagaaagcagcccagctcgcttgggcggcaacctaggcgaagggaggctgttccaaagggtccctaa

SEQ ID NO: 103482 - DNA, 267 bp, Glycine max
  Peptide Sequence Number=SeqID_220260
atggaaaagacaacttgggcaagtttgatgcaaagtcggatgaagaatcaattcatgttgcttttgatgagactaactcttaggccaagaaaggatatacttgatgatattatagatattttagaagatacgcatattcatgaagaagtccacaaagacaaagaagatggaaatagtagagattctcaatccaaagaaaatcaaataaatgtgatcttccaagggagtggagaacttcagggtatcaccctcttgataatatcatag

SEQ ID NO: 103483 - DNA, 297 bp, Glycine max
  Peptide Sequence Number=SeqID_220261
atgaaggttgaacaactctttgcttgccatcatattagcatagagagaaaagttccattggctacccttagctttcaagggtatgccctctattggtggacttcccttgttagggagcgaaggattcatggggatcctctagtagagtattggaatgatcttaagagttccctaaggaagaggcgcattccctcctactatgaaagagagcttatggtgatgcaatcctaccccccaagggtattggatagaagactccaagaggcttgggctagagctactaaagaaggccctagg

SEQ ID NO: 103484 - DNA, 261 bp, Glycine max
  Peptide Sequence Number=SeqID_220262
atggtggagttgactaccaaaactattgagctataccatcgtagctcttttactcctcaagacgaacacattgaatgtgaaactgagagctggtaccaagaggtgtcaaagctaaaggcaaagtatgattctcttcaaaggacccagaggtatttgcttggggaagatgttggaccattgaacataaaggagctgcagaatcttgagaaacagcttgaagggtctttagcacaaccaaggcaaaggaaggtgcgaatgtaa

SEQ ID NO: 103485 - DNA, 1977 bp, Glycine max
  Peptide Sequence Number=SeqID_220263
atggcattctcaacagccaccgtaaccactgctccttatggatcatggaagtcccccatcaccagcgacgatgtctccggcgccaccaaggacctcggaggcaccaccatcgatggtcgtggccgcctcatttggctcgaattccgtccaacagaatcagggcggggagttcttgttcttgagccggaaaacaatggaggtgaagctgtggatattactcctaaggagtttggagtgagaacattggctcaggaatatggaggtggtgctttcactgtttcaggggatgttgtcttctttgcaaattacaatgatcagagattgtacaagcagtccattagttctctagatgtgcctcccgtaccgctcactccggattatggtggacctttagtcagctatgccgatggaagattggatgcacgctttaaccgttttattagtgttagggaagatcgtcgggaaagcagtctaaacccacctacaacaattgtatctatagcacttggcagcaaggatcttcaggaacctgaagtgctagttagcgggagtgacttctatgctttcccccgtctagattcaaaaagtgaaagaataacatggattcagtggaatcaccccagcatgccgtgggataaaacagaactttggatgatagttggagtacctgttttttattacatgtatatgtcatgtttcaacttgaagcttaatcatcttaaggttccctgcagtgagatctacaagcgtgtttgtattgctgggaatgatccttctcgtgtggagtctccaactgagcccaagtggtcccttgatgttggctggctacagattgagtttgagaataaggttgtgtctgtttattctttggaagctgagtttacaaggcctctgtggacttatggtatgaattcttatgaatttgttgaaagttctaaacagaaaaacttaattgcttgcagttacaggcagcatggaaagtcatatctgggaattattgatgtgcagggctcaaagctaactgtgattgatttcccttgcacagacataaataacataacgtctggtaatgattgcctatacgtggagggagcatctgaggttcttccatcgtcagtggccaaggtgactttcgatgatgataaatcaaaagcagtggacttcaatattatttggtcttcgtcacccgacagtttaaagtatagttcctacatcagtaaaccagagtttattgaatttccaactgaagttccaggtcaaaatgcctatgcatacttttatccaccatctaatcctgatttccaagctagcaaagaagaaaagcctccattattattgaagagccacggtggaccaactcaagaaactcgtggaattttaaatttgagcgttcagtactggactagtcgaggttgggccgtcgttgatgttaattatggtggaagtactggttatggcagggtgtacagagaacggcttttgcgccagtggggaatagttgatgttaatgactgttgtagttgtgctacatatttggtggacagtggaaaggtggataaggagcggctgtgtattatggggggctctgctggtgggtataccaccttggctgtccttgctttcagagatacttttcaggctggggcttctttgtatggtattggagatgataaggatatgtatgaaagatcccctatcaatcatgttgacaatttttcttgtcccatcattatatttcaaggattggaggacaaggttgtgccaccggatcaagctcggaaaatataccaggcggtgaaagaaaaaggtgtgccagttgctcttgttgagtatgaaggagaacaacacggtttccgaaaggctgagaacattaagtttacacttgaacaagaaatggtcttcttcgcacgattgattgggcactttgatgttgctgatgacatcactcccatcaaaattgacaactttgatgactaa

SEQ ID NO: 103486 - DNA, 435 bp, Glycine max
  Peptide Sequence Number=SeqID_220264
atggtggaggaagaccccaatgttttgaaacacaccactggtgatgatgacaaactctcaccattgcatgtagctgctgccaatagtcaggtccagaccccgttgatgtatgctgcaaagcagggaaagactgattgtgttgaaaagcttattaatgcaggagcaaatatattcatgcttgattctcgacatggaggaacttgcttgtacgatgcagcttttcatggccgcatagattgccttgaggccattctttttgctgctcatttcacaccttttgaagattctcggttcgagattctttcgctgcacaagatcggaaccaatgagttgtcgtatcttgggagaggagcgcaatcagaatttcttaccgtgcagtggaggcgttttctctctaaggatagcgtttacgcgcttttaaccatggctatttaa

SEQ ID NO: 103487 - DNA, 546 bp, Glycine max
  Peptide Sequence Number=SeqID_220265
atgaatccttatggtggtgggacctcgacttcatttgccagtctaatgaggagggaaggtggtttcaaggatagctggaatgtagatggtgtgccactgaaggtgaagtatcctagactctacattacatctaaccagcaacaccaatatacacaacagattgggatgagctcagacacagaatgggaatggacattgcaatggaggcgcttatttttcgatgttgaaatagatatggctgccaagtttatggaggatacagaagggctcacaattcatccttacaaacatgacaagtgggtatttgataagggaccaaaggaagtagcagaaaacacaggcacaaagatggaatcaaaggtgcaagcaggggttgacagcatatcaggcacaggggagaacacaacaagcaaaggcaaagatacagaaaacacacgggtgccattagcagatggtcacgcacaacaagcagaaacagtggtgcaaacagcaagcaaaaccaaaaggaagattttgaggcctgcttacctcaaggattttgtctga

SEQ ID NO: 103488 - DNA, 309 bp, Glycine max
  Peptide Sequence Number=SeqID_220266
atgtttttggtgcagaacgttgtggaggtcccattgtcttttcataggcaatggatgtaccgttacccaaactatgttttattcaattgtgatggcaccaagcattttattagggcaagtgcgtgtaaggtcaccatcaacgatggggtgccatcaattgctgacccatggtttcggtaccttggtgaaaaaaaattgatggctagagatgaagttgccttctacttccagtttgatgaccatgcatgggagcttttgatcaggaaagaaattgaatgggaggagcaggacatccagcttgaagactga

SEQ ID NO: 103489 - DNA, 2301 bp, Glycine max
  Peptide Sequence Number=SeqID_220267
atgagtgtggtggggtttgacattggtaatgagaactgtgtcattgccgtagtcaggcaacgaggcattgatgttttgttgaattatgaatctaaacgcgaaaccccggctgtggtctgctttggcgagaagcagcggattttggggtctgctggtgctgcttctgctatgatgcacatcaagtccacaatatctcaaataaagagactgataggaaggaagtttgcggatcctgatgtggaaaaagagctgaaaatgctccctgttgaaacttctgagggtcaagatggaggcattttgattcatttgaagtacatgggggagattcatgtatttacacctgttcaattattgtccatgctctttgctcacttgaagaccatgaccgagaaagatttggagatgctcatttcggattgtgttatcgggatcccatcatactttaccgacttgcagagacgggcgtatcttgatgcagcgaaaattgccgggttgaagcctttgagattgatccatgattgtactgcaactgcccttagttatggaatgtataaaaaagattttggaagtgcaggtccagtaaatgttgcatttattgatattggtcactgtgatactcaggtctcaattgcgtcatttgagtttgggaaaatgaagatactttcacatgcgtttgacaggagcttaggggggagggactttgatgaggttatatttagtcattttgcagcaaaattcaaggaagagtaccacattgacgtgtattctaataccaaggcatgctttaggctacgtgcagcatgtgagaaattgaagaaagttttgagtgcaaatcttgaggcgcctctaaatatcgagtgtttgatggatgagaaagatgtcaagggatttatcacaagggaagaatttgagaagctggcatcaggattactggagagagtttctattccttgccgcagagcattaattgatgcaaacttgacagaagagaagatttcttctgtagagctagttggttcgggttctaggattccagcaataagtacattactaacttctctgttcaagagagaacccagccgacagctgaatgcaagtgagtgtgtagcccgtggttgtgctctacagtgtgcaatgctcagtcctatttaccgtgtgagagaatacgaggtcaaggatgttattcccttttcaattggactttcatcagatgaaggtccagttgctgtgagatcaaatggtgtacttttcccaagaggccaaccctttccaagtgttaaagtcataacctttcggcgaagtgatttgtttcatttggaagctttctatgctaatccagatgaactaccacctgggacatctcctataattagttgtgtcacggagaaagaagaagagaatgtggtagatctaacatcattctttgtgctgattggtcctttccatggatcccacggtagtaagatcagagttaaagttagagttccacttgatctgcatggcattgtcagtattgaatcagctacattgatcaaggatgattcggttatggctggtgattatcattcaaattctgatgcaatggatattgatcctatttctgagacagttaccaatgggtttgaagataataccaataagaacttggaatctccatgtagttctgctgatggtacaagaaaagataacagaaggcttaatgtgccagtgaatgagaatgtctatggtggaatgacaaaggcagagatctcagaagctcgtgaaaaagaactccagttggcccatcaggacagaattgtagagcaaaccaaagaaaagaagaacagcttggagtcttatgtctatgatatgaggagtaagctcttccacacataccgaagctttgcaagtgaacaagagaaggatgacatatctaggacccttcaagagactgaggaatggctttatgaggatggtgttgatgaaactgaacatgcttattcttcaaaactggaagatctgaaaaagctggtagatccaattgagaatcggtacaaagatgataaagaaagagtgcaagctacaagagatttatcgaagtgcattttaaagcatcgtgcttctgcagattcccttccaacccaggataaagaactgatcatcaatgagtgcaataaagtggagcagtggttggaagagaagatccagcaacaagaatcatttcctagaaatactgatccaatattatggtcaagtgatatcaagagcaagacagaggagttaaacttgtatgactttctgttttccttttcagaagtgtaa

SEQ ID NO: 103490 - DNA, 190 bp, Glycine max
  Peptide Sequence Number=SeqID_220268
atgaagacaaataaccagatctggatcccatggtggttgacacacaatgacacagtggtcattgatagtgagggtgagtcgatgctgattgtctccattgaaggtggttgcagtggaggtgtcatcgccaaagtggtcacagtagctatagaagatgaagcaaggaggacattgacattggtggatgttg

SEQ ID NO: 103491 - DNA, 187 bp, Glycine max
  Peptide Sequence Number=SeqID_220269
ggtgttcaacgataacaattggtgtgcgagtttgaggagaggagaggctaagagggtcatggtgtggctggtcggtgacggtgcaactattgtgcgaggttggcacttggcaatgctgaaactagttcacgtcttcatggggtcagcgacggtgcaacacaacaatggcttaggggtttctttgtga

SEQ ID NO: 103492 - DNA, 546 bp, Glycine max
  Peptide Sequence Number=SeqID_220270
atggtggccctagacctgaaagtggaacaacaacaactatcagcaaaggagttgcttgagggtatatgtagatccatgaagcaagtgttttctgaagaagagtcagacattatgtggatgatgactaaattctacttttttaggaagcttcctagagggacaaacgcctcatttcttgctcttataccgaagaaggaatttccagaaggtctatctgattataggccaatttcactcatcaaaagcttgtacaaaattattgtgaaagtgctctttggcaggttgagaactatcatgcatttgctggtcatacatgaagcaaagagtaaaaagaaggcaactcttgtttataaagcagattttgaaaaggcatataaagtgttaactaacaattcctttttgtatgatgtccagaacaagaagttgtttgggagtgatagcggtggaggacaacatggtgtctcgatatgcaaggttgatgaactgtactaccttgaaacttcctttgaagtacctaggcttacttatagggggcaatgctcgtaa

SEQ ID NO: 103493 - DNA, 252 bp, Glycine max
  Peptide Sequence Number=SeqID_220271
atgtcctcgcttttggttatcagggaaaactcgaacccgaacccgaacccctacccgatcaactcaagtattccctgtcaaagtcaggacgggtatccacaggtaaagtatcagttagaggattactctagtttggagaacaatatactgggtcgtgagaaggtgaatctgcatgtacaaggtcatggtaggagagaaggccttcaaggacaagttcaaccccaaggtgaagaagaaccttattccctttag

SEQ ID NO: 103494 - DNA, 318 bp, Glycine max
  Peptide Sequence Number=SeqID_220272
atgaaggtcccacagcagatggaggatgagtcatccgaaactaccactccagagcccttggtcagaaggaagaaggaaaatcaaacagaagaagctgcagccacttctgagaaatctcttgaagccacttttgagccttcagaaccaatggcagattcagcttcacttcagcaggcagcagacccttccactcctgaggatcagactacaccagtcctgtctccgaacacctctcctacagctacacctatgcttcacttaacagacaaggaggatgttcaaacacaggatactcaggaccgatcacaggatttttaa

SEQ ID NO: 103495 - DNA, 183 bp, Glycine max
  Peptide Sequence Number=SeqID_220273
atgtcacgaaatcttacggattatgcaaccatcccttctttggcttccggaatgttacagaacttgatggattgcgccttaacacgtcttttcaactcccgacatgccgcagaacttcacggattgcctaacgatgggtgtcaagcttgtaatgagcttcaaaacaaagaaagggaaacatag

SEQ ID NO: 103496 - DNA, 294 bp, Glycine max
  Peptide Sequence Number=SeqID_220274
atgcaaaacaaatggggacctctaagggtacatagaatgaagaccgaagaacgaagaagagcgatgaggaacggtggaaaacctttgcgaaatcgcccacggaaacgtctcggatgcgttacggaagcgcctcggcttggattttcttcatggaaacaatttttctcactaattttaagggaaaagagggtggtggttgccgcccagctcgcccagaaggcaccgccttctgttggaagattctggaaggcccaagtgggcttgattgctacttgtacccctcgtgtttactaa

SEQ ID NO: 103497 - DNA, 486 bp, Glycine max
  Peptide Sequence Number=SeqID_220275
atgcttagaaaattagaagagatttatggagcactagaatctatctctgtaaaagataccttgcttgaagaagaagagtatgcacttggcgtatatggagaccgggaaccagtgatcaaggagtttcctccaaggaagattgttgctcccaaccctaacagtctgatctttaagcatcgacttacagacagaaaaatgtatcctccttgtgaaaacgtcccaaaagccaattgctacaaagtcaaggagtttttgattgaagacgatgaagatgttccaccaattagatatgttaaggctcgtcctggtcgacttttcaaacataagcttgaagctctaaggcaaaaggctgagattaccaatttggattggtatgccatgaagaggttttacagacttcaagaatgctactttggtctggaacttaatgagaaaccacctgtagatgcagttcacatgaaattaggtgatgttatcagaccttga

SEQ ID NO: 103498 - DNA, 861 bp, Glycine max
  Peptide Sequence Number=SeqID_220276
atgggagatcacaaagttactggctgggaatgggatttccattggaggcgacacttattcgattgtgaggtatctatggctgataatttcattaatgagatgacaggagtgagggtccagctgaactgcagggatgactgggtttggaaaccagaaccctctggccaatactcagcaaaatctgattatgacatgctaaggggagttgtagtgcagggggcagacgttgcagattttgagcaattatggaagctgcggattccatcaaaagctgcaattttcgtttcgagaagcacagcggaagatacaccacatcttttcttccaaagcagcaaaatcttgcctctctggtgggaaaccacatcttgggtctggtgggtggcactcacatggtcagtatggcagatgagaaataacattattttctcaaatgggattttcaatggaaacaaactgatggaggatgccacatttctgttttggacatggttaagaaactatgagaaggatttcgtaactaattttaatcattggtcatctaacctcacagagtctgcccttgggaaccatcctactggtctctatgtatcggtacctctgcctcatttgaaggataccatgaggtggttagcagatccttcgggcctctactcatctaagtcagcctatagtctgttgaccaatgtcaatagaaatctccctcaccctaatatctacaagtcgttttggaaacttaacatacccccaagagctgcgatctcatcaagaggaggctggccacttgtttttcaactgcaaggccactattgctttatggtgggaatccatgagctggaacaggatggtcggtcccctggctga

SEQ ID NO: 103499 - DNA, 363 bp, Glycine max
  Peptide Sequence Number=SeqID_220277
atgaaacaggccaaatacagtctaaaggcccaagtggagaaggacgaaggcccaagtggagaaggacaaagcccccgagtggagaaggatgaaggcccagaggcagagacactatcaagactattaattgttgctgaaggcccaaacttatcttccttcaccggaagtggcgtctaccctgacttatcttccttaaccggaagtggcgtctacccagacttatcttccttcactggaagtggcgtctaccatgacttatcttccttcactggaagtggcgtcatccaaaccttcgtagcctgtatcaaacgatccgctcctactcaggttcgcatcatctggtatcagagcttcggctcttga

SEQ ID NO: 103500 - DNA, 1104 bp, Glycine max
  Peptide Sequence Number=SeqID_220278
atgaccaaaactgctgcagaaaccacagcaaccagagctcttttccaccagttccagagctcttctttgccacattcgagacaagccggagacgacaagtcaaactcaaacgggaaaactgataactgcggagagaagtctgagtttgttaatgaaaaaactgatgaaaagattcaaagcctcaattcaagccatgaaaccgatacatcgctaggccaagaggtagctgttgagcatggaagtacagataggacatcaattccttctgataatggattactctgcaacaacacccctgcatctgttaaggccagtgatcggaatagtgaaaggtctacttctgcagactctgtctctacaaatttaacccaaggtgtggatctcatccaagattcacaaccagcaagatccaatgaaatatctgttccaaggggtacaggttctactagaaatgctaaggaatttaagctcaatccagctgccaaaaccttctctccatcttttgtgaatcccatgccagcaacttcggctgcaaacatggtatacataccaaatagctctcctccagtacctgttactattcaacctgaagttggattcaatacttttgcttctcggccatcaatgcctgttaaggtttcacagtatagtaatttgacggtgggaaatggtggcagtggctctcaattttcgcaacctattgttggacatgtggcgcatagagcccaacctctacgatatgctacacattacaatcctgttttgtctgaacctgcttatatgcaaccaagctctcctgctgttatggttggacgttccccccagttagtctatgttcagccagtttcccatgatttgattcatggaacgacggctgtcccaccagtctcagctcgccctctgatgaatcatgtacaatttccaaagcagcagggaggaacaattggtccagcaatgccggtttgtgtgccccctcctgtcttaacaagtggacatcagcccttcacacttcgaagccacattcctcttctgcaacctggctttcctgtctctcgacctatttccgtcccaggaccaaatggtttctatggcaccaagttttag

SEQ ID NO: 103501 - DNA, 384 bp, Glycine max
  Peptide Sequence Number=SeqID_220279
atgcttcatgcagatgttgttggtggaaacataactggtggcgatgaggaagcagttgcgcataatgtttgttccgagagtctaacgtgtgaggtagagaatcatacagggcctttgatggacacaaaacaggttaatcactcaaggtactatgatatcttctattttggagggcagcaccttagttatgaaagcttagaattcaaagcttatctagaaaatggaaaaataatgtcagataaggctacaaaaggaaataagagtgtcaggtggcttgtgtcccacaggctttggcatagcagtgcagagcgacccccacctgctgcaggggatgccatagcagagtggttggtagtggttgtagcagaccagatagctggatga

SEQ ID NO: 103502 - DNA, 213 bp, Glycine max
  Peptide Sequence Number=SeqID_220280
atggagatgaagaaattggttcatccccagcaaagagacatgcttgatgttattaaaggctttgcacctacctctggcagtaacagtgacaaagatgatcataatggggagcaattgatggaagatgaatctcaaattgctctaaggagaaggaagaaacttgttcttaatggtgatttggaaagacaaatcaaagatctccatgagaagtag

SEQ ID NO: 103503 - DNA, 303 bp, Glycine max
  Peptide Sequence Number=SeqID_220281
atggggaagacacattttgatgtggaggagaagcgggctaagggggatgatgatgatgtcgtggtggtggagggcggatcgccgccaaagagactgatggcggagatttaccagcatttcacgaacccgtggagccccgggagtgataggtccaagaggcagagggaacgcgagaaggagaggctctccaggaggaagtgggagcctcaacattttttcaagattatcaactgctcgccgactccaactcgcccattgcagggcctgtggaaggattgcaacaaaaccactgctgcaatttag

SEQ ID NO: 103504 - DNA, 219 bp, Glycine max
  Peptide Sequence Number=SeqID_220282
atgggttgcagaaacagggactcaatcacagagaatcacacttcgtcatcatcatcttcttctgattcactcagtgaagccttgcttttcaccaccatgtgcatcgttggccaccccgtcgatgttcacgttaaggatggctctgtctattctggaatcttccacactgcttctgttcacgccgactacgattcccttgtaggctcaaaagggttgtga

SEQ ID NO: 103505 - DNA, 351 bp, Glycine max
  Peptide Sequence Number=SeqID_220283
atgtacctcctcgaagaggctcatccagaggaacgacgttttggtgacactgtaggtgttcgaatcggagtcggaaggggaaaccctagaagtggagatgaaggatgggccccactcgaagaagagcaaggaagggattccggttccgctttggcaccagaagtcgaggagattctcccagcagtggagggtgtggtagagttgcttgaaggagatggtgggcttttgggcccattgggtgatgcggatgtggtagagttgcttgaagggaaaccatgttgtggtcgaggcaccaactccctcagcgtcgcgatgaagaagttgaagcgacaagaaggaacgccagaatga

SEQ ID NO: 103506 - DNA, 852 bp, Glycine max
  Peptide Sequence Number=SeqID_220284
atgtctattcgaacaaaccccatgaaagcaattcctctggtgctgaagcgcctgagggcgaccaggatcaccacgaaactagatgcatcatctgctgccaagttggaagagttgatgtctctgctggacaaaaaaaaggacttgttcaagacagtgaagagcaatggagatgaattcctcgacatattaacactcctagatggccatcttcgctacttaaacaaggacaacttagacaatgccaagtttgagaaagacatggaagctattctccaaagaatcaaggactcagctgaaaagttgctgccaaagggtgctactaatgaaggtgaaacacaagcacttggctcatcatcaaaagtaagacctctggataaccagatgaaaaagttgcactcagatccctcttcaagccaaaacaagaatgagttgctggatcatgacttgtatcagaagattgaggtcagttatgaagaacttaaagattctctaaatatttgcttgttgtctctcttagtattccctgaaggtgctgttataaggaaaagacatacaatttattggtggattggagagggttttgttacaagtaatggagagaaaacagcagaggaagtaggcgaggcttatggtaatggattaaatccagttgtgaaaaaatttaaagttaatcctcacatctgtggtcagttggtgtcatttgtgtcaagagaaaagctacagcatcttggattttcttttcaaataatctctcatcatgaacagccttcatggttagtagttgagcgacaaaaagttaaccttggtgataagggtcatttgaaatctgacctattggaaaactatttttaa

SEQ ID NO: 103507 - DNA, 1392 bp, Glycine max
  Peptide Sequence Number=SeqID_220285
atggtggagcttattttgttgtatggaggtgctaaatttgaaagctacaagggaaaattgaatgttgtattgggattaaatgcctgtaggagagcctctataagtttgcgccatgatttcgttatgttctgctttgtatgcattgacaactgggctaccatcactaatctttgcccactttgccagaatgagtttcagttaatcacttgtgttccagtatatgataccattggaaacaataaagttgaagatgattcattcttcaaggatgatgactggtccattgaagagaagaataacacactgtcatttccctcttactacattgatgaaaatgcagttatttgcttggatggtgatggctgcaaggttcgcaatgggttggctactattgaaggagattctgatctcgatacatcaatagcctgtgattcatgcttagacctcatctgtaagggacatttggcagaaaaaagtggcccagggttttgttttagatgtgttgttgatgaagtttctaaaggaacatccaattcagtagagaggacaacgatggaatgtaatgcagataatcataatagtaacagtgaatgccatgctgaggattccttttcaggaaaagtgtctgtgtctgttgctgatacaggagagacagctgttgttgtttcaatggttgaccaaacaatatgggttccagcaacaagtgagaaaagcctattgccttttgaagttggtgggtacccaatgactgaatcatgtattttaatgtctgacacaaatggtcagcaaagtggggaagtgaagacagggacaaatacgttacaaatcatggaggaagaagaactggaactgtctttgtcaaacaacatatcctgtagcgtaacttctaaatccttagtgcataatgatttaaagaaaagtgtccgtggagcaagggatgacccaagtggctttgacggaaccaagttatttgacgagtcccttaccaaaactagtccatccagaattgaatccgaaatgggtcttcaacttggtttgtcagtgggctctttcttatctgttgatagtgcagacaagaatgaaacaaaagatcaagcaactaatgtcctgtgcttgagttcagaagaatgttttttgaaaggagatgaaattgaagccaatgcttgtaaggacaatgccagagtggctggtggaaagagaaagcatgctgattataattttccatggtcattgtgttggggagagagagagagagaggatgtaaaaatgttgtgggatgaagcacactttgccttagtcctcactcctcatgcttattatactctgacagatgactccaacatggacactagacccaacactaacacagatgctctaacatggtcaatgtaa

SEQ ID NO: 103508 - DNA, 645 bp, Glycine max
  Peptide Sequence Number=SeqID_220286
atggatctaaatgaacaacaaatcggcatcaaagtgtacaacaacaatgcaactccagcacccgaacatgaaacaccgaacccctcttcaaaccctcctcaacccaagaaacatcgtgccctaatggcaaagggcgtccaaaaaaccctatcaaaaacctccctcctcggtaacttcctccccacaggaaccctcctcacttttgagatggtcctcccctccatatacaagaacggccagtgcacccacattcacaccctcatgatccacttcctcctcttggtttgtgccctctcctgcttcttcttccacttcaccgatagcttccacggccccgacggtgccgtctactatggcttcgtcaccccgaggggcctcgccgtcttcaagcccgctgtggccgtcccggaagacgacaggtttaaggtcgggttcaccgacttcatccatgccgtcatgtcggtgatggtgttcgtggccattgctatttcggatcatagggtcaccaattgccttttccccgggaaggataaggatatggagcaagtgagggagagtttccctttgatggtggggattgtttgcagtagtttgtttctggtctttcctactttcagacgtgggattggttgcatgtctgcctag

SEQ ID NO: 103509 - DNA, 417 bp, Glycine max
  Peptide Sequence Number=SeqID_220287
atggtcattaattctcataagttgatttgtaaatttgctgccaatcttttgtctttggaatcccctgttggggtgaggttctcctacaccaacaccagcagtgatataagtgagcttggtgacaccattaccggtaatctaaagattcacacacctttatcatcaagtggtttagaagatttccacaattcaggtcacacaaattctacatttccggtgaaagctatgctggtatctagcaatgttctaaagcaggctattgcttgcttcaactcccaagttgcttcctacacctcctttataacttctagaataaacaatgcagaatgtttggctagtgcttgcagcgtcttgaacatgctcattctcaaggtgtcacaagtgtttccttctctcgtgatggaagtcagttattaa

SEQ ID NO: 103510 - DNA, 1403 bp, Glycine max
  Peptide Sequence Number=SeqID_220288
cactttccgagacttctgagtttgcaaggaaatgggttccattctgcaagaagttctgcattgaaccacgggctcctgaatggtattttgctcagaaggttgactacttgaaggataaagtggatgcgacatttataagagaacgtcatgccattaagagggagtatgaagagttcaaagtgaggattaatgcattggtggctttggcacaaaaggttcctgaggatggttggacaatgcaggatggtactccatggcctgggaacaatgtcagagatcatcccggaatgatacaagttttccttggtcaaaatcgtgttcgtgacttcgaaggaaatgaattacctcgtcttgtctatgtgtctcgtgagaaaagacctggatatgatcaccacaaaaaagctggagctatgaatgctttggtgagagtctcggcaataatcaccaatgctccttatgtattgaatgttgattgtgatcactacataaataacagtaaggcccttcgtgaagccatgtgcttcatgatggatcctacatcagggaaaaaaatatgctacgtacagtttcctcaaagatttgatgggattaatcgtcatgatagatactcgaatcgcaatgttgtattctttgatatcaatatgaaaggtttagatggcatccaaggaccaatatatgtgggaactgggtgtgtcttcaggagacaggcattctatggatatgatgtccctacatcgaagaaagcaccaagaaagacatgtaactgttggcctaaatggtgctgctgtctgtgttgtggatctaagaagaaaaagattaaagcaaagtcaacttcaacactcttggaagatgggggtgttccaaaagcagcaagttctgctacactcttgaaagaggccatccatgcaattagttgtgttaccgaagatattttaacaagtttcaagatgcattgtcatggttggagatctgtatactgcatgccaaaaaggcctgcttttaaaggttcagctcctataaatctctcatatcgtttgcatcaagttcttcggtgggctcttggatctgttgagatctttttcagtaggcattgtcccatatggtatggctatggtggtggcttgaaatcgctggaacgattctcttacataaactcagttgtttatcctctgacttcaattcccttaatttcctattgcgcattgccagttgtctgtctgctcactaggaagttcattgtccccgagctgcaactggcatcctggaaatgcagtggggaggtgtcggtatacatgactggtggaggaacgagcagttctgggtcattggtggtgcctcctcacatctctttgctctctttcagggtttgctcaaagttctgccaggaattcagtcagtattga

SEQ ID NO: 103511 - DNA, 270 bp, Glycine max
  Peptide Sequence Number=SeqID_220289
atgagtcttggagttgcagaagagtggatatatgtcattaagaggaacccaaatggaaaaatatcatggcatgccttggatcctgtgtaccatctatggcagtccctgccacctgttcctaaggaatattctggagctcttgctcgatctttgatcaaggaaggagcaacgaaaaaaaaaaagatgcagcaagatcagctcaagaaggttgtttctttgtccatgatttcccatttggtctgcaaagtctgttacgatgctatgagatga

SEQ ID NO: 103512 - DNA, 525 bp, Glycine max
  Peptide Sequence Number=SeqID_220290
atggctcagccaatacagagtatgagagttatgcgaggttcatgttgccaacaagctcgggtcgcgccactcgcgtgtcacgctctgcgaggtgtgcgagcagaccgtgatatccacttcgccaaccccctcgccagctgccacgagcgcatccctgtcacgccgttctttgagttcgtacactcattcaaggcctccttgccgatcaacttccaccaccgcttcttctccaacaccgatgctgacgctgacgctgacgtcagcaccgaggaggctgaggccgcgtcctggctgctagctaatctgaagacggatctaaatttgtctcagtacttgttctccgaaaccaaaccggttccttacatagatctggattacgcggccatcgatccgaagacggaggagaaaagttctgccatcgccgacgacatcgttccagtgcagagcaacttcgagtcgttcacctacgagcaccgtacttctttcttcacggctacttttctcaatttacaaccttcggagtga

SEQ ID NO: 103513 - DNA, 159 bp, Glycine max
  Peptide Sequence Number=SeqID_220291
atgtctagttttgctctggaaattgcttctgggatatcaaagatgtttgctcagaagaatgtcacgctgagcccggggaggcacaagatagtgatactggatgaagctgataggtatcagatacgttatttatgtggcctgactagcaagctaaactaa

SEQ ID NO: 103514 - DNA, 660 bp, Glycine max
  Peptide Sequence Number=SeqID_220292
atgtggatgggtgtcttaggatcagatgtgcaaagccttctcccggcagcaagaagtttatttcttctgtggaaacccgtgattaccgggtcacaagaaaatcatttcattgcaatccagagtaacaaagcaccccgtccaagtgcactacaattaacactaaagacacatgtacctctgataagtactggttccccaatttggggccaagttcgggctccatcaaagcatctagtccactttgtcaataacagcaccgaagctctcatcctcaaactgcatggcggtcatgtccatgatgcgccatcgcatgaggggatggtcgcggacgttgcggtggagcatgtcggagatgacgatcttggagaagtcgatgttggtgatggcggtgtggccagcgtcgtagaggtgctcggagaggcggaagttgccgcagccggggatgaggagctaaagcgggagaggaacggttttgaggagggagaggagtggctccctgaggttgggtcattcggcgtaccactcgaaggaatcaccgtggagggtgaagaacttttcccagttctctttgctcgtgaagtctcccagggtttccaaaatgtcttccgggggacgaccatggcagtgagaacgttaatgaccttaatagcagccttgtag

SEQ ID NO: 103515 - DNA, 315 bp, Glycine max
  Peptide Sequence Number=SeqID_220293
atgggcactcatctccaagtgattggtgatcccatgaatggagttcaacggcaagagcatttggtgttcagaaggttcgggaatcctttcgctgcacacgatcggaaccaacaggttgtcgtatcttgggagaggagcgcaatcagaatttcttaccgtgcattcaatggaattgtcaggggatgtgcaagatatgtcaactcaagagattttaacggttacaccccacaacatcttgtagccctccaaggacaatctaaatgtgttggtgcccttttagataatgctgctcttattggtgctagaactgggtaa

SEQ ID NO: 103516 - DNA, 267 bp, Glycine max
  Peptide Sequence Number=SeqID_220294
atgaatccacgaaaacaatgcaaacagaaacgaacgcaaaacaaccacaaacctaactggcaagcgcgaagactcacaatcagcgacaaagggaatgcagtcgaggaaagagcaaagtgcgagcagttaaaaaatgctacaaatcgcagtaagacagcgaaaccgcattgtgggggaaattcttgccacatgagattgctgacatggactcaaacttgtcacgtgggtttgcctacatggactaaggtttgtcacatagacatttga

SEQ ID NO: 103517 - DNA, 123 bp, Glycine max
  Peptide Sequence Number=SeqID_220295
atggtgcagttttattcaacattttccagcactttaactgcattctctacacctaatgttgctgcattaaacaagatttctgcaatctgcaatgaaaacgcgaagcaaaatgggttagtttag

SEQ ID NO: 103518 - DNA, 321 bp, Glycine max
  Peptide Sequence Number=SeqID_220296
atgaaagataagagagaagaggaagaaaaactagaaaaacaaaagaaaaagaaggatagtaaggccttgttttcgaagaccaaggggaaggaaaaagaggaaaatgattcctccaagaagattgttaataggaaaaccattttgcaacaaaaggtgatatcaaaagaccactccttcttaaacaatccttctaccttctcctataaagggaaacatccattagcactgccgtacctcttgagcttgaggtattatgaggctccaaatccctatgataggtggtatgatgaatgtgttgagtggtgcaaccctcttttgtaa

SEQ ID NO: 103519 - DNA, 444 bp, Glycine max
  Peptide Sequence Number=SeqID_220297
atggcccgcaccaagaaaactgggcagataatgtttgaggcagcaaaggaaatcgttgacaagattggatcagctggaggatcgatcatagaaaaagtgactcaacagctgatgttatccttcaaccagatgcagtcccagttgcaatcacagatccaatcacagggacttgcactgcctccggagcctgaggttggtccctcagctactcgtgtgagcacaaaagggagttgtgttgatccctcaccgaccgatctagagacaggtgacctagacaaatgcgggttatacatcaaagacaatccttcccacctggttgccctaggaagagtttatgagggatccatagtggttcacaacatccctttgttgcatggccaagtcaaggtaggtgttgagcaggttaaagatgcagaggctcccgttcctgtacccactgacgag

SEQ ID NO: 103520 - DNA, 571 bp, Glycine max
  Peptide Sequence Number=SeqID_220298
gccggacaggaatacgaagccctgcgcgtcctcgacaaaggcgaactggcgatggttgatttccaccagccagaagccgccggcaaacaccagatggttgatcagcatgaagacgaggaagtaaccacgcatcccgtcgatcagctctccgttctcgcgggccgtgcattgcccggccacccagcccggcctgcgagatgccgggaattggattgtcaacgcgcttttgcggctgaggacgcggggactgaatgccagatgaatgaaaaaaggcaattccgtgaagcggatgagccatgcaccaaggacataccgaggcaaacaagcctcaaggccttgcatggcaggggaaagccgaatccgccgcgcgaagctttatcgaacgaaacgaacaaaggcccggcggtgaagcgaccgccgggccttatccgtttaagaggctctgattcgtcaggcggcggcctggatggcggcgacctgccagttgtcgttgccggggcggcggacaaaggtccacatttccaccgattcggacggatgttgctcgtcaccttcgatcaccttgcccgag

SEQ ID NO: 103521 - DNA, 312 bp, Glycine max
  Peptide Sequence Number=SeqID_220299
atggcgaggacatgtagtcctctaaaggtgaggacgtgtagtcctctgaaggtgagggcatgtagccttacaaaggtgaaggcacatgaccctttgacggcgaggacgtgtagccctctgaagttgaaggtacatgaccttttgaaggcgaggacgtgtagtcttctgaaggtgaaggtgagggcgtgtagccctctcaaggcgaggacatgtagtcctctggaggtaagggcgtgcagccctctgatggtgaggacgtgtagtcctctcaaggcgaggacgtgtagtcctctcgacggtgagggtaactag

SEQ ID NO: 103522 - DNA, 165 bp, Glycine max
  Peptide Sequence Number=SeqID_220300
atgaccaagccaaatgatgctccaagtgttgctaatatacctttggatgcaagaggatcttctggtgctagcaccctctggatgcaagaggatctccttattttggatttaaagtttagtacaagactaatattactttgttatggattttatgtcatactttga

SEQ ID NO: 103523 - DNA, 342 bp, Glycine max
  Peptide Sequence Number=SeqID_220301
tccctccctcacctccgcaagcgccgcgggaggcgtctccagcgcctccctcgtcgccgtgaaggccgtgggctccgtcgcggacggcggaaacctgatttgggggaggcagctgcgcccggagctctgctcgccggtgctgaagagggaggctgtcctcctccggccatgcctcgccgccgcctcctcgccggccgaggagaagcaaaggttgctccggcggggttctttgacaagtacccggctctggtcaccggatttttcttcttcacgtggtacttcttgaacgtgattttcaacatcctcaacaagaagatctacaattacttcccctatccatag

SEQ ID NO: 103524 - DNA, 291 bp, Glycine max
  Peptide Sequence Number=SeqID_220302
atggcctcaataaactccacctacaaactcttcattgtgatcctaatgatcgaggcatttctcttgcacttgagatggtggtggcgaccggagagaatgatcatgacaactccattgcggttgtgcttcgcttttattttgagaacaccgggtcagatctccggcgaagcatatatttcaggatcttcaaggggttctgacgtttgtcaagcagaaaataacgaaaagaacgggaaaaacattcacagatcaagggttggcaaacaatccatcaagcaaaaaagtgattaa

SEQ ID NO: 103525 - DNA, 564 bp, Glycine max
  Peptide Sequence Number=SeqID_220303
atgcatattgagctgaccgcttcggtgtcgcacggtctggatttcagcaccgagcaatttgacgctgcggtggtattcggccggccgccgggcaaaaagctgagcgcgcacctgctgttcgacgaaatcctcacgccggtctgcacgccgacgtttctgccgccggcgccccggctggcggacttgacggacaaaaccctgctgcacccgacgcgcgatcggcgcgactggctgcgctggctgaaggcggcgggggccgatgcgctgccgtccggcaaggctcagcatttcgataccctcgatctggcgatgagcgccgcgctgcaggggttcggcatcgccatcggcgatctgtgcctgctggaggaggatattcaggcgcggcgtatcgtcacgccgttcccgctctgcgtcagcagcggcgcggcctattatttggtctatcctgaacgcggggcgccatcgccggcgctggcgcagtttatcgatttcctgacggcggaggccgccgacagtcgcgcccggctgcagaattacctgccgataacctgtaatgctttgtaa

SEQ ID NO: 103526 - DNA, 906 bp, Glycine max
  Peptide Sequence Number=SeqID_220304
gatccctcattctccagagttgtccagacgtcctcccttctccagtctttgtcgggcgtatacctctttagacactctacgaggacggcgccgaggagcgggccgtgcgggcgcggcgcggagggcgaatacaagtctcttttttctaatcccgccttcccacacatcgcatcgccacacgtgtcgagtcgagtgtgtcttgtcggctcggccgcgacgttagcgacgacgacgtggtgccgccgccgccgccgtctcggtctctctcgctccacggcgcgtcgtctctgtcactcaccgcgcccggccggcccagccggctcggccggcggctggctttccctttcttccatcgtccaaggcgaagtcgctttggtttggctgccgcgggtggaacagtatgaaagcatcggtggttcagtggtagaatgctcgcctgccacgcgggcggcccgggcctccgtggcgcaatggttagcgcgttcggctgttaaccgaaaggttggtggttcgaccccacccgggggcgtcacgttttgccagtcgtcatctgggacgacgcgcaggacgcgggccacgcctggagcaggaggacgaatcggggcgagcgggcagcagggccagcagccgagcctggcgtcgcgctgtgggcgagcggtgacgccactcgtccggcgctgcattgtccgcaactcggaccgttcgagtcctgtcacggtcgtccttttgctaccctgccccgaccctcggcgccagcgtatgcgtgatgcgtgttttgcaaaatgtggcagcggtgggattcgaacccacgcctccgaggagactggtgccttaaaccagcgccttagaccgctcggccacgctacctcccatgggcgagtcgagagccgctcaaatgttgactga

SEQ ID NO: 103527 - DNA, 482 bp, Glycine max
  Peptide Sequence Number=SeqID_220305
gatggcatagatcacatcttagacctcactcctgtagcagagaaaaggaaagaaagcctcaagaggctaacattaacctcccatacttccattggaaggacaatgtagaagcttacttagattgggaaataacaatagagcaacaacttaaaaggaagtctacttcaaaatcttatgactctcactcatatccaaagaaagatcaaggtcaaggcatcttaggggcggcaccttctaagcccaaagatgataaagggaagacaatagaaaaacaaccccctaacactagggacattaattctcaatgtcccaccaagaaaaccatgattatgaggagccaagacatttatagtagccaagatgaggctactacttcaccttcctctagtgaaagtgaagaagcaaaaggggaagaatctagtgaagacatctacccccaagaagaaggacaacctttaatggttaaggaggagtgtaaggag

SEQ ID NO: 103528 - DNA, 312 bp, Glycine max
  Peptide Sequence Number=SeqID_220306
atgaagtatgttgtgtatgtacatgggggtgcagcgaccatgttggatatccctagtgggggaaatagagtgtgcattgatggtgcccatgtttcatacttcatattgtatggaaatagtataaactttgtcatttggaactcccttgagactcgggctgatcccccgtgggggaggggggggcaggcagttgcctatgcacgacatggtgaccttaacacttgctgcctagttttcctaagtgagagtgtcgtgtggacacacttaggctatttccttgatgaatggtaccacattgcatttgagagttga

SEQ ID NO: 103529 - DNA, 387 bp, Glycine max
  Peptide Sequence Number=SeqID_220307
atggtgcatcagcacggcgtgcagtacattctgccagcggtgctgatggctggcgtgattcagatcctgttcggggtatcgggcatggcgcggctgatgcgctttatcccgcaggccgtcatgaccgggtttgttaacgcgctcggtatattgattttcttcgcccaggttccccacttctggagccgaagcccgctgattgtaggcctgttcgtgctgacggtgctgattgtgctgtgggtaccacgctacatcaaaagtgtcccctcgccgctgatcgccattgtggtgttgacgctgtataccgtgagcaccggtcaaatcctgccgaccgtgggtgatgaaggcgcgataagcggcggtttaccggggcttaccgaactgcgg

SEQ ID NO: 103530 - DNA, 338 bp, Glycine max
  Peptide Sequence Number=SeqID_220308
agtccccatgtgtatccgaaacaagaattaagttcaaagaagttccttcgagggcagtggatgatgagatgcgttgttctagtaagatcagtgacgacacaacaatcgacaacaaaggtgcacatagtctaggatggccagtggggagtgaccatagagagcttagaatgggggcatgccaatggaagactccattggagcttctaggcctaggatcttcttcatcaatggattcccttgcttcttggaaaatgaatggcaacggaatggagaaggaagagagagaggagatgccacttcaaggagaagatgagtctagaagaagctcaccaccatag

SEQ ID NO: 103531 - DNA, 1241 bp, Glycine max
  Peptide Sequence Number=SeqID_220309
tagtcagtttaccagcccagtgtccgatctcagcggcgctgattatgcatcagggtatcgcgggcggcggaaagtgctggttatcgccgccgatgaacgttacctgcctaccgataacggcacgctcttttcgaccggtaatcatccggtagagacgctgctgccgatgtaccatctgcacgccgcaggtttcgattttgatattgcgacgctctccgggcaaatggtcaagttcgaatactgggcgatgccgcgcgaagaccaaaagattatgccgttcttcgagcgttatctgccgcagttccgccagccgctggcgctttcagatgttgtggggcaactgggggccgatagcgactatgcggcggtatttattcccggcggccacggtgcgcttatcggcctgccggagagcgaagccgtcgccgaaacgctgcgctgggcgctgcggcacgatcggtttgtgatttcgctctgtcacggcccggcggcgtttctcgcattacgtcatggggagaatccgttaaacggttatgccatttgcgcgtttccggatgccgccgataaacaaacgccggatatcggctatatgcccggtcacctgacctggtattttggcgaagcgctgaaagcgatggggctggaaatcgtaaacagcgatattaaaggtcgtgtgcatcaggatcgtaaagtgctgaccggggacagtccttttgcggcaaatgcgctcggtcaactggcggcaaaagcgttgctcgacgaatatgcaaatcacccgggcggcccggaggttcttcagattggtgaaggcgacatcccttcggttggtgataacgacgtcctgatccaggtgaaagccgctggcgtcaatcggccggatatcttacagcggcagggcgtttatccgatgccggaaggagtaacgccgatacccgggctggaagtcgctggactggttgtggcggtaggagcgcaggtgacggattttcatcccggcgataaagtttgcgctctgaccaacggtggcggctatgcggagtattgcgcagtgccggcggggcaaacgttgccaataccgcctgggctgagttttagcgaagcggcggcgatacctgaaactttctttaccgtgtgggccaacctgtttcagatgggcagggcgcaacctcatgaaagcgtgctgattcacggcggggccagcggcatcggaacaacggcgatcctgctgtgtcatgagttag

SEQ ID NO: 103532 - DNA, 395 bp, Glycine max
  Peptide Sequence Number=SeqID_220310
gatgtcctggacattgtatccgacatcgtggatcctgcagcttttttcttgccttgtgcattgtgcagcaactccagtattttcgggcaggatgtcctggacattgtatccgacatcgtggatcctgcagcttcaattcttcatttgaccttttatcttgccttatcttcaaaccttgcacaggtttctaaagaagatcttatagtcagatctttcttggtcggtgctgttgtggttgcgtcctttggttaccgcaaagagcgtgatggatcttgggtaaaaaagggtgctcaaccaaatgatgatgaaggacaattaccagttaaaggggactcttctctccttcagagtattttggacaggtttgatggacttcaaacctatgttggtgaaag

SEQ ID NO: 103533 - DNA, 885 bp, Glycine max
  Peptide Sequence Number=SeqID_220311
atggtagaagaatttgaagagatcttaggatgtcctctagggggaaggagaccatacctcttctcagggttctatccctcattagctagaatttctaagatagtccaaatctcagcgcacgaattagaccacagaaagcaagtcgaaaatggggtggttggaataccgagaaaatatttggaggcaaaagcgagaatcttggtaggtaaaggcgaatgggccccgttcatagacattctcgcactgttgatcttcggaggaatcctctttccgaatgtggatgggttggtggacctagcagtgatcgacgcttttctcgcctatcataaccacaaggaaagcccggttgtcgctatgctagccgacctatatgacaccttcgaccggaggtgtgagaagagcagtacgaggattgtttgttgtactccagctctttatgtatggttggtttcacacctttttcgccaagaggtaaggcatgcttgcccgctagaaagtcatcattcatgcacaaagaaaggaggcgcaaattgggaccaactcttagcaaataaagaaggagcgtctatcaactggttccctcgatggaaagaagaaagaatcggggttcttatttcgtgcggaggatttctgaatgttcccttgatagggacgaggggttgcatcaattacaatcccgttcttgctataaggcaacgtggctaccctatgagaggggcaccactagaggaagagcttgcgcctgtcatctcacgaggtttcgataagaccaacgtgaagacacttcagaaaggtccgcaaggcatgggaggtggtgcaaaagaagggacaaagaactcaggggcagtaacaatgggcccattggtggctaccgtaagtggttga

SEQ ID NO: 103534 - DNA, 237 bp, Glycine max
  Peptide Sequence Number=SeqID_220312
atggcagagttgcacctagtgcttgacgtcgtcatccctttgaagttaaaggtgtcggatttcgacaagtacaaagggaccacttatcccaagaaccacttgaagatccttactggggcagccatcacatggtatagtaacttagaaccttcccaagtccattcttggaaggacccaatggttgccttcgttaggcagtatcaatacaattctgatatggctccggataggatgtag

SEQ ID NO: 103535 - DNA, 537 bp, Glycine max
  Peptide Sequence Number=SeqID_220313
atgaggggccaagacatgtatagtagccaagacgaggctactacttcacctttctctagtgaaagtaaagaagcaacaggggaagaatccaatgaggaaatctacccccaagaagaaggacaaccattaatggttaaggaggggtgtaaagaggtaagtgtctcctccaagaggttagctaagaaggaaagtcattttgcaataaagataaacattaaagaaacttcctctcttagacaacctccacattttctcctttgtcaaaagatacttgttagcactgccacacctcttgggcttgaggttattcctcaagtaaaggagttgttggatgagggtttggttcgtatgagcttaaatcattgtgctttgttggtgcccaaaataggtattatgaggcaccaaatccctatgataaatggtcgacaatggtgtttcccttgctcctacgtatcctcaggtgcgatgaggaaatcagacctacgtagttctttaaaagcaagaaagttatgcggagtgttgattttagacttttaa

SEQ ID NO: 103536 - DNA, 354 bp, Glycine max
  Peptide Sequence Number=SeqID_220314
atggataaatttgatatctttgtccctcatcctcttacagacgcatctttgcttattcaactttcaccggaatgtgggtgcaagccattggtctgtttgctcaagcgacctgtgctccgagtttggacttccaagaccgttcaatcagaaattactcgtgctacacatttggtgggggtgccaatcaaccgcttgtttcattctcccttgctacaaggttgtgaaaacaaaacaatgatggataccttagagccctacactggggcaatgaaaggcaccatgcataaacctcaagcgaacctaagggcagattataagttctcacccaatgggttcccagctacaaggtcatga

SEQ ID NO: 103537 - DNA, 784 bp, Glycine max
  Peptide Sequence Number=SeqID_220315
atgattcttcaaaatcttgacttgtctggaaattcattctcatcttctatacctgattgcctatacggtcttcatcgtctcaagtctttggaaattcattccagcaacttgcatgggactatttctgatgccctgggaaatttgacttctcttgttgaacttcatttgtcaaacaatcaacttgaaggaaccattccaacttctttgggaaatttgacttctctttttgcactttatttgtcatataatcaacttgaaggaacaattccgacttttttgggaaatctccgcaactcaagggagatagatttaacaattctcaatctctctattaataaattcagtggaaatccatttgaaagtcttggatcactctctaaattgtcatctctttggattgatggcaataattttcaaggagttgtcaaggaagatgatctcgcaaatcttacaagcttgacagtgtttgatgcatcagggaacaatttcactttaaaagtgggtcctaattggattcctaattttcaacttacctttttggatgtgacatcatggcagataggtcccaactttccatcgtggattcagtcacaaaacaaacttctatatgttggactgtctaacacagggattttagattctattcccacttggttctgggaagcacattctcagcttttgtatttaaacctctctcataatcatatccatggtgagcttgtgactacaataaaaaatccaatatctatccaaactgttgatctaagcacaaatcacttatgtg

SEQ ID NO: 103538 - DNA, 285 bp, Glycine max
  Peptide Sequence Number=SeqID_220316
atgtcattgcctagcgctgttcatgtgtcctccaccttcgagtttggagctatgcttcatgattgcctaagtgtggaccctcaagtgcaatcctccattctccacttttattcggagacccatgaatgtcattgcctagcgctgttcatgtgtcctccattatcaagcgcggagcctctgcaaaaaaaagaaggagtagagatgagaatcgtcatcacggagagggcaggacggacgaaatcaatgtcttatctttgctttcctcttatctccgatgagaggtaa

SEQ ID NO: 103539 - DNA, 388 bp, Glycine max
  Peptide Sequence Number=SeqID_220317
aacggactaaagcgaggagttcattggccatacatagtgaagggggatgggggtcaacctctttcatgacccatggccccattgagacacgtttttcggatatggattttttcgagatggttaaccacttttttaaccgtgagagggaggtcattcagaacccgctggctccagtccagaaccggtggaagttccccacgccgatcccccaacggcggctttccgttcactttccggaaattgaagaaatctattccagtgtcgcagagaacattatgtctcgcgatctggaaatatctgcggagatttctattgaaaccctccgcggatgggtggaggagataaaggagaaccctaatcccctaaaatccctcattagggaacacct

SEQ ID NO: 103540 - DNA, 657 bp, Glycine max
  Peptide Sequence Number=SeqID_220318
atgacaaataaactattcatactttctgttgcggctatctcactgacggcctggcaaaaaagaagctccaaaacaggatggtgcaaaaccttaccctctgctgcaaaggcaggtatcggtgctgccgaatcaacggtggctgctgcacaggcttcggtaaatgcagctcaggtggaggtgaataaacttaaacctctggttgctaagaatatcatcagtaacgtacagcttcaaacagcacaggctaacctggctcaggctcaggcacagcttcagcaggcggttgcttcaaaacgtcaggcgacagccaattacaaaggggtagaagctaatatcgaatattctattattcgcgcacctatttcgggggttgttggaaaacttcctttaaaagtgggtagcttggtaggaccaactgatcagactcctttaacgacaatttcagatacttccgaggtattcgcctatttttcgatgaacgaaaaagaatatttcaactttttggagaaatctgtaggagctacaatgcctgagaaaatcaaaaatcttcctatggttgatttacagctggctaatggaagtatttatcctgaaaaagggaagatcgaagctattacaggacaaattgatcccactacgggaactattcagttcaga

SEQ ID NO: 103541 - DNA, 201 bp, Glycine max
  Peptide Sequence Number=SeqID_220319
atggatatgacacagatgcaatttatgaatacgggaacccgggaaattgtccccttcttagatacaacgtttggggcagcacgacgctcgacgtatgtatttaagaaggtgacacagactcttcgttggtttgccaaagtgaggggatcaagacgaaaacccgcgcataatgcatatgcgaaaggggtacatgacacttag

SEQ ID NO: 103542 - DNA, 339 bp, Glycine max
  Peptide Sequence Number=SeqID_220320
atgtctggaaggcttcttgccagttcattggcattcgaatgccacatcatgcactacttggttgtgtgcatcctactccctagatcttccaaccttgcacagagatccttctctataggtgcaaatgtagtatcttccttcggttactgcaaagagagggatggctcttgggtaaagaaggatgctccagtacaggccgctaaagaccgctctccatcaccatattctcagagagatgactcttcatctcttatgcacaacattcttgaaaggtttgatggacttcaaacctatgttggtgaaatggtgaaaggtttgatgctttggggcatcccatga

SEQ ID NO: 103543 - DNA, 330 bp, Glycine max
  Peptide Sequence Number=SeqID_220321
atggttcgtaatgtatcgaggcgcttgaaattgaacaacagatgctctcgagaaattcatatggtcataacttttcacacagatgtcagattcgggcgcataatacatcgagacgctcgaaattgcacagcggatgctattgagaaattcaaattgtcatcacttttcacacggatgtccgattcaggcaaaaaatatataatgacgctcgaaattgaacaacgaaagctctcgagaaattcaaatattcataacatttcccatggatgtccgattcaggcacataatatattgagaagctcgaaattgaacaacggaagctctcgataa

SEQ ID NO: 103544 - DNA, 255 bp, Glycine max
  Peptide Sequence Number=SeqID_220322
atgggtacttccatacatcaacttgactcgatgaaccttttcgtaaaagcacgagcttggttcaaccccataacccaggaaatggcaattttgatcgccaatacttcatcaacaattcatagggatgaaagactcgggaatatgcatgcaataaatgggtttatgatcccaacatggttggctcatgaggaaaatacaaggatcatgtatgagcaaacatgtagaacaaaaagtatgttgaacgcatatgcatga

SEQ ID NO: 103545 - DNA, 669 bp, Glycine max
  Peptide Sequence Number=SeqID_220323
atggagaggtacgcttggggagtgcctgctttggtgcatatgtatgaccagctgaacgatgcatctatgagccacagtcggcagcttggaggttacatcacactgctgcagtgctggatttacgagcactttctgtcggtcacggactccactgctgatcaagagtacgacgaggattctccgcgtgcgtgtaggtggattgcgaccaagaagaccgtgaagagcattcgtacgccgtcatatagggagcacctggaccgactccggatttcggatgtctgttggatcccttatggggagcaccgggaggtccgagacttccacgtcaaatcatgttattccgatctcttgcgctgggggcctgttgctgtttattaccgaccggagaggatcgtgcggaagtttcactacacgcagaccattcctactcctcttgtcgattcatgggtctcgtatgatgatatacatgacaggtggatgcactacgaggatcatatcgttctagcagaccatgcattagatcctctgcctcatggtcacgccccgcagccccgagttgtccctcaggcctcacaaacagatatccctcacgtgtcggagccaagagcatcgtcgacatctacagaggagcctagacatgcagtggaagtttgtgatgacattgcttag

SEQ ID NO: 103546 - DNA, 291 bp, Glycine max
  Peptide Sequence Number=SeqID_220324
atggagaattggcaaacagcgctacgcaataacttcgcgggactccggactcgaaggtggagtacacatgaacaacgcaaggcaataaattcatggggctccgaaaaaagtggagaatggagaattggcgaacagcgctacgcaatgacttcgtggggctctgaactcgaaggtggaggacacatgaacagcgctagtggagaatggagaattggcaaacagcgctacgcaataacttcgcgggcctccagactcgatggtggaggacacatgaacagcgctaggcaataa

SEQ ID NO: 103547 - DNA, 441 bp, Glycine max
  Peptide Sequence Number=SeqID_220325
atgaggagaggcaagagtgaggcaaacactgaaaagaagaaggacactactccaaacgaaggcaagggagtaccttatcctttggtaccttcccggaaagagaaagaaagacatttggccagatttcttgacatcttcaagaaactggaaattactttaccctttggagaagcacttcaacaaatgcccctctatgccaaatttttgaaagatacgttgacaaagaagaactggtacatccatagtgacaaaattatggtgaaaggcaattttagtgctgtgattcaatgcattcttccaactaagcacaaagatcctggagttgtcacgataccgtgttccattggtgagcttgagataatacctacacgcatgacccttcagctagctgatcgctccatcacaagaccgtatggagtgattgaagatgttttggtgaag

SEQ ID NO: 103548 - DNA, 354 bp, Glycine max
  Peptide Sequence Number=SeqID_220326
atgggtgaagtagaggaggtgcaaaagcagatgaaggccgacatggaggccgtgaaagtgcaaatggccacaatgatggaggccatgatgagcatgaaggaaataatggaagccaacgcggttgcagttgccgctactagggctgttgctaaggtgaacccgatgcccccatttgatatcaatcaaatgaatcatccaacctcagatatggtgggcaaagatttgggaagtacgaatgaccccatgatgtgcaaattcaaaatgagcacgccttcccgccatatggctcgcctcccagtgagaatgtcaataactccactcctatacccattgagagccaaaaacccaaaatga

SEQ ID NO: 103549 - DNA, 255 bp, Glycine max
  Peptide Sequence Number=SeqID_220327
atggccgcagcaacccccacttctctgcggttcctcctctccgtttccgtaaccctaaccctgcttaacctcgccgcctcaaattccgaaggcgacgctctctacacgctgaaacggagcctctcggaccctgacaacgtcctccagagctgggatcccactctcgttagtccctgtacttggttccacgtcacctgcaaccaggacaaccgagtcactcgagtctttcctaattgttactgtctgttactttaa

SEQ ID NO: 103550 - DNA, 540 bp, Glycine max
  Peptide Sequence Number=SeqID_220328
atggtgttgatgatgatgatgaccatggtgctggcaaacatggctaaatcagagcttcactacgttggtggggacaagtctagttggggacctaatgttaacttgacagaatggtcaagtcatgagcacttccatttggaagattggctttacttaatgatgtgcttgcaagactttggatacgatagaaacgagtataatgtactagaggtgaacaagactggttatgagaactgcgtggacacaggatttgttcaaaacatatcaaggggtgcaggaagagacgtgtttcatctaacagaattcaagacctactacttcttaagtggaggaggctattgttggcatgggatgaaggttgctatatctgttactgaaggtgtttctgcacccaatccagccacttcaccaaaaggtggtgctcaagcaagttcgccaaaaagtggttgtgcttcagacggcattcaagtcaaccaaaaacttttggagttcatctttgtcttgatgtggagcatctcttcaattaacatcagttactag

SEQ ID NO: 103551 - DNA, 510 bp, Glycine max
  Peptide Sequence Number=SeqID_220329
atggcgaaatcagagcttcactacgttggaggcaacaagacaacttgggcagccaatgttaacttcacagaatggtcaagtagtgagcacttccatttgatggattggatttactttggatatgaaaggcacgagtacagtgtactagaggtgaacaagactagttatgagaactgcatagagaaaggatttattcaaaacgtatcaaggggtgcaggaagagatgtgtttcaactaacagagttcaagacttactacttcttaagtggaggaggccattgttgggatggggtgaaggttgctataactgttactgagggtgttgcttcaccaactcctgcaccttcaccaaaaactggtgctccaacaccttcaccacaaagtgatgttccagcaacttcaccaaaaagtggtgctccagcaccttcaccaaaaactagttctgcttcagatgacaatcggctgctgcaaatgtggattaaaatgaagaacaagaggatcgataagtga

SEQ ID NO: 103552 - DNA, 1881 bp, Glycine max
  Peptide Sequence Number=SeqID_220330
atggatgaccaaggatgggttcccatatccactgttgctgattttaaaagggtcaagaagatgagcacagacatagcttttatccttgatgcacttcagagctctaatactgttgaagtggagggtgacaaaatacggaaacacaatagttggtcgaaatggattcgaatttcctcaggaaattcagaatcatcaacagatcagattcaacagggcgaacttgtagatggtgctgtcaattctcttgagaatagtgatgctgttggagataagacaaaggagacttccgaagaaaatgataaagatgctgttcatgactcaattttggcagagcataatcaaccaaacaaggatatgttacaaatttcatatatggaccaagaaaaaaatactgagagccatcattctaatgataaatcacatgaaggtgtcaaattctgtgattttgacacagctaataataatttatgtagccaacaagaaactgagcccaaaatatttgacaataatgaagctggaaacatggatgtattgaatgaaatggatgtccgagacctttccaatgattttgccaatacttttatgctcgatgaagagatagagcttgagcaaaagatgctaataaagaagactgaactttcttctagtggaaggaatgatgatgaagatgatgagatggctgtcattgagcaggatgttcagagactagtaattgtcacccagaatggtgatcctaaacaaggatctagaggtggtgttaaagaatcaatatccatctccaatgagcttgcttctgcaataaatgatgggctttacttctacgagcaggaactgaaacataggcggtctaatcgtagaaagaataactctgatagcagagatcgaaacataaaatctccaagccataattcaggtgcatcaaatataaaggtgtttgagagtattggtggaaacagtgtcgaagagtctggaagcaataattctcgaaggaaacataaagtttttcacaagcaaccatcgtcccttaagcagcggtttttctcaagtaattttaaaaatcacggaactggtcgaaactctaacggaatcatatctgaaagcccgcctagtaattcggttgggtttttctttgcttctacgcctcctgaaaatcatggtttcaagccttccaaattgagcagttcaccacatgggggcctttctggtagttcaccacatggggttttttctggtagtccacatggggttttttctggtagtccacatggggggttttctggtagtccacctgtgggttcaatgccaaagtcttttccaccgtttcagcatccaagtcaccaacttttagaagaaaatggtttcaaacaacagaagtacttgaagtatcacaaacggtgcttgaatgatagaaagaaacttggaattggttgcagtgaggaaatgaatacattatacagattctggtcctattttcttcgagacatgtttgtgccttctatgtataatgaatttaagaaattagctaaggaagatgctgcggctaattataattatggtatagagtgccttttcagattctacagttatggtttggagaaggaatttagagatgatttatacaaggattttgaacaaacaactctggatttctaccataagggcaatctgtatggcctggaaaaatattgggcatttcaccactatcgcaaggtccggggccaaaaagaaccattgaataaacaccctgaactggacaggttgcttcgagaagagtatcgtagtttagaggatttccgtgccaaagagaagaatgtgagttttgatggcatccccaattttgatgagaactctaacaacataacaatacgagttgtggagtag

SEQ ID NO: 103553 - DNA, 594 bp, Glycine max
  Peptide Sequence Number=SeqID_220331
atggttacttacgaagcagagaaggatgtgagctcaccattgaagactgttgaggaggaaaaggcagatgaggttattgatccattgggagagttggtgaagaacttgttcgacatttaccaaaggcctgttgaggtgtcatgggatggtgctaaatttgggatcaataatgtcaaagatggcttcttcatcacacacgctgatgtgagcgagataatattaggagacaagtgtttaaacatctccattctacagctatggcttattgcgagcattggttatggatcattgtatgggttccttgaacctcagtgtatccacaatgcaagcagtagacgtcaagagtgtgaaaattacattggaaggtggttgaaggaagtaggaaaacaaatttacatagcaccttatttaaaccaggcccattggcagctcgttgtattgtgcccaggcgacaatgtagtggtttggttttgttctttgaagaagaagccggatgctgccatcaaaggtgcagtaaacagtgcaatgaaatcagtcaccaaaactgcagagggaaagccacctcagcatgggcctcagtggattgaagcaaag

SEQ ID NO: 103554 - DNA, 1289 bp, Glycine max
  Peptide Sequence Number=SeqID_220332
atgggaaacgctaacggcagagaagacggatccattccccccgccgccgccgatccctccgccgccgcacgtggaactcacgcgccgccggtctctctccctccggttcgcgccttctcctccgattcaatggccaatagcccgccgcacagccctcgccgctccagatcgccgatcctcttcggtcctcagctagggtggaatttcggttttgtccggtcaacgaggttattcgtcgattttgctttccgtgttcggttgttgaaacgaaacgtgttgttgaacggatctggtaattttgttgttgatggattggttctttcctgcatggatcgtcatgaacgtggttcagatgtttggatatgcgttgtggatggcagaatggatggtgtggatctcgaagattatgaactgcttattctttttgaaactccaacttatgatattcctgtggagtttcctgccaatccacattctggaacgctggcacacccttctgtggtctctgtttacatcctctgcgttctgttctgttcatgtcaaagagggtctcttgttgttagtaacttctgtggtatggatatgcaacagtggtcattccactttctgctatcttgttatagtggttttgtggttcctctagctccattacaacgaggtaatggccctccttttctcaatcaaatgtggcagaatgagtctcatggtattgttaatcaccctcctgagcaagggatccctgtcatgattacatggaactatggtggtaacaatgtggctgtggagggatcttgggataactggacatctaggaaggcattacagcgagctggcaaggatcactcattccttatagtccttccaccaggtatatatcattacaggttcattgctgatggtgaagagagatttatcccagagctacctaatgtagctgatgagatggggcatgtctgcaatcttcttgatgttaatgattatgtgccagaaaaccccgatggtgtgtctgagtttgaagcaccaccctcccccgaatccagttatggccaagcatttccagctgaagaagactttgcaaaagagccaatggctgttccttcgcaactgcatcttactgtcctaggtatggaaaactctgacataggttcctcttcaaagccccaacatgttgtgctaaatcatgtcttcatagagaaaaatttggcctcaaagtctgttgttgccctgggactcactcacaggttccagtccaaatatgtgacagttgtcctttacaaaccgctcaagag

SEQ ID NO: 103555 - DNA, 366 bp, Glycine max
  Peptide Sequence Number=SeqID_220333
atggaaaagattgatgactctctcaacaaagacagaggcatcatcatcgcagaggagaataaggatccaccactgagtgattcaatggaaaagactgacccctctctcaataaagacgaagggattgcaaaggatgcagatgcgctactgagggaaatggaacaagacctagccttccttcaacgtccacggtctccaactagtaatggatacttggaggctgtggtaatcaacaagaaacggaaaattgaagaagtagaaaaagaaatggagatacctcaacttcctgagtttgaggaacctccacggagcttcgggggattggatgatatagtcaacttggcaaaacagcataaaaataattag

SEQ ID NO: 103556 - DNA, 270 bp, Glycine max
  Peptide Sequence Number=SeqID_220334
atgggcccgaaatctaccctaaggctcatgagaaccctagggccttctcttgcatctctggcccaatctttttggagtcttctatccaatgcccttgggggtaggattgcatcagagaagggaaaccctagaagaggatcagcgagagatgtgctcgcccagcgccccacaagcttgccccacgagtcatttgtctcttctcgcgctcagtgcgctcagctcgctaagccaaatttcactaactcgcgcttagcgggccagtctcgctaa

SEQ ID NO: 103557 - DNA, 409 bp, Glycine max
  Peptide Sequence Number=SeqID_220335
atgtattatcctggtcatcaccaacatcaatcatatgtagaacccaatgtacctccagtgcatgttcttggatttatgtcccaacatcatccatcacaagcacaatatcaatcaacaagtttttctagtcatgcgtctcaaggatgtcaacaaagttttcaaccactggggttcttatcatgtatacctcaatactcatttcaagtcccttctacctcaaatgttttttatggctcctcacaaatgtttgccaccactttcaacactccaccatctacatataatcttgcatcatcgagttcttgttatcgtccatcattacctactcaaatatgttacatgagtcacgaagatgaggacgagggtgaggataacaacaataacaacgatgacgatgacgatggtgatg

SEQ ID NO: 103558 - DNA, 402 bp, Glycine max
  Peptide Sequence Number=SeqID_220336
cgtctgctaagcgcaacactcatgggctaagcgcgaggaagaatctggaagaagatgagctgtacaggttcattaagcataccgctccaggtcatcaagcgcaccgcttcatctcatccgctaagcaagagaagcgcgctaagccaaaaatcactaacgattcagagctttgcatgtctagggtttctagagagaaaaaggtccaagttccagagagttttgagagatttttccgtgtgaagatctatagagaccagagcttgaagcaagagccagcttcctggtatggaaagctaaattctctgttggatcctccctggtcattcaacagtggaaactggtttgactctaaagtccttgatagtgcagggatgagttgtcgtgctttcacaaggaatcaag

SEQ ID NO: 103559 - DNA, 222 bp, Glycine max
  Peptide Sequence Number=SeqID_220337
atggctcctcatttctactccaaattgcaaggagaagccattttcggagtcgtaaagcacacctctatgttgtgggacttcgaatttcaggtagaaaagtgggagattttgagggttagagaagccaaatttggggttagtggaaattggagtctaaagtgggttgattctagtttaaaatgtcaattaggacttgtaggaaagcttgggaagagcaaatga

SEQ ID NO: 103560 - DNA, 1491 bp, Glycine max
  Peptide Sequence Number=SeqID_220338
atgagtcagcctaagattaaacgccgagttggtaaatacgaggtggggaggaccattggtgaaggtacatttgcaaaggtgaaatttgcaaggaactctgagacaggagagcccgtggctcttaaaattcttgacaaggagaaggtgctaaagcacaagatggctgagcagttgctttatagtttagactctgacacgatgaagtcaagtctcttagatgtttttaatgcatctttgcagatcaggagagaagtagctacaatgaaactaatcaagcatccaaatgttgttcgattgtatgaggtcatgggaagcaagaccaaaatatatattgttttggagtttgtaactgggggggaactctttgacaaaattgtaaaccatggaaggatgagtgaaaatgaagcacgtagatatttccagcagcttataaatgctgttgattattgccatagcaggggtgtctaccacagagacctgaagccagaaaatttgctattagatacttatgggaaccttaaagtttctgattttggtttgagtgccctctcccagcaagttagggatgatggacttcttcatactacatgtggcactccaaattatgttgctcctgaggtccttaacgatagaggctatgatggggcaactgcagacttgtggtcatgtggggttattctctttgtattggttgcaggttacttgcctttcgacgaccctaatcttatgaacctgtataaaaagatctcagctgctgaatttacttgccccccatggctttctttcactgccaggaaattgattacacgaatcttggatccagatcccaccactcgtatcactatacctgagattttggatgatgaatggtttaagaaagaatataagcctcccatttttgaggagaatggggaaatcaacctcgatgatgttgaagctgtctttaaagactctgaagagcaccatgtgacagagaaaaaagaagagcagcctacagccatgaatgcatttgagttaatctccatgtccaaaggactgaaccttgaaaacttgtttgatactgagcagggatttaaaagggaaacaagattcacctcaaaatcccctgcggatgagataatcaacaagattgaggaagccgcaaaacctcttggctttgatgtgcagaagaaaaattacaagatgaggcttgcaaatgtgaaagctggaaggaagggaaaccttaatgttgccacagagggactagaaagtagcaaaaagttggtttatttggtgatgtgggacactatttgtcacattattgtactgaaatttgaacgtactcatcataaacagatatttcaagtggcaccttctcttcacatggtagaggtacggaaggcaaaaggagatacattggagttccataagttctacaagaaactttcaacaagcctggatgatgttgtttggaaaacagaagatgatatgcaaatgcgagaaacaaagtga

SEQ ID NO: 103561 - DNA, 519 bp, Glycine max
  Peptide Sequence Number=SeqID_220339
atggccaaaggtcatcatctactacttcagaagcaaagaaaccactttcagctttgtcaaacattctgcgcgctgtttggaggcaaagaaaccaattttctgcgtccattaagtgattttgggttcagtgattggagcaactgggaagcttgtggcataagcaaaggaacgcctgtgagaatcagaggggccactgctggcaatgtcattggcgtgaatcctttcttgaaaagtattgaagcagttgtagaggttggtgatgataaaacagttatatcacgaaattcattgatcaaggttaaccagtcaggtcttcttatggaaacaaaaattgacatcactcctcgtgagccaattccaacaccttctgttggccctcttcaccaagactgtactaaggaaggtcttattgtgtgtgatcgtgaaaagatcaacagtgaccaaggaacaagtttggatacattggttggaatatacttcggccttgacagcgacagagaaaattggcatcatcaatag

SEQ ID NO: 103562 - DNA, 448 bp, Glycine max
  Peptide Sequence Number=SeqID_220340
tgaactagcagctaaaagatactttcatggcgcaggtagtagtgacaagagagttaatgctgacattgacattgtaccaggaaaaagcgagaaacaaaatctagaaaatccagtgacttcttcatgtgaatacaagttacctcttgtgtggattgacttggaaatgactggtttaaatatcgaagtggacagaatattggagattgcttgtataattacagatggaaatttaaccaaaacagtggagaatttagaatgtgagtttgagcctaactcaaccccaaaagctagctcaaggggtgagggttacccctcacttatatactttaacttggctttatttatagacgatatgggacttgagttttttccaatacaccccctcaagtccagagcacttcttggacttggtgcgtggataacaatggtgggtgatcctttggattaa

SEQ ID NO: 103563 - DNA, 251 bp, Glycine max
  Peptide Sequence Number=SeqID_220341
ggcatctccgcatgtcatcggactcgctgtctctggatgacaaaggtgcagatgatgacgttagtctcggcatgtcaaccggctcgcttgcctctggtgcggataaccataagaaaagcgtttgtacggataaccacttaggtatctccgcctgccacctgacttcacgggtcaggattaacagaaaagcgtttgaatggataaccacttgggtttctccgcatgtcatcggactcgccgtctctggatga

SEQ ID NO: 103564 - DNA, 357 bp, Glycine max
  Peptide Sequence Number=SeqID_220342
atgctcaatggaatgccccagaactcccccatgataagcacatattgcattcgagttgtatccttggaaaaatggaggttgaggaatctttgctggggttatgaatgccatgacattatcaagcaaataagggagcaagtcagcatacaacaccaaaattggggtgaattctacggtcttcttttctggaaaattccttccccagctggtgttttgaaggcgggccttggggctgatttaggggtggcctttgtggatgattgggtgttcttggctgatagggtggtgggtaatgagaaaggccgatattggctgagtattgacattattaagctagtgggggattttgccatgtag

SEQ ID NO: 103565 - DNA, 870 bp, Glycine max
  Peptide Sequence Number=SeqID_220343
atggcgggtgggagcgtcttctgctccacttcttcttcttctaatttaacaacaaccactcagcctcctctcgattctcttttcctctctgcctcttcccctttcctcggttcaagatctatagtgagttttggagatgttcaaggagggaaggggtgcaatgactcgttcttcagttcctacgatgagcatggggatcatgaggacatggacgagtacttccaccagccagagaagaagcgcaggctctcggtagagcaagtgcggtttcttgagaagagctttgatgaggagaacaagctcgaacctgagaggaagattcggctagccaaggaactcggcttgcagccgaggcaggctagctacaatgatctcaaggccaattatgacaaccttctcagggaaaaggttaagctcaaagctgaggtggcaaggctcactgagaaggtgcttggaagaaagaaaaatgaggggaacttggaacaggctgaaaccaacggattgcaggagccactgcagaagtctttggctgattcagcctcagagggtgaagggtccaaagtgtctattggggcttgtaaacaggaggacattaattcagccaagagtgacatatttgattcatcagaaagcccacattgcactgatggaatccactctgcacttctagagacaggtgactcttcttatgtgtttgaacctgatcaatctgatgtgtctcaggatgaagaagataacctgagcaagacccttttgcctcatttcatctttcccaaacttgaagatgttgattactccgacctgcctcatggttcatgtaattttggaattccggaggaggatcaagccatttggtcttggccttactga

SEQ ID NO: 103566 - DNA, 747 bp, Glycine max
  Peptide Sequence Number=SeqID_220344
atgagccaaggtccgggcttatattttgatattggaaagaaggccagagatgttcttcacaaggactatgctcaacaatcaccaatccactttaactacagattcttgaactggaatttagatctctcctgtcaagaagaactggtgcatggactaaggggccttttcacatgtaacatacctgactctgggaagttggaaattcaacacttgagtagattcagtggatttagtgcaagcattggattatcgggagaggcagaaaaaggatataaccctgttgcaaacatctctggtcatataggaaccagaattctcaccctgggagctaatcttgcctatgacttatcagcaagctcatcagcaaagataactaacaatctgaatgctgggttgagcctgaacagtccctaccttgttgctgccgcaaccttgcatgacaattttcaaaccttgaaaggttcctgttattttgaagtgaatcccctgaccaagactgcaattgcagcagaggtgaagtatgaccttgcagattatgagactatcggtgtcaccgtgggtgctcagcacgcattatttccttggacactgctaaaggcccgacttaacaacaatggcaacgtaggtggtctcattcaacaaaagtttgggagaaaattttccataaccgtggcgggagagatgaattttaacgaagaagataaagaaaagtttcctaaggttggagtctccatggctctaaaataa

SEQ ID NO: 103567 - DNA, 813 bp, Glycine max
  Peptide Sequence Number=SeqID_220345
atggccagtgaggcagaattcaggaaggaggaggtgacccttcaagttgatggttccactggccgtataattgtgaaaggcgaaaggcaaacaaatgaacagaaacgagttcagtttgagctggcctttccattgcctccagattcagatgtggataacatatccggaaactatgacagtgaaatccttcacgtgcatgtccccaagcaagcttcacatcaagagcacaacaaagaaagtagtgatatagagaaagcttcaaattatggcagtgttgaaatgccacaagaaattgaaagtgaggaacacaatgttgttgatgagggaaggaatcatggtcatgaacaacataaggaagatagagagaagaagaaagaaagaagaaatgaaaatgcacaacacatggatgattattattctaaaaaattgacaaggaaattgattatcattgctaacaactgcccccctttgaggaagtcggagattgaatactatgctatgttggcaaagacaatgtggatttgggcactgcatgtagaaaatattagagagtgtgttgccttagcattattgatcctggtatctgatgtcatgggagctatagggcctaattgtgctgttaagaataatagttttgagtgcattgagatggaaaggaaaacccttcttaagtttaaacaaagtctaaatgatccttttcattgcctatcttcatgggttggcagtgattgctgcaaatgggtgggtgtaagatgcaagaaacacacaaggaaagcccttcttaagtttaaacaaagtctaaatgttccttaa

SEQ ID NO: 103568 - DNA, 336 bp, Glycine max
  Peptide Sequence Number=SeqID_220346
atgggaggaactgaagagaatgacaagcatgaggctgaagttgagaaggagcataagaaggaaaagaaagagaaatccgaggatgctggaaaagaagaagaaggagaagaatctaaagagaagaagaaggagaagaagaagaataagaaagacaaggaagggaaagagaagaaggagaagaaccctgaagataaaaatgatcctgcgaaattaaagcaaaagcttgaaaagctagagtccaagatgcaggctctgcaaactaagagagaagaaatattgaagcagcttcgagaagtagaacaaggtgcaagtgagccccctgtggcctcctcttag

SEQ ID NO: 103569 - DNA, 435 bp, Glycine max
  Peptide Sequence Number=SeqID_220347
atggatggatgggttacccttaatacagatggctcttctacaggaatcgatgaggcgagcagagcaaatgcattcattgctgaactatggggtgtttatgaaggtttgaagttggctcagaatagaggctttaaagttgttattgttcaagttgattcccaagttattgttaacattcttaagggaaagaaggatgggagtgctcagggctggtcacttgttaggaagattcgtttgttgtttagtgctgattggagaacaaaggtgtttcatgtgtatcgggaggctaatatctgggcgcatatgttggctaagatggcgataaacttggatggtgagtgtgtgatgtttgagcatcctcaggttgaattgtctcagctgttggaagctgatagaaggacagtttctactctggatcatttagttgctctgtaa

SEQ ID NO: 103570 - DNA, 219 bp, Glycine max
  Peptide Sequence Number=SeqID_220348
atggttacccgcacctttcatcaaccaggggcaaacgagcccattgacgtgcagagactaacatcgtcttctgcaacttttgccatccaaggacaacgagtcaggtggcaggcggtgataccttatggtcatccgcacctttcgtcaactgaggggaacgaattcgacgttatcaggatgatgttggtcattcggttccgttggtgggtgaaattctga

SEQ ID NO: 103571 - DNA, 449 bp, Glycine max
  Peptide Sequence Number=SeqID_220349
tccctatcgtcgcattgttgttacctaagaggatgatatctttaaaggctggtgatgcattgtcgttggtagtccctatcgccgcattgttgttacctaagcggatgatatctttagaggctggaacaaatgaaaacaatgatggaagcgatgatgaacataaggaagatgaggtcaacattgctacaactgttgctgccagtattgctactaagagggactcgactcacccacttggtttcaatcaagagggtcatctagtctcagatgtagtaggtcaaggagacgaggcaacatcaaatgcatatgggccttattatgtccaggtccaaaacaagtcttcctttccattgtatggtttgcctcccaattgtacaccactcactgttgtgtacgctcttagtgaaaatatcggtaatcttgcacctgtatccattgagaatcaataa

SEQ ID NO: 103572 - DNA, 228 bp, Glycine max
  Peptide Sequence Number=SeqID_220350
atgggtaatcatgaactgaaaaagaagcctcagagatcttggtggataagaatcatcaaatgggcgattcccatcaagagtagcaaatattttctagcatcaccggtcttcattaacaataaaaatctgctgaaggaagggaaagcaactgcagtagaagaaagagatttacagaaagggcttcagttagggtttggggaagtaaccaaaggatcgtcagatttttag

SEQ ID NO: 103573 - DNA, 231 bp, Glycine max
  Peptide Sequence Number=SeqID_220351
atggaggtgtatttcaagtctccttcccttgaaaaaacagaagttgggcctcaagtagaagaaaacatgcactttcacaactctgttcaggagctaagagaattgaagtctcaattgcaccatgctgcagattattgtgaaacaactttcttcaaaagtgaagctaagagagatttgctatcaggttcaagattcattttccctatggtggtccatgtagacaagacatga

SEQ ID NO: 103574 - DNA, 1167 bp, Glycine max
  Peptide Sequence Number=SeqID_220352
atggctaagaagcttgactttaagaacattcaatcatctaagaccaacgaaaatattcctattgtacatagcaactggaaagatgtaccaaaatctctaaaggacctagtatgggatgacattttggtaagtctagtaatagatgcaccaaatgccaataagaagttcatgtcaacggtggtgacaagatggaggcaatttaagtctaccttgaccagcaaatttgtgtatgctaacactgacgggaaacaaacacaagatccttcatcaaaatatgatcttgatcctgaaacttggaatgaatttgctgcaacttgccagtcacctaactgggaggtggctcgcacgaagccttatggccatatgacatctcagtcagcacaagaaatatctaataaaataggtagctttgttccccatggtcgtgacgacatactgaacactgccattgggcaactggaccatgggggtcgtgttcgtgcaacgaggtctagtgtgaccattattcaatactatagaagggcatcacgtggctccaacaactcctccacatccgggagtaatgctaaaactagtgtcaacccatcaagggaagaagatgttgctgatgttataccgactatgggattgtatgtgcaacatgatcattctacacacttggtggccttgggaaaaatatataaggagaggtctaccatacacagtgtgacttatgcatatgacatggtccttgacacattcattgcattatggacacaacttgtaaaacttgtatcacatgagttcaagcttgggaagattccatgtatggattgcttgagcctcagtccttacataatgcaaaggatagacgtggggaatgccaacaatacattgaaacatgggttaaggaatcccaacgagagggcccattggcagttggttgttttgtgtcctatacaagatgttgtcgtttggttttgttcgttgcgaaagaagccttatattcatgtcaaagctgcaattaacaatgcaatgaacacattaaagactactttgcatggtcatactaagcaagctgcacctgagtggattgaaagtcacgttcaaaccgaaggctatgagtgtggctattacgttatgcattggatgtggaacatagtaagcggggagttgaagactgattga

SEQ ID NO: 103575 - DNA, 783 bp, Glycine max
  Peptide Sequence Number=SeqID_220353
atgactatggcattgaaagagaccattaaaatagagttgtcacaaaaaggatcctcgggcttacccccaattgagctggacatacaacaattaggtgctcgtgtcagcataaagggaagtaatgctgaaaccaatgtgcacccttcaggggaagatgatgttgatgtcataccaagtatgggattgtatgtgcaacgttatgatcgtacacacttggtggcattgagaaaaatattacaggggggttccaccatacacagtgtggcttatgcatatgatgtggcccttgacacattcattacatggcccacacagcttgtcaaagttgtatcacatgaggatgcacaaattactccatacaaagtggctgcacatgtgccaacaccgactaatgtggacgcagatgattcgatgcgtgggatgataaagttgagttttgatatttacgacaagccagtagaaatcaagtttgatgggagtaaatttggaattgtagatggagctacatcgatattcctaacatattctgatacgagttcgtctggtgatactaagccaactgcacctaagtggattgaagttaagagtcacgctcaaatcggatgttatgaatgtggatattacgtgatgcattggatgtggaacatcgtaagcggggagatgaagagtgattggtccctgtggtttggtgatgacaagtcattggacaacgacaccatcacaacaattcggaagaaatgggcaagttattttttaaagaatacagacattggccgggtgtaa

SEQ ID NO: 103576 - DNA, 330 bp, Glycine max
  Peptide Sequence Number=SeqID_220354
atgatagaccagctttttgtaggtagtgctagagtaggtcgcattgtcatggctgctactgtaaaacatcttactccaatgattctggaacttggaggaaagtgcccaactgttgttgaatcagatgtcaacttacaagtagatgccttaaaagaagaattggaacaatattttggtaaagatcctatggagtcaaaagacatgtcaagaattgtgtctccaaaccagtttgtgaggcttgtgaatctcttagatgaggataaggggttggatgaaaatgcaggtccacagatcataaagttgtatgctaaggtggttcatattttctaa

SEQ ID NO: 103577 - DNA, 1437 bp, Glycine max
  Peptide Sequence Number=SeqID_220355
atggatccttctcagccaaaccatttcaatgctgtaatagagaagattgaacgcctttacatgggtaaggatagtagtgatgatgaggatctgcttgatgtttctaatgatgatttgtatgatactgaagactcttttataaatgatgctgaactggccttgctctcagctcacctcattgttggtcgtggttcacaaacgaatgctccagggatcaccacaacattagagtttgatgcaacttctgtggcggctggtattcctctcctgacatatggtcacgaggatgttgggatttctgctgataaacaagattattcccctattcatgcatcacgggaaacaggttcatccaatgcctcccgattcatctgtgccaggtatgagaaagaaggaaagccatctgaattagctgatatagacatttttgatagtacagtagatcctatgaaagaacctccacttctaactgctaatatagtaatatccatccttgctatagattatccagtggagaaagtttcatgttgtgtcttagatgatggtgcagctatgctgacatttgaagccatttcaaagacttcaaagtttgcaagaaagtgggtttcgttctgtaagaagttcaacattgaacctcaggctcctgagtggtattttgcccaaaaggttgactatctgaaagacaaagtggatgcaacattcatcaaggagcatcgtgctattaagagggagtatgaagagttcaaattacgtatcaatgcattggttgcaatggcacaaaaggttcttgaggatggctggaaaatgcaagatgggactccgtggcccgggaacagtgtcaaagatcatcctagaatgattcagttcaactatgatgcacttgcacaagttttccttggtcaaaatggtatttataatattgaagggaatgagttaccttgtcttgtctatgtgtcatatgagaaaagaccaggatatgaacaccacaaaaaagctggtgctatgaatgccttggtgcgagtctcaacagtcatattaaatgctccttacctactcaatgtcgattgtgatcactgcataaacaacaacaaagcactttgtgaagccatgtgcttcaggatggatcctacatcagggaaaaaaatatgctatgcgctctatggatatgatgcccctgctacgaagaaaccaccaaggaaaccttgtaactgttggcccaaatggtgctacctgtgttgtggatctaggaacaagaataggaaagtgaagtcaggaccttggaaaacctcatgtagtgaggcacttaaagagctgaaagaatggatgaagcccgagaaggtgaatacttcaatcacaatatatccatcatcagtagagattgtgccagaaccactaggggttgtgctggtcatctcaacatggaactttcctttctga

SEQ ID NO: 103578 - DNA, 453 bp, Glycine max
  Peptide Sequence Number=SeqID_220356
atgaagtacatacctggaaaggtggtcattaacaaaagcaaggagtgtgaagatggcactggtatggtgttcacaagtatggactcaaccgatatttttgtcattcctttatggaggggaagtggatacacgacaatgtttgttcaagtccagacgccacacatggtttctacaggtcttgaagattacaaggccaggggaacacaagcggctccttactttattgtgtccttttacacagaatttgcagagagcaaggacttggtactgatccgtggggatgtcgtatttaccagcaagcttactgactcggaggcaaaatggcttttggaagctgctcagtctttttatttgaatgatgctaggtacaaactggttgagaggttcaagagacaaacacatgattttgagttcaaagatgtcttgcaagtattggacatgcctattttgtaa

SEQ ID NO: 103579 - DNA, 177 bp, Glycine max
  Peptide Sequence Number=SeqID_220357
atgtggactaagtttggatgtgagagaagtgatagggagatctcatggaagtgcaaaaaacatattctacgtcggttattacggacattctacgtcggttctgcatcgtctttgaagccaccgtcattgaaagcaaagactttcgatgatggtcagtcaacaaccatcttagaatag

SEQ ID NO: 103580 - DNA, 195 bp, Glycine max
  Peptide Sequence Number=SeqID_220358
atggatgccgccagaagaactggagacataggtgttgctggaggatgccgccagtggcacaggcgagacatgctgagctggagggtgtcgccagtaacacaggcgagacatgttgacatgaagcatgccgcaaataagaatggcgggacatgcaacgttttaaaaattttactagatggcaacatgagagtttaa

SEQ ID NO: 103581 - DNA, 378 bp, Glycine max
  Peptide Sequence Number=SeqID_220359
atgcccctcaaggggacggcattgacctggtacgatggactcccacctaggtccatagacaagttcgacaccctcgttgaccgcttcaatgggcattacgcaaccagcagatctcaccacataacctcaactgccttggtcagtctgcgacaagaagacgacgagtctcttagaaaattcatggacaaatttgggcacacagctatccagatctggaatcttaaccccgaggtagcgttgcattccatccttaagccccgacaagttcgcgaacaatccgtgcaaaaagccccaagtagcatgggcgagttatgcgagttagcgaagggctacatccaaatggaagaaatgtccagatttaggaatgaagtccgataa

SEQ ID NO: 103582 - DNA, 177 bp, Glycine max
  Peptide Sequence Number=SeqID_220360
atggcgtcgtcatggttgagtgatttctactgcaagggtatgtcagcctgcataatgcagtcgatgaagggatgccgacaggtggtccgccctgctggacggtgcatgtgggagaaacttaagtcatctagagtgttgactatgtgtcacgagtgtgattccccttgggacgtctga

SEQ ID NO: 103583 - DNA, 1926 bp, Glycine max
  Peptide Sequence Number=SeqID_220361
atgccactgcgagccactgcgagctcttgtacgtctatctgcactcaattcaactcggagcttagggctcctgaacttcacacgtcgatttggagagacacatttgttaagagaacaggagggaagacctgcaaaacaaaggactatgacgctcaagctcgagaaagcgatagagagagaaatgtgcacaggcttgctactcgtgtgctggtgtattgtgttgagggttcgatgaaacctggagagtatctgaagtccggggtaatagtcttgacaagtagagggcaacaagtcgatgtggcttgtcaagccctcgagcctggacaagtgttgtccgggttgcttttgtcaagttatctgggatgggcatgtctttggtgtgtcaggtattcattttctctgacaatgtcttcattcttgtttgattccttcattggcatggatgacggtgattctaggggctcaattgaacaacccatgatcaaccaagaggtcatctctattggtagttccttgtcgaaggatactcgctgtggtgcctccgacaacgagttcttctctttggagaggggtgcgaccttccgctattgttggggagcctgtccctgttactgtgatcctcatctcttatgcttttggggtgtgaggagaggtagcggcagtggagatgtaaaggcgtctccccatgtgcgacatagccatagaactgggtcgtcgtcatccatacttgtcatggttggctatgcgtgggtgaaactggcgaaccttgaggactaccgcaagttggtcgttcaggcttgtgggaatgacaacttccctttcttagaggcggcgtcgggcacacttggatatgtcctcttctcaactccacccaaacagttggccaatgctgactggcaagattggttgggtctccttgaacagcatttccaagaagctgtcctatctattgatgtcttggttgatggtttgtcactgatgttcaacagggacaaggagccccacttcccattctataggcagtttaaccctactaggttcaagtcgtttgacgaggatctactgacccctgtggagagggtcgacgaggctattttggagcagctatcgaccttgctggacacgcgggccattctgtctcttccttcggtgggacctacgggtggggctttgccaccacctgctgctattgctgctgccggagaaggggggttgatgcccggtgcgggtcgccctttgatcgtgcaggatgtgccttcagctctaccaattatcgaggctcctgctgccactcttgatgttgctaaagttaatgtgccaactactttggctagttctattgtggcaccatcgtccaccgttgttgcacctttgctaagtgccgatgtggcaaccactagggcttatgtggtgctacctccttattctttagctccaatgagaagtttggcgattctggaagagaatgaactacgacaccaggaggctttgcacaagtggcatcctcggaggaggaggttgccaaatggagggctaacgtcatcatcgcctttgttgaggttggatggtgttgaattgtttaaacgttgcaaggacttgcagatggagaaaaaatactcggctgacaagctgaagggcatacgacgaagagggatgagcttgctagaagagagagaggccaacaaggagcttgaggaggagctactcgtttacaagaaggagtccgtggagcaacatgaaaaaggatttaacaaggctatcaagcaggttgggttcttcactaaggaccttgacttgggtctctttgaccctttcaaggatgtgaaggatggtgtcttgcttgacaaggaggattttgttgcggaggagaagattgttaatgaggagcagggtgttgcgaagcaaggcaatgatgcccatgtctag

SEQ ID NO: 103584 - DNA, 243 bp, Glycine max
  Peptide Sequence Number=SeqID_220362
atgatccctgttgaagtcgaggaacaatcgacaaggagactactattccagaaacaacaaaataaagaaaatatgagagtggaactcgaaaccatagatgaagtccaagaaacagtaaggatcaaggaagaagttgccaaactccgagcagcaaggagatacaatacaaaggttcaatcacgagcctttcaacctagtgacctcatatggcgagtccgaggtgaagccaaaaaagatacttga

SEQ ID NO: 103585 - DNA, 324 bp, Glycine max
  Peptide Sequence Number=SeqID_220363
atggtcgtcgaagttgctgtgagtgagctgaaccaagggggtaccttgggttttgtaggagtgcataccaaaggcgaaccttgggtttttgatagacttaaaagatcattaagggcagagcttacgtacctagttcctgtgaagatggaacttagtaatagaaagggctcaccaatggtgaacattgggtttgtcaagcctcagaccgagaacgtgtttgccttgggttttctcatgcctgtggagctgtgtcgaggcttaccaaggacaagccttggattttatgaacctatgagggtcaccaagcgcggaacttgggtttaa

SEQ ID NO: 103586 - DNA, 768 bp, Glycine max
  Peptide Sequence Number=SeqID_220364
gagccacccctgtctactacagaaagatccacggtggaggttgggccaaatgcttcttccctgaccaaaaaggaagaggctgttgatgaacttgaaactgccaaagccgaaatgggtgaagtgatggaagaaaatcaacgactaaagacgtgtttgagccgaatactaaacgattaccgcacactccaaatgcaattccacaacagagttgaacaagagacaaaagactcttctgatcagaaagtgaacaacaacaatgaccatcaaagagaggaatcagacctagtttccctcagtcttggaagacttccaactagaaacaatgagaaagttaataataaaccattgaaagaggaagaaaaagaagataaagaaggcttgtcccttggattggactgcaaatttgaaacatcaaaatctggaagcacaactgagcacttgccaaatcaaagccctaataacagtgttgaagaagtgccaaaggaagaagcagcaggtgagagttggccacaaaggaagggacacaagacagctagagatactactggtgaggatgaagtttctcaacaaaatcctgcaaagaaagcaaggatgaatgatgggtgtcaatggaggaaatatggacagaaaatttcaaagggaaatccttgccctcgagcttactatcgttgcacggttgcaccatcatgccccgtaagaaagcaggtatccatatccattacagctatagtgtaccactcttcgggtttcaatttgacagagaagtag

SEQ ID NO: 103587 - DNA, 156 bp, Glycine max
  Peptide Sequence Number=SeqID_220365
atgggacaagaagcggcggtggtcatggctgttgaaggccttgatccggagtgtgaggttgatgagccggataatagcatggaagcagctgctgaaatggtggaggccatggctgtggctgaaagtggaagagggtggttgtggttaccttcgtag

SEQ ID NO: 103588 - DNA, 210 bp, Glycine max
  Peptide Sequence Number=SeqID_220366
atgaaatggggtgaattgtttccttcatcttcttctgcattaccttcatcttcaacaaaagtcaatggttgtgcatcaagcttcttgaacaaatcagccgctaatacaaaaccaggaacaactttgatgtttcttcagccacttttgcctctttctagccccaaaagcgcttctgggtctccaggagatcacagagacaagagaaattga

SEQ ID NO: 103589 - DNA, 447 bp, Glycine max
  Peptide Sequence Number=SeqID_220367
atgaaggctgacatggaggccatgaaagagcaaatggccacaatgatggaggccatgatgagcatgaagaagataatggaagccaatgcggttacagttgttgctaccagcgttgttgctgaggtgaacccgatgcccctatctggccttaaccaaatgaatcatccaacctcagatatggtaggcaaagatttgggaagtacgggcagcccctattatgcgcaaattcaaaacaagcatgccttcccaccatatggcttgcctcccaactatacaacacccaatgtggcatacattcccaatgaggatgtcaataactccactccgatactcattgagagccgacaacctgatcatgcacatgtctctcaacccatgggggagacacatgaaatgccccaccacaatctagcggactttgagccttgcctcggatatgccacttaa

SEQ ID NO: 103590 - DNA, 246 bp, Glycine max
  Peptide Sequence Number=SeqID_220368
gattcaacaagtgattctcctcaaatttcagccagcccgtatcaattagaccttgcaccttacgcttcagagccctacaatgctcaatggaacgccccagggcttctccgtgacaagcacacgttgcgttcgagtcgtattctcggagaaatggaggttgatgaaccttggctagggttatggctaccattgaattatcaagtggtcttcgtcatcggaagtgcggtagacaggctttgtggttga

SEQ ID NO: 103591 - DNA, 543 bp, Glycine max
  Peptide Sequence Number=SeqID_220369
gccaaggcaccaccgcttgtggtgccttggcgcggccgcctcatcggcggtgccgcgatgccggggcagaagcgcccggcggggccatcgatggccgggtcacgccgttccgggcgtgacgggaagtcgttgcttggccagcagcttctcgcgcttcatgcgacccagggtgacatcatcgatcgggagtacacccaactccgcgtccatgcacttcttgttcaacttgcggtgctggtcatggagtgccctgaactccggatcacgcgcgcggcgggcgtcgatctcgctctggggctgatcttcaaacatgatggacctccttcgacagatacacgaacgccccggccgcaaggcacggggcgttgttcatggaggagcgccggtcgatggccacctggacgcctgcaacgacctgcggcactggcctgcgcacgtcgattcgctgcggttcgcgccctgtttgcatcggcccggccctcccatcgtccggtccgcggcattgcgtcccggacgattgaccctacgcctgctcaaggcggg

SEQ ID NO: 103592 - DNA, 702 bp, Glycine max
  Peptide Sequence Number=SeqID_220370
atgggtcttgtagtgttgatgttgatggtggtgatttccaccactgttttgtgcccttcttctcttgctctgacgctagatggattggcattgttggaggtcaaaagcactttgaatgacacaaggaattttctcagcaactggagaaagtctgatgagtctcactgtacatggactgaaatttaccttatatgcaactgggggggattatatctcccagcattggcaaactcagtagactgcatagactggcacttcatcaaaatggcttacatggagttattcctaatgaaattagcaattgtactgagcttagagcactattttaacggaaagttcaaatacagggatttatcaagcaactcattgaagggtgctattccttcttctattggccgtcttacacagttgcgagttctgaacttgtcaaccaatttcttttccggtgaaatccccgacattggagtactgagcacctttgggagcaatgcgtttattgggaatttagatctttgtgggaggcaagttcagaaaccatgtaggacatcacttggtttcccagtggtgctaccacatgctgaaagtgatgaagctgcaggcaagtcgaatccagtgctttgtattttcagcaataatgctatatcctcctacaatatcttcatattaatattgattctcccaatttttaatcagccatgttaa

SEQ ID NO: 103593 - DNA, 372 bp, Glycine max
  Peptide Sequence Number=SeqID_220371
atgtcaacatcagagtatctacaaagtgggagagccactgagaaatcagatgtgtatagttttggagtgctattgctagaacttgtaactggaaagagaccaacagatccttcctttgcaaggagaggtgtaaatgttgttggttggatgaacacattcctgagagaaaatagactggaagacgtagtagacaaaagatgcactgatgcagatttggaatctgttgaagtaatccttgaactagcagcaagttgcactgatgcaaacgcggatgaacgtccatcgatgaaccaagtgttacagatactggaacaagaggttatgtctccatgcccaagtgatttttatgagtcacattcagatcactgttaa

SEQ ID NO: 103594 - DNA, 636 bp, Glycine max
  Peptide Sequence Number=SeqID_220372
atgggcaagagaatcataggatacaaatgggtgtacaagaggaaacctctagtatcaaaaaaagaagggaaaaagttcaaggctcgcctagtaacaaaaggatatgcacaacaaaaaagggttgattatgatgagattttctccccagtcataagacgcacttctatcaaggcagtgctagccttggtagctagtcatgacatgcacttagagcaaatggatgtgaagacaacctttcttcacggtgatctaaatgagaaaattcacatggagcagccagatgggtccagtaaagatggaccaggtcagttggtttgtaagtggaagaagtctttgtatagattgaaggagtctttaaggcaatggatccttgatgatggctcttttattattctgctactatatgttgatgatatgttgattgttggttatcatttgtgtgatgtgaatgagtttaaatcaatgttgagcaaggagtttgacatgaaggacttgggttctgccaaaaagattcttgggatggagattcacatggacatgaaatccagacgacaatggctctcacaacaaggctatgttgagaaggtgctagacaagttcaacatgagcaatgcaaagcttgtgttactccattga

SEQ ID NO: 103595 - DNA, 591 bp, Glycine max
  Peptide Sequence Number=SeqID_220373
atgtctatatgggtaacaacaaagcatgtgttgttgttggaaggggacaggccaatggttttaactatagaactgatggagatcgagataccctcagagtgtgtctgggtgtacttcatgaaacagaaatctaaagtctttgagaagttcaagttgtggaaggctgaggtggagaaccaaacatgtagaaagattagatacggtgaatatagcatgttatttgctccattgatcaccatgaacatcattggatgggaaagttgcacaggatgtttagactgtgatgagagatctaaacttgatccaaagtccaaaaaatgtgttttcgtaggttattccaaatgtgtgaaagggttcaagttttgggatccaatttccaagaagatggtgatcaacaaggatgcagtgtttgatgagcaattcatattactagagatagtcaagacaaatatgccaatgtttgatggagcttcccccaactccgtggaggttcaagtggactttgagcaactgttagtgattcctgagagggtaaaaccatgtagaccaagacctgaggccacgaccccacacctaagcctagattggtaa

SEQ ID NO: 103596 - DNA, 258 bp, Glycine max
  Peptide Sequence Number=SeqID_220374
atggctgaatcagcaaactcaatccacaacagtggccagaaaaagttagccggcaaagttgccataatcaccggcggagccagcggcatcggcgaagagacggcgcgtctgtttgctcaccatggtgcacgaatggttgtgattgcagacatccaagatgacctgggtatccaagtagcagcatccattggctctcacaggtacaagatattcttgcataatcttactgtggaaacaaaaaattactactattactaa

SEQ ID NO: 103597 - DNA, 276 bp, Glycine max
  Peptide Sequence Number=SeqID_220375
atggtggcttgccataccatgccttacccttatacagttttttactgccacagccaagaaagtgagaacaagatttatagggtcccacttgctggtgaaaatggggatagggtggatgctatggttgtttgtcacatggatacatcacaatgggggcatggtcatgtttcatttcaagttctgaagatgtgctcagtgggagctaaagaaataatgcaaaaacttattatcggttatttggcatatgagcaaaatgctgaagtgcttctggcatga

SEQ ID NO: 103598 - DNA, 606 bp, Glycine max
  Peptide Sequence Number=SeqID_220376
atggagaggagtatgattgatgcttccagtggtggagctcttggtgatatgacccctgctgaagctaggaatttgattgagaagatggcttccaactcccaacaattcagtgcaagaaatgatgctattgtccgtagaggagtccatgtggtgcccacagattcatcttcatctactgaaaataaaaagcttgagggaaaacttgatgccttggtcaacctagtaactcagcttgccatgaatcagaaatcggcacctgttgcaagagtctgtgatctatgttcttctacagatcatcatacagatctttgtccatctttgcagcaatctggagtcaatgagcaacctgaagcttatgctgcaaacatttataatagagcccctcagcagcaaaaccaacaacagaatcatccaaatcttggatgggcaagtcctccacaacaacaacagcctatccctcctttccagaatgctgctggtccaagcaagccatatgtttcgcctccaatgcaacaacaacaaagacaacaagcaactgaggcccctcctcaaccttccttagaggagttagtgaggcaaatgaccatccagaatatgcaattttag

SEQ ID NO: 103599 - DNA, 840 bp, Glycine max
  Peptide Sequence Number=SeqID_220377
atggcaaactattatgaccccgaggataaatcacctaagcaggtgagggtgagaggtcatttgattaagtttgatgaggccactcttaacactttcttgaagacccctgttattgtggagggggaatcactctatgcttattctagatttgcactcctaaggcttgatcctcaggagttagatgccaagctctgtatcctagggagtggattcgagcttaatgttgatgggcagcccttgaagattctgaggaagaacatgactactctagctcagacatggaacattttttccttcttgaacttgattcccacctcccacacttctgatgtcactcttgacagggccagactcatctatggcattattatgaagatggacatgaatgtggggtacctcatctcccaccagatctccctcagtgctcagcatgacacatccagacttggattcccagccatgattacaactttatgtaaggctaggggagttcagtctgactcgagatccttggagagcttaagtcttgccattaatttggcatacattaagaagaactgttggaatcttgatgatccaatagtaactttcagaggacccaggaaggctagaagaaagagatctgaggccttttccacttcagcaccagagacaggaggtccttcttcttctacacttcctccctcttcctccacaaagatcccagtgattcctctagcaccttcacagattccacttccagctcctctctctgcaagtccagcagattttattttgactccacaaatgttgcactctatgctccagagcatccatagggggcagtccatcatcatgtag

SEQ ID NO: 103600 - DNA, 915 bp, Glycine max
  Peptide Sequence Number=SeqID_220378
atggaaaagtccaacttgcaaccaaaccttaactatgagaattgtcagcctaaattcgaaacaaaggagaccccagattcacacatcctacttgttcaccttcctggttatgcagaagatgatataggagctcaatttgagtacgattatagaagagttagagtttttggtggaagaccccttggagataacagatcaattcgcttcaacgttgtatatgcagttccttggaattgtgatgtgaacaagcttaagggtatgttccaaggagaaatttatagtgttacaatgccaaaggtgaatacatcaagcgatttcccagatcaaaattcacccaaatcttcatcacatggaaaggctcaaattgaagtatctgaggaaccaaaatcaataattgagagtcaaaaacaagataatgagactttaaccttaccaaaagccataagtgattcattgcctcaaaagggtgaagaggtaatttcacaagatgccaagaatcgaagagaagaaaggtttgaaagtagtgaaaagaaaagggttgataggaaagacactatggaagaaagtgagaatgtttctgcctcaggaaaaccaccccagaaaggaaaaaaggaacatgtcatggatgagacaagtttcatcacaaagagtgaagaggatggtaagggtaagggagaaaaaatggaaatgaatgatacacttgatgaagggaatgatggaaaggacataattggaacatcaaaaaagaaaggaataaaggaggtggctacttctgcttctcatgccgtgacaagtttggtaaagaggttcaatgaagaagatatgatgctgttatatacaagtgcaacaacggctatagtgttggcactaggtgtttatgcttcttaccaaacttcgttctcagctagacaatag

SEQ ID NO: 103601 - DNA, 1143 bp, Glycine max
  Peptide Sequence Number=SeqID_220379
atgtcggaagaatttaccgctctcatgaacaatggtacatggtctctagtccctagtcaacctcattttaatgtcattggaaacaaatgggtatttcgtttgaaaagaaatccagatggatcgattgctcgttacaaagcccagcttgtagctaaagggtttcatcaacgaccaggcattgattataaagacaccttcagtctagttatcaaacctcaaataatcaaaatagttttgtgcattgcgctttctaaagtctatgttgacgatcttcttcttacgggaaatgatgtcagtttcctggccaaattcaaagcagctcttgctacaaaattttctctcaaagatcctaggacgtcgagccacttccttggtatagaacttcttcctaccactaatgtcatgttcttatctcaacaacactacattcgggatatcttgcaaaaaggtaacatgattgatgcaaagccagttggaactccgatgtctactacctgttcgcttagctcacacgatgatacccctagttgtgattcatctttattccacaacatcattggatccttacactatttatccatcaccaggccagatgtcgcattcgccgtaaacaagttgtcgctatacatgcaggcacctaagactactcacatgcaggcacttaagcgtatcctacgctacctcaagcataccatctcacatggtctacaactcgttgcaaccaaaaaccttgacctcactgccttttgtgaagcaaattggggtggtgatacaaatgacaaaaagtctacaggtgcctatattgtctatcttggtccaaatgctatatcttggtcttgcaagaaacaatccatagttgcaagatcctcaactgaggttgaatatcgcaccattggattaatggcttttaaacttttatggctacaagaactactattggaacttggcatcaaattaaccaagcaaccaactatcttttcatacaacattggtgccacatatctttgtgcaaatccaatttttcactcaaggatgaaacacttagttattgaataccattttgttcatgatattgttgccaagggtgaactcaaagtgtctcatgtttccttccagtcattaactagcaaacttgctaactaa

SEQ ID NO: 103602 - DNA, 345 bp, Glycine max
  Peptide Sequence Number=SeqID_220380
atggctccggatagaatgcaactacaaaatatgtgtaaaaaggtgcatgaatctttcaaagaatacgcccaaaggtggagggatctagcagctcaagcagcgttcccaatgatggaaagggagatgatcacaaagataatagacacattaccgatgttctactatgagaagatggtgggttacacaccttcgagctttgccgatttagtttttgccgacgaaaggatcgaagtgggtctgaaaagaggcaaatttgattatcctgctttgatgaatgggaagcctggggaaaatgaaaagaataaggagggaggaacccatgctatgactgtcattcccacatga

SEQ ID NO: 103603 - DNA, 474 bp, Glycine max
  Peptide Sequence Number=SeqID_220381
atgtctatccacatggttggagcattctcacaaaatagagagacctcgattggtctccctataatttcacttaatgagagtgacctgacttacccatttgatgatgatgtatatgtgagccagctcatggtgattatcatgctggagatggagaggcatagcctttcttatgggaatgctcttataggaagtgacatttgggcatgggttttgtttgtttacatttgtggaagcaatgacttccaagattattttgatgatgccaaagaatcaagagttaagcaagttccaaagaatcaggagtcaaaaagcttcaagaatcaagtttcaaagaatcaagattcaagaacaatcaagtttcaagattcaagattcaagaacaatcaagatcaagattcaagactcaagattcaagaatcaacagaagactcaatcaagataagtactaaaaaagtttttcaaaatattgagtag

SEQ ID NO: 103604 - DNA, 207 bp, Glycine max
  Peptide Sequence Number=SeqID_220382
atggccacttcacgctttcagccttgttttcggtataatgaatttagtaacattcctgttagtaagaactcaaagttagctgctttggaagctgtttctctacaaggcgagacactgcaaattacattagagaagactcaaggaaatattcaagtagatgataagactctagatagtgatgcaatcctatcccccaagggcaattga

SEQ ID NO: 103605 - DNA, 291 bp, Glycine max
  Peptide Sequence Number=SeqID_220383
atgcgtagtcatagcacattcattgttcttttgaactggataactgttgtgaagctcgaagattcaaggcacattcttggtggtgaagctccttcttccatggcttattccctagtggatggtgtctcccctctcctcttctcctttgccttccactgcatctccatggtggaaaatcaccattggaggacctcattgaagctcaaagatccagtctccatagaagctccacaagcaagcttccatcaagtggtaatcagagcacaaaagcttcaagtaggtgctccttaa

SEQ ID NO: 103606 - DNA, 426 bp, Glycine max
  Peptide Sequence Number=SeqID_220384
atgtctctttattgggttgtctttggaaaggcatgtcatcttccagtggagattgagcacaaggcatactgggcagtgaagacctgcaacttctctatggatcaagctggtgaggaaagaaagttgcaactgagtgagttagatgagatccgcctagaggcctatgagaatgccaagttctacaaagaaaagaccaagaagttccatgatagcatgataattaagaaggacttcatggttggacaaaaagtgttattgtataattctaggcttggactcatgagttttgagatcaaaagcgactccaccaacaagagcttcaaggtcaacggacaccgacttaagccattcctcacaaacccttctttagtggtcgtagtagtggaagagacttccttaatccaccctactcttcctccaccataa

SEQ ID NO: 103607 - DNA, 510 bp, Glycine max
  Peptide Sequence Number=SeqID_220385
atgaatgcagagattaaggctttagaacttaatgatacttggattttaactgatatgcctcaacataataatgttattggttgtaagtgggtgtataagatcaagcacaaatcagatggttcaatggagagacataaggccaggttagtggccaagggctacactcaagtggaagggcaagattacctaggcaccttttctccagtttccaagctaaccacagtgagacttctattggccttagctgctatcaataaatggcatctcaatcaattagatgtgaataatgctttcttgcatggtgatttaaatgaagaggtgtacatgatgcttcctcaaggtatgcaagtagccaagcttgggcaagtttgttttgaagtagccagaaaacctactggtatcaatctttctcagaggaagtatgccttagacattctcagtgatgctggtatgcttggatctaaactagtgtctactccatcagattatgctactaagctacatcaataa

SEQ ID NO: 103608 - DNA, 963 bp, Glycine max
  Peptide Sequence Number=SeqID_220386
atgggcgaatgctataacccgctttacgacctgatgttccaggcgggcgtccccccgcgctatatgcgcatctgtgaaccctttggccccgagcagcgccaggggttgtggctctatcacgtcgtggagcccgagcgctgggcggcgatgtgcgagcgggtggcgggcgttcactgcggtggcgtctatgccgggcaggacaatcatttttatggccaccgcaaaattctgaaacccgacgcgctcagctggcgggaatacgccatgctgctgctcgacagcatgccgcaaatgacggcggaacattaccgcaataaaatcgcgatttatttgcactggtatcagaagagaggcatggccgatattcccgacacgcaggaaggcgatatcggggcgaaagatattccgtcctggcgacgcgtgtgtaagtctcttcccgaagaccaacgcattgaagccatcaacgcctttcgtcaggccattcatgaaaatagccctttccgtgagcagcctgtcgactgcgtgctgtggattaaacaggacgatatcaccgcgaacgattacaaccccaataacgtcgcgccgccggaaaaacggctgctctgcaaatcactggagctggacggtttcacccagcccattgtggtaacggaaagcgatactcaacattatgaaatcgtcgacggctttcaccgccacgaaatgggttcgaaccgggcggtgttaaagcgccagcttaaaggctacctgcccgtcacctttctgcgtaaagaacggcagaaaaagttcgaccggatggcggccaccattcgccataatcgtgcccggggtcgtcaccagattagtgcgatgtccgacatcgtccgcgagctggcccagcttggctgggatgacgagaaaatcagtcaggaactggggatggacaacgacgagaccgtcgatactccgaagcctggacggtaa

SEQ ID NO: 103609 - DNA, 900 bp, Glycine max
  Peptide Sequence Number=SeqID_220387
atggcggaggtctccacagaggccattgcctcccttgtccaatattatgaccagcctttgagagatcctgggatgccctctgggaggaaggaagtcgtatcttttctcagggaattggaccgcgggaagcaagtcgaaaatggggtggttggagtaccaaggaaatgtttggaagcaaaggcgagagtcttggctagtcaagacgaatgggccccgttcgtggacatcctggcactcttgatcttcggggtggtcctctttccaaatgtggatgggttggtggaccgggcgacaattgatgcttttctcgctttttacgaccgcaaggaaagcccggttgtcgctatcttagccgatctatatgacacattcgaccgaagatgtgagaagaacaatacaaggatcgtttgctgtacaccgactctctacgtatggttggtttcatacttctttcgccaagagatgagacacgtttgcccactagaaggccaccgctcatgcaccaagaaaaaaaaggcaaactgggaccgactcttagcaagcaaagaaggagcgtctgtcaattggttcccccgatggaaggaaagaagaaccgagattcttatttcatgcgggaaatttccaaatgttcccttgatggggacgaggggttgcatcaattacaatatcgtcctcgccataagacaacttggttaccctatgagaggggcaccatcagaggaatgcctcataccttttattacacgagttttcaatagcaccaacgtgggggtgcttcagagggtccacaaggcatgggaaatgtcgcaaaggaaggacaaggaacttagggggagtagcaacaagcccatcggcagttaccataggtggttgaaagcctacgcacaagatctggattag

SEQ ID NO: 103610 - DNA, 141 bp, Glycine max
  Peptide Sequence Number=SeqID_220388
atgagctcgcttagcgcacgtggtgcgcttagcgagttcacactcgctcagcgcctctgtgccgctcatccttcttccagattcttctgtgcgcttagccagaggatggtacgcttagcggatggctcgcccagcacgtga

SEQ ID NO: 103611 - DNA, 246 bp, Glycine max
  Peptide Sequence Number=SeqID_220389
atggattgcctggcgaatctgcggcaaatgggtttcgaacaacgcttcgccctgggaggcgatcagcagcgactggtgatcgatactctgcgtaagatgggacggaatcacagcctggactttggccagcgcatggcgcgcggcggacttaagctcatcgtcgctgttcggcgatacgctgcgcggtcagcggatagcgatgacagcgcagcaattgcagcagttcgggaagccgctgagttttag

SEQ ID NO: 103612 - DNA, 222 bp, Glycine max
  Peptide Sequence Number=SeqID_220390
atgaatttggccactgaccaaatcgcatctccaggacacgtaagaagacttcatgtagaacaaaatgagtttgagacattgatacggtggagtctaagtaaaatcaaaatattgtccgacttgaagatccaattgatgcaatcctaccgccaagggcattggatagaagactccaagaagattgggccagagttgcaagagaaggccctagggttctcatga

SEQ ID NO: 103613 - DNA, 351 bp, Glycine max
  Peptide Sequence Number=SeqID_220391
atgtctcctccacctctaggacctcacgatcactcacaaactcatatcaagctctcaggatggcttcctctcgtagctctggtctctatgaatcttcacacaacaaattctctcaaactctctagaacttggacctttctctctctagaactctctgattatgcagaagcttcaagaaaagggtacatcccttgtggtacaagtagagggtacatctacttgggtttgactgagaacaagagagggtacatctcttgtggattagatttttacaaggttgaaagaaatctcaaggaccgcaggtcgcttggggactggatgcaggcacgggttgttgctgaaccagtataa

SEQ ID NO: 103614 - DNA, 787 bp, Glycine max
  Peptide Sequence Number=SeqID_220392
atgtcgtggaacttcacggattgcctaacgatgggtgtcaagtacctcgaagtggtcaagcaaagggtccttataaccaacaaggatagtggagatcacacactggcaatcaattcaacaaagacttgggactactatgctggaggagactttgactcagtttatgcaggacaactggctaagcagatagctgagaagtcatccaacagttttgtggcgaatatagaaaagaatcccaaggaggaatgcaaagctgtgatgacaaggagtaagaggtttgtggaggcagaggatgaggacagtgatgtgcccaagaagaaagctgctgaaaagaaagatactgatgataagaaagatgatatgagagaagtcactgtgggaaagactcttattgacctgggagccagtattaacttaatgccactctccatgtgcagaaggttgggagagttggagatcatgcccactaggatgactttacaacttgctgaccgctccattaccagaccatatggagtaattgaagatgtgctgaagaagttgggttggagattagatttggtcttggttatcatctataacttaactggtcatggttttattcttgcttctcctatggatcttatcctagatgttggcaaattagttgttcgccagcaagctaaagatgttgttcttgctggttttatctttatggtcatcaaagcttttagcatcaattttcatgcacccaaggctgctgaactagagggagctgttttggctatttctatagctcattccaaag

SEQ ID NO: 103615 - DNA, 813 bp, Glycine max
  misc_feature (493)..(493): n is a, c, g, or t
  Peptide Sequence Number=SeqID_220393
atggccacaatgatggaagccatgatgaacatgaagaagataatggaggtcaatggggttgtagttgtcgctaccagcgttgttgctgaggtggacccaactcccccatctggcctcaaccaaataaatcatctgacctcagatatggtaggtcaaggaggcaaagagttaggaagtatgggcagcccccattttgtgcaagttcagaacaagcatgccttctcgccatatggcttgcctcccaactatacaccacccaatgttgcgcacactctcgatgagaatgtcaataactccactcccatactcattgagagtcaacaacctcaatctgatcatgcacatgtctctcaacccatgggggagacacatgaagtaccccaccacaatctagttgacttcgagcctcgccttggatatgttgctgaagggcaagcagttggtggtgtacctctaccaaacactttggaggaccctcaattttgcccacaancacaacctttacattttgcggtggggagagtccctccaaatacggtggaaaggggaaaattagatcatatagaggaaaggatcagggccattgaaggaggtggagattatgctttcactgacatggcagaattgtgcctaatgcctgacatcttcatccctccgaagttcaagatgcccgatttcgataagtacaaggggactactttccccaagactcacttgaagatatattgtccgaaaatggggacatactcgaaagatgaaaaattgttgatgcatctcttccaggaaagtcttatgggggcagccttcacctag

SEQ ID NO: 103616 - DNA, 744 bp, Glycine max
  Peptide Sequence Number=SeqID_220394
atggaagtgctgtttgatgttgaagcacgctatgaggccaggttggagtggctgtatttgctggaagtgctcgatgatcctacccggattgtcgcggcgcaatatgccttgctcaaaggctggtatgatttggcggtattggcagcagacaaaaccagccgtacgcacaattttgaattgcgctatcccacgccttatcgggattatttacaaaaggcttcgcgtaaccgtgccattgatgaggcctgggtctatggcatcatccgccaggaaagccgtttcatgcattatgccaagtcatcggtgggtgctggtggcttgatgcaggtgatgcctgccacggccaaatggattgccaaaaaactcggcttgaatggttaccatgatggcatgctgcatgatattgataccaacgtaaacctgggcacttactatatgcgctatacgctggatacttttaatggccaggaagtgatggctaccgcggcgtacaatgccgggccgagccgcgccaggcgctgggccggtaatacgcccctcgaaggcgcgatttacgccgaaaccattcccttcagcgaaacacgcaactatgtcaaaaaagtactggcgaatgcccatatgtatgcccccaggttgggcttgcccatgctgacacttaaaagacggctggggactatccccgcgcgtacgacggctgaggtggagtctgtgacaacgacgatcagtatttcggagcaggagtag

SEQ ID NO: 103617 - DNA, 765 bp, Glycine max
  Peptide Sequence Number=SeqID_220395
atggtggaagtatatgcaaaatccttatattacatagaaataacatctgatacacaagacaacagaattatggttagtaccagaggattaggtcgtgacttaagtcacgttactggcagaggtgtgggcagaggagatcgtgatgatttcgatgatgctctgcagcatcgatggcctaccgcatccactcgcaggcaacgagtacctgtcactactgtgcataatgagccagtggtccctgtggcagaggctgacggagcttcgattgaggctaacgtatatgcggatgagccaatggcaggaggtgacgtacaggacactggggcagacatttctgcagacacaggtgcacaagctgctgaggatgagcctaagggattttcgggtggtccgagcgacccatccgtgttgatcgggtatgcggatcacattgcaggcaacatatggatgggagaggagcatcctgagttgaagttatcctctcatgggaggaaggtccatagtttaggtaggttcgtccctaccattgagggactagttgctgggacaggactaagtcctctgatcgcgtgtttgatagacactgacgatcggggacttttttcttcgtttgtcgagcgatggcatcgggagacttgtagtttccatctccctgtggggagtagatgcactggtgcatatgtacgaccacctcaacgatgcttctatcagcaccagccaacagcttggcggttacatcacgttgttgcagtgttggatatatga

SEQ ID NO: 103618 - DNA, 297 bp, Glycine max
  Peptide Sequence Number=SeqID_220396
atgcaaagtgttctagacaagttggatggtctccgcaccttcgtcggagagtgttttgactcattggacaaccacattgatgccattgatgcacggattgtcatcatcaaaaagggggagattgtggaagcaaagctttccaagtttatttttatgacaccaaaaactcaagtcaagagtcaagagttaagcaagtttcaagaatcaaagagtagttcaatcaagaatcaagattcaagtaaagattcaagagaagactcaagatatacaagaacttcaagaaaagcatcaagataa

SEQ ID NO: 103619 - DNA, 537 bp, Glycine max
  Peptide Sequence Number=SeqID_220397
atggagtcaaacaacatgccagacttgaacggtgtcgctaagaagactaaaggtcgacaaaagatcgaaatgaagaagatgagaaacgagagtaaccttcgggtgacattctcgaagcgtcgcactggggttttcaagacagccagtgagcttgcaaccctttgtggcgtggatgtcgctgtgattatgttctcacccggtaatcgagtattttcgtttggcagtcccagtgttgattctgttgtccaacgctataagacacagggcccacctcccctccttaccttggacctcaacaaggttcactccactgtggacgaagttgagctccacacacacctccactgcttgtccaaccaaattgctattgagaagaagcgcacaaaggatttaaatcatttagcgaaggctgcagaggatcagttctggtgggctaggcctattgaaagcatgaccgattcccaacttgacaagtataagaagatgttagaggagtttaagagacaactcaaagaaaaacgtgggaacctcaactga

SEQ ID NO: 103620 - DNA, 240 bp, Glycine max
  Peptide Sequence Number=SeqID_220398
atgccagcaatcgaagacaaaacgctgtttacctcgacaatacggagggagaacaccaccctcaatttgcctaggctactcaacaccaacaacggcgcggtcgcagaacagggacttccggcgcgaaggaagaagacgacactcaccgggagaacaaacgcgatgcagaggatgacgacagtgggtgacgcttttttgagaccagcaaaaatgctgggtgcacctagcaacactctttaa

SEQ ID NO: 103621 - DNA, 378 bp, Glycine max
  Peptide Sequence Number=SeqID_220399
atggatgaaaatatagcccaacccaacacgcatgctcagcgcacgacatgcgctaagcgggccagccaacacaggcgctcagcgaggcgtcaagctcgaagaatagcaacatgcactgagcgtgcatctcgcactgagcgcacgatccaacagaagcacacgctgagcgcacagcaagcgctaagcacgaggtgccgtgctaagcgcgcctacgaaagcccgaggcccatttcagcagctataaatatagagtcagtccaagggggaacgtacacctcgcctcagagcacatttctcagcattctaagcccgagcttctctctttctctctatattccttatttactatccattctttctttcacccctcagttgtaa

SEQ ID NO: 103622 - DNA, 780 bp, Glycine max
  Peptide Sequence Number=SeqID_220400
atgacactgaaaccttcactttctcagaaacaaaatccaaaaggcttcactcccatccaccttgctttacaacacgaccaagagagaatgcccctttgccttgtacaaattaacaaagatctcattcaactgaaagggagggacgacttcactcctctgcatttagcaagtcgaaaagaagaagctgatgatgaactttcttatttgcatttgaaagttggaacagacgtagctgaggatggcattcctcctcctctgcatttggcaagtcgaatgggagaaactgagcttttggacaagttcctagaggtttgtccagattccattgaagatgtgaatactagaagtgaaactgcactgcatattattgcagcgaaacatggagcgaaacatggacgctatggggctcttaaagtcctatttcggtggctcgtgaggaattccaaagaagatgatcgacagttcataagaacaacgacattgaactggaaggatgaaaaaggcaattctattttgcacgttgcagcactctacaatcgcataaaagtagcgaccaagtcaagagcacatttggttcgtagttttcataagagacggtatatgacacaggaggaatgcaatgcatatttggtagttaccactcttattgcaactgccacttatcaagtagccctgagtccccatggtggactttatcagactcatgttgggactaacaatactgtgatgagtcatgtggcggcctcttcttcatccataaatttcaaatctacaacttga

SEQ ID NO: 103623 - DNA, 424 bp, Glycine max
  Peptide Sequence Number=SeqID_220401
ggggacgaagaaagacaaagaagaagaaccgttcctttatcatagaaaaggaacctttagtcatcgtcgcggagttaatcttggtggtgcaattctctgtagcgttccatggtgggaacaaaatcatgaaggtccaccttgttcctcgaaaattcaaaatctctatccaattcggtggcgacggggggaatccaatgtcggatgctcaggcactgctggggatcgctgggaagaagcttcagtgactcccgcacgtggcgcacacgatggaaattcaccccagcgtgacgaagatcgtggtgaaggagggtggctcggtagagctctcgctcgactagctggagctcgatatgtgcaggtttcggttgccggaatcaacgcggccgaagcttacgagtgcggtgtaggtggtaatcgctgttag

SEQ ID NO: 103624 - DNA, 276 bp, Glycine max
  Peptide Sequence Number=SeqID_220402
atggctgcaatatctgtattaggtgcaatgtgtttaatggtctttggaaaacaggaggtggcccttccaatttatgatgtaactcggcgagatacatttacaaatctttttgaaatatgggcaaaggaaatagacctttattcaactaatcaagattacatcaagatgcttgttggaaacaaactagacaagaggtttgatgcaagggtgggggtgacatcctttgctgctgtgttatgtttattggagttatggtggtttatgatgggttgttaa

SEQ ID NO: 103625 - DNA, 204 bp, Glycine max
  Peptide Sequence Number=SeqID_220403
atgcgaacaagaggagaaaatctactcggtaaattcactactaaaaaaaaggtcttctacatcggttctaatggcctttctacatcggttatgacgcgtggtggtaacacagtgtcgttgaataccgacatcggttggaggaccgcctttgaagggcgatctttctacatcggttctaaggttgaaaccgatgttgaatggtag

SEQ ID NO: 103626 - DNA, 660 bp, Glycine max
  Peptide Sequence Number=SeqID_220404
atggcgaattgctttagtgtttggtcatcagcggtcatttgggatgggttgcagttgatcccattatgggacttggcaagtggagtattgaagctcacattaatagtccacattgaacaagttagaggtcttgctgttagcaacagacattcttacatgttctctgctggtgaccataaacaagttaaatgttgccaaaataatatatatatctgcgaaaatttgggagcgtatacccgttcgtacccagtatcaatattacagaatccccaagttgttacgggttctcatgacactaccatcaagatgtgggaccttagatatggtaatttatggctttatttttcctatcttcttgcttgcctatgtattgatcatatgcataacctaacacatgatgcattcattttcattcagcaactgttcacaaagccacactctcaatcaaagccaagaagtaccctcaacataatgatttctgacccgttgaaagttgctgccgaagggaataacatagacgatctctaccaagagattcagcaagatccacgtgttttggagtccatagattcaatcccatttgttgaaactcctttgcatgttgctgcatctcttggtcattttgagtttgctactgagatcatgacactgaaaccttaa

SEQ ID NO: 103627 - DNA, 633 bp, Glycine max
  Peptide Sequence Number=SeqID_220405
atggatcctagcgtttctgtgttgactacggagctttcaaagctatcatggaggaagacatatgcaaaagctgcatttcgcactcactatggccactacgaattttgtgtgatgtcattcggcttgtgcaatgccctatcatctttccaagccactatgaacaacatctctggaccttatctatgcaggttcattattgtcttcttcgatgatatattaatttacaataaaaccttccctgggcatcttgatcaccttgcaaaagcttttgaagttttactcgaaggactcttcttcctcaagctcaccaagtgcacctttgctcaacaacaggtcgagtatttgggtcatattgtatctcgtcatggcgtggaacctgttcccaccaaagttgaggcaattcaagcgatcaattccagtggttgccagaggcctagctggccatcaaaattctcaaaaatgccatttacagagctccagttctggggttgccgaacttctcccaaccattttttgttgaaacacgcgcttctggtgtgggcatgggggctcgatcacggcggtagtgaagaaatggcgtcagtatctattggaccaccacttcatcattttgaccgaccactggagccttaa

SEQ ID NO: 103628 - DNA, 255 bp, Glycine max
  Peptide Sequence Number=SeqID_220406
atgacgatcagactggtgagggctgggcctaaaaatgatgtcgaagcggtcaagatcatagcaggcagcgttggccgaaggtcatgggccaaatggagctacgacgagcctagttcatcagatcgtcaaccttcaacatcacgaacttttccaccttctacacatcagcaagagaggaagcacgagcgaaagggaaatttgagaggagagagctacgcacgagagagtgagaaagcacgaggaaaaaggaaataa

SEQ ID NO: 103629 - DNA, 429 bp, Glycine max
  Peptide Sequence Number=SeqID_220407
atgtgggtgtgggtgtttctgtgtgtgtgtgtgtgtgtgtgtgtgtttgtttctgtgtgtatggctgtgtgtgtgtgtggttgtgtatggggaattcccctggttggggacgagaggagcgatgtgattctgctaaagtttcttcgagccatggatttcaaggtgaaggatgccttgagcatgctcagaaacacagtgcgttggcgaaaggaattcggaatcgagggtcttatcgaggaatatcttggaaatgattgggacaaggtggtgttcagtcatggacacgacaaagaagggcacccggtgtactacaacgtcttcgatgagtttgaggacaaggagttgtacaacaagacaggcatatcgacaatagtgcagctaaacgaccttaagaactctcctagacttggcaagagggagctgaggtag

SEQ ID NO: 103630 - DNA, 588 bp, Glycine max
  Peptide Sequence Number=SeqID_220408
atggtcttagtgtatataaaagtgctcgaggagtttcctattagacaagctattgctccaaatcccaacagtttgattcttgagcatatgccaaccaaaaggaatgtctatccccttcgtgcatttgtttggagaagtagggatgcagacccttgtgagatgcccttctccattccattggaccttcaacaactcagtatgatgtatcatcttaatgttgttctcccttgggattgcaccaaggttgaagaaaccttccagactaaagacgttcctttggaggatcctcagtatagtccaagggagtatgttaaacgagttgaagatgcacttccgaggacccgtgaagcccttgatcaagcctttcaagacaaatattatgttgagaagaaagctatgaagtggttcttgattagggattacttcgacaaaaagcttactaggtgggaaccttcaagaactcccactcctctaggcaatcttgttttccctgctccaattaacttatcatctaatgatgaatctagtgatgaattcttgaggaagttagatgaagaagttgccaaacaaaagggggaggataagtaa

SEQ ID NO: 103631 - DNA, 165 bp, Glycine max
  Peptide Sequence Number=SeqID_220409
atgactgtcgtaaactacgctactgaagctacaattgctgctaaagctgtaactaccacaaacgagttggggttcgtcactgtcgcgattgagtcatggccacttatcggttcttcgaatgtttgtgtcaaacttgtacagtccaaaactttcaaaataaattag

SEQ ID NO: 103632 - DNA, 435 bp, Glycine max
  Peptide Sequence Number=SeqID_220410
atgaaggacctaaggttcatgcccatcttctacataattgcatacactaacttggccctatctaaattgatgttggaagtatgggagggcagtctgtctgaattcaattcgaatctctttcctgggatacacaagcgggctgccaactactacgggtttggtcttaataaaacaaacctggcgtatactgggattctctctccttcctctattaccaccggtgtttccaagaagggtacatctactagggttgttgtaactgagaacaagagagggtacatctcttgtggatcagttcaattggagggtacatccacttggttgttcaaagagaacaagggagggtacatcccttgtggatctttccttgtaaaggcttttacaagattgaaaagaaatctcaaggaccacaggtcgcttggggactggatgtag

SEQ ID NO: 103633 - DNA, 207 bp, Glycine max
  Peptide Sequence Number=SeqID_220411
atgactgtgaaaaagaggctaagttatgaagtgcaaaaagtgacagtagggctcagctcagcatttgggctaagcgcacatccaccgctaagcgtagcttcggcgcacttagcacgacaaaagaatcaaggccgcttgctaagcacgagatcagtgcgcaagcgcagctggtgtcttcaaccaggctcagcgcacaactggcactaa

SEQ ID NO: 103634 - DNA, 651 bp, Glycine max
  Peptide Sequence Number=SeqID_220412
atggctgaaggaactcgatccaagactaatatggaatgcatggaagaagccatagccaagctagcctccaaccagctccatgtcaccaccaaacttgatgaactcatccaacacatcacagtgttggaaaccaatcaacaacactcacccacaccttcatcttcctcatccaaccctcactctccttccacgaaccccgttctctctcgcatgaagcttgaagttcctcgatttgatggttttgaccctttgggatggaccttcaaaattagtcaattcttcgaataccacgcaacccctaaacccgaacgcctcgtcattgcctccttcgccatggaaggacctgcacttgcctggttccaatggggtttgccggagtttacctctctcggccctccaaccatcgacgttggttcaagtggcgggtctcgcgtgcctccaggaggagaaattggccgaccaacgtcacgacatccacggtggcttccgcggctgagctccacccagcctttcccctctccatccaccgtcaccaccaactcctctgctgttgccctcccctgcgaaaccaccaccgcctcatgttcaccgcctgtcaccggaagagatgactatgtgtcgggagaagggtctctgtttcaattgcgatga

SEQ ID NO: 103635 - DNA, 318 bp, Glycine max
  Peptide Sequence Number=SeqID_220413
atgcaatcacatggactagcactgtctcctaagcttaaggttggtccttcagttgctcgtgtcagcacaaaggagagttgtgttgatccctcagggaacgatccaaacacggggagttatgggaccgaaaaatctacagataggccggatcatgaggtcgatggtcccatatatttgatgacattatccatctcacagctttttctgaagccattgcatatgactgagacaagtatgcaagtggggaatttcgatatgtatggattcctcgagccacagtccatccagagatctgggcaatcacaatttgaatcataa

SEQ ID NO: 103636 - DNA, 1431 bp, Glycine max
  Peptide Sequence Number=SeqID_220414
atgagttctgacgcgttgaaagttgctgccgtagggaataacatagacggtctctaccaagagattcagcaggatccacgtattttggagtccatagattcaatcccatttgttgaaactcctatgcatgttgctgcatctcttggtcattttgagtttgctactgagatcatgacactgaaaccttcatttgctcagaaactaaatccagaaggcttcactcccatccaccttgctttacaatgcaaccatgacgaaatggtccttcgccttgtagaaatgaacaaagatctcgtccgagtcaaagggagggaaggcttcactgcgctacatttggcaagtcaagaaaataaaactgagcttttggataagttcctcaaggcttgtccagattccattgaagatgtgactgctagaagtgagactgcactgcatattgcagtgaaacatggacactatgagacacttcaagtcctatttcggtggctcatgagaaattcccgaaaagattctcaaaagttcataagaacaatgttggactggaaggatcaaaaaggcaataccgttttgcacgttgcagcactctacgatcacatagaggcagtgtcattattgttaactatggtggatttagatgccaagaattcagaaggcaaaacagcatcagacattgcaagcagcgaccatatgaagagcatattaatcaaggaccttgggtttagacggtatatgacagaagaggaacgcaacgcatatttggtagttgccgctcttattgcgaccgccacttatcaagcagccctgagtccccctggtggattatatccatctgatgttgggactaataataatactagtcatgtggtggcctctactcattccataaatgacaaatcttcaattccaaaagacgggaactcaatcatgtctgcaggagagtttaatttgttttcgatcgctaatatgagttcctttatggcatcaactttcggaattatccttctattgccgaggacgaatattcttatgtggtgtctactatattcgccaccgtttttccttcagattagcttctgtaccgctatgatggtgatatctcccgcccctcttaacgtatacgtgagcattgcggagttgcaaaacaaagatgaagattcaaaaccttccaaaaaggttgaaggggctgaagaatctgcagatgagaaggaaagtgacaatgagggttccaaactgcgaaaatctgctctcgaaagattggagaaagctaatgaagagtcacggcttagccaggcaagcataaaaggatactttcccttggggggttggggtgggagaaaggagcaagatgttttgaacgcaatgggttcaatgtatgctgctgttacctctattggggttataaatagtgccttagtgcagcctagcaattga

SEQ ID NO: 103637 - DNA, 831 bp, Glycine max
  Peptide Sequence Number=SeqID_220415
atgagacatggcgtagagaggctatttggaaccggagttaacatcggttttgagaaagccgatgttaaggagttgattgtaacatcgttaaaaattgagatttcacaagccgcgcgcgctcgaaaaccttgccctccctcttctctttgtcaccgtgaaatcgctcttctctttctcctcccacctgaaaacttccagaaaccgctccctcgacacccacattgtcctcgctcgaacccacacaaccccctacactgtcgaaaaacccacattgtcctcgctcgaacccacagaaccccctacagtaccggaaaacccatattgtcctcgctcgaatccacagaaccccctacactgttcttggaagtctggctcgaagaaaacccaacatacactgttgctactagggtgctgaaacagtcgtgggtgctcaaagctcaaagctttctccgcgaggtactattgctgattgaggtacgaggaaagcttaaagtttcatgccattttgttagatctcactgccattgtcactttttgggttcgagactgcttggagcaccagtagagattactagtgataaggatcctgttattgttcataacaagttattgacacttcttgcaattattttggagtttggggcacttgtttggactagggtcagatatagtcataaacaaagctcttccaagttgttccttgagctgaaagaattcacagaaacatcatcttctaaatctgaggctgcctcttttgtgtatcttcttctagaactttggagcagaaactttaggtgccttgccccgagatattggaagaccagtggttaa

SEQ ID NO: 103638 - DNA, 228 bp, Glycine max
  Peptide Sequence Number=SeqID_220416
atgtatgatagtatgatgtctgaagaagttgatatgaatgttgaaaatgaggaagatgctggcgttaaagtagaacacgttgattgctttgatgtctttaatacttctcaattgtttgctagttgtgatgaagttttacaatgggctcgatcgttggctcataacattgaatttgttgtcgttataatgaggtcagacaccaatactggtgttcgaggaagagcctaa

SEQ ID NO: 103639 - DNA, 390 bp, Glycine max
  Peptide Sequence Number=SeqID_220417
atggcattagcgcgtgacttttgtaaggaaacaacccatggggcattttggtttagaataggtagcaaaatacctttggcaatttacactttgggtatgatagcaaaatacttggatgtattagaaataccaggatgtgcacgtatgcaattttcgatagccaaagtgcttaaagtatgcatgaaatggccccgaggaagcttgcctcaaagaggtccaggaaggacaaggcagccgaaggaactagttccgctccggagtatgacaatcaccgctttaggagcgctgtacaccagcagcgcttcgaggccatcaagggatggtcgtttctccgggagcgacgcgtctagctcagggacgacgagtatactgatttccaggaggaaatag

SEQ ID NO: 103640 - DNA, 417 bp, Glycine max
  Peptide Sequence Number=SeqID_220418
atgaagagatgcttatgcgatgcacgatatgaatgcatttatggacacgagagcccgaaaaatcatttcttcttacttgcgcatttgggggtgcagtgccccatgtgtgcagttaagaaggtgatatggaccttccgacttcccatgacaaaagacgagaccaacatacaacgcttgtcgcaacctacccttttgcgggcgagcgaggcgaggctcacgggtgcgtcttccaaaggaggaaaatgcgcagagtcgccaccaacgtttatttgtgggaaacgtcggaaaaacagaaggaaaccggtcatgaagaatattccagattcgggagttgtatttacatttgaggaaggtcgacaaaagcggggctcttgctcctacgtaccctccatcgaagaggaaatcagacctacgtag

SEQ ID NO: 103641 - DNA, 312 bp, Glycine max
  Peptide Sequence Number=SeqID_220419
atggagcagaggttagcaaacacaaggagaatgcctcttaacgacaagaaattcatagaaacttctctcctttctgacctccgagtcgacggccgtcacccttccgactaccgcaagctcactgtcaaactggccaagcaagacagctccgtggaggttcatttgggccaaacccacgttatgacctttgtcactgcccaagacagtagtgtttatctcttaatcctcaagatgaaacgtgtgagatttgtaggatggcctttgatggatgttgtcctgactgtaaacttcctggagacgactgcccgctaa

SEQ ID NO: 103642 - DNA, 483 bp, Glycine max
  Peptide Sequence Number=SeqID_220420
atgtgttggattcaaactggatgggattcaagtccttttaacatgagtgatcatgtcatcagcggtcacttgggatgggtgagatctgttgcagttgatcccagtaacattagttggttattttgctcgagttgttcctttggacagttatgggacttggcaagtggagtattgaagctcacattaatagtccacattgaacaagttagaggtcttgctgttagcaacaaacatacttacatgttctctgctggtgaccataaacaaaatccccaagtcgttacgggttctcatgacactaccatcaagatgtgggaccttagatatggtaatttatggctttatttttcctatcttcttgcttgcctatgtagtgattatatgcataacctgacacatgatgcattcattttcattcaggaagcaactcgttacctctccgataagatcacaaatcaaatcgattccaacaaagtcttctaa

SEQ ID NO: 103643 - DNA, 249 bp, Glycine max
  Peptide Sequence Number=SeqID_220421
atgcttggactcaacagaattgaacgggtacttccagttggaacttccttgactgttgttggtgaggtaatctcagttgaacattcatggaagaaatccagagatttgcttgagaagattggtagacaaggagatctaactggttatagagtttcttgtctccttattggcgcaaaggatgatttaactccatatccaagggcagtacaagattcagttaaggtattgcatatcaactcagtgtcatga

SEQ ID NO: 103644 - DNA, 534 bp, Glycine max
  Peptide Sequence Number=SeqID_220422
atgaaggacacagtaagaggatcaaatcaaagaaaggttgtaggggtggtatttccaacttgtataatatccctgctttttagaaaaatatttctggctaccttactgcagaagattgttactgcagaagagaagatgccttatgaggggatataccatgcggggaaagaagcttatttgcaggtgattgcaatggaaaaacgtgaaactgactcaatgaggttcttggaagacgagcagaagcagaggactgcaatggaattgtttgaacagtacatgcaattcaaacaagaggcagaaaaagatggaaagaagaacaagaaagagaaggatccattaaaaccaaagcaccccatgtcagcttatttgttgttcactaatgataggcgagcagctcttgctgccgagaacaataatttgttggaggttccaaaaatcacatccaaagagtggaaaaacatgacagaagaacaaaaaagaccatatgaagagattttagcatttaacaatctggatgtatgcaaaacaaactaa

SEQ ID NO: 103645 - DNA, 526 bp, Glycine max
  Peptide Sequence Number=SeqID_220423
atggactgtcttcaggcaggaagtcttgcttcattgaaggctactttagaagaattgtctgggcaagctacattaagctcctcaaatgaagaggagacatctgtgaatatagaagcaactcaatttcatgtatttgatgaagttagggatggagagtggcttgttattgccacaaatgttgttgaaatatctttaacaatcccacggataaagtatgtggttgatactgggagagaaaaggttgcaaacttcccatttcctacttctcttaaagattcttctctgcttgaggctaagacttgcttgaaagctcttgaagcacttgataagaaggatgaactttcttgctcttttttcttgaatatccaaaaaaaaatagcaatgattgctgccatttcacaggatccttcgagttttaagtctgaagaattgcaatactcaaaagattttacccatatcatgtttgaccggaagaatgctccaaccatgtgggatcaacacaagcttaaaggagcactcaaaccag

SEQ ID NO: 103646 - DNA, 279 bp, Glycine max
  Peptide Sequence Number=SeqID_220424
atgacgaaacttcaaggttgggggtcgggtagcatatttgagacattgcagctgggcaaacctttaattgtggttgtaaatgaagatttgatggataatcatcaaagtgagttagcagaagaacttgctgatagaaaacatctgtattgtgctagtcctcaaacactccatcaaactatagcaaatatggatttaagttctctctttccttactctccaggtgatgctacaccagtggccaagcatataaacaatctccttggttttcctgatgattga

SEQ ID NO: 103647 - DNA, 201 bp, Glycine max
  Peptide Sequence Number=SeqID_220425
atggctgccatggctgtggcagccgccatggcgccgccatacccaacccgccacgccaccgctattcggtcaacacctcctgagcatttacctaacccttcatctcaaggacaaggactgcaaattcctggggaagacaccattattatcattcacgctcttcttgaccctggatacccattagcccagagtcggacaagg

SEQ ID NO: 103648 - DNA, 1182 bp, Glycine max
  Peptide Sequence Number=SeqID_220426
atgtcactcagggaacagctcagttccataaccaaaggcaactcctctatctcaacttttttacactcaatccacaatattgctgatgaattggccctcatttgtcatcctattgataaacttgaaatggttattcatgctttgaatgatcttggaccaaccttcagagaaattactgcttccatttacactcgtgattcaccaattgctttcaacgaactctatggcaagctggtggattttgagatgtttctgcaacgtgaagaatgcatcttgacaccgcaatgctacaagattcatggctacccaaacaagccatgccatccaactgcccatgtggcccaacaagtggtctctcactcatcttcaccctcttggctatttgattatggtgcatcccatcacatcaccaatgacatgagcaatttgtccataaaaaagattaccatggaactaataatcttcaagttgcaaatggtttctattgaattttacccttggcattttgaggtaaagaacttgcacacgaaggagattcttttgcgaggactgaatgaagacaatgcatataggctccaaccgcatacacctgccccacacacttcctttgctaccttcaacccaacactcaagctatggcaccatcgacttggtcagcctgcaccattaactcttcttcatgcactcaagtcaaacaacattgtctattatggttccctcactaaatgtctaccttgtctttccaataaaagccacaagctaccattctcaacgtcctcaatttctagttcttacccattagaaattttgtactcggatttatgggggtcgactccagttaatttaattgatggttttcgttattatgtaattttcatggaccatttttccaagtatgtttggctttatccactaaaactcaagtctgttgtctcaatcatatttccaatttttaagaacttggtagaaaggcaattcaattcccaaattaaaaccctttattctaacaatggcgaagaatatatcaaacttcgaccattcttacaggccaatggtatctcccacttcacaaccccaccccatacttctaaacataatggtctctctgaacgaaaacacttccacctcattgaaattgctcattgcctcctaaaccacatctctcttcctccacattactag

SEQ ID NO: 103649 - DNA, 144 bp, Glycine max
  Peptide Sequence Number=SeqID_220427
atgggggaggaaatggacctaagagggtgcagctcctctgttccttcgaagacgatcttgggagttcttgtagaagaactggatcttcacgtggagatccaacaaaatattttaataatggatcgtagcaagatcagatcttga

SEQ ID NO: 103650 - DNA, 1611 bp, Glycine max
  Peptide Sequence Number=SeqID_220428
atggtgaggtgtgctcatgttaaggccatggatggcaatttcaatgaggtggaagtgttttcgttcagagagaccattatgtttagaagtatggggtggggttgtgaagtgggagataccattggccttgttgggttgaaggtagcaaaggaagtgtgtggggcaggtgtatgcggttggagcctatatgcattgtcttcattcagtcctcgcaaaagaatctccttcgtgtgcaagttctttacctcaaaatgccaagggtttttcacagtattggaaaatggtaggattgttgagtggtggcatgttggtgttggagagagtaggagcgtaaccatggtaattgttgttgcggccagtttgatagtgtcctcgatcattgcaattataatggcactaagtaaggtttgcaattattggaaccggtgtcaagatgcattcttcacgttgcagaaacatctcaaaatccaccagcttgccatagagttcgttgaaagcaattggggggcacgttgttgtgcctatgacatagccttcaagatcacgagctatgagaagtctttgaggccattggaatcagaattgtttgatgatgccatgatggggattgaaaagaagaaaagggctgaaggagagaatcaaggagcatcattgctagcacatgtggatgtaccaatactcttgatatcgttgagtttgatgaagcttccaaagaagaaattcaataaaagcaaaatacaatcaaagcctagggactgcgtttccgcatatcagcctttcgggtgtgacgaggtgtggggtttggatttagatttcggatctgatgagggaaatgagtttggattcaaatgtccacttaagatccatggatcgggggatcatgaagaggaccatgattcaatgccacaactccctagaattctgctactacttcatagccatagagcaaaacatggagtctttttcattcttgatgaagcctcgttagttgctgcttatgttggcaaagcagttcaattaagggactatgttagtgatggtaattgtaatgagaaccttgtactcgtggttggtacaatggctcatgggaaaattgatgctgactatattgacgatcttatatcagatccaaacagcaatagggtttctgattctgagaaaaattccattgatgagctgaagaagctcctgaaagaggaattagaggacgaggaggtttccatttggggtgtccctctcttgaagggtgacaggactgacgtcattctcctcaagtttgttagagcgcgggagctcaaaacactctctgatggaggaaggacttcaacatcaacgcccttctggatgaagatctgggtgacgacttggagaaggtggtgttcatgcacggacacggcagagatggccatcccatctgttacaacgtctacggcgagttccagaacaaggacctctaccacaaggccttgtcctcttaggataatcaaaaaaagtttctccgatggcgtattcagttgttggagcgcagtattcggcacctcgaggataatgaagaagaagctacagtgtttcacgaaacgcacactagggttcaagcggttcacgaaatga

SEQ ID NO: 103651 - DNA, 303 bp, Glycine max
  Peptide Sequence Number=SeqID_220429
atgaagaagaagaaggttgaagcagctagtgtctcgctaagcgagggctttgcgcttagcgagcaacatccgctaagtgaggcactcagcttgcttagcgagttaggagaatctggaaaaatgccaagcatgcacgcgcccagcgtgccattagctcgcccagcgaacgcagcaaagccaaagatctcaactttcaagaggattctaggtttaggagtgatttttaggtttctagaggtggaggagacatcctcaccactgtgcaatctgaattttgcttccaaaaccccctattgtagctga

SEQ ID NO: 103652 - DNA, 306 bp, Glycine max
  Peptide Sequence Number=SeqID_220430
atggcaacaaggcgggtcggggtcggattttgcttatcccgcccccaactctccattccccccgaaactcaatgggggtgtaaatttaccccatccccgtctccaacaggtcagcgggacgggtttgagagcaggcttgggtcgggtattaataatctcatcccgaccccgaatccgactttggctatcgagaaaaacttgaacttgacctcgatcctagtcaactcggattttccctgtcaaaatctaaaagagtttaagatgggtcccatgaactcggatcccattgttatgcctgtacgctga

SEQ ID NO: 103653 - DNA, 777 bp, Glycine max
  Peptide Sequence Number=SeqID_220431
atgactaccgcaatgctcaacactggtaccttcaccttcaccgcacctaaccgttcacaacgaatccacgaaccggagacaatgccgcacgaaaaacaaaatgagagaaacacaggcaacaaaaatggcgtacaatcctcattggaagaaaggcttcatgttggtcagcccgttgagctatttggacgtcgactagtaactgcaacagcacatcgtgatgtaaaggctcagcgacatgcacgacaacaagagcaagcaaatgatgttgtcaatggcattgaggtgattgactaccttacttggacccaggtgtggacgttcatggacgggtcaagccttaagggtttttatgatgtgcaatatactgccttgaataaaggcatttcaaatgcctttcttgagagcatttcgatgaagcaagaggcagatgttgtgacatcagcgggacctaagtaccttagtgatctatcaacctaccaccagcacgcttgggaaataactgcattgacctacctttatgaccatttcttctatgcgagcttgtgtgcgagcaagcaatatggaagttatatgatgctacgaatggttttcaagaatctgcccatcaattgctttttagagtgtttaactgattatgaccagcatcagccacttgttgctagatggtcctcgtatgaggcatacaagcatgtcagaccttttacagaccaaacatactactttggctacatcatgtacgggatagacatacggttgtatcttccaaagagggtttag

SEQ ID NO: 103654 - DNA, 1179 bp, Glycine max
  Peptide Sequence Number=SeqID_220432
atggggcttgtctctacaattcacagcttcaattcaatactattctttctcccatcacgcctagccgaaaaccaatctgctccagtttttgtggagacaaagatttctgctactgctccagctcctgctgctcctgcaattcctcgatttgcttatttgatttccggctcaaaaaacgatttggagaagctttggaggactcttcttgccctttaccatccactgaaccattatattgttcatttggaccttgagtcaccactagagatgaggttggagctagcttctagaattgagaaacagcctgtcttctctgaggtcggaaatgttttcatgattccaaaagctaacatggtcacttacagaggaccaaccatgattgctcacactcttcatgcttgtgccattctgctcaaaagaactaaagactgggattggtttattaaccttagtgcttcagattatccccttgtgactcaggatgatcttctctatactttttctgaggttgacagaagccttaacttcattgagcacacaagtcgtttgggatggaagctggaaaaacgagcaatgcctttaattatagacccaggtctttacaggacaaacaagtctgatgttttttgggttggtcctaagagaactttgccaacagcatttaaactatttactggttcagcatggatggttttatcgcactcctttgtagaatatgttgtgtggggttgggacaatctcccaaggacccttcttatgtactacactaatttcatctcctcccctgagggctactttcaaacagttgcatgcaatgagccagaactagccaaaactgttgtaaacagtgacttgcattatatttcatgggacaaccctccaaaacagcaccctcatgtccttaacatcaatgacacaaccaagatgattgcaagcaacgccgcgtttgctcggaaattcaagcacaatgatccagtcttggatgtgattgataaaaaactactacatagggaaaatgaacaactattcacaccaggtggttggtgttctggcaatccaagatgttctaaggttgggaacattcacaggattacacctagtccaggatctaaaaggcttcgtttactggtgactaggctaacttggatggctaaatttggtcagaaacaatgtatatag

SEQ ID NO: 103655 - DNA, 591 bp, Glycine max
  Peptide Sequence Number=SeqID_220433
atggaaacatgctcaacgacagaggagctattacaaggaatgatggaccaagcccggtttgaaattggtgatgcaagcaagggagaacaacatgtgtgcatgcaattggcagacaaaagcccaagcaaacccaaacctttgatgatccacttcaccagagatgctgcctcccaaaaaccgcgaggctcccaacctatcccgggtaagaagtttgtcccattcccttgcagaagcaacaaggcggtcccatggaggtatgcccctcaaaagcccaacgaaaagaaggacaaggccgtcggagatgacctatcctttgccaaagttacttacatctctggcatgagtggtgtgacccgcagtgggcgtgtcttcgcagcaccggacccgttggtgtggtccaaggatgcgaagggaaaggcaaaggtaggcacgaaagaaaatgacaaggcaagcccaattctcgatgaggagatcccggttgggagatttgctaagggagaggaagacttcagtacgaagaagatatccaccaaagaagcaaatgagttccttcgaatcattcaacaaaacgagttcaaagtgattgaatag

SEQ ID NO: 103656 - DNA, 276 bp, Glycine max
  Peptide Sequence Number=SeqID_220434
atgacattgtatgtgaaaaatactgcattaagaaggagaaatggtcctaattttgtcaaagccatagagacccctcgtgggaggatgtgcggaaaaaggcacaggccatccataagcaaaacactgcccccacatgttgtctcatgggggtttgaatatttagaaaagaagctgatggctgagaagacaaagaaaaaactggaggaagctgatcaatccaaaatcactgaggcaatgattgatcctccatctcccatcagacgacatgtgaagtga

SEQ ID NO: 103657 - DNA, 1062 bp, Glycine max
  Peptide Sequence Number=SeqID_220435
atgaaaatagaaaatgaaaatcaaacacacctaaatgattcagtttctgggcgtaaacaaaatcgaaaaaagaaagtaactttggaggtttggtgtaaagggttcttcatctgctccatcctcacgaacccgtcacagaggatcttactagcgcccaccatctttgccaccgcaatccctctttacgccgctacttggcaccatcccaaggggaggagggctgttgaaaaacttattagacgatgtcagcttgttgagactcctggtgttggtgttggtgaggtcgaggaggggcactgcgtgatgacggatttgggaagtatgatagagatttactgcaccattgaatttaaaaatgcgtgtcgaatatacaactccgcctgcactactacgactcggtgctgtctccttcacagtgtgccacgcacctcgctcattcaatcaaatcagcgcgtggcactaccatctgttgacgttagaggaagaataatgagaagtggtgaggcagacagagaaatggaaatgggttcagtggtggttgaaaaagtgggaggcagatcatctgtcacaagttgcttctcaagataccccctcaagttcgtcatacccaaaaaggtgggttcttccaaaacagatgctgtatgggtttatgccctcaactatggaggtggaattgtatctgtttacaaatctgtgggatccaagtgttctcaacaaatattagaggctagagttggaagcaatgcacttttagctatcattcctgatccagtaacatgcttttccactgcaagatactgtcagaaacaagtcttctgtgtgttgccagactcaaatttggtcatggtcgattggattacaagtgggcgccatgaaagtggagaaaaatgggattttgatctatatagaagcagtaataatatattcttagaagatggtcaacctttatttctggatacggcagcaggctcaactaattatctttactactgtttgggaacgtgcgatcttataaaggagaggtttattccttatacaggatttgtccttgttgttttgtga

SEQ ID NO: 103658 - DNA, 369 bp, Glycine max
  Peptide Sequence Number=SeqID_220436
atggcttcttgttacaaacagatgttattagacaaagaaaaaattggatgtgtacaagaacacatgcacaactaccaagtaattgcaatgattgtactcttggggccaaaggtgcagtatgtccagaatcgtgtgcaagatcacgtgaaagaagttatgtctgagcaattacagcatccttctgctgcttggagtcaccaaagagacaaggccgatcattttattacaaaaccaagcttcatagcttcttgcagtgcctttggtcctaaggacttctcttcagaatactttgatttcttggaagatgaaaggaacaagatttcattatggaagaagattctggtaaaatatgcacttcctcgggaatga

SEQ ID NO: 103659 - DNA, 423 bp, Glycine max
  Peptide Sequence Number=SeqID_220437
atggaagaaggatgctgcaaaatacctaaattccaattgttgtccatatcattttcttacttgggtatcccaaatggggcaaacccaaggcattgcaagttgtgtgatcctatcatcaacaagtgtgagagagagttagcaaaatggaaacaaagacacattccttttgggggcagagtgactctaataaaggtttccaacagtgtagtggataagctggactctcatgacaaccttgaatgttacaagactagacttgttgcaaaaagatttactcagaaaaatgatattgattataaagagacgttttcactagtctcaagaaaggattcttttaggattaccatggcattagtaacccattatgacttggagctacatcaaatggatgtgaaaattaccttttttttagtggagaattag

SEQ ID NO: 103660 - DNA, 198 bp, Glycine max
  Peptide Sequence Number=SeqID_220438
atgaaacaatatcgaggttattctgatttggattttgccggatccaaaactgacaggaaaagcactagcggaacttgccaatttataggatctgctcttgtctcatggcacaacaagaagaaaatagtgttgctttatccactgccgaggcagaatatatctctgctggcagttgttgtgcataaatcttatggatga

SEQ ID NO: 103661 - DNA, 333 bp, Glycine max
  Peptide Sequence Number=SeqID_220439
atgcgggattaccttatggttacctgcacctttcgtcaaccaggggcaaacgagcccgttgacgcgcagagactaacatcgtcttcttcaccttctatcgtcctaacccgtgaagttagggagagcgagtcaggtagtaggcggagatacctcgtggccatccgcacctttcgtcaaccgaggggaacgaattcgacggtttttactctcgtcgtccggaaacattcaagcccaacgatgcgtgagatttttctctgctgggcagggacgatcgagtgcaatggcgtagggaagtgtcgtcgttgtccaactttgtcgctttcaagacactga

SEQ ID NO: 103662 - DNA, 381 bp, Glycine max
  Peptide Sequence Number=SeqID_220440
atgactccaagagctggtagcccgcggagacaccttacggttatccgcacctcgagtgtgattgataagcagaggccaatatggtcatctgcgcccttttcggagatgtctgagttcctcattgaaggatacgtaggagtaagaccttgcttttgtcgtccgccccatatatcttcctcaggcggcgggcccgatgatccaggaggtcatgtgatgtgcacccttttatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 103663 - DNA, 169 bp, Glycine max
  Peptide Sequence Number=SeqID_220441
gttacatatgtgcttaaggattgtgttgtttcagagctaccagtctgctctctcaagaagggtatggctacattgggacaaggagagttgattcaaggctatatccttataatgggtcttgattctatactgccagttcttagcaccctgatagcaatgtatgaagatg

SEQ ID NO: 103664 - DNA, 381 bp, Glycine max
  Peptide Sequence Number=SeqID_220442
atgagaagacacactattacgtttcgcctcgccctcccgttgaagggtaggttgcgacaatcacctataacacaactaagtgtcgtcctcattagggttaaggaggttgctaaggctgcgggctcgccagccattactgatgcaagctccattggagcttgtaggcctaggatcttcttcatcaatggattcctttgcttcttggaagatgaatggcagcagaatggagaaaggaagagagagaggagacgccacttcaaggagaggatgagtctagaagaagctcaccaccataggaggccatggataagagcttggaggaagaaggagatgaatgaagggagagggagagaagagcacgaaattttgtgctctaaatga

SEQ ID NO: 103665 - DNA, 294 bp, Glycine max
  Peptide Sequence Number=SeqID_220443
atgcattgtcttcccaagctatgtaggctttttctgttttttgtccttctttccattctttttagaaagttattttctaaggtagataagacatttgatgtgaccttgcttcccacattcaaagcatgtgaagatcaagaaggtgattcacaattgtcgcaacgtgcccttttgcgggcgagcgaaggcgaggctcacgggtgcgctttccaaaggaggaaagatgtgcggagtcgtcaccaacgtttatttgtggaaaacaccggaaaaaccgaaggaaaccggtcaaaatga

SEQ ID NO: 103666 - DNA, 468 bp, Glycine max
  Peptide Sequence Number=SeqID_220444
atgggtggagtctgcaagttcgatgaaatgactaatgggtacagcaagatgcagacctatagaggaaagcttcttgatccaacaatgaacttgaggaatcacttagaagttggtggattgactatagaggacataatactagtatacctcattacctacattcacactccgaggtcaagtaatgatgctcgggtaacaggtgatgatctgcagattgttgatggtctgaaatcagattatgaatttcattatgctgtacttgcctcaagattcattgactatttgaatgttgatggctctaatgagattgtggattttaccaaagcatctagtgagattatcaaaaggcatctcaagaagcttaacagatggatgaagttgctaaagctgaagctccacaagagcctacacattaacggagtccatttgagtcacttatgtagaagcaaggcttcaagaagattttga

SEQ ID NO: 103667 - DNA, 219 bp, Glycine max
  Peptide Sequence Number=SeqID_220445
atggataaaagcaaggagactacaactcctataaatttctaccttagtgcagatgaaaaagggaaactcattgaccaaacaaagtacaaagagtcacatttctcaacagttaagagagttttgaagtatcttagaggaaccttagatgtcgacttgtggtaccctaaaggtgttgagatctctttattgggagacacagattcaaactttgttggatga

SEQ ID NO: 103668 - DNA, 356 bp, Glycine max
  Peptide Sequence Number=SeqID_220446
atggctctagtgattggtcgcttcctaaggatgactgcatcatcttggaatagcgagaagcaagcatgtgttgccttatctattgttaagggtgattgtgatatagagtttgttgatacatactcacaactaacttatatcttcaccaaacctttagcaagggataggttcttccaccttcatattgaacttggcatcctaagtgtcgcaacctacccttcggcgggagggcgacgcgagactcgcgggaggcgtgttccacgaaaggaatacgcgcggagtcgccaccaacgtttatttgaggaaaacgtcggaaaaaccggaaaagacgcgatctacgaacttttaagtgaaag

SEQ ID NO: 103669 - DNA, 417 bp, Glycine max
  Peptide Sequence Number=SeqID_220447
atgacaccacttaagctgccgtcccttggggcggacgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcctcccgcgagtctcgcgtcgccctcccgccgaaggctttctgcaacaatgtacttaccttaacaatagataaggcaacacatgcttgcttctcgctattccaagatgatgcagtcatccttaggaagcgaccaatcactagagccatgagcaagaggctccaagaagattgggctagagctactgaagaaggccctagggttctcatgaacctcagggtagatttctga

SEQ ID NO: 103670 - DNA, 417 bp, Glycine max
  Peptide Sequence Number=SeqID_220448
atgatggcacatcagttgtcataccctaatttgtccggggaccattgtttggtggcacgcaacctttgcttgaccgcttcaaagtacttaacacccatcgttaggcaatccgtgaggttccgcggcatgctggaagtcgaaaggaagcattgttgcgcaatccgtaaagttctacaacattacagaggtcaaaaagggcattgttgtgtaatccgtaaggaatcaacacaaaaagcaaaatggggtgtatttagtaaaaagaggtgtgcaaatagcaaccaggcccacttgggccttctagggggttccaacagatggcggtgccttctggtggaagcgacccagctcgcctgggtgagctgggcgacaaccacctccctctttttccctataaataggggaaagtgggcagagtaa

SEQ ID NO: 103671 - DNA, 315 bp, Glycine max
  Peptide Sequence Number=SeqID_220449
atgggtgccaagcacctcaaaatgaccaaacacaagttgcatgccaccaagcaaaggtccccggggagattggcattatggttgctgggcagaatgttgctaaatagcaacgccatccatatccatgtaagagtggtcatgttggtgcgcatgatccgcactcgtctttttgcagcggcacgggcgaaatcttgccccggtatgcatattagatgcgtgataacctccctctctggatgtgctcgcacagtgggtcgccctccaatatcagggggtggcccaggaactgataaaaggaaactactggccccttaa

SEQ ID NO: 103672 - DNA, 210 bp, Glycine max
  Peptide Sequence Number=SeqID_220450
atggaaaaaactgacaggaaaaccttcaaagataagaaagcaaagaaagcttacatcacttgggaagataacgatatggattcattcaaagaatcagaaaatgaagtcgtgaatctaagtctcatgaccaaaaactataaaagcgaagaagagaacttcaagatgcattcaatgacttacataaagaatcaatcaaacttgccaaactag

SEQ ID NO: 103673 - DNA, 501 bp, Glycine max
  Peptide Sequence Number=SeqID_220451
atgggatcaagtcaaaagccttcgcttaagaagaggttctatcaagtcaaaatcaagagcttagagggtagaagtctccatggaaccgtaggcccgtctatccgctacaaggtcaccgctcgtgcgtcgaaaaagggaaagcgaattgggaccaactcttggctagcatggaggggcgattctatcttcatgcgaaggatgtccaaatgttcccttgatggaacaaggggttgtattaattataatcccgtcctcgccataagacagcttggctaccctgacagagagcttagggggagcagtaatgggatcatcggcggctatcataagtggctgagagtccgaacacaaggattggattggctcccaaatctaaagactgtgaggggcgatgaggttaaagcttcggaagaaagtgatgaggtacaagccctaaaggaagagcttgaaagagcccgagtagtcgaagagaagttcaagtccatagccatcaaagtctga

SEQ ID NO: 103674 - DNA, 387 bp, Glycine max
  Peptide Sequence Number=SeqID_220452
atgtgtaggtcttgtgcactttcattcgcacatctttttcgaaaagatgtgatctcaggcatcaatcgtgtccagtgtgagacattcctttatccccgaaccgctggccaaaccaactccatgacatatatcatgtccaaccgttctacaagccttgagccaaaatcccaactcaccataaaccttgacccaagcagtccgaggggttggtttacttttggacatgcttcttttgctctgctattctttttcgggcacatttggcatggtgctagaactttattcagagatgtttttgctggtattgacccaaatttagacgctcaagtagaatttggagcattccaaaaacttggagatccaactacaaaaaaacaggtagtctaa

SEQ ID NO: 103675 - DNA, 228 bp, Glycine max
  Peptide Sequence Number=SeqID_220453
atgttgcacattcctcttcttcattcttcgattcttcttctccccgtgccgccgccattcataccgccaatcaccgccaccgtcgttgtcttcgtcttcgcctttgtcgtaagtctctgttatccactctatgagattattgtgaagccattaccaggattgggggagattaaggatccgtataaggcatacggattgtcaatctgtatggctcatatggattggtaa

SEQ ID NO: 103676 - DNA, 273 bp, Glycine max
  Peptide Sequence Number=SeqID_220454
atggatatctctgaagatactgacatccctgtaatattgggaaggccattcatgttgaccgcaagctgcatagttgatatggggaagagaaagctggagctaggttttgaagatcagaaaattgattttgatttgtttgttgaagacaagcctgctccagaacacaatgtatgcttacaggtaatggaaggaggtcaagaggttctgaagatcattgggaacttgttgcataatctgtacataggagtatatcagcctatctttgaatgttaa

SEQ ID NO: 103677 - DNA, 198 bp, Glycine max
  Peptide Sequence Number=SeqID_220455
gcgattccggctccatgcccgcaagttgctgaggacgagtttttaccgcaacacattgatctcaggcaattccggctccatgcccgcaagttgctgaggatgagtttttaccgcagcacattgaccttagggagattcaccagcatagatacagatttaaatgtcttgaagaagaggatagagacgctgcatttgtaa

SEQ ID NO: 103678 - DNA, 156 bp, Glycine max
  Peptide Sequence Number=SeqID_220456
atggcgcttagctcaatcaaaatgaggtttggccgcaagaaggtcagcttagccaccaggattgacactcagctccatgaacttcagttctcgcccggaatgaatcagcctaagatgaaggggttaggcgctaagcgcttgagactcatggcttag

SEQ ID NO: 103679 - DNA, 156 bp, Glycine max
  Peptide Sequence Number=SeqID_220457
atggaagtagcaggaaaaaaatgggctctcttggattcaagaagaagaagaaacccttataaagcagttcttggtgaaggagcgacgattttcacaagaccgaaaagactcggtctttgggggttgataaggtgtcaggttgtggtatctagataa

SEQ ID NO: 103680 - DNA, 321 bp, Glycine max
  Peptide Sequence Number=SeqID_220458
atgcagaggctcccgttcctataccccactgacgaggcagttgtgtctccagcaaagcctccagataggccggatcctgaggtcgatgatcccctgtatcagatgacattgaccatcccacagcttttattgaagcctctccaggttatgaatctgactgagacaagtatgcaagcggggaattccaatgtgtatggattcctcgagccaaagtccattcagagatctgggaaatcgcagtttgaatcggaaagttatatcaagagttggatgcagagttcaaaacgcgatgtctaccttggagcctacctgaatgggtaa

SEQ ID NO: 103681 - DNA, 216 bp, Glycine max
  Peptide Sequence Number=SeqID_220459
atgcatctacgtgatcaaggaataccaggaagccttcttaacaacaaagagaagaacaagatgaaagattgcaaaaatacaagtggtgaggatgtctccttcacctgtaggatctcacaatcactcacaaactcatctcaagctctcaaaccggctcctgcttcaagctctggtctctgcagatcttcacacagcaaatctctcaaaactctctag

SEQ ID NO: 103682 - DNA, 540 bp, Glycine max
  Peptide Sequence Number=SeqID_220460
atgggaaagttgttgcacttttctgccatgggatccacaatcttcattctcttggggctggtagttacagtttacggttttgtggactatggtagtagctctttgtcaagactcaaggttttggaagttgagagaaaattaaagcagcttagaggacattccttaaaaactatccagagtgaagatggggatatcattgattgcattgacattaataagcaaccagcttttgatcatcctgcattgaaaggtcacaaaatccagatggctcccacttataattcagctaagaaggacatgacaatagggaccaaaactactagaactagaaaaaatgcaaagagtggcaaaatgatgaagcaaagggatgaagggtcatctgtgactgtgacttcccaagtgtggcagaaaagtggaagatgtccagagggaacaatacctgttcgaagaatacaagaaagagacatgataaaggctcattcaattgaagattatggaaggaagaagccagcttctctcatcaacatgttggtcaactga

SEQ ID NO: 103683 - DNA, 303 bp, Glycine max
  Peptide Sequence Number=SeqID_220461
atgcaggacattgcttcagatgagatcaaagcacttaaagcaagaaaactcattgttccacagacgtggaagggttactcattgaaaagaggtcctaattatgcacctaaaagaaagaaggttgtcactgacttgacacgagataacttccagagtggtgagtggaaagaattagagttcaaagagtacaactacagtgctaaaggtcagcctcttgaaggtggcaatcttcatccgttgctgaaggcaaggagatataccttcctcctcttttccccaacccaaattctatttgatatttag

SEQ ID NO: 103684 - DNA, 798 bp, Glycine max
  Peptide Sequence Number=SeqID_220462
atggggtttgaagagatgccgacaaataattttgttgagagcagcttctggaacttcgatgccttgttccagccccaacaacacccagctcgtgattcacatgatacattttttctggaagctcgttcaacaactaagatattgccagaagattatgttctgagagttacgcaagttcatgaatctggtggttatgggtctagaggatatgcatatgactggaagagagaggaagcaaataaaaacctcctgcgaacccatacaacttctgtttcctccaggatgctttaccaactggcacagaaaccatttgccccaaaaaaatatttctctatagatcgggtattcagaaatgaagcagttgatcggacacatcttgctgagttccaccagatagaaggtcttgtatgcgatcgtggactcactctctgtgatttaataggtgttctacacgatttcttctcacgcttagaagtgatttcgttattgagttcaggcatgaccaagctgaagttcaaaccagcttacaatccatacactgaacctagcatggagatttttagttaccatgaaggttttaaaaaatgggtagaggtaggaaactctggcatgttcagacctgaaatgttgcagccaatgggacttcctgaagatgtccaagttattgcgtggggcctttcccttgagaggccaacgatgatactgtatgggatagatagcatcagagatctctttggacacaaggtagatcttgggcttataaagaaaaatccaatgtgtcgtcttggaattgactaa

SEQ ID NO: 103685 - DNA, 720 bp, Glycine max
  Peptide Sequence Number=SeqID_220463
atgactctacctggtgcattttatggaccagttcagaaagcaatagcattggcagttgggttccgttacttgggagccaaaggagacatcaaagtggacaacccttctgttgaaaaggatgatgaatacagcacttcccaagtatctctcttaacagggccatacaatgactttgagtgtgttgaagctggttgggcggtcaatcccagtgtgtatggagataggcaaactcggttatttgtttactggacgattagcaatgaaattgctttaggtgctgcaatttatccgatatcaattcctggtgggcttcaatacataataactatttacatctataaggatccctataccaataattggtgggtgcaatatggtgagaataccaacataggttattggccacctgagttatttgaaacaatacgttacaatgcagaatctgtggagtggggtggtgaagtttacagttccactattgggcatactcctcacactgcaacacaaatgggtaatggacaatttgcttcagtttttggtgagtcgtctacaataacaagaatgagaattcatgacaactctgcagccttgaagatcccagaatatgttgctgaattcacggatgaatttaactgctatgatgtttggtatttgtcagattatgttgaagatcctgagttatattacggagggcctggtcaaaatccaaaatgcccttaa

SEQ ID NO: 103686 - DNA, 429 bp, Glycine max
  Peptide Sequence Number=SeqID_220464
atgacacattatgtgcacataactaatttaatgctatgggcagtgatgtttctccaactgtggctacaacagaaaaaggatggggaagcaagagagctgaatctccacccagcccatgaatcttggcacactggatatctacacattggccatagtgaactggtattttcattgagctttctcatcaaagttgccaccaagttacaagggcattttttgccaatgccctgcccatgcattgaatttgacattgacacagttgaacatggactgctagcaggtcaagcagataaagcaccaagagaacccaatgttttactattgctacctaaggtgaaggaaggacctgagctggagatgaatggtgaagctggagtggtgcatgaagatatcagcttgagaggagctctcacacactgggaaagttga

SEQ ID NO: 103687 - DNA, 366 bp, Glycine max
  Peptide Sequence Number=SeqID_220465
atgtggaagcccattaagctgtctagaggtggtcctgccctttcccaccttgcttttgctgacaacctggttttattctctaaggctagtcttgaccaggttaaaatcatcaaagcatgcttaggatattctgcaccagttcgagccagaaagtcatctaaccctctcaaaagcagtgttgacaacattatcgtcctataccatgcaaatgacctaagtatttatgtgaggaccttgataggaaatgtcaaaatttcctatggggggactcgaatgatcatcgaaatatgcacatggtgtcatgtgatcatatttgtaaatggaaacaagagggtggtttgggcttgcatcaaacgagtcaagtaa

SEQ ID NO: 103688 - DNA, 726 bp, Glycine max
  Peptide Sequence Number=SeqID_220466
atggaggggttgtataaagtggtggcggagtataaagaacaaggaggatggaatttgaatcagatacaacatttgttacctgagaatatcgccgatattattcaaagtgtagtgggtagccaagctcaatttatcattaaaagtgtctatgatgaaatccaccaacgtggtattgataatcaaaatcccttttccaacctttcttctcttcagatcggatcagatcagaatcccaccgccatggatttcatgaaggtcttcgatcaaaccgttcgagaaataaagagagaggtgaatctgaaggtgctcaaggttccggaaatcgaacagaaggtgctggatgcaactgataatgaaccttggggtcctcatggtactgtgctggcagagatttcacaggctaccaaaaaatttactgaatgccaaatgatcatgaatgtcctttggacaagactgggtgaaactggaaaagattggcgttatgtatacaaggcattagctgttatagaatatttggtagcacatggatctgaacgtgcggttgatgacattatagaacatacttttcagatatctgcactttctagttttgaatatgtcgaacctagtggtaaggatgtgggactcaatgtaaggaagaaggctgaaaacattgtgtcgcttttgaatgataaagataagatacatgaagtcagaaataaagctgctgcaaaccgtgacaagtag

SEQ ID NO: 103689 - DNA, 153 bp, Glycine max
  Peptide Sequence Number=SeqID_220467
atgtttgtggagattgtctttgccacttatccattgaggtcgaagaaaagtacgaaaggaaagagtcctggaaagggtactcccagggcgttattgttgtttctccttctgcctgagttcgtgtttgtcgcaaactgggctgcgcttccgtga

SEQ ID NO: 103690 - DNA, 300 bp, Glycine max
  Peptide Sequence Number=SeqID_220468
atgactccattgatgaagaagatccaaggcctacaagctccacatggagcttacatcaccatcctaggagcaccattggatttaaagcaaccaaagcctcaccaaattttgagtgaaacacttgagaaaaaccaaaagtggcgtctcaaatcacctttactccttctccattccactgccattgatcttcaagaagcaaaggactccatttatgaagaagatccaaggcctacaagctctacatggaactacattataaatggagaatgtgtacagattgtagggctatcaacaacataa

SEQ ID NO: 103691 - DNA, 1276 bp, Glycine max
  Peptide Sequence Number=SeqID_220469
cgcagttaagacggatctcaatggaaaagtcattactaatgacgatgataaagagattcctgacgctgtgaacacgttaatttttacaatagcccaacatttcattggagacccatccttgtggaaagacaggtccgcagaattattatcaaatcttaagtgtagaaccttagcagattttaggtggtatagagatactttcctaactagggtttacacaagagaagatagtcaacaacctttttggaaagaaaaattcctagccggtcttcccagatccttaggagacaaagtcagagataaaatccgtagtcaatctgccaatggagacattccatatgaaaacttaagctatggtcaattaatttcctatgtccaaaaggtagccttaaaaatctgccaggacgacaagattcagaggcaattagccaaagaaaaagctcaaacaaagagggatttaggttccttctgtgaacaatttggcttgccagcctgtccaaaacaaaagaaaaaacaaacctccaggaaagaagcccaggatcataagccagccaatagaagaagattttcaaaacgaagatactctcaaaaaccctcaaccagtagagaaatggaaaatcctaaactaaaaataaaattaaaaataacgtgctacaattgtggaaaacaaggccacattagcaaatattgtagactaaaaaagaagttaagaaaccttaacctagaaccctcaattgaagagcaaataaacaatttgctcatagaaacctcgaaggaggaaacagaaacagaaacttcatcctctgtgctttccgatgaaaacctaaatctaatccagcaagatgaccaactatcatcaacaaatgatgatgggcaaatcaatactctaacgagagtacaagatctcttgtttgaagcaatcaattccatacctgacccccaggaaaagaaggttttcctggaaaaactcaagaaaacattagaggtaaaacctagacaaaaggattttatcacgaacaacaaatttgatgtaagtaacatactcaagagattagaaaattcttcaaccaaaccaacgacaatccaagatctccaaacagagataaacaatctaaaaagagaggtaatagaacttcgtcaactacaagagattcatcagatcattctttctcagcttgaggtagatagtgattctgaaagtgcccacaacagtgaagtcaatctaccagcagatttagaagatgatatgtttatgggatttaatcaacaagattaa

SEQ ID NO: 103692 - DNA, 550 bp, Glycine max
  Peptide Sequence Number=SeqID_220470
ggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtaggccctgttcctggtgggaacaggggaaggggtcagatttatcttgacgggagcaagagtaataataatgtgtataatgctacagcagcgggtatggaccagaacttcttgtatccagaaggtgaatctatcaaacttgatcagccattaacaagtaatccaaatgtgggtggatttggtcagggggatgcggaaatagtacttcaagatccgttacgtgtccaag

SEQ ID NO: 103693 - DNA, 528 bp, Glycine max
  Peptide Sequence Number=SeqID_220471
atgattgaatcagaaagactttcctatgttagaaaaaaccaaaagaaactcagagttgacaagttctgtagcttgcagcagtcatcggatgctggaaatacaaaaggtttaagtaaaggcaagaggatcatcttaccttcaacctttgttggcagcccacgttacatggatcaactttattttgatggcatagctatatgcagtcacgtaggcttcccaaatctttttattacttttacctgcaatccaaattggcctgaaattcataggttgctgacacctttgaatttgacagcaatagataagccagaaataatctcccgaattttcaagcttaaatatgagcatatgttatcagaccttacaaagaatcacttactagggaaagtcgttgcatacatgtacacaatcgaattccaaaaacgaggacttcctcatgtccatttattgttatttttacacgccatcaacaaatatccatctccaaacgatattgatcatattatatcagcagaaataccttcatag

SEQ ID NO: 103694 - DNA, 348 bp, Glycine max
  Peptide Sequence Number=SeqID_220472
atgaatttactttggcattcgtacaatgtatctgaccatgcaatattacctcagctggatgtgcaataccttcatcctcatgcagccgttgattctagtattggtttgaatccatcccctctattggagctttcagctgcaattggcagcaaagatgtttgtctgggtgctgaagttggatttaatacaacttctgcttcattcacaaaatataatgctggagttgccttcaataaaccagatttctctgcggcacttttgctttacctgcttattgtttcttcttttttatgttctgaagtctctcaactagtgtctgagaagacctatcagcatggaaagacatag

SEQ ID NO: 103695 - DNA, 297 bp, Glycine max
  Peptide Sequence Number=SeqID_220473
atggatctaaatctggagcagaaagaaagcaccaagatttttgttgataatcaagctgctaattctatctcccataatcctgtgtttcatggaaaaaccaagcatttcaacataaagttgtttttcttaagagaagtgcagaaagaaggacttgtgactttggtttattgcaagtctgaaaatcagctggcagatttgcttacaaagccactcccagttagtaggttcgagtttctaaggaaaaaattggagtttgtagctcctaaagcaaggaggagtgttaagaacatgctttag

SEQ ID NO: 103696 - DNA, 210 bp, Glycine max
  Peptide Sequence Number=SeqID_220474
atgtctcctgatcgggtcgtcattggaaaggcatgtcatcttccagtggaaattgagcacgaagcatactgggcagtgaagacttgcaacttctctatggatcaatctggagaggaaaggaacttgcaactgagtgagttagatgatatccgcctagacgcctacgagaatgccaagcttggactcatgagtggtatagttgaggtctaa

SEQ ID NO: 103697 - DNA, 617 bp, Glycine max
  Peptide Sequence Number=SeqID_220475
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctcatacctgtcgggacccgaaagatggtgaactatgcctgagcggggcgaagccagaggaaactctggtggaggcccgcagcgatactgacgtgcaaatcgttcgtctgacttggaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 103698 - DNA, 990 bp, Glycine max
  Peptide Sequence Number=SeqID_220476
atgctgggcaccgccgacgaggaccgtgccgtgctcaacctgggcggtatcgccaacctgaccctgatcccgcgcgaaggcgcggtgcgtggcttcgataccggcccggccaatgcgctgatggatgcctggtgccagcgccataccggtcgtaccttcgatgccgatggtgcgtacgctgccagtggcgcggtagacgagggcctgctggccggctggcgctcggacccgtggttcgcgctgccaccgccgaagagcaccggccgtgagcagttccacctggcctgggccgaggtgcacatgggcgaaggccaatacgctgccgccgatgtgcaggccaccctgctggagctgaccgtggcaaccgtggccgatgcgctgctggcgcagcagccacagacccggcgcctgctggtctgtggtggcggcgtacgcaaccggcagctgatgaaacggctggcggcgcggctgccgggggtgcaggtggaatccagcgcggtgcacgggctggacccggagtacgtggaggccatgggctttgcgtggctggcgcagcggacgatggacgggctggccggcaacctgccgagcgtgaccggggccaaggggccgcggatcctcggggcgattcacctggcccgagcgtgggctcggctctacagcattgtggcgcggccgctaatcgaagccctgccctgcgggcaaggcctgcagggcggcgatggcgtcggagagcgcgtccacttcgggatcaccgaagccggagcggacctccagttcactgctgaacaggccctgctccagcaaagcggcgcaggtctgttcgtgggtccagccgcgggcgaccgcgacgcgtttgatgcgttccagcagcagcgggtccaggtcccgcagcacaacgtcggccatgctcgcttccccgttcgcaaggcaccgccccctcggcgcgtcgaggcgatgatcccgcagaccggacgggcaggcaatcag

SEQ ID NO: 103699 - DNA, 177 bp, Glycine max
  Peptide Sequence Number=SeqID_220477
atgaaggataaatcacaagtttggcgatcccggttgtatggctccgcctcctccaaggaagctttggaatcaatgtttttcaaagactgtgtcggcttgtggggccacactggaatcctcttcaatggtgcccttctaggaccgcttcacggggagcttcttcgtagccaattctag

SEQ ID NO: 103700 - DNA, 380 bp, Glycine max
  Peptide Sequence Number=SeqID_220478
atgcagagtgggtcccaatgtaaatcatttgatgtagaaataggagatcgcttggaggatatgattcgtgatcttggacacgagtcttttcaaccagcacatgtccctatgtataatacattgcaaactcattcaaagaagcctttgtatctggggtgcaagaattccttgacgttgttgtcaacggtgttaagtctagttaatgtgaaagccatatatgggtggagtgacaaaagctttagttcacagcttcaagtcgtgaacgatatgcttccagaggaaaatacgttgccaaaaagttactatcaggccaagaagatattgtgtccgatgggtattgagtatcagaagattcatgcttgccctaatgattgcatact

SEQ ID NO: 103701 - DNA, 513 bp, Glycine max
  Peptide Sequence Number=SeqID_220479
atgtgtaaaaaagagcacaaatccttcaaaggatacgccaaaaggtggagggatttggcagctcaagtggtgcccccaatgatggagaaagagatgataacaatgatagtagacaccttaccagtgttctactatgagaaggtagtgggttacacaccttcaagctttgtaggtttagttttcgttggcaaaaggatcgaagtgggtcagaaaagaggcaaatttgatcatcctgctttgacaaataaaaagcctagggcaaatagagaggatgataaggaggaaggaacccatgttgtgactgtcgtttctacatgtccaaatttcctagcaactcaacagtgtcattactcaaccaatatcagcctttctcattacccaccactcagtcatccacaaaggtcatccctaaatcagccacaaagcttgcctttcgtgcacccaatgccaaacaccacccttaacacaaaccaaaaaaccaaccagggagggagttttccagtgaaaaagtga

SEQ ID NO: 103702 - DNA, 827 bp, Glycine max
  Peptide Sequence Number=SeqID_220480
gtcgactctagaggatcccacaaaagtgcttcacaggtctctgcaggaatcattaatcctgtgcctattcatcgggttttccatgatgagaatgaacaaaagctttgggttaagaagtctgatcatttagaattacaaaactttttgaataaggagtttcaaagtttagaaggaattaataatccttttagtacgggaatcgttaatcaatctgcgagattggatgtcagtaacttttttaacgattttttcaattattttgaggacaaaggaaatcttatcaatgagaagtttgattatgatagtttagatgtgtctggatccgaatataaaggaattcgttttaagaatattgttttttgtgaaggaatgggggtaatgaaaaacccgtacttttcagacattgctgtaattccaaacaaagggcatcatattagggtcaaattatcagaaaaaatttcaactgccgataccataaagaagaaacattttttatttcccattgataatggactttatttttatggtggcacatacgatcgtgagcaattgcatcacgaaattgatgattctgcggtagaccagctgttaagagggttatctgaagtatatccttacgattttaagatacaggaagttaattttggtttcaggccgactgtgaaggataggagacctattattgggagtcatagtgaatattccaatatgtatgttttcaacggattgggggcgaggggaatattaaacggatgttatttttccggaagtttgtatcagcttatagagaaaggaattcctttacctgatgaagttgcccttaaaag

SEQ ID NO: 103703 - DNA, 423 bp, Glycine max
  Peptide Sequence Number=SeqID_220481
atggctccaaagaaactctccacgaagaggtctagaagagacgccacaggagaaggatggtcattccacagggagaggcgtgtccagctcagggaggatgagtacacaaacttccaggaggagatagctcacaggcattggacacctctagtgactcccatggccaagttcgaccctgagatagtcctagagttctacgctaatgcctggcccatagaggaaggagttcaggatatgtgctcatgggtgaggggtcagtggattcccttcgacgcagatgccctcagccagttcctgggtgacccgctgattttggaggaaggccagcagtgtgagttcagccaaaggaggagcgaggtagacgatttcgatgaggaagccatcacccagctgttgtgcataccgggtcaggattttgcctag

SEQ ID NO: 103704 - DNA, 216 bp, Glycine max
  Peptide Sequence Number=SeqID_220482
atgtttcattttcagaaccttttatttattcaagaaacacttaagaccttacacaaatggaacacaagttcggatttgagaacatggctgagcgcagcacttgcaaatcaagatacatgcattgacggattcgacggcacgaacggcatggtgaagggtctagtatccactggtataggccaagtgatgtccttactccaacaacttctcacacag

SEQ ID NO: 103705 - DNA, 447 bp, Glycine max
  Peptide Sequence Number=SeqID_220483
atggcgatttatggagacaacaaacaaaggccacttgatcaacaaccccaacaattgaaagttggaagtggaagttactggcagttggaagttggaaatgaaagttattggaagttgaaagttgaaaatgaaggttggaagttggaaggggaagtggttgtcattatcaaaaagggggagaatgtaaatcatgaagattttgatatcaagaagaatttgcttgagaaagagggagatgtaaatcatgcaagctttgatggtgtcgagaagaaatcacatgtttgtcatcatcaaaaagggggagaatgtgaatccttgtttcaagattcactaaagaccaagtcttgccttaaaacaaagtgctttcaagacatgcaaggctctggtaatcgattaccaggaagtgtaatcgattaccagaagacagggttgagaaatagctattga

SEQ ID NO: 103706 - DNA, 306 bp, Glycine max
  Peptide Sequence Number=SeqID_220484
atggcgcctaccaggcaccctctggacccagataagtccaacagggccctgggtaaagtaatccgaccgccgatcacccgggccttcatcaagaagtactgcacgcctaggcaggcgcagggtgatgcacatcaggccgcagacgcaccgccaccacctcgacaggccgatccagctgggtcacagggccctcagtcagcaggggcaggtgatgcaatcctacccgcaagggcattggatagaagactccaagtagattgggccagagatccaagggaaggccctagggctctcatgagccttagg

SEQ ID NO: 103707 - DNA, 192 bp, Glycine max
  Peptide Sequence Number=SeqID_220485
atgtggctttcaatttttcttcttctctgttttcaaggtcttgcgagatgtggaaagagttgcagactaaggtggcttaattacctaaggccaaacctcaaaagaggaaactacaccaaggaagaggaggaaactattatcaagttacacaagcttgaaaagagttatgaaattgtaaatcctattttttaa

SEQ ID NO: 103708 - DNA, 211 bp, Glycine max
  misc_feature (53)..(53): n is a, c, g, or t
  Peptide Sequence Number=SeqID_220486
ttggctggcgttgttgccgttgaggtcacgggcggacctgaagttccattccnaccctggaagagagtcaacccaaataggaaatcaaatcaacataacaacaatgggagaagttacatgtttcctttttcaaatactagcacttcagaggcttaacaacaactatgctctcgactttgtagttgatagatacacatgcaacatttgttaa

SEQ ID NO: 103709 - DNA, 864 bp, Glycine max
  Peptide Sequence Number=SeqID_220487
atggaaatccaatcttggaaacacagcataccacttttttttactacccaaggttttgatatatttcgaaatcgagaaatttcaagtggagcgggtgctatccgagaacaattggccgatctggatttgagaattcttatggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggtccatcactttcattacatagatgtggattgccccgcgaaatagcaatagaacttttccagacatttctaattcgtggtctaattcgaaaacattttgcttcgaacataggaattgctaagagtaaattcgggaaaagaccgattgtatgggaatacttcaagaagttatgcagggacatcccgtattgctga

SEQ ID NO: 103710 - DNA, 536 bp, Glycine max
  Peptide Sequence Number=SeqID_220488
acaacttgcaatgtatctcacaatgtagtccaactatttaaccataataataaccctgctacaagcttccaatctacaccaccatcgcacgagactttatctatagatgattctgaacgatgctcaaaaagacatgcaatcaatgtttcttccatccagagaaatttgatgtcatcttatgacaatcaaaaaaatataacaactgcttctacatccacattccaagccagtaatgcttattccaatataacacaattagacattcacagagatgaacatcagagaccaactgacactacacaacatgatcaatttgtcggctatgacagctcagatttcaatgatgatgatgtcaatatgacacaggaaaacattgatatagaatactcattgaatgacccaacaatagatgattttgatgattatgatgaacagacctttctatctgcctcatctacataccaaaatacaggtggtacttacattgatatcggagatcctgtatgggaatgcccacattgtaaggctatgatgtg

SEQ ID NO: 103711 - DNA, 1227 bp, Glycine max
  Peptide Sequence Number=SeqID_220489
atgagtgaggccgcggcgccgctgattggcatcgtcggggcggacaataacggacttaacgggctggagaagggctttgaccgggtactgcagggcgagccgggtaaagaggtgtatcgccaggacggggacggcaacattattgcgatgatcgattacgagccgccgaagcagccgccgacggtgcagctcagcatcgataagtttgaccagtttacgctgtacagcaagctgcgcgacggcgtgctgctcaacaaggccgattcgggcgcggcggtgctggtgaagatcgacaccggcgagatcctcgctatggcatcttatccgtcgttcaaccccaacaattatgacaacgccacgccagcgcaaatgcgcaataccgccatcaacgacagctacgagcccggttcgacggtgaagccgctggtggtgatggaggggctgcagcgtcatctggtgcgccccgattcggtgatcgacaccacgccctacagcgtcaacggccacctgatccgcgatgtcggccactggccgcgtctgactatgaccggcattttgcagaaatccagcgacatcggcgtgtcgcacatcgcgctggcaatgccggcggaagcgctggtgaacacctatcaggcgtttggtctcggcaagccgaccggactgggactgaccggtgagagcgtgggttacttcccgctgcatcgccagcgctgggcggacatcgagcgcgccaccttttcgttcggttacggtctgcgcgtaacgccgctgcagattgcgcgtgaatacgccacgctcggttcgtatggcgtctatcgcccgctgtcgatcaccaaagtgacgccaccggtgctgggcaggcaggtggcggatccgcagatcgtgcaaaccgtggtgcacatgctggagagtgacgtgctgccgggcggtaccggggtgaaagcagcggttccgggctaccggctggcgaccaaaaccggtaccgcggagaagatgggcagcagcggcaaatatgacggcggctatgtcaactacaccgccggcatcgcgccggccagccatccggaagtggcgctggtggtgatgattaaccatcctaccgctggcgatcactttggcggatcggtggccgcgccggtatttggcaacatcatggggccggtgctgaaacacatgaacgtggcaccagacgcgatttacagtaaaccggcatcagataaatcttaa

SEQ ID NO: 103712 - DNA, 255 bp, Glycine max
  Peptide Sequence Number=SeqID_220490
atgctttcttttgacttccggcatgtcacagaacttcacggattggctaatgatgggtgccaagtatctcgaagtggtcaaatgagggtcgcatcccaacaaacagatggtccccggacgaaattagggtatgacattgaggaagcttcttggggaagctacatgagttgcctcggtaaaaatgctgcccagtcttcgttatcgttggatcagatcgaaatttggtctgcagctacacaagacacttgtccatga

SEQ ID NO: 103713 - DNA, 423 bp, Glycine max
  Peptide Sequence Number=SeqID_220491
atggtcattcctctgaagttcaaagcaccaaagtttgataagtacgtggggactgcttgccccgagaatcatctaaaaaggtgctatcggaagatgggggcatatgcgaaagatgaaaagttgctaatgcatttctttcaagagagtcatactggggcagccgtcacatggtacactaatcttgaaccttcccgagtccattcttggaagggcctaatggttgccttcattaggcagtatccgtacaactctgatatggctccggataagatgcagctacagagcatgtgcatgagggggcatgaatccttcaaggaatacgccccaaaggtggagggacctggcaactcaagtagcacctccaatgacaaagaaagagatgatcacattgataggggacacattaccagtgttttactatga

SEQ ID NO: 103714 - DNA, 408 bp, Glycine max
  Peptide Sequence Number=SeqID_220492
atgcaaatcaatttaaatgtcatattcagatcaaatagcggaagcaaaaggagtacaagcgtacctccaaccattgcagatgaaacacgaagcggtgcaagcacgaacccgaagagaagtaggtttggtgatacaaaactgagagcaccccatcctatttatagtgtctgcctatcacagagtttaaccaatttgttatcagaacgtgggcttgagaatagggacctaacttctactaaaggaaaattgcttatggagaaaacgacggcgtttaacggtttaccgtgtttggtttgttttctacaagcacatccgaagctggatgagatagagagagaaaagggatcatggattatgccaatattcatgatattgggtgctctgattcttgcgatcttctcatcatag

SEQ ID NO: 103715 - DNA, 486 bp, Glycine max
  Peptide Sequence Number=SeqID_220493
ctgcaggcctcgctgcagggcacgatccgctacgacaccacggtgaacggtgcgaccaactacaacagtgtcacgctgggcagcaccaacagcggcccgaccacggtgcgcaacgtcgccgccggcaacgccggtaccgacgcagtcaacgtggaccagctgaagtcgggcatggcgcagaccctggactggtctaaggcctacaccgacgagcgcatggggggcttcgagcgcgacctgcgcaagaccgacaaccgcgcctcggccggtatcgcttcggcgatggccaccgcagccctgccgcagcccagcgaagcgggccgcagcatggcctcggtcgctgccggcagctacaacggcgagtcgggcgtggcggtcggtatctccggtgtctccgagggagggcgctggatctacaagttcagcggctccaccaacagccgtggcgaggccggtgtggccgtcggtgccggcatccagtggtga

SEQ ID NO: 103716 - DNA, 378 bp, Glycine max
  Peptide Sequence Number=SeqID_220494
atggccgcagtgctgggcctggtcctggggatgggcctgctggccgcctgtcgcagccatgcgccggccgccgagggtcctgccgaaaccaccgccgtgcagttcccggaggcttcgaaggcctcgttgaaggaaggcatctatcccgacgtcgccgacctgcgccgtttcgcgccgggcatgagcaagcgccagctgtataccttgctgggcacgccgcacttcaacgaaggcatgtggggcgtgcgcgagtggaactacctgttcaacttccgcaccgcgcagggcgcggagtatttcacttgccagttccaggtgcgcttcgacagcaagggcatcgcccaagggggctactggaagccggaatcgtgcgcggcg

SEQ ID NO: 103717 - DNA, 423 bp, Glycine max
  Peptide Sequence Number=SeqID_220495
gacatgatagaagtgtcctctttttaccaccgacaatgggcactagaataccttgagtttgtgaactttagatatgatggaacaacataccaaatcaggctaagacagcatcgggcaaaagtctactttgcggaagggttgaacgaattcaggaaagatttatcaatttttgaatctgtgatcattaaattcttggcatgcaacaacaaatccatgtttgatctttatttcgttccctcactggaatgccagacttgcggaagaccacaactgatgtcaagacaacatatttggacacttgaaatcacacaatcaatgcttggtgcaccaggaccattgagactccccaactgtgccatgacacatgtaaattcctgcggtcaacacatgaccattctcagaagatttggacctccattatag

SEQ ID NO: 103718 - DNA, 549 bp, Glycine max
  Peptide Sequence Number=SeqID_220496
atggaagtgcagaaaagtgaagcactgctactggggtttcagcattaccttctgactcttggcattaccgttctgattccaactatacttgttcctcaaatgggtggaggagatataatacccataatttctattattcaagccaacagatataaatcatacacagatccttatgaggtcaaaaggtttactcagacaatgagagggattcaaggtgccttgatcacaacatcatgtttccagatggctgttggatttttcggtttatggaggaatgctgttaggttccttaggccactctgtgtagtcccttatgtaactttcactggactcagtctctatcgtcttggtttcccaatgtatcttaatcgttatatgagcaccaagaagcctatatatgaccggtattcagtgctattcactatttcaagtgcatggttatttgcactggttctaacttcatgcactgcgtataaccacaagccacaaagtacacagaatagttgccgcactgatcgtgctggactaattagtgccgctccatggtaa

SEQ ID NO: 103719 - DNA, 717 bp, Glycine max
  Peptide Sequence Number=SeqID_220497
atggattatcattcacaatacagtagtgctagtgaatcaggttggactcattatttggaccaatcctctcttcctgaaaattactaccagaggagaggtggtgttgtggagtgtgatgaaggaaaaggagcaagaatggaagagtactctgaggaagatttgtccatggtctctgatgcttcttctggacctccatattatgataatgaatgctattgtcagaattggtatccttgcctttcttctacaaccaaagattcccaaaagaagaacaagaaggtcaaagaatatggcagaagtcaacagccttcgcctcttgatgacactgcaagctctccttttttcaactgtgccaaggagagtcacaagaagcaagacagtttctcagggaatggagcagtggagagtgcattgaatttttctcaatgtgtatctgcaacaagaataaagagaaagacaaaattccagaagcactttggtttcttagataggtctcttgctggaaaactaacctcagaggaacaaggcatctctgggacctcccaggtcttctcctttggatactattcacaaactcttcttgagatgcacaaaactgaattaactaatttcacccctcattctagagaaaaagggaaaagttgtttcaccaccatgaagcatgcatatatcaaatccaaagggctagtagtaatgagtagtgacccacttgattaa

SEQ ID NO: 103720 - DNA, 1714 bp, Glycine max
  Peptide Sequence Number=SeqID_220498
atggccgaactcttcaggctcagttccgtcgagtggagcccttcgccggtcatcgctttagccaccagcttcgacggctcgcgtgtcgccgccgcccgcaaagacggctccctcgaaatctggctcgtctctcccggctccatcggctggcactgtcagctgactatacacggaaaccctaacggaagagtaacgtcgcttatttggtgccccggcggccccgacggaagccgcttgttttcgtcaaacatagatggctccgttactaagtgggatcttttccacttgacgcagaaggttaatcctaacagaattcttaaagttagagacactcctatgtgttcttgcttgctagaaaatgatgctgatgtggccgcaattgctgtctgtgatgtgattgcggagtgtcaaaatgccttgacattgcgtgtcacaatctggcaaatggcagtgactttccctaagagtgacgagatcaatgataaaaggaagggtggacaaatggggaatgggtttcatgattttgatgaacatgagagcattgaaagtgatgaagatgatgattctggttcacctggtcctctcgggctattggttggtgagcatccacgcgtggcaattgcccttgacaatggatgtgtgagaatttgtgatatctctgacacagatgaatttattcttgtaaaatctttgcccccggtgaaaggacgagttttaagtgtgacttggagtacagatgctaactatatatattcaggaagtagtgatgggttgatacgatgctggaatgctacattgggcaatgaaatctataggattacagctggacttggagggtctggtacacttgttagtgcggacagcagtggtagtgtccagttttgggacagtcaacatggaactctcttgcaagcacattctttacacaagggacatgtacatgctctggcagcatgtcctagtcataatagggtgttctctgctggttctgatggccaggtaattctttacaagctatctagtagtcagtcaacatcatccaatgatatcaattctccatcaacaatgaagagatggatctatgttcactatgtaagggctcatacacatgacatcagggccctagctgttgctgtaccaataagtcatgaagcagatattaagccagaaaagaggattaaaagagctcgacgtgcagaaaatcccattagtttccgttaccataagtgggctcatttgggggttcctatgcttatctcagcaggagatgacacaaaactttttgcatacccagtgaaagaattcaccatgttttctcctcatgatatctgtcctgcgcctcagagaacacccattcaactagtgcataattctgtctttaatcaacgcaaactgcttttagttcaatcttcgcaaaagatagaggttcaattgctacaactaaaaaatgtccgcacttctggaggctttacaaagaacgttgtagtggctcaagttaacagtaaggcatctcagaagataatttgcagcaccatttctaattcaggggcgctatttgcatactctgatcataaaaagcctagtctttttcaattgaaaagggatgaagttggaaaaatcaagtgggatgttagaaaaagggagcttcctcagatattaccatttgcccattctatgattttcactcatgactcctccaagttgatagtagcag

SEQ ID NO: 103721 - DNA, 1778 bp, Glycine max
  Peptide Sequence Number=SeqID_220499
gtagtggattcagcgccgccgcagaaggtcggcgaagagagagaatcagtggtttcaagaagaagcttttcaaacccggacagggattggaattccccaacttcgacgacgtcgtaactgttcgctgtgttggaattggaacattgctcgatggaacaacgtttgattccactagggagagggatcaacctaggacgtttgctcttggaaaagatgacattggtgctggtttggaccgtgccattatcactatgaagaaaggggaggtggcattgttcacgttgcccggagatggtggtgatggcgatgtttcgcttgattccgacgactcttcggctgtgcggtttgaggtggagctcgtttcgtggatcacggtggtggatgtttgcaaagatggtggagttgtcaagaaaattctggagaaggggagtggcattgagcgccctggtgatcttgatgaagtgcttgtaaagtatcgggtggtgcttggtgatggcactgttgttgtggagacgctggaaggaggagttgagtttcacatgaaggatgttattaatacggttactccagatgcctttggggagaaggggagagaagctggcagtgggctctgttcaattcctccgaattcagtgctgcatgttaatattgaattggtgtccttcaagcctgtcataaatgttactggtgactccaaggtgattaaaaagattttgaaagaaggggagggtgctttcacagccaatgaaggtgcaaatgttactgtgagcttcacagctatgctagaagatggcactgtatttgagaaaagaggaattggtgaaacactacccttggaattcataactgatgaggaacaagtgattactggtctagaccgagctgtggcaacaatgaagaagggtgagagggcgataattagcatacatcctgattatgcatttggagatgttgaagtgagacgagatattgctattgtgccaccgggctcaaatgtagtctatgacattgagatgatggattttattaaggagaaagcaccatgggaattgaatagtaaggagaaaattgaggtggctgggaggatgaaagaagaaggaaatgtattatttaaagttggcaattatcagcgagcaggaaagaaatatgaaaaggctgctgattttgttgatgaagatggatcctttgggtttgatgagcaaaagcaagctcagacactgaaagtgtcatgctggttgaatagtgcagcttgtagccttaaacttaatgactttcctggagcaatcaagctatgttcacaggtgcttgatgttgaattttgcaatgtgaaagctttttacagacgagcacaagcatatatagaaactggagattatcttttagcagatgtagacatcaagaaagctcttgtggtggacccacaaaacagagatgttaaggtaattcagaagaaattgaagcaacttcaagctgacagtgacaaaaaagatgctaagctatatgaaaacatgcttgcacgtaaaacaaaggacccatctatggctataaagagattgaaggtagagaaagatcagggggaaaatgaagaggttgcaagaatggaaattgacgaagttgctgatagcgcagttggtggttgtaggaacggcgatgttggggttgttcatggtagccgccaaaatggatttgccgtcgaaactacttgtcctgacgaaaagtctgacacaccaccatctccagtgaaccctaacgatgacactataggattcaacgaataa

SEQ ID NO: 103722 - DNA, 303 bp, Glycine max
  Peptide Sequence Number=SeqID_220500
atgtttgatggcgataactcatcactttttcttggagacaaagctttctttcagaaaaaagaggctgattttgccaaaagactgattgatgcagacattgccgtagtgggaaaacaaggtgaaattgattttgaggaagctaagttttcacagcatttgaagaagggagaagctgtgagtgactttgctaagttaaaaatcatttcagagcaaaggaaatatctgccagaagagttattacagggctgctttttggcaaaatgcaaggaacttatgggaatccaatctctcgagttgatgtaa

SEQ ID NO: 103723 - DNA, 198 bp, Glycine max
  Peptide Sequence Number=SeqID_220501
atgactctctctttgttgattaaggaaccagaatccaacaccattgttgcctcgattagctacctccatgtcgtattgtctccttcttccaatgttgatattgatgtcttttcctctgcatcgaacacactgaaggattcaagctttgtccaaccaagctctcgtcactgctcatgtctcttgggcatgatgacgtga

SEQ ID NO: 103724 - DNA, 381 bp, Glycine max
  Peptide Sequence Number=SeqID_220502
atgaagaatttgaggctagactatcttaagctagctgcgggaccaaagcgtaaacgacgcctttatggtactggagaccttgctcatacttacaaatgcggaaatgacagcttcatgcagcatacacaaggttcttctagtcgcgatgaagatgcttcagaaattaaccaactaagggtggaggtgcgtcaatcaaaggaagagatgtgtgtttttcagccaattatccttcagttcctacctcttgaagcaaaaaatattattcatcaacaacaacaacctcaccagcagcacgaccatgtagatgaccaacaggcagatgaccaacatgaacatgatgaccaacagaggcactctcctgatgactattttgattattga

SEQ ID NO: 103725 - DNA, 261 bp, Glycine max
  Peptide Sequence Number=SeqID_220503
atggcgatatgtagaagccatagggaaccgccagtcaaactggcgagttccatggtacaggcctacgttgcaggccagctagggtgcaggagcttgcaggagctttttcagagagctttttcagaaaggggagttgcaactgccattggcgagttgcctgcaagttgcaactcccattggcgatttacacaagaaaaaatagccatcagcaatggtgattttgtgcttataaatacagcagttagaaggtatagtttttag

SEQ ID NO: 103726 - DNA, 453 bp, Glycine max
  Peptide Sequence Number=SeqID_220504
atggacccatgggtactagtacctatcgccttaagagggttgtatgccctcaccttcagatggctgcacgtcctcgcctttagagggctccacgtcctcgccttaagagggttgcacgcccttgccttcagagggctgctcgccctcgccttaagagggttgcatgccctcacctttagagggctgcacgtcctcgcctttagagaactccacatcctcgccttaagagggctccacgcccttgccttcagagggctacatgccctcgccttcagaggactacaggtcctcaccttcagaggactacacatcctcgccttcagagggttgcgcaccctcaccttcaaaggactacacgttctcgcctatagaggactacttgtcctcgccttcagaggactacacgtcctcgccttcagagggccacatgccctcgccttcagaggactacac

SEQ ID NO: 103727 - DNA, 474 bp, Glycine max
  Peptide Sequence Number=SeqID_220505
atggtactagagaaaggctatataccaagtcaagtcatgagtatatttctggcactattttatgcctccattatcacattcatctcccgaagtctcattccttctccttattatcttaacaagcctgaaatcccagagttagtcctagggactctagtagccatagtaactggggcaatactaccccttatggggtttcttatctccaacatgataaatactttccttgagcctacagatgaactccgtaaagactcaaagttttgggcattaatgtttattgcccttggtgtagctggcaccatatttcatccaataaggtcatacttttttgctgtagctggctctaagttgataaaaaggattgggctgatgtgttacaagaaaattattcacatggaagtaggctggtttgacaaagctgggataagaagtgagatatacaagttgcgggtgatatatgtgcaaaattaa

SEQ ID NO: 103728 - DNA, 556 bp, Glycine max
  Peptide Sequence Number=SeqID_220506
atgcaggaaacacatgaagtacctcgagaccgcactatagccgacttcgagcctcacctcgaatatgccatagagggcaagcatttggtggcatacccctgccaaacactttggggggccctcaatactgcccacaaccacacctacaacccttacatttcgcgagactatccttttgctgacatggtagaattgtgcctagtgcccgatgtcattatccctctgaagttcaaggtgtcagactttgataagtacaaggggactacttgccccaagaatcacctgaagatgtatagtaggaaaatgggggcatactcgaaaaatgaaaaattattgatgcatttcttccaagaaagtcttactggggcagctgtcaactgggagcatgaatctttcaaagaatatgcccaaaggtggagggatctagcagctcaagtagcgcccccaatgatggagagggagatgataacaatgatagtggacacgttactggaattctactatgagaagatggtgggttacatgccttcgagctttgcagatttagtgtttgcgg

SEQ ID NO: 103729 - DNA, 831 bp, Glycine max
  Peptide Sequence Number=SeqID_220507
atgacataccaagctagctctaaaggttactgttattttatgcaacagcagggaactcaatttgaaaggaaccagtcttctgcaggttatcaatgggagtcataccggcaatctgattatcacaataaagcagaaggaattcttaatttggatgatctgttaatgaaattcaaagatattgtagagtcaatacaagatgcctttagaagaactgaaactcagattagtaagttggtggatgacatgactaacgctgcggctaggaaagaggaagagcgtgtagagattgaaatacatcaagaaaacattcatcaagttacctccatctatcatcaattgaccaatgaagaggaaaagcctgaagtctccagtactccagaatatccctactgggccactgttggctatgttggagggaaagataaaggtagattggaactcagtgtggaggatcaaaagatctcttttgacatctttgaggccacgaaacactcagatatgggtgatgcctgttttgacgaagaagaagaggtggagcaggaaataacattgttagcctcaaccatggtactacagtctcttttggttaaagaacatggctatgggagagattgcttaccttgtgatgaagagctcgatgattcaaaagacagttgtgttgaccaggtggtttttgaagaattggaaaaactgagaccagcaaaaaagcccaaagcaaaattaaagacccttccggcacatttaaagtatgtattcttggaagaagatgagaccaaacctattataattagcaactctttgaagaaaggagaagaagatcaactggtgtag

SEQ ID NO: 103730 - DNA, 330 bp, Glycine max
  Peptide Sequence Number=SeqID_220508
atggttagaactagaggtttaggtcgtgccctaggtagggttataggcagagccctggggagagaggatcatcatgattcagatgatgttctccagcggcaaaggcctacagcatccgcatgtaggcaatgggaagttgcccctattgctgaggatgctcatgatatgactgaggacgtacctgcaactagtgcagaagctactgatggtggtgagggatttcctattgatgatgctgagggattcctaggtgggacgtgtgacccatcagtgctgactgagtttggtgaccatgttgcacttagcatatggaacggagaggtattttaa

SEQ ID NO: 103731 - DNA, 1254 bp, Glycine max
  Peptide Sequence Number=SeqID_220509
atgagatttaagaaagggaataaggtggaagtgttaagcaaagttgaggtgccgtgtggctcctggctatatgcagagatcatttgtggtaatggccaccactatactgtgaaatatgatggatatgaaagtgatgctggtgaggcaattgtggaacaggtgtccaggaaagacataaggccgtgtccgcctgcacttgaactcacagataattggaattcaggtgatgttgtagaggtcttccagaatttctcatggaagatggctacagttttgaaggtttttgggaaaaaccacattttggtcaggctacttggatcttctttggaatttcaagtgagcaaatttgacattcgggtgagacagtcttggcaagatgacaagtggattatagttggaaagcaattgcctagttctgttggctgtagacgtggatactgttacacatcatctgttgagttgggttcttccagccatgaaaacagaaaacgttctagcgcccaacttcagaagatgtatacaaagacaaaactgtcaggttccgcttactatcgtcctgaaaagaaaaaactgagtattctggaatccaaactcgtttcttttaaaacattgaaacgaggaagcaattcacaagttgacgcatatgctaagcctcccccaaagtttagagcacgtgaaaatgaaggcagatgtcacagagcaagacttagaaatccacccacaccactcaaacaggtacagggtgtcagttttccaagagaagtgatcgctgaagaatgcatacctgcttctgtaaacaacagaaaaactgggatttctaatatggttgacatggagaggaggaaacagacaggagaaaacttagaatcaaatcatgcttatagtgttacatgctctgttggtagttgtagtatcactagcaggaattcctataaatcgcaatttcctgtatatgcaggtccttttgatgatgtagacagttcatttagtgatgctgagtctgtctgccagaggagtgatgaggaagggaattgttcccctcctacacaagaggaattggcggcagaaattcataggttagagttgcatgcctatcattgtacaattgaggcattgcatgcatcaggacccttaagttgggaacaggaagcattaatgacaaacctccgtctttcgctccacatatcaaacgatgaacacttaatggagctaagaaatttgatttcttctgaaaacagcattcctttcagatga

SEQ ID NO: 103732 - DNA, 288 bp, Glycine max
  Peptide Sequence Number=SeqID_220510
atgcacaagtactggaacagcattgttcaaagcagtcatggcagctacaagactctgagcatgcattcctccgcaaaacagatatctgaggctcacaggtggcctgaaatggaagaatgcgagaactccacaaacctatggatgtgttggcttatcaagggccacactagaaaagccatcccttgtctagagcaagaaagaatctgtagaaatctggaagcaacacctatatgcctccttctcagccctggaaaatgcaggggaagcattactagtaaatgcaaatga

SEQ ID NO: 103733 - DNA, 99 bp, Glycine max
  Peptide Sequence Number=SeqID_220511
atgtacaacttcgcaatgtttgatgacattgtaaatggctttgtcggcattgactatttaatagatgttattggtgagattgttgaaattggtcagtaa

SEQ ID NO: 103734 - DNA, 333 bp, Glycine max
  Peptide Sequence Number=SeqID_220512
atggtgctggagaaaggttgccatcggctcatatccaccatcgaacttgacggcattattgttggaagaaggaggtggggcattttggtccattcagctttgtatgggaggtccaagaaacattcaatcttcgacacgaatgttcacagtagaatcactaattgtgctaattcatgcttcttgcgggatctaagtttgagtaaaattcatgatcctggggcagatccttacgtgcatgaacgaagaggaaaaagtatggtcatttttctatctcgggattcattgctgaatcttactagtttaaacgaaggattgcgtgtgttgtcagattaa

SEQ ID NO: 103735 - DNA, 285 bp, Glycine max
  Peptide Sequence Number=SeqID_220513
atgtttagcagttacgcgtggtactggactgagaaggagggaacaagatatttctcttcccatgaagcagatcgagagatagatgttggtcggggtatccctttgtcccctactagaatttatcaccatcattatcataaactgcaaccatcatcgttagcaactgtcaccacctttgtctcgatggccgttatcattgtcactgtttttatcaccaccaccagcgatgcgacaatagttatggtaacgaaggtgataatggtcatggtgataatgataggttaa

SEQ ID NO: 103736 - DNA, 201 bp, Glycine max
  Peptide Sequence Number=SeqID_220514
atggagcaccggagaaacttctgtacatacttctccagaaatggggggcacagtgggtgtggttgggtggcgcggtggtggcctgctgaaatgcgcggcgaaacagcgctgttggcacggtggctcgagactgaaacgggtggaagatcgggaacgggatgcggcggcgggagatcggaggtagcgggtactagtgggtga

SEQ ID NO: 103737 - DNA, 1980 bp, Glycine max
  Peptide Sequence Number=SeqID_220515
atggacgatggcatgcaattgcaaatctcccttgacaagctaccaatcaagcgcttggattccattgaagaaaatggaattgaacgattcccaccagatgtggattacgatgagaagcggctctccctaattaggcgaattgacttcgcttgggctgttgagaaggatgaggagaagaagaagaagcagaagagctcaaaggagacctcaacgccatggcaatggcagggcatggtagaaaatttgcagttggctcatcaggagctctctgtcatcatagatctcattaacactgttgaagcaaatgatgcagtaacagtggctagcatgacaagaccaaaactattaccaaatgaagctttgtctgacctggctgtatctgcagccaccaagctgcaatgttaccgccatgttgggaaatatttcaagcaatctgccaaggcttttgaacaacaggttgctcgggaagctaggttttatggtgcccttatcaggttgcagcaaaattggaaggttaaacggcaacgtcaggcagctattgttccagggaatgaaggcttcacctttgatctctttgataactcatatgaccaagcagctattattcgctcattgtctatgtccactgttcgagttaatcatgatgcagctggaaatctggcaataaatgtgtctccggatttatgccattctctccaatttggtttcgttggtgcacaatcagatgatacaaggaggaaatccaatcaaaacaaatcccacttttcaggtgagcttaatttgggaaaaacaggtgaagagtccttaagtgatgaagagtgtgttaagaaaacacattcactccttcgtgaagtacatgaagcaattttcaatgaacaggtgtttgatctggtgaatcgagaagcatttaacacagttgcaggtgtcagtgtgactggaatacgggaaaattatttacaattaagcttaggtcaagaaacctctgtgtacttaacactagtgtccaatagtcaagatcattctacagttgaaggtgaactcaccgataacgcagaaaatgcaattttacctctggaatcatctgatggaatgaagcgtgaagccaaacagaacacctctaacaaagggcagttttctaattccatctgctatgagatttatattcaacagatttttcatgaatatatatttggaaaaggtggtgataaaccaagttcctctggaaatcgtttgtctggcatacaggcaaaggatggatccagtcttcttggtcatttttttaaatctttagctcacaggatattttcaactaaagttcttgcagagctggaaaacgtggtatgcaaggtcccgtatatacagctaatttctaatcccacatggcattctcgggcttcgtcatggacactctacatggaggttcctcaatctattcttcgtggtagccaaaccaaaacatcagattattatgagaaaaatgctgtcaagcgtcagttttggactaaggtggtggtaaatgatgattgcatcaacgttaaagctgaaggttctccaaatgtcgctggcctgttcaagggaaagattgaggaaacccattcaataaacaaatataactgcaacttagctgatcttcctgtgattattctgcagcaggttgcgagccaaattattaattggctctatcaggaagctatgatggttgggataaaagcaaatcgagacttcttatgcctatctttggagctggagcagggtgaaacacttggcctggttgcaagtgttgatccagaagatagtgaagggtgtatatcttggtggttggtcatggaggacagttttgcagaggagcaaaagcttcatatgagcatcacggatggtgcatccgaatataggaaattcctaggtcacttgtctcttgatttgttatacgcaacactgatcgacttggttagcttgtgcagtggtggaggcagccaatga

SEQ ID NO: 103738 - DNA, 1107 bp, Glycine max
  Peptide Sequence Number=SeqID_220516
atggaggacagaaaagccaacataatctctgttatatcagtgattgcactgatcattctcgtcatcagtgctcgtgttctcttaaagctctcacgtgccttcttcctcatatgtggcgcttctattgctgcgatcctcgctgtcttttcctgtgtattcataaggcaccgttacaaccgtagaaggaagttgttggagtcacagttgaggacagaagggcgagagcttcgaatagagcacattttcctaagaaaagttgccggtgttcccacaaagtatcgtttcaaggaacttgaggaagcaacggatggttttcaagcacttttgggaaaagggtcctctgcttcggtcttcaaaggcattctcaacgatgtaacttcggttgcggttaaacgaattgacggcgaggagcgtggggagaaagaattcagatcagaagttgcatccattgcaagcgtgcaccatgtcaacctctacatcccaaacgggtccttggattgttggatttttccattgagggagaatcatgcacgtaggggagggtgtttgccgtggagcttgaggtacaaggtagctatcgatgttgcaagagagttgtcttatcttcgccatgattgtaggaggagggttttgcaccttgatgtgaagccagagaatatactcttggatgagaattacaaggctctagtttcagattttgatctctcaacgcttgctggaaaggatgtgagtcagctatgggatggttctattggagatagttggagggaggaggaatgtgtcgagggtggaggatccgagggacaggaccaagaaaaagtgggactttttcttcccaagattgtgaatgtgaaagtgagggaggggaagttcatggagattgtggagcgagggggtgttgaggagagtgaggttactaggttggtgtatattgcattgtggtgcatacaagagaagccaaggttgaggcctagcatggcacaagtggttgacatgcctgaagggcgtgtgagggtgaatgagccacctggttcaagaatgattcttgttgatttacttgctgttgatgaagaccctgcagatcataaaaatttgcaaggttgttga

SEQ ID NO: 103739 - DNA, 2244 bp, Glycine max
  Peptide Sequence Number=SeqID_220517
atgaaaatcgtaattgcgaagaatcccattaatcttgtcaactctcagggttcgcttgttcttttccgtgctccttcccttgctcgaaattttcttcacgcttcgagctccaaatggccacgcagcaccaatcccctcatgttttcgttttcttcattgagagtttcagtttcgtgcgcttcttcgtcctcgactgtgtacggaggttgggacgatcttggcagttccgacgcgcctggtgagtccaacgcgctgcgcaattttctcgtttctatcggaatcgatgataggaagaacgttttcgtgttcctattgggtctcgtttgtgcgttggcgatttctagggttaaggtttcttctattgtcgttcttcctgcttccgcgttggttttcgccgttggtttcacggtagggtttttccgaaacggaacgttcggtgaggtgagggcgagtgggagtaagaggagggaaaaggaagagaattcgaatttgaattggaagctgtcttgggagaaattgaggagtttggtggaattttttgacgagcttgatcttgtggtcgataacttgaagaatgatgtacaaagtgctattagggataataagattcgagtggatgatttttatggttatgttgaagtcacggataagattaaaatttcagctaagaatgctagggatgttgttagggctttaattgataatgaggaaaactctggtggtgttttggttgagaaccataagagtggtagaagaaagaaacaagttggagaaagtgggtaccagatgctccagtcttttagcagtttgtttggggaaaatttgtttagctccaatcccaccaaagtcagagaaaatgttaagcaagaggcagtggatagaacgttgaatcaaactcgaggaaatggtaatgtgcctctagttgaagacagggctttgaatttggttgatgatcataagggaaatcgtaaattggatctggatccttctcaagactcatctactaactctgttttggatatgaacaaaaatggaagtataagaactactcccgagggagaaaatgttggcttaggggacattcggagaagcactaataaattctttgatgataaagagtatagttacaggaacaaaggattgagattcacaaataatcacagcttctctttgaagatggattccagcagcgtaacagacatgtgggaatcccaagacagtctgattgattctgagagctttaaagtcagaacaaaacgcatggaaagtgagtcctcgtttttgcgtgagcagctgctcgatggaggtcatgagactttcaggtcttctcacgacaagagggagggtggatctgacaggtctcagtataacaatgatacggtgaattatgatgatcatcgccatcttgcagatgatttatctgcacacgagaatgaattcaataccccttcatctacaaagatttcagatgatatgatgtttgataggtatcttgctgaagcaacagaccttctaaaacaagcaaaagagtttataaaaggtaggcagggtgaagagcaagctgaaatcatgttatacaggtccgcaaacttactatccaaggctgtggagttgaagcccatgagtttgttggctgtaggccagttaggaaacacttaccttcttcatggagaattgaagttgaagattagtcgtgaattgagaactcttctttctgggagcatccaaccatcatctgtcaaacatagtagaatattgaagggactgaggaataaaatcaatagtaaagaggaagttgcaccatttcttattgatgtttgtgaagagtgtgaagagctactagtggaggcaggcagaaagtataggctggcattgtcaattgattcaaatgatgtgagagccctgtataattggggccttgctctttctttccgaggccaattgatagcagatattggtccgggtgctgcttttgaggctgaaagagtgttcctggctgcaattgacaagtttgatgctatgctgttaaagggcaatgtttatgcaccagatgctttgtttagatggggtgtggcattgcagcagcgatctcgcttaaggccaggaagtagtaaagagaagttgaagttactgcaacaagctaaaaggctatatgaagatgcccttgatatgaactccaataacgggcaagtgaaagacgccttatcctcatgtctcgctgagcttaattatcgacagttttag

SEQ ID NO: 103740 - DNA, 654 bp, Glycine max
  Peptide Sequence Number=SeqID_220518
atggaatcctcctcctcctcaagccatcaagaaggtttcatgggctattgcggtttcaataccaacatgatagtggaattgcttggtatctttaacggtctcaacattgctaaggctgctagtttttgcactgttgcttgcgagacaaattctcaaatagcgttgcagatgatctctcaaggaaatgcttgctccgattggttggctaagacgggagcaaacccacaagataaccttcgtttgattagttcttgtccttcacctatgcattatttgctcattgctaatgccatggtcttaaatagcgccactattgcggcggagtggctcctgcttgctatcccaccaaagccggagtggcccctttccgcgatggagagccttgttgcggggtggattgaagtagccatggttatcaaaatcacactcgagcaagttaggatagaattgcgagtctgcatcgagtttgcgagtttgttgttccctcactctatcccgcaacggtgggattgtgaaagcgaaggcaaggtgcgcatgcgtggtgcccgcagccacatgcgtggtggccgtggcgacggtgaagtgtgtggctgcaacaagccaacaacggtgaagggagtctccgcaacggtgagtgcgatggcccgagactag

SEQ ID NO: 103741 - DNA, 387 bp, Glycine max
  Peptide Sequence Number=SeqID_220519
atgagcataatcctaagttcagcctttttggtcaaaattgcagctgctttgtgcagctgtctacttcctgaaagtcttcaagtaacaagtgttaaacagctacctgaatatcatgaatgctcggaagataaatttgtcgaatctctttctcctgccacaccccgtgagtcaacagaaatagatgaggagcaagaaaagcaccttctatcgccatcagatggaactgaggatgctcatttcgttaaagaggacgcaagtgaaataagtggtgtctttgagggtagtgaatcgcaatgcccttccataccatatttggaggaaagaggtgacaaccgtgacatgaggaactcaagagggcacttctttttgctctctgtgattttctag

SEQ ID NO: 103742 - DNA, 273 bp, Glycine max
  Peptide Sequence Number=SeqID_220520
atggaaggtttgaagtttgctaagaatgctttaacaaaatttagagaaagcataaagtatgttaaagggtcagagggaaaaatgaatgccttcaaagcttgtgttgttaaagtgggcagtgttgatacaaaggttggtttgtgtttgggtgttcctactaggtggaactccacatttgtgatgcttcaaagtgtacttgcataccgatgtgtttttaatactcttgctattgaagatgcaaattatgtgacttgtcctacagctgaagaatga

SEQ ID NO: 103743 - DNA, 603 bp, Glycine max
  Peptide Sequence Number=SeqID_220521
atgaagctttggttgttgagcttaccatgcagagagagtgtgtgcatcccaagtgagcgtgagacacttttgaagtttaagaataatctcatagatccttccaataggctttggtcttggaatcataataataccaactgttgccactggtatggagtcctctgccacaacgtcacttcccatcttcttcagcttcacctcaacactacgttttctgctgctttctatgacaggggagcttataggagattccagtttggtggagagataagtccttgtttggctgatttaaagcatttgaattacttggacttgagcgccaattatttacttggagcaggtatgtcaattccttctttccttgggacaataacttccttgactcacctcgacctctctcttactggattctatgggaagattcctcctcagattgggaatctctcaaatttggtgtatcttgacctgagttatgtttttgccaacggaacagtaccctctcagatcgggaatctctctaagcttcgatatcttgacttgagcgacaatgatttacttggagaaggtatggcaattccttctttcctttgtgcaatgtgttga

SEQ ID NO: 103744 - DNA, 273 bp, Glycine max
  Peptide Sequence Number=SeqID_220522
cggaaaggcacttcaagtcggagtcaacggcattccgggtcacaggaaaccccaattcctccctccattccctctggatcattgttctcatcagaggaacagcgtatacgaaatccatgaaggtaccctaatatctgaggtttatgggattaagatggtcattgaccaatccctattttatgatttaacaaaattacctagtgaaggtgtgccttttgagggtgcactgattgatgattggaaattcgattgttctgtgcatgatgtccgtcg

SEQ ID NO: 103745 - DNA, 965 bp, Glycine max
  Peptide Sequence Number=SeqID_220523
atgaatttcacacaacccaagaaatatgcatctaaatcttctaagttgattgataagcaagtttcccctactgaattagcatcccaatccaaagttgattggcagacatcgggcaccgaaaatgtaacagcagagtcaaatttatcaaatagccatcatgactttgatcctactctcttgggaggcttgccttctagtaacatgtttgagatggatgttaagatatttgactcatcaaatagtgggggtgaaatggatgatgataatgctcatgagcatggctacgtttctgaatttgagaaggagacaactcaagctttggggcctgcattggtggagcaggttgatagaaacattgattgtgataagtctgataaagagtgtcttactggagaagatgcaaagttgcagtttaagaagaagaaatcagaaatgaattcattatctctgcatgaaaaagacttaggtaaaggccaagatccttgtgatgtacctaattacgtgaaagataatgctattactctgtggaaaagatttgaacttagcacaacaaaattgtctcttaagttggatgagcaattgcaccatgtaatggagcctactgtggccagcaagctccaaggggattataaaattgggaaaagaataaatatgaaaaagagttgttgtggtgatgttgctattgaagctttggttatagtatgtcctgttgtttctcaattggaaatgggcagcttggttgttgctagttttggaacaaaaggaaacaaaaagttattgcatgactttgacaagccctttactggaaaagttagtgttaaggagaagatgatctccaatttgacattcaaggaagagaatactattgttgatgagccagttgttaatctattgaagtacttgactaacaagctagatgttgcacttgcaaaagcacgacttccatctaggcataaccctttaca

SEQ ID NO: 103746 - DNA, 1446 bp, Glycine max
  Peptide Sequence Number=SeqID_220524
atgaatactcctattatcgtcaccactatcaccaccacacgggacgaacccgactatgatagcagctcctcttcgattacggtgcccgaatcgagcaggagctggatgaccaacctcagctttggcagccggcgccgccggagctcggtctccgtcagctcctccaccatggagagcccgcacgcgaagcctcacaaggccaaccaggctgcatgggaggcgatgcggcggctctggcgggacaaggggcaggtggggctggaccacttccggctgctgcggcggctggggagcggcgacttagggaacgtgtacctttgccagataaggaaccccgtggtggggttgccgcagtgtttttatgcaatgaaagtggtggacagagaggcacttgctataaggaagaagctgcagagggcggagatggagaaggagattctggccatgcttgatcaccccttcttgcctactttgtacactgagtttgacgcttctcattactcttgcttagtcatggagttctgccccggtggagacttgtatgcagctcgccaacgccagcccgggaagcgcttttccatagcatccgctaagttttatgcggctgagacactattggcactagagtatcttcacatgatgggcatagtgtacagggatttgaagccagagaatgtgcttgtgagggaggatgggcacatcatgcttacagattttgatctttcgctcaaatgtgacgttatcccgaagctgttaaggagcaagaccagattggaacgcagcatcaagagtacaaagagatctgtgccagcctgcactgcccccatgcagcctgtgttgtcatgtttcttatcatcaagcaagaaaaagaaagcgactgtgacaacagttataagggaaaatgttgaggtggaagaaaatgatccagagctggtggctgagcctattgatgccaagtccaagtcatttgtagggacacacgagtacttggcaccagaagtgattctgggccaaggacatgggagtgcagtggattggtggacgtttggggtgttcttgtatgagatgttatatggtagaacacccttcaaaggtgaaaataatgagaaaacactcgtcaacattttgaagcagccattatctttccctagaattgcagttagcagcagcaaggagtttgaagagatggtgaaagttcaggaccttataagcaagttgttggtgaagaatcctagtaagagaattggaagctgcatgggttctgttgagatcaaaaggcacgagttcttcaagggtgtaaattgggccttaattagatcagttaggccccctgaggtccctagtgaaataaacaaaattaggagtagggttttgctaccaaaacttagcaaaacagacagcgatcagccttatcagcttagaagtcatcattttgaatacttctaa

SEQ ID NO: 103747 - DNA, 423 bp, Glycine max
  Peptide Sequence Number=SeqID_220525
atgaccaagagaaacgttgctgctaattcttcttttgagactactagcttggcttctctgcaccaaaagttggccatggccaagcgatgctctcgtgataatgcatacctttctcaagagctaagacagcagttgctgctagtattgccactgccattccaactgcaactggctagtgtaaggatgctaccttgggcaagagccaatctcaatcacactgctcaggctctcataatttccacagtgacgggagcagcatatttcatagaagctgacaagactgtcttggcaactgcaagaagaactccttcaaccaaccctccaatgcatgaattccaaatggataatttagattttggattcggcttcactacgttgggctatcttagcattaaccaatcattgaacttatcatatatgtaa

SEQ ID NO: 103748 - DNA, 160 bp, Glycine max
  Peptide Sequence Number=SeqID_220526
aaactatgaggtggctactgatatgttaatgcaacacccaaggccatttaatgcaggaaaactgatttggacagctagcgcaagggttgaaatttcgagcaataggcaggataatgcatgtctttcaaacttgacttttaggttcacacttgcctcttaa

SEQ ID NO: 103749 - DNA, 291 bp, Glycine max
  Peptide Sequence Number=SeqID_220527
atgggtgttttgaagaaagcaacttcagaaatcaaagacttggtaaatgtctactcaagatgcagatctgttaagaatgtcttggctgtggcacctgaaacatttactatcaaatggtttctgcagaagcttggtcatgaaggtctcaacaatttgctgatggcatatgatgataaatcagcttatgccttatgtgtattttcgtttgcagctggttcaaacagtgaacctatcacattttctggaaaaactccggtatctcaatccccgtatactatttgccggacataa

SEQ ID NO: 103750 - DNA, 351 bp, Glycine max
  Peptide Sequence Number=SeqID_220528
atgagctggtatggaggagattggatgtgtggtgtttgcgagcacataaatttcaagaagagggaaacatgtcagagttgtagataccccaagtatgggggaactgacccttcaacctacagatacaacaagactgaagcattagcaggggattggttctgcaactgtggagctcataactatgccagtagatcaagctgctatagatgtggtgcaatcaaagattattactgttcaggatatggcacaaaatctggagaatatggatcttacacttttcccctaggatggaagaatggagactggctttgcccaagaatgagaagaaatttcagaagacctggaatatga

SEQ ID NO: 103751 - DNA, 2211 bp, Glycine max
  Peptide Sequence Number=SeqID_220529
atggtgtcgtgtctttcccctccctttgttcactttcttccttcctcggaccctccatacaagcttcttgaaaaccaccctcatctgaatctgcttgccaaatgccccgacatccccagcctcaaacaaatccactccctcatcatcaaaagcggtctccacaacaccctcttcgcccagagcaagctcatcgagttctgcgccctttccccttcccgagacctctcctacgccctctctctcttccactccatccaccaccaaccacccaacatcttcatctggaacaccctcattcgcgcccactccctcacccccactcccacctcctccttacacctcttctcccaaatgttgcactccggcctctaccccaattcccacaccttcccttccctcttcaagtcctgtgccaaatcaaaagccacccatgaagccaaacagcttcacgcacatgccctcaagctcgcccttcaccttcatccacacgtccacacttcgctcattcacatgtattctcaagttggtgaattacgccatgcgcgcttggtgtttgataaaagtactctgagagacgcggtgtccttcactgctcttattactgggtatgtgtccgagggccacgtggatgacgctcgacgcctttttgatgaaattcccgccaaggatgtggtttcatggaatgccatgattgctgggtatgttcaaagtggtcgctttgaggaagccctggcgtgctttacacgcatgcaggaggctgacgtgtcgccgaatcagagcactatggtgagtgttctttctgcttgtggccatttgcggtcgcttgagttggggaaatggatcggttcttgggttagagatcgtgggtttggtaagaatcttcagcttgttaatgcactcgttgatatgtattccaagtgtggtgaaattggtactgcgcgtaagttgtttgatgggatggaggacaaagatgtgattttgtggaatactatgattggtggttattgccacttgagtttgtacgaggaagccttggtgttgtttgaggtcatgcttagagaaaacgtgacgcctaatgatgtaacgttcttggccgttcttccggcttgtgcttcccttggtgctcttgaccttggcaagtgggttcatgcttatatagataaaaacttgaaaggcacgggtaatgtgaataatgtttctctttggactagtatcatcgtcatgtatgcaaagtgtggctgtgttgaggtggcggaacaagtgtttagaagcatgggttctagaagtttggcttcttggaatgccatgatatcagggttagccatgaatggacatgcagagagggctcttggccttttcgaagaaatgatcaatgaggggttccagcccgatgatatcacgtttgttggagtattatctgcttgtactcaagctggttttgtagagcttggacaccgatatttcagttcaatgaacaaggattacgggatatcaccaaaattgcaacactatggttgcatgatagatctactagctagaagtggaaagttcgatgaagctaaggttctgatgggaaatatggaaatggagccggatggagctatttggggttctctgcttaatgcttgtaggattcatggacaggttgagttcggtgagtatgttgcagaacgcctctttgaattggagccagaaaattccggggcatatgtgcttttgtcaaacatatatgcaggagctggcagatgggatgatgtagcaaagataagaactaagttaaatgacaaaggaatgaagaaagttcccggttgcacctctatagagattgatggtgttgtgcatgagttccttgttggtgataagttccacccacagagtgaaaatatttttagaatgctggatgaggtagataggctcttggaggagactgggtttgtgcctgatacttctgaggtactctatgatatggatgaggagtggaaggaaggggctttgactcaacacagtgagaagttggctattgctttcggtttgataagcacaaagccgggaagtacaattaggatcgtgaagaatcttcgtgtttgtcgaaattgccattcggctactaagttaatatccaagatcttcaatagggaaataattgcaagggatagaaaccgttttcaccatttcaaagatgggttttgctcatgcaatgaccgctggtga

SEQ ID NO: 103752 - DNA, 354 bp, Glycine max
  Peptide Sequence Number=SeqID_220530
gggaaaggcggcaaacaagaatgtgtttgcagtggttcgcacggagtcggtagcaagtcacacgacagcgacaatgggttccattcttggaaccaaaagttctctatgaagttggggcagcacacgaggtgtgtgacgattgaggtgaagtgcaagtcgggagtgggagtcgtgagagatgttggcgtggtgagaattgcagtttcgaatcttcttggagggttgggtcttggattcgccactgatcaggatggtggggtcgttgctgatgccactgtaacccgtgaacgccttgtaggtttcatacggggtgttaagaatgattgttgttcttcgtcattgtctattagagtt

SEQ ID NO: 103753 - DNA, 984 bp, Glycine max
  Peptide Sequence Number=SeqID_220531
atgtctatgcagacactgaatcaccctccatttctgactggagatgcctttagaaagaggactcagactcggtgcagagggagagcaaattcaaccacagctttgcagttatcttctgatgagagtggaaactttgcagaaccaggtacttcccttatgagatgtaaaaactctggttcccttctaagccaaccaaacactgttggtgttataggaggggtatcacttctatcaactctgattttcttggagaaacttgcttgttggggttcaagaaatggtaaagaatgtccaccttttgttgtttccagtgatcctgagttgagcaaagtgctttcattacgtggtcctcttccttctgcaaggagcagatttgatcgtatcaaattgaatcaggaccttgtgattgagaatttgcggagcaaaaggaactttctgcagcagtctggagctcgtggtttggccatgccttgccatctctcacatgcgtggcacagtgaaatttctgaggatagttcactaccctttcttcatgatggtgattgtgttgccatggaactcaagaacgccatgttgaagccaattcatgctgctgttactgtggggattggacttctgactacagattcaaattttgtagctagttattaccaggagaagcttcaaagtcagggatttgaagtagtgtttctagacaaagcaaccgaagaacatgtattggttcctgcaatggaggcgttgtacagaaaggacgtggaaggggcaaggaatttattgagaattgcaatccatgttcttttggttagggcagtgaatgtggtgcttctggcatctgatgatttgctgggggttctccctcacaatgatcctcttctacggaaatgcatagacccaatggatgctttggccaggtcaactatacattgggcagaaacaacggcagagaatttctcatttgctacagcacctttctttgatagatag

SEQ ID NO: 103754 - DNA, 450 bp, Glycine max
  Peptide Sequence Number=SeqID_220532
atgttcctaagccttcactctcacgcattctccggcaaccctctgctctccaaattcccactttccggccaccccctttcaccctcttcagctctcgaagccctcaaagcgcaaattggcctaaacaacactcactcttctccctccccgagcttcaaggtgctgcctttcagaaatgggaggcctttggcctcttccgcggccgggtccggcgactcgccgccgatttggcatctgggttggctcggattggacgaaataaggggtatattcgagaattcaggtgcccagttgagcgtggactcattggtgtatctgagttcgagtgcagaggacgacgccgtttactgggcaatcgatgtttctgataaagtacctgaattgggtagcaacaaggagaggttgtgttttgtggatcttcgaacgctcatggtggctaccgactggtag

SEQ ID NO: 103755 - DNA, 432 bp, Glycine max
  Peptide Sequence Number=SeqID_220533
atgccaggttttcatttgatcccactcagaaattgggtctggatattgcctcttgcatccttacaagggctccattgggacaagatgctgaaggaaaaccaaaatttgttatacgcccggtacttgcatccgaatcttcaggtatatcctgaagggaaaatgagccagcattttgcaagcttaaaaccgggtgatgttgttgaagtgaaaggccccattgaaaagctcagatatactcctaatatgaagaagcatattggcatgattgctggaggcacaggaattactcctatgcttcaggtaattgaagctatattgaagaatcctgatgacaaaactcagatatctttactttatgctaatgtctccccggatgacatactgcttaaacaaaagcttgacattctagcaacaagccacccaaacttaaag

SEQ ID NO: 103756 - DNA, 747 bp, Glycine max
  Peptide Sequence Number=SeqID_220534
atgcaacttcctaactactgggtttggcctggccaggctaaggcactgttggaatggcataatatttcacgattttgtgggcattgtggagagaaaacagtcccaatggaagctgggagacggaagaaatgttcaaatgattcatgcaagaagaggatatatccacgtgttgagccaaaagagcgtgttctattggctaaacgaccaatgcatatagctcgcttgtatacctgcttatcaggtttcacagagccaggagaaagcttggaagaagctgtaagaagagaaacatgggaagagactggcattgaagtgggagaagttgtataccacagttctcagccatggcctgttgcaccaaatagcattccatgtcagctgatggttgggttctttgcatatgcaaaatcccttgaaataactgtggacaagacagagttagaagatgctcagtggtacagtagagaagatgtaagaaaagcattgacctttgctaaatacaagcaagcccaaagaactgcagcagaaaaggtcgagcaaatgtgcaagggactagaaaagaatcaaagcttggcttcagatctcaacgtggagagtgctgatgaacaacacgctcccatagtttttcctggaccctttgcgatagcccatcaccttatttcttcttgggtcttctcagatcaaaatgtagtaaatggtgttgaatgcaattcaaaacaacccatccgttctatgacaaattcgtag

SEQ ID NO: 103757 - DNA, 519 bp, Glycine max
  Peptide Sequence Number=SeqID_220535
atgcaacctatacccactttttccttcaagaccagggttgtggctgcagcgcttaatcctgcagattctaagagggctcttggggttttgaaggacactgactctcccttacctagtgttccggggtgcgatgttgctggtgtggtggtcaaagtgggaagtgaagtaagcaaattcaaggttggggatgaggtttatggtgatatcaatgagtacttcattgaagctgctagccttcctttagccatcatcactgcttatcaaggatttgaaaaagttgagttttctgctggcaaatctatacttgttctggggggtactggtggagttgaatcccttgttatccagataaattcatataaactctcaagtcaagtaagtacacttaatgagtttgaaatcaactataatataattcatttcatcaaggataatagaagatacaaatgtgggaatacaatcatgatcctggatgccagcatgaaacccagaggcccttgcaatattatgagctactag

SEQ ID NO: 103758 - DNA, 267 bp, Glycine max
  Peptide Sequence Number=SeqID_220536
atattctacactgtagataatccaacaaaaaattggagaggaggtgcggggtacatatcaaaggatattgttgtgaaaggcttacccggccctagtgatgatactcttatacttgtgtgtggaccccctggtatgatgaaagcaatatctggagaaaaggccaaggactggacacagggagaggtttctggcgtcctaaaagaggctggatacactgaacaaatgttgtctagcatggaagtcaataatgggcatctgtgggggtaa

SEQ ID NO: 103759 - DNA, 1542 bp, Glycine max
  Peptide Sequence Number=SeqID_220537
atggaccaagattcgctcaagcgctacaccgattgcgtttatttcttagcctctcccctcacttgcaagaagggggctgaatgtgagtatcggcataatgagattgcgaggcttaaccctagggattgctggtactggctatctggccaatgccttaatccaacctgtgcttttagacaccctccattggatgggcatactggagcgtcagtgccatctgaacctacgcaaacttcattacctgcaaacaagacaatggttccctgttattttttcttcaatggatcttgcaacaaaggtgacagatgctcatttttgcatgggcctgatgatagcatttttactgtaaaaccggtgaagaatgacaatggaagcactgatgcactcaacctagaaaataaaacatcatctggaaatagaataggtttagtgtcaacaccaactgatcaatctgtagctgctccaaagaatttgtctgatcttaaacttcagcctaaggaagatcatcagctggaaatacccaaagatgttaagcagcaaggttattacctagagctatctgcttcagagtataaagaagctgcagtgagtaggtcagactcttcaattccagatgatggctttgttcataatgtacctcatttatgcaccgagcagagttcagaggagcaagtaaatagtcacatagagcctgaggagcggtgggaatcatcccctcattcccctggatttgatgttcttgttcatgatgaagtggataacttgggttatgaggaagattctgaatatgtaacggtgggtgatagggatgagcaagagctggatgatcagtactttgggtatgaatttaaagattcagttgagtatgatactatctgcccagaagctgatattctgtatgaacaagaaacatatgatggttacagatttttagataggggtcttattcatgctaatggcagaacaattcatgcttatcccagagatgtattcttagatcctagattgtccaggaaaaggattcggatgtcagctgagatggctgcttatgacaagaatttagatcttcgtgaccatctgaggagacgtagagaaattaagggtcctcctgtttcaaatttcttaagacgagaatcatctcctttgatgattcgaaagcaggaaaggcatcagaggcatggcattgagcagcgaccaattagaagattgacatcacaactgggatatagtgctatagattcgattggagaggttggaactctttcagttgctaacaagcacaggaaaccagcttttaaacaaaggggatttattcacgagttctctgcattttcaggacctaagactcttgcagaaattaaagaggagaagatgaagaaggctgaaggaagtttacattggaaaagcacatcaactgattttcaggatcccaaacctttgagtgaaattctcaaggacaaaaggaccatggatcagacgaagtttgctgatgacggtgctttcttagcatcctttacggtgctaggagattgccattggtag

SEQ ID NO: 103760 - DNA, 364 bp, Glycine max
  Peptide Sequence Number=SeqID_220538
tgatcaaggggttctcacaaaccctaagagaataaagatcatttctgagtggcccactccaccaagtgttgagggaagaagcctagagtttcaggggacctctggatttgaggtcaaatccttttcaaaggggaaaggaatgatgcaatcctacctcccaagggcattggatagaagacacaaagaagattgggctagagatgcaagagaaggccttaggtggcgtctcctctcaactcttcttcttctccattccgctgccattaaaattcaagaagcaaaggacttcattgatgaagaagatccgaggcctacaagctccaatggagctacatcatgtggtatcaagagcgtcttcatctag

SEQ ID NO: 103761 - DNA, 432 bp, Glycine max
  Peptide Sequence Number=SeqID_220539
atgcaggagaaggtcctaggggctccaaacaatgtagaggcttacttagattgggaaataagggtaaagcaacaacttaaaaggaagtctacttcaaaatcttatggctctcactcttatccaaagaaataccaaggtcaaggcatcttaggggcgacaccttctaagcccaaagatgataaggggaagacaatagaaaagcaaccccctaaggctagtatgcaagaaaagactagctctataaagtgctttaaatgtcttggaagaggacacattacttcccaatgcccaaccaagaaaaccttgattatgaaaggccatgacctttatagtagccaagataaggctactacttcaccttcctctagtgaaagtgaaaaagcaaaaggggaagaatctaatgaaaaaatctacccccaagaagaagaataa

SEQ ID NO: 103762 - DNA, 357 bp, Glycine max
  Peptide Sequence Number=SeqID_220540
atgtttgccatcactttcaacactccaccatctacatataatcttgcaccatctagttcttgttatcgtccatcattacctactcaaatacgtgacatcagtcacgaagatgaggacgagaaggaggataacaacaataacaacgatgatgatggtgatggtgatgatgatgatgacaacggtggtcatcatgttcctcaacaacaacggacaattacacgtgagcatcctagaacaagaggaggtagagactgtagatcaagacgacaacaaacacaaacaaatccagtccaacaagatgagagacccaaacgcgtatcaagaagaactcgttgtgggacatcgtctcattattag

SEQ ID NO: 103763 - DNA, 183 bp, Glycine max
  Peptide Sequence Number=SeqID_220541
atggatgacacttctgcacctgctcctacaattgcattgcttgtttcagttggagcaagtcgagcagctaaggttgaccaacaacaaaacacacaatgtggcaatgggaaaaatgcaggatatggtaatcgaggtgtgaggaaagaaagcaatggatacgatgatgatgattttctactataa

SEQ ID NO: 103764 - DNA, 120 bp, Glycine max
  Peptide Sequence Number=SeqID_220542
atgggtagtcctagtcctattggtcccatcagagaaaaagctttaatcaacactgcccaaagaagaaacttcaaagttcaattcaaaggtcaatcaagccattcacagacccacaggtga

SEQ ID NO: 103765 - DNA, 206 bp, Glycine max
  Peptide Sequence Number=SeqID_220543
ggcaaggagatagagcgtttaaggccgttaaagaaggtggaaaagttgtgacaatagtacccccaggacatccaccagctatttttttcgtgctcacttcaaagggatctgtcttagagaaattaagaccttattttgagagtggtaagctgatgccaagactcctgtgccattttctcaggttattgaagccatttcctacttag

SEQ ID NO: 103766 - DNA, 318 bp, Glycine max
  Peptide Sequence Number=SeqID_220544
atggatgaattgaatgtaaatagtgcagcagaggaaccaagtgggagttataaggaaaactttgctcaacaagcatcaccaaggagtacactgagtccaagaagcattcagagtgattcaattgatttggctattgatggagtggtggatacctcaattgagcaattgtatcacaatgtgtgtgaaatgaggagctctgatcactcaccctccagggctagtttctactcttacgactatgatggtgagtcaaggattgattcagaactgggccatcttgctggtgatattgtggatttggagatcacaaaggaggtg

SEQ ID NO: 103767 - DNA, 177 bp, Glycine max
  Peptide Sequence Number=SeqID_220545
atgttgggcactgtagcatcaccctctaaaaacactattattaagtcaaattttgcggagatgttgcggttgaaacgtaagaagcatagggtgtcgggattaacggcttttggacgcgaaaagactagggacaagggaaagggtaaagtgaccgtccggttccgtgtgagggagtga

SEQ ID NO: 103768 - DNA, 1284 bp, Glycine max
  Peptide Sequence Number=SeqID_220546
atgatctcctcgggtgagaatcctcgaaaagcgcttgatttggctgttagagctttgaaatcatttgagatttgtgcagatgggaaaccgagtttggacatggtcatgtgtctgcatgtcttggcaacaatatactgtaatttaggacagtacaatgaggccattcccgttcttgagcgttccattgatattccggtgttggaggatggccaagagcatgcactggctaagtttgcagggtgcatgcaattgggtgacacttatgcaatgatggggcagattgagaattctctgctgttttatgcagcaggtcttgagattcaagggcaggtcctgggggaaacagacccgagattcggcgagacatgccggtatgtggccgaggcacatgttcaggcactgcagtttgatgaggctgagaagctgtgtcagatggctcttgacattcacaggggaaatggagctcctgcttccattgaggaagcagcagataggagactaatggggcttatctgtgactcaaagggtgattatgaagctgctctagagcattatgttttggcaagcatggctattgctgcaaatgatcatgaagcagatgtggcttcagttgattgcagcataggtgatgcctacctggcgttggcacgctatgatgaggcggtgttttcttatcagaaagcactcactgtgttcaaatcaaccaaaggagagaatcatccaacagttgcttcagtctatgttaggttggctgatctgtacaacaagatagggaagttcaaagaatccaaatcttactgtgaaaatgcactcaggattttcggcaagatcaagccagggatcccctcagaagagattgctagtggcttgatagatgttgctgcaatctatcaatccatgaatgatttggagaaagggttgaagttgctcaaaaaggccttgaagatatatggcaatgctcctggccaacaaagcactgttgcaggaattgaggcccaaatgggggttatgtattacttgctagggaactattctgattcttacaacatcttcaaaagcgccattgccaaatttcgtgcaagcggagagaagaaaaccgctttgtttggaattgctttgaaccaaatgggccttgcctgtgtgcagtgttatgctataaatgaggcagcagatttgtttgaagaggccaagactatattggaaaaagagtatgctccatatcatccagacaccttaggggtctatagcaatctagcaggcacctatgatgcaatgggaaggtaa

SEQ ID NO: 103769 - DNA, 2055 bp, Glycine max
  Peptide Sequence Number=SeqID_220547
atggcaacttgtgttcctgctgtaagtggtgcactgcattatggagtgacaaactgcaagggacacagctacagaaggagtgcttccttttctgatgtgcctaacacgggattcttacaaaaagatctttcatggttagaagattctgatccaggaatcatactagtacacttgcacagtgtttacttaaaattgtttgagtgttttgtagtagcttctgaaaatttgatcagaaagagactgaatggaaaaggatcttcactttctggttcatctgtcatagctgaattaatgatttttcattgttttggggtgcaaaattttaggtctaaagtggtatccaaggtcctgcagatacacagatgtgggttttctgcacctccacttcataaggatcagaaactcttcaaagtcatttcctcatggaagaaagatagtcccacaaaatactttgactttatcgtcattgggagtggaattgctggcctccgatatgcgcttgaagttgcaaaatatggatctgttgcagtgataaccaaggctgagtctcatgaatgcaatactaattatgctcaaggtggtgttagtgctgtgctatgcccttcagattctgtggagagtcacattaaggacaccattgtggctggggcatatctttgtgatgaggaaagcgtccgggttgtctgcactgaaggacccgaaagagtcagagaactgattgctatgggtgcatcatttgatcatggggaagatggtaacttgcatctaatgagagaggggggtcattcacatcatagaattgttcatgctgctgatatgactggaaaagagattgaacgggctctactgaaggaagttatcagtaatcccagaatttttgtgtttgaacaccattttgctatagatcttctcacttgtcaggatcgatctgatatgatttgtcttggtgttgacacactgaattctaaaaccctagaggtagccactggagatggaattgccatggcacaccgagctcaagctgtgatttccaacatggagtttgtgcagttccatccaactgccttagctgatgaagggcttcctattaaaccaaccaagcctcgggaaaatgcatttctgataactgaagctgtcagaggtgatgggggcatcctttataattttggcatggaaagattcatgcccttgtatgatgagagggcagagcttgctccaagggatgtggtggcaagaagtatagacgaccaacttaaaaagcgtcatgagaagtatgtgctcctcgatataagtcacaagcccaaggaggaaattctctcccatttccccaacattgcttctacgtgtctccagtatggtttggacataactcgtcgtccaatcccagttgttccagctgctcattacatgtgtggaggagttcaagctggtctccaaggagagaccaatgtgaaaggtctgtatgtagctggtgaggtagcatgcacaggtttgcatggagcaaatagacttgctagcaactcattgcttgaggcactggtttttgcaagaagagctgtgcagccctcagttgatcacatgaagggctctagccttgatctgactgcatcaaacttgtggcctagacccgttgtgcctttgccactcggaagtaatgtcacagacaaaattatgtcaacgacaaaggaattgagggcagaactgcaatccatcatgtgggactatgtaggaattgttcggtccacaatgagactagagactgctgagcaaaaaattggtagtttagaagctaaatgggaggagtctctgtttcagcatggatggaagccaacaatggtcgggcctgagatctgtgagatgagaaacctcttttgttgtgcaaagctggtggtcagcagtgcgctttctaggcatgagagccgtggactacattacactgttgattttccttatctcgaggagagtaagagacttccaacaatcatttttccaagttcacctgtaaacagtacatggagttctcggcaattacacaagcagcccatgtaccagtaa

SEQ ID NO: 103770 - DNA, 552 bp, Glycine max
  Peptide Sequence Number=SeqID_220548
atggagcgcgcgaacaccggattcacaacgaaaccctacgtagaaggtagaactgttgctgctgcgtttcttttacttacactcactcaattgaaacttgaaaccctagaagagaagaacgatgtggaagtggttgttctgtcgagagccagcgccgccgccgatgccgccgacggtggtgctggtgccgccgctcttcgacttccctcccctcgccgcgcgcaaccgcatgctccaccccatctacgacgtcgttttcggcaagctcgccatcacctccctcttccaggactactttcaccaggccaggcacttgaccacccgaatcatgctcaagccgatcgacaatcctcacgtcgatgtcatcgcaaccgtgactggtttcaggtcctcttgatcacaagccggaagaaagtattgccggagatgcgttgtttcgctggcaaaggttttcttctctattctttgcaacgttttaaattgtggtcgcgttccttaatattgtgggaaattgcggataaatgtggccagtatggtcacaattatggttga

SEQ ID NO: 103771 - DNA, 249 bp, Glycine max
  Peptide Sequence Number=SeqID_220549
atggattggacaatccataagtctcatacggattgggccaattacagaaggagtgaaggatcacgggatggattggattgcaaaggagaagaagagcaacaattaaaagagtgggaatgtgtgaatgaggagaatgaagtgaatgatggtgtaaccctatcacaggttttcctaatttcctgcacatcaagaatgtcaagtactaatcacctgcttatgtttcttgagcaggcacatgaagtatgttga

SEQ ID NO: 103772 - DNA, 2134 bp, Glycine max
  Peptide Sequence Number=SeqID_220550
caaaagagcgaagttcaaacaatggaagtcactagtggaaaaacagacggagaaaaaggtcaaacgacttaggacagacaatggattggaattttgcaataatgagttcaatgagttttgcgcaaatgaaggaatagcacgtcatagaacggatgaacaggacattactggagagagctcgatgcatgctctcaaatgcagactccagaagagatgtggtcaggctctacagcaaattattcaattctgcgtgtatttgggtgtccagcatattaatgaaggaaagttggagccaagagccaagaaatgtatattattgggttatcaagatggtgtaaaaggatacaggctgtgggacccaaaggaatctaagctcttaattagtagagacgtgacatttgatgagacagctatgcttaacccaagaccacataaagaccatgataataaagttgaagttcatggtgatatcaagaaggtggagtttgaagttgaagcacggaaaccagaggagatctatgatgaatctgaagtgacacctacagagtttgaacatacattggctagtgataggccaaggaggcaaactaggccacctcagaggtatgatgactttgttgctttcgcactcaacatggccgaaagcatcgatgatgaacaagaaccaagttcattccacgaagcagttacttgtgatgaagcatcacagtggattggtgccatgaaagaagaacttgaatccctccacaagaatcatacttggaagcttgttgagaaaccaatcgatcagaagattgtgggttgcaagtggatatacaagaagaaagatgggataaggttcaaagcaaggcttgtagcaaaaggctttacacaaaggaaaggtattgactttaatgaagttttttcccctgtggtaaagcatagttccattagagtgcttcttgctttagtgtctttgcttgacttggagttggagcaattagatgtgaagacggcttttctccatggtgatttggaagaaacaatttatatgcaacaaccagatgggttcgttgttccaggaaaagaagaccatgtgtgtcttcttaagaagtcattgtatggattgaagcagtcacctagacaatggtacaaacgttttgactcatttatgattgatattaggtacataaaaagtgaatatgatagttgtgtttatcatacgaaactatttgacaacacatatatttacttgcttctttatgttgatgacatgctaattgcatgtaagcacccaaatgagatcaataaggtgaaaacacaattaagtggtgaatttgagatgaaagatttgggtccagctaaaagaatccttggtatggagattatacgagatcgaaaaattggaaggttgtgtttatctcaaaagagctatgttgagaaagttctagagagatttggaatgcacaatgcaaaagcagttattccttactcaaatgcagttgggagtctgatgtatgctatggtttgtaccagaccagatatagcacatgcagtgagtgtcgttagttgttatatggctaatccaggaaagtctcgctggcaagcagtaaaatggattctcagatatttaaggggttcaactaatctgggtctagtgtttggcaaagcaacaaatgaatgcaatagtcatgtcattggatattgtggctcggattatgctagtgatcttgatcgtagaaggtccttgagtggttatatttttacgcttggaggtagtgctataagttggcgtgcgactctgcagtccactgttgccttgtcgactacagaagcagaatatatggcagctactgaagcggtgaaagaagctttatggcttaaaggtcttgttggtgatcttggtgtaagtaaaaaggaagttgttgtgcattgtgatagtcaaagcgcaattcacttaaccaaaaaccaaatgtaccacgaaaggacaaagcacatagatataaggatgcattttatttgtgatgtggtaacacaaggtgatgtgtcaatagaaaagatttctactttagataatcctgctgatatgatgacaaaagctcttccaacaataaagttcaaacagtgtctggactcagtggggattaaaaattga

SEQ ID NO: 103773 - DNA, 324 bp, Glycine max
  Peptide Sequence Number=SeqID_220551
atgaatccatcaggtgcagtcagagatgaagcttgtcagccaaggcaagcccatcgattatgtcccctccaccttcgacaaataatctatgaagattctactgatgatccgccttggcatatcgacaaaagaggaggctatggcagtgaccattgcaagtgccagggtgagactgacgtggttgaaagagctatatcattgctacgtcgagtcaggctcgtgcttgtgggttaccacaacttatcttttgcacttggtcgacaatacaatatttgtcgacaagtcttcgacccacgtccatgttgtctacctcctctaccttga

SEQ ID NO: 103774 - DNA, 480 bp, Glycine max
  Peptide Sequence Number=SeqID_220552
atggatatccatgatgatcgtagtggtgaagataacgaggttgctcgtggcattgaggatgctagtcatttggatggtgcatttgaagaaaaagttagtgagaagatagttattaatattttgttggatatagtaaacattaacttgacaaatattgatagtaatgatgtgaaaagagcaaatggttttgtgtgcaaaagcaaggtgcttagaaactgcaaaggtgaaacaacgcaacaaaattttctttgttatagggaaggagttaaagactatagggatataaccattgaaatgcaaaaacacgaggaaaaaatgatacaagatgtgattgtggatatgacaaagttcgatatagaatttaagactcagcgacaatgggtgataaaacttatcatcaaaaaccctaaatctcaagacatagggttaaggttcaataaaacaaaagggggacaacttaaaactcaaggacatccttag

SEQ ID NO: 103775 - DNA, 207 bp, Glycine max
  Peptide Sequence Number=SeqID_220553
atgggtggttggactatttgggataatgaggacacaactaagagggatgtttgccatatggagcgccctttgacggcggaacctaatgacaacgaagttacttgttctaatgtgaagaaatgttgtgaatattttaagtcattgggaccgccttattcctatgagaatgatctagaactagtcaaggcttcctttttgtacccctag

SEQ ID NO: 103776 - DNA, 498 bp, Glycine max
  Peptide Sequence Number=SeqID_220554
atgggaaagtcgggagagaagcccttctcagttgttgctcttcttattgacagtggtaataataagaagaaattcgagaaggtcgtcaatattgatgataacgtggcactaaccgactttagcttggttcttggatatctgactcatgttactctaggctataaaattattctagagttgaggaaatctttcggtgatgttgatcctctaaagttgattgagggtgaagatgttgccttaaagaaggcacgggagtatggtgatgtgttaacaggagagtttgacaagctaaaggcccgaggttgggacttagaactctatcggacttatcttggggctcttagtactattaatgaagatttcgtagctgaaaaggttagcaatttagagacttttgatgaagaaatggttggcgggttcattaaaaccctgggaactaatgctaatgatagggttgtgggtgcttctaatgttgatgccaaccttagagggttttaa

SEQ ID NO: 103777 - DNA, 231 bp, Glycine max
  Peptide Sequence Number=SeqID_220555
atggggttatttttgaaaacgaatttgatccctcttttgtttgtgacggggatatggctccacgaggctccccgctcggaggatgttgattgggttgacaaacaattttgtgggagaacaatattggtgggtggcagattgaatggcccgaggatgatggttggatttgctctcaaggtaggagataagatgttgggatgccctctaccgctctggaagaggaggaaatga

SEQ ID NO: 103778 - DNA, 126 bp, Glycine max
  Peptide Sequence Number=SeqID_220556
atgggctggagtatccttaaaaggctgaaacaacctaacgcgttattgatgatgtcatcttgtggtgtgtttgtgtactgtgtgtttctacaaggttataatgatggtgttggaggaaagacttag

SEQ ID NO: 103779 - DNA, 873 bp, Glycine max
  Peptide Sequence Number=SeqID_220557
atgctagttatgtgcagggtcactcttgctgaccagtcaactttagatgccatcgttgttggttttgaccaagacaaggatgttgccgtgctgcgtgttgacgcaccaaaagacaaactcaggcctatacctattggggtctctgctgacctgcttgttggtcagaaggtttatgctattgggaacccgtttggacttgaccacacactcacaactggtgtcatcagtgaactaggttcaatgaaagagacaaagtgcaaggctgataaacttctcaacaagcacttgttagaaaagaaaataaagagtgggcttcggcgagaaattagttctgctgcaactggtcgtccaattcaagatgttatacagacagatgcagcaattaatcctggtaacagtggaggtcctctcttagatagttctggaaacctcattgggataaatacagccatatattccccatctggtgcatcctctggtgttggattttctattccagtggacactgtaagtggtattgttgaccagttggtgaagtttgggaaggttacaagacctattttagggattaagtttgctcctgatcagtctgtggagcagttgggtgtaagtggagtgcttgtcttagatgctcctgccaatggtcctgctgggaaagcaggcttgcaatcaacaaagcgtgactcttatggtagactcattttaggtgacatcataacatctgttaatgataagaaggttactaatggaagtgatttgtacagaattcttgaccagtgtaaagtgggtgataagttgattgtggaggtgttgagaggtgaccacaaggagaagatccctgtcattctggagccaaagcctgatgaatcatga

SEQ ID NO: 103780 - DNA, 531 bp, Glycine max
  Peptide Sequence Number=SeqID_220558
atgaccttccttgtcccaaacaaagccagacccggatccctgtggaacctccaacacgtccaatgtgaacgcatcctgcctaaacacgaaacccccaacattgagacaaatcaaaaggacaacagagggagtgttttcctggaagaggcgaacggtggcgagttcatcggactggagcttcctgggggaggtgacgacgaaggcggcggcggagtcggcgtcagagaggaggagagtgaaggagagggcgagagaggtgcagagaaggagaagggatttgggaatggtgagtttggggaagagaggtattattggaagtgttggatttggggggcgaaggaggaagagggtgggagtgtagagatggagggatttggaaaggaagaacgagagaatgaagaagaagaagaagggaagagtgtggaaatgagtgaaaaggtggccattgttttggttggagtgaccaaggatgtctgttatgctaaatggttggaaatgttgtttgtggtgcttagatcagttgggatctag

SEQ ID NO: 103781 - DNA, 2553 bp, Glycine max
  Peptide Sequence Number=SeqID_220559
atgaagctgatcatggtctcttggatgaaaatatgtaggcctctgagtgtagtaggaggtcctggcctaaggtctctcaaagctattaacaaagcttccatcttgtctctgacttggaagttcatttcttcagtagatcattgggccgagctgatgagagcaagggttctcaaagatggttttcaggacacaactattgaccgccggataattgcgcagtctgtcacagggcagtccgatgacgcacatctgcagacgcatggtagggaggccaaggggacatcacagctagctttgtaccaaaatgggcgaatatggcacaagggaagttgtgcccctgatgagagagaagatcaaaatcacgaaagaggaaatatgggggcagagttgaacgttgaagacagggggcggactaccataacttcagaaatcaccagaatgcacccagatcagcagcataaggtcgaagagcaaacggaggaccaattaagcaactcaatgcagcaacacgtggccctaccacaagtaaggtctgatggcatatatcaaacagaaaatcataatcaagatgcagaaaacatctggagtatggtcacaggtttagggatgactacccgtaattcccaaaagaactatgttcagcagttgatggaaatggagagaagagatgtcgatgaggccgagagactggggaggcttgggaggggggttaagtggccaacaattcgaaggatggtcaaggagaatcacatagacatgctatgtctacaagaaacaaaaaaggagagtgttgacaaggcaatgtgtatagccatgtgggggattcagaaatcagttgggaaacatacccttcaatcaactcagctggcggcattctgtgcatatggaatgagaaatcgttcaagggcactttgggaaaatgttaaacagttgaaaaatcaaaatcctggaggatactggtgcatagtaggggatttcaataacatcaggacagctgaagaaagagtgggatcagcaccttgggtgggtaagcgatttacatggttcaaaccaaatggcactgctaagagcaagttggataggtttctggtttctccagaacggctatccaaatggcctggctcctcacaattcacgctcaataggaacttttcggatcattgccctgtaatgctcaaatctaagagtattgactggggatatgtgctaaaacagaaatttaaagctctcaaagacaaggtcaaggtgtggaacaaggaacaattcggagacacttacagtaaatacaagaaaattgaggaagatttaaataagatggaagaggagacaggtgacaggctactaaatcatcatgagtctaattgcttgaatggggtgctgattgacggatcgtggagggatgagccaacaatagtcaaagaggaagttaggaggtatttcttgcagcatttccaagaatctgatcaggcaagaccaagacttgatagtacttgttttcagaccattgacatccagcagaacgaaatgttggtggagcgttttcacgaggaggaggttaaaagggcggtgtggagctgtggtagtgataaaagtctgggtccagatggattcaactttaaattcattaagcaattttgggatatcatcaaatatgacttcttaagattccttgatgaatttcatgtaaatggagtttttccaaggggcctcaacgcatctttcatagccttaattccgaagatagtggatcctcaagcgttgaatgattacagacctatctcactgataggttgtacttataagatacttgctaagatcttggcgaacaaagtgaagaaggttgattatgagaaggtgtatgattatgtgtcttgggagttccttaattacatgatgacaagaatgggtttctgcacaaaatggatccattggattgaaggatgtctaaaatcagcatcggtttcggttctggttaatggcagtccttcgtcggagtttgtaccccaaaaaggacttaagcagggagacccactatcacctttgctatttaacattgttgctgaaggacttaatggcctaatgaccaatgctatggagagaaggttatacacgggattcttatcaggcacaaacaaagtggaagtcagtctcctccagtatgcaaatgatacaatattttttggggagacaactatggagaatgttagagcaataaaagccatcctaagggcttttgagcttgcatcgggattaaaaattaattttactaaaagtagttgtcgggctttcggtgtgacggatcaatggataagtgatgcagccaattacctccactgtagcttgatgtcctttcctttcacatatcttggtatccctattggtgccaatccaagaagatgtcagacatgggaccctatcattactaaatgcgagagaaaactagcgagatggaaacaaagacatttgtcttttggggagagagtgactctcataaattcagtgctaatgtctgttagacaagtggcctcagatatcttaagaaggggaagttga

SEQ ID NO: 103782 - DNA, 436 bp, Glycine max
  Peptide Sequence Number=SeqID_220560
atggaaatggaagttatttcaaagtcagggggaattgtgggcaagggtgctggaatcaaaggatctgaagatactgtctcaacatccacagcaggggcagttattggacaggtcgataaaatggaaggaggagggtaccaattattagagaagtatcctaggctatacatcatattggatcagcaaaatcaattaattcagcatatgggaacccacaaagacacaggatgggctgacccaactgggcagtactcagttaagagcacatacagtgtgcttagacagcacgtaccagcggaggcccagggggaagagttcacggaattatggaagctcaaagttccatctaaagcggttaatagtggaggagagtgcatgccacttgttctttcattgcaggaaaataattctgatttggtgggaatcgttgtcatag

SEQ ID NO: 103783 - DNA, 303 bp, Glycine max
  Peptide Sequence Number=SeqID_220561
atgatcgagtccgatggcacgcagagacaaattatggtcattctgcgccttttgtcatccagaggcggcgaggccgatgacatacggagacaaattatggtcattaagcacaccttttttccatccagagacgatcgaatccgatggcacgcagggacaaattatggtcattatgcaccttttgtcatccagaggcggcaaacccgacggcatgcggagataccttatggtcatccgcgcctttcgtcaaccgagaggaatgaattcgacagtatcaggatgatgttggtctttcggtgctga

SEQ ID NO: 103784 - DNA, 787 bp, Glycine max
  Peptide Sequence Number=SeqID_220562
tgtgatggagtcgttggtgtgtccaagcttcagcgcctattcctccaacacgctcgacgacatcgcggatcaggtaactcgaaacgacgacgtgcgtttcgaagaaaacgacaccgacttcgagttcgtcgcgtttcgcgaggtcgccgacggagttttcgtcgacgacaacgcgactccggcgttcccgatcttcgaccgcgacctcgccactgccacggcggaggacggaggagaagtaaaacggcgagtttccggcgaggaggacgacgtggtggcgattcagatcacgctcgggaagctgctgatggacgattcttcgccgtcgtgctcgtcgtcagaggtggaggacgagctggagaatgttccgccagggacgtactgcgtgtggacgccgaggaaggcgccgccggcgcctgcgtctccgtgccggaagagcaaatcgacgggatcgtcgttgtcgaagcggtggaagcttctggatttgctgcggcgaagcaacagcgaggggaaggagtcggtggtgttcctgacgccgtcgtcagtgaattcggcgaagaagggaacgaaatcggagaccggaaaaaaatctctggcgagtagcggcggcggcgagaagagaattgcggcggttccggcggtgtcggcgcacgaagcgctttatgttcggaacagagaaatgaggagagaggttaaacgacggtcatatttgccgtatcgacaggatttggttggtttctgtgttaatctcaaccccatgggcaaggcattccctcttcacttttga

SEQ ID NO: 103785 - DNA, 165 bp, Glycine max
  Peptide Sequence Number=SeqID_220563
atggcttctatttgggcatgtcctgatgaagatgtgaagattgaaaccttctgtggtaccttcttaggaggtgatgttgctttaatcctttattatgagggtctcagtttatcttctaatacaggcattggtcgccaaagaaaaaagttgcaccgcataatataa

SEQ ID NO: 103786 - DNA, 246 bp, Glycine max
  Peptide Sequence Number=SeqID_220564
atggacatacaggttcctgaatgtattaataaaaagcttgcccaggcaaaaatcaagtgtgcttttatagtttacttagacatgaaacagatagtgatcactcttgattcttcagatatcctatcattggaaaaacaagaggacaaagagtgtctagcaaagatacttgaccttggaaattattggcatttaatttctctcactgttatagatcttcgagacaacgattgcttaggcctctcttga

SEQ ID NO: 103787 - DNA, 243 bp, Glycine max
  Peptide Sequence Number=SeqID_220565
atggcgcgcccagcgcacgatctgaacgcgctaagcgcgaggtatggcgctgagcgcgactacgaaggcccgcctaaaaagcgaacgatgtacaatgagcctcaagagttatcaatgcaaaggaatttattccaggggttaatcgcttgggaaagggtaacacctaacagaacatctaaagaaaagaatcattgggttagcattgctaggcatagaatgataactcactgcccatgcatttag

SEQ ID NO: 103788 - DNA, 1170 bp, Glycine max
  Peptide Sequence Number=SeqID_220566
atggcagcagaatttgttggtggtgctcttctttctgctgtccttcaggttgcatttgtcaggctcgcttctcctaaagttctagacttctttcgtgcaagaaaacttgatgagacgctgctggacaggttgaacacaaagctgctgttcatcgatgctcttgctgatgatgcagaacataagcagttcagagatccacatattatgaactctccaaatgtgaagtggaagatcaatctgagtctcaaaccttcgcttgcaagaatatcttgcaagccaaaagggtgctcttggtttaaaaaggctactaattctgatgttggatcaggaagtaaagtgtcacagaaattgccatcaacttctttggtggttgaaagtgttatttatggcagagatgatgacagagaaatgatccttaattggctcacatctgaaactgacagctatcagtatttactattgtgggcatgggtggattgggtaagaccaccctcgcccaacatatatacaatgacccaaggatggaggaggctgattttcatatcaaagcttgggttgacaaaaataattcttgaggcaatcactaaatcaaaagataatagcagagagctagaaatgattcatgggagattgaaagaaaaattaacagggaagagatttcttctcgttttggatgatgtttggaatgaaagacgagaagaatgggagtctgtgcaaactcctcttaatcatggtgctccgggaagtagaattcttgtcaccacacgctgtgaagaagttgtttgtatcatgcggtctaataaagtgtatcacctaaagcaattacaagaagatcattgctggcaagtttttgtaaaacatgcattccaagatgatcattctatattgaatgctgagttgaaggagattggtacaaagatagttcaaaagtgcaaaggattgcctctagccttgaaatcaattggaagtcttttacacacagcaaagtcatctatttcggaatgggaaagtgtattgttaagcaatatatgggacatactaaaaggagagagtgaaattattcctgctctattattgagctatcaccaccttccgtctcatctcaagatgtgcttagcttgttgtgccttatttcccaaagattacgagtttgtcaaggaacatctataa

SEQ ID NO: 103789 - DNA, 2352 bp, Glycine max
  Peptide Sequence Number=SeqID_220567
atggccaaggaagctgtggaagattggaggaggagaaaacaggatatagaggcaaacaaccgaaaggttcaggtgtatggtagaaattatacatttgtggagactagatggaagaaactccgtgttggtgatatcattaaagtgtataaggatgaatactttcctgctgatcttcttctgctttcatcaagctatgatgatgggatttgttatgtcgagactatgaatcttgatggagaaactaatctaaaattaaagcatgccttggaggtgacaattcatcttcaagatgaaaaatctctgcaaaagtataaggccatggttaaatgtgaggatcctaatgaaaatctgtactcgtttattggaactttacaatatgatggtaaagaatatcctctttccttgcagcagatcctgttaagagattctaagctgaaaaacactgattatatctatggcattgttatctttactggccatgatacaaaagtcatgcagaactccactgatcctccatccaagagaagcaaaattgagagaaaaatggataagataatctacatcctcttcagtaccttggttttgatatcctttattggttctgtcttttttggtgttgagaccaaaagggatattagttctggcaggtatagaagatggtatcttcgtccagacaatacaactgtgttttatgatcctagaagggcaacacttgctgctgttcttcattttttgactgcccttatgttgtatggatatctaattccaatatcactttatgtgtccatagaacttgtgaaagttctgcagagcattttcatcaaccatgaccaggaaatgtattttgaagaaacagataggccagctcgtgcacgcacatctaatttgaatgaggaacttggtcaggttgatacaatattgagtgataaaactggtactttgacgtgtaactcgatggagtttgtcaaatgttcaatagggggcattccgtatggtcgtggtatgacagaagtggagaaggcacttgttaggagaggaagtgatgtggaatctgaagttgatgggggatcatctgatatcctgggtcagagtaatgatgctgtggactctcggcattcaattaagggctttaactttaaagatgagcggataatgatggggcaatgggttaatgaaccatatccagacttcattcagagattctttcgagttttagctatttgtcacacagctattccagatgtagataaagagtcaagagaaatttcctatgaagctgagtcaccagatgaagcagcttttgtcatagctgcaagggagcttggttttgagttttttgcaaggacacaaacaagtatatcgttacatgaattgaattatgaaagtggaaaaaaggttgacagagtgtaccggcttctgcatgtcttcgagttcagcagttcccgcaaaagaatgtcagtgatagtgaggaatgaggaaaatcaattattgctcctatgcaagggtgctgacagtgtaatgtttgaaaggatctcgcaacatggaagacagtttgaagctgaaaccagggatcatatcaaaagttattctgaggctggtttaagaacccttgtaattgcataccgtgaacttgatgaagaagaatataagttgtgggacaatgaattttcaaagatcaaaactactgtaacagaagaccgagatgtgttggtagatgcagctgctgataagatggaaagggatttgattcttcttggtgctactgcagttgaggatagactgcaaaagggggttcctgaatgtattgaaaagctcgcccgggcaaaaatcaagttatgggtattaaccggagacaagatggaaactgcagtcaacatagggtatgcatgtagtttacttagacaagacatgaaacagatagtgatcactctggattcaccagatatcctatcattggaaaaacaaggggacaaggaagctctatcaaaggcctctcttgaaagcattaagaagcaaattagagaaggaatctcacaaatcaagtctgcaaaagagagttctaatacaaataaaggaagttcttctgggtttggcttgataattgatgggaagtccttggattattctcttaacaagaatttggaaaggtccttctttgagctggcaattaattgtgcttctgtcatatgttgccgatcttcacccaaacaaaaagctcgcgttacaaaattggtgaaattgggaacagggaagacaacattatctatcggcgatggggcaaatgatgttggcatgcttcaggaggctgatattggagttggcattagtggtgctgaagggatgcaggtctaa

SEQ ID NO: 103790 - DNA, 191 bp, Glycine max
  Peptide Sequence Number=SeqID_220568
atgcctgaagggagcaaaagcagaatacgtttcagcaaattgtacagtttttcttgtttgaaatctccattcagagatggtcattcccaaattgggcggaaggggtactcaagggttgtctactgcaatgatccagataaccccgaagcagttcagttgaattatggaggcaattatgtttcaacaaccaa

SEQ ID NO: 103791 - DNA, 387 bp, Glycine max
  Peptide Sequence Number=SeqID_220569
atgaagagcaaacgaagaacggcgaagaacttccatggaatcgcttacagaaacttctcggaagcattacggaagcgcctcggcttggatttttttcccttctttctcttctcctcactaatttcaaaagcggacaaccatcctcatcccggatatcatcggacttgcctgtctctggatgataaaggggacttcaataatctttggataggaagggtgcagacgaacatatgttgtcttcgcgtgtcattggacttgctgtctctggatgacgaaggtgagactaaagtagtcctaatcaacgggctcgcttgcctctggttaacaaaggtggcggatggccatgattggtctccacccgtcatcgaacttgctgtctctggatga

SEQ ID NO: 103792 - DNA, 639 bp, Glycine max
  Peptide Sequence Number=SeqID_220570
atgctcagacggaggctatctgttctctcaacatcaatcaccagaagctcaaattatagcaaacccagtctcggatacccatctatccaatctcatccctttcagctccctcactctcccagtgcttatcaaataattagtcctaatgcattcccggattttcaaggttttagagcttacagtcttctgagcttgaatgatctgagagataaggttcccagaaaacagccgacgaggaaggggcgtgggattgggtctggaaagggcaagactgcagggaggggtcacaagggtcagagagccagaaaaggtataaaattggggttcgaaggaggtcagacccctcttcgccgaagattacccaaacgtgggttcaagaacccatttagcctcacttttcagccaataggtttggggaaaattgcaaagtttattaatgctgggaagatagattcttctgaactgattacaatgaaaacactaaaggatgcaggggtactagggaagcaaatgaaagatggagtaagattgatggggcgtggttctgagcagatcaagtggccaattcatctagagtttatgatttacttggatgtttgcttgaaagtctgctctctcctttctccattggcagcataa

SEQ ID NO: 103793 - DNA, 387 bp, Glycine max
  Peptide Sequence Number=SeqID_220571
atggaaagggagatgataatcgtgatggtagacacattaccagtattctactatgaaaagatggtgggctacacaccttcaagccttgctgatttagtttttgctgatgaaaggatcgaagtgggtctaaaaaaaggcaaatatgatcatcctgctttgatgaatgcgaaaactggggcaaatgaaaaggatgagaatgagggagaaacccttgctatgactaccattcctacacggtcaaatttcccatcaccccaacaatgtcattactcagccaataacagtccctctcacccaatcctccacaaaggccatcccccaatcatccataaagcctgcccaccgcacatccgatgccaaaacaccaaccaaaaaggaattttgtag

SEQ ID NO: 103794 - DNA, 342 bp, Glycine max
  Peptide Sequence Number=SeqID_220572
atgttcaacactgttcatgttattgatcagccttacggtgaagtgagtaggtcatttgctataagatggaaagatgaactagagcctacgtggcatctgctacactctagtgacaacatgcactctgtcacatattaccaagatttggtgagcctagttctacttgttggatggatggaacatagagagttctatgagctcactggaaatcatcaggtcaccttaacccactatggacagagtgttttcctcctcaccatcttcaaaagcagctctaaaccaaaagcttttcctaaatgggcattccttgtaccaccaagttcccaactcagccacttttaa

SEQ ID NO: 103795 - DNA, 525 bp, Glycine max
  Peptide Sequence Number=SeqID_220573
atggcttcgtggtgcagtgttcgaagcttccaggttccggcgatggaaggcagcgcactgcgcaaccgtgcttcattggccgccagagtggggtgtttgtccgtggccggcacctccttctggcgttcctcttcgtcaccgaagcactctttgtcattcacatgcttgagcatttcttccgaaactcgtattaaggaaaatgttcaaacagaaggggcacctgcggctctgggaccatattctcaagcaatcaaatccaacaaccttctttttgtgtctggtgttcttggccttgttcccgagaccgggaagttcgtatctgatgatgttgaagaccaaactgaacagcttcttaaaaacatgggggaaattcttaaagccggtggtgctagctactcgtccgtcgttaagacaacaattatgttggctgacttgaaggacttcaagaaagtcaatgagatctatgctaaatgtgaagcttgcactgacttgtttgtgtgtgaaaagatgaatacactatcctaa

SEQ ID NO: 103796 - DNA, 1110 bp, Glycine max
  Peptide Sequence Number=SeqID_220574
atgccgcagtccaaagagggcaccttcatgaccgaagcgtcaatcatcgccgcgctgctggcgtttatgcagcgcgaagaaaccacggaagcggatttcaaccagctggcgctacagctgttcgcgtggcaattcgaacacaatcttccttacgcccgcttcgcccgccagcgcggccgcacgccgctgacggtaaaacagtggcggcagattccggcggtgccgattacggcgtttaaagatctgacgctgagctgccgtccagtggcggagattccccacatctttatgaccagcggcaccacggggaccggccgggggcgcagctatcacccgacgctggcggtttacgatcgctcgatgctgatcaatttccgccagcgctttatggccggatatccgcgcctgccgatggcgatcctgtttccacacagcagcgagctgcccaactcttcgctggcccattatctgacgctggcgatgcaagaatgtggcacgccagacagcgaagtgatggtggatgcgcaggggctgaaactgccgcgtctgatcgccgcgctggagcaggcgcaggccagcggccaaccctatgccctgctgggtgccagctacagttttgtccacctgctggacgaactggcgcgtcagcagcggcgtttcaggctgccgccgggcagccgcatcctcgacaccgggggttttaagggccagtcgcgtgaagttgcggcggaagcgttttatagcgcgctgcagcagacgctcggcgtgccgcgttcgcactgcatcaatatgtacggcatgactgaactcagcacgcagttttacgatgccggcaatgaaatctgcccgccggtgaaatccggaccgcactggatccgcacgcgcgtggttcatccgctgaccggtgcggacgtgccggaaggtgagacaggcgtactggtgcatcacgatctcgcccatttcaattctgtttcctccattctgaccgaagatgccggcgtgatggtgcccggcgggtttcagctgctgggccgcgtcgcgggtgccgatgctaaaggctgctcgctggcgatggaatcgtttctcgctgccgcgcaggcgcggacatga

SEQ ID NO: 103797 - DNA, 939 bp, Glycine max
  Peptide Sequence Number=SeqID_220575
atgtccatgtatactgacaatcataagctgcttattcatttctttcaagacagcctaactggggccgctctgaagtggtatatgaatttggacagtgcgagcattcgtactttcaatgacctgggtgaagcgttcatccggcagtataagtacaatttggacatggccccagatcgtgatcagctccgtgcgatgacacaaaaagagaaggaaacgttcaaggagtatgcccaacgttggagggaagtggctgcccagattgtcccgccgttggaagaaagggaaatgaccaaaatatttttgaagaccctgagccagttttattacgagaaaatggttgcaagtgcaccaacagacttcaccgaaatggtcaacatgggggtgcgattagaggaaggtgtccgagagggacgtttgactggggaaagtgtccctgctgcaagcaatgccaagaagtttggaggccactttgcgaagaagaaagatcaagaggtggggatggtagctcatggtaagcctcagcagaatttcaccccatatcgtcaggttgcgaatgtcgcatccgctatcccaaacccatcatatcaccaacaaaggccacattacccctacccataccctccacaacaataccctccacagcaataccctccacaacaataccctccacaacaataccctccacagcaataccatcagccacaataccctcaaaaacaacaaaatcgcccgcaaaccccccaacaaccatatcactcacaaaaccgacagaaaacaacctttgatccaatcccgatgaaatatgctgacttactccccggcctgctcgccaaaaaacttgtccaggtcagaacaccccctcgtacaccagatgttttacctccctggtttcgtcatgatttaaacctgcgctttccaacaaggggccccaggtcatga

SEQ ID NO: 103798 - DNA, 414 bp, Glycine max
  Peptide Sequence Number=SeqID_220576
atgttggtggcgactccgtgcgtattcctttcttggaacacgcatcccgcgagtcacgcgtcgccctcccgccgaaggataggttgcgacactcctttaccatatccacatttagtcactcttttccttcaacatttcaacatccctcttgattctgaaccttatgttccaatcaagagatctttcttgatcggtgttgttatggttgcatcctttggttaccgtaaagagcgtgatggctcttgggacaattaccggttgaaggagactcttctctccttcaaagtattttggacagaacaagtggacacgcgattcgacgagatggactcaaggatcacaaaggttgaagaagatgttaccttcattcgcacatgctttgatctaccaccaccaccaccaccatcgtcttag

SEQ ID NO: 103799 - DNA, 99 bp, Glycine max
  Peptide Sequence Number=SeqID_220577
atggtgcttacctcaacaacgtctttgaaagtaggcactctaagacgttatttacttcagcaccgtcttagaatgcctactttcagagacgttggtgag

SEQ ID NO: 103800 - DNA, 444 bp, Glycine max
  Peptide Sequence Number=SeqID_220578
atggtgtgcactaaaagattatgtagacttgtgtataggtgtaggaagaaagattttgttagaagagatactactgggagtaggaactgtgggtgcccctccaagcttcgtgggaaaccagtcattggagggcaaggatggatggtgaagttgatgtgtggaattcataatcatgaattggccaagtcattagttggacatccatacgttgggaaattgactaaggatgagaagacaattattgataatatgaccaagtcaatggtgaaaccaagaaacattatgctaacattgaaggagcacaatgccaatagttgtacaacaatcaaacaaatatacaatgcaagaagtgcatactgttcttacattagaggaattgataatgaaatgcaacatctaatgaagcttcttgaatgggatcaatatattcattggcatagatga

SEQ ID NO: 103801 - DNA, 1003 bp, Glycine max
  Peptide Sequence Number=SeqID_220579
aaggctacacgttgtcaccttcagaggactacacatcctcgtcttcagaggactgcacatcctcgccttgagaggactgcacgtcctcgcggtcagagcactccacgtcctcgccttcagagggctgcacgccctcgccttcagaagactacacgttgtcgccttaagagggttgcacgccctcgccttcagaggactacacgacctcactttcagaggactacacgtcctcgccctcagagggctactcgccctcagagggctacacgccctcgccttcagaggactacatgccctcgccttcagagggctacacgccctcgccttcagaggactacacgtcctcgccttcagaggactacacgtcctcgccttcagagggctacacgtcctcgccttcagagggctacacgccctcgcctttagaggaccacacggcctcacctttagagggctacgcgccttcaccttcagagaactacacgccctcgccctcagaggtctgcacgccctcgccttcagaggactacatgtcctcaccttcaaaggactacacgtcttcgccttcagagggctgcacgtcgtcgccttcagaggactacacatcctcgtcttcagaggactacacgtccttgcctttagagggctacacgccctcgccttcagaggactacacgtcctctcctttagagggctacacgccttaacctttagaggactacacgtcctcgccttcagagtgctgcacgccctcgcattcagaggactacacgttctccccttcaaaggactacatgtcctcgccttcggagggctgcacgccctcgccttcagaggaatacacgtcctcgccttcagagggctacacgccgtcgcctttagaggaccacacgtcctcaccttcagagggctacatgccctcaccttcagaggactacacgtcctcgccctcagagggttgcacgccatcgccttcagaggacttcatgtcctccccttatga

SEQ ID NO: 103802 - DNA, 402 bp, Glycine max
  Peptide Sequence Number=SeqID_220580
atggcgagctctctgttacgggaagacttgcatcaggtgcttttgcttgtgagacatccatttttgaaagcatgttctgtttactcttatggtagccaattagccagtcatatagtgacgtgttgctgcattttatgtatgtctggtcagttagcatacccaaagccaagtttagtgcaaaaggatgctttggggtctgctcttctgccatttgctggtcaccaaataatgataagtggtggcggcagcaacaatgatagtggtgatagcggtagtgacaacaacggtaatggtggtggtaatggtgagagtggtgatgatagggtgagacgaaagaagggagagagagagagtgacaatcctatgttattgctttgtaacttaactcctacctcaggataa

SEQ ID NO: 103803 - DNA, 204 bp, Glycine max
  Peptide Sequence Number=SeqID_220581
gaagctgtgggactagcaaaacttgcagataggccggatcatgaggtcgatgatcccctatatctgatgacattgattatcccacaaatatttttgaagccgctgcaggcatctgacttagacaagtatgcgattagggaattccgatgtgtatggattcctcgagccacagttcatccagagatctggacaatcgcagtttga

SEQ ID NO: 103804 - DNA, 129 bp, Glycine max
  Peptide Sequence Number=SeqID_220582
atgggtgccaaatacctcgaagcggtcgaacgagggtcacatcccaacaccggatggtccccggacaaaattaggggcgcaaaattcgtctatgcgcgtttatccactcagcttgctgctcttgaatga

SEQ ID NO: 103805 - DNA, 249 bp, Glycine max
  Peptide Sequence Number=SeqID_220583
atgattagtgatcttggacaagagtgttttcatcaagcagatgcacttttgtatgatacattggaaagtgatttgaagaaacctttgtatccggggtacaagaagtcattgacatggttgttagtgggtatgtttcctgaagaaaacatgttgccaaaaagttactataaggcaaagaagatactgtgtccgacggtgatgcaatcctaccccccaagggcattggatagaagactccaagaagattga

SEQ ID NO: 103806 - DNA, 837 bp, Glycine max
  Peptide Sequence Number=SeqID_220584
atgggccgcgctgcgctggtcccaggcgttgaagccggcagtagcaccgagcagcagcccaagcaccatgcccagcacggccacgcgtgcccgcacgtcaaagcgctcttccccacgggccgccacctcctccaccagcctgccgcccgcgatgaagcccatgcggtcggccacatcggccgcccccagcaggtcgtgcgtgaccatgagaatggccacgccctggccgcgcagctgcgtgatcagccggctgaattcggccgtggcctgcgggtccaggcccgaagtgggttcgtccagcagcagcgccggcaccttgcgtgccagcgccagcgcaatggccaccttctgccgcattcccttggaaaagcccgagacgcgccggtcatgcgcggccgcatccagccctgcagcggacaaggcctggccgatggcatccctgctggcgggctggcccgccaggtccagcagataggccacgttctcgcgcgcgctcaggtgctcgtacagcgccacgttctcggggatataggcgatcaggccgcgcgcctgcgcggcagccgtcaccgggtccacgccctgcacgcgcacctggccgctgcgcggccgcacaaagcccaggaacaggctcagcgtggtggtcttgcccgcgccgttggcgcccagcagcgcatagatctcgccggcatgcacggccaggtccaggccctggaggatggtgcgctcgccatagtccaccacggcgcccagtgcttggagcacgggcgaggaggcagaagtggggttggaagaaacaggaagggatggatgcatggcggggctcagaacttggcttga

SEQ ID NO: 103807 - DNA, 783 bp, Glycine max
  Peptide Sequence Number=SeqID_220585
atggcggaaaattattatcacgtggttgcctttaccggcgaagggctgcgcggcaacccggccggggtttgcctgctgacacagccgctgccggcggcgcggctgcaggcgatcgccaacgagatcggcctgccggaaaccagctttgtctgggatgacggcgacatgaccgccatccgctggtttaccccgcagcgcgaggtcgatctctgcggccacggcaccctggcggcggcgcatgtgatgttcagcgtggttaacccggcgctgcaggatattcgcttccgctcggccggcggcgaactgttcgtcaagcgcgatgcgcaggacggggaacggctggtgctcgacttccccgctcggccgccgcagaaggtggctgaaccggcgggcctcgcggcgctgctgggcgtgcagccgcaggaggtgtggcaggcgaaagcgctgatggtggtgctggaaaacgaggcgcaggtgcgtgcgctgcggccggacatcccggcgctgatcgcgctggccgggcgtgcggtgatcgtcactgcgccgggtgacaccgtggacttcgtttcgcgctatttcacgctcgacgccggtgaagatccggttaccggctccgcgcactgcacgctgatgccttactggacggcgcgtctcggccgccatcggctgcaggcgcagcaggtctcggcacgcggcggcgaactgttctgcgaactgcaaggggatcgtacgctgctcggcggctatgctcacgtgttcctgcacgggacgatcgcgctgtaa

SEQ ID NO: 103808 - DNA, 321 bp, Glycine max
  Peptide Sequence Number=SeqID_220586
atggtccatgacatcttcgtcaaggtgaaactggaagtaacagggacatcagcagccctaaatgtgtttggcagtagacgaagcagcgatgtaccacgatcttttgccccaatttttttcaagatggttacttccatacttcaacttgactcgatgaaccttttcgtaaaagcacgagcttggttcaaccccataacccagggaatggcaattttgatcgccaatacttcatcaacaattcatagggatgaaagactcgggaatatgcatgctatgcatggaaaatgggaaaacgcaagggtcacgcatgagcaaacatga

SEQ ID NO: 103809 - DNA, 945 bp, Glycine max
  Peptide Sequence Number=SeqID_220587
atgtatcacactaagctagatgactttaaggctgagctggagaggcataatttctataaatgcctcaccaatttagccgatgggagcatagacctggctttgattgatgctgacagtctcaacacattcttggagacacctgtggtattagctgagggagagactctacccgcatactccagatactacaggttgcctacagacttcagagagatagaggttgctttatgcatacctggccgagggttcatcttgaactctgagggccatcccgggaggattctcaagaaggatttgactacactagctcaagtgtggagtgtcctcttatactccaacttggcccccacatcacatacctctaatctgtcagtggacagagctaggctgatctttggcctagtctctcacttggatatgaacatagaagcattgatttctggtcaaatgacttctatagtccagtctaacacctctagacttgggttccctgctttaatcaacgcattatgcagagccagaggggttgtatctgacagccttaccttcgagcgcctgagcctggaggctcctactctagcatccacttcagcagcccccttcgtcccagctcagacaaattctcaacgctttgaagccatgctccaaagcattcataagggacagatcattttactacagagttttcagatgatagcacctccagactctattccttctgttgaactgtttaatgagatggtagccttgcccgggacccaaccttatcttcacaaggaagacgaaggtcccacaacccaggtacctcagcatatggaagatgagtcatctgagagattcctgaacacaagggaagggttgtccctgtgtggttcagactttggtaaaggagttttacaaagagagtggaaaatctcgagtgggttgcttgaggactggacatag

SEQ ID NO: 103810 - DNA, 753 bp, Glycine max
  Peptide Sequence Number=SeqID_220588
atggaagttcattctaatggcgttgtggttgtgtttgccttgtgcattgcacttgccagttgtggctcgttggtagtgggggaggttaaggatgacaagcatttgattcatccaccacatttgttagggcctgggattatcaagagagggtttaagcgtagtggacttggcttcggtgctggtggtggtttaggaggaggaggaggcctaggtggtggctttggtggtggtgcaggtggaggaggtggcctgggcggtggcggtggctttggtggaggtgctggtggaggccttggaggcggtgtaggtggtggcattggcgggggtggtggtttaggaggtggtgccggtggtggtctaggagttggaggcggcattggtggaggagccggtgttggtggtggcattggtggtggagctggtggtggtttaggaagtggaggtgggctaggtcatggtgttggtgttggcattggcggtggagctggtggtggtttaggaggtggaggtgggctaggtcatggtgttggtgctggcattggcggtggagctggtggtggtttaggaggtggaggtgggccaggtcatggtgttggtgctggcattggcggtggagctggtggtggtttaggaggtggaggtgggctaggtcatggtgttggtgctggcattggccgtggagctggtggtggtttaggaggtcgaggtgggcttgctccctgcccctatttctgggacctgttagggagatag

SEQ ID NO: 103811 - DNA, 315 bp, Glycine max
  Peptide Sequence Number=SeqID_220589
atggatgacatgcccccgcaccttgcattattttggagtgccgtcctctggatcatagatgttggagtagaattctttgaccatagtgacgtcgatctgcttctccaagagtttggtaagaacctgatgccattgtctccattggagctctccgtaaaattcatcgaacatgcctgcggagagctccacgttcctctccgctgtctcagaagtgaagcgagaggaatcccaggtgtattccccccccttgtgtgggcactgctcggcatttccgtggggtcatctaaaaaaattagaaataggactagattttaa

SEQ ID NO: 103812 - DNA, 351 bp, Glycine max
  Peptide Sequence Number=SeqID_220590
atggcctccatcattgtggccatttgctcaattcatggcctccttgtcggccttcatctgttcttgcacctcctctacttcacccattattctagctctagcacaggttcggtaccatgttcaatcattatgtcacaacctacccttttgcgggcgagcgaggtgaggctcacgggtgcgtcttccaaaggaggaaaatgcgcggagtcgccaccaacgtttatttgtggaaaacatcaaaaaaaccgaaggaaaccggtcatgaagaatattccagattcgggagttgtatttacgtttgaggaaggtattagcacctctcacgtttgtcccaaaggacaacagccttaa

SEQ ID NO: 103813 - DNA, 429 bp, Glycine max
  misc_feature (422)..(422): n is a, c, g, or t
  Peptide Sequence Number=SeqID_220591
atggtctcttttgaacattcatgggaggtttgtatctatcaaacatttcaaagaccaaaaagaccaaacattaaacacccactccacaatccaaatactaaaagttcttcaaccaagacactttggttcggacttgaacaaaggaaagagattttcagttccattagatccgatccagaacaagtaaaagtctggttccaatcccatccagaattcctcaaagcagctgatccagaaacttctgtgtttttgaaccaaaagtctcatctggcaacatttttagcaggatcgaaatcaaaggaggtcctagctaaaaatctaaaggaagttctgcaaatgttacaacaggaagaaaaaggttcatcctcaaagaaggaagaaacaagttctgctgaagaagaagaagaagacccctttttccnaaatgag

SEQ ID NO: 103814 - DNA, 609 bp, Glycine max
  Peptide Sequence Number=SeqID_220592
atggtgcacgccctcgccttcagaggactacatgtcctcgtctttagagggctaaaagtcctcgcgttcagagggctgcacgccctcatctttagagggctacacgctctcacctttagaggacttcacgtcctcgccgtcagagggttgcacacgctcaccttcagaggactgaacgtcctcaccttcagagagctacgcgccctcaccttgagaggactatgcgtcctcgccttcagagggctggacgtcctcgccttcagaggactgcacgacctcaccttcagagaactacacgtcctcgccttcagagggctaaacactcttgcctttagaggagtacacatcctcaccttcagaggactacatgtcctcgccttcagaatgctgcacgccctcgctttcagaggactacatgtcctcgcctttagagggctacaagtcctcgcgttcagtgggctgcacgccctcgcctttagggggttacacgtcctcaccttcagagggctacacgccctccccttcaaagggcaacatgccctcgccttgagagggctgcaagtcctcgccttcaaagggctatgcgccctcgccttcagagggctgtaa

SEQ ID NO: 103815 - DNA, 465 bp, Glycine max
  Peptide Sequence Number=SeqID_220593
atggaatatgcagaatgtgaagctgttgttaaagatttccctccatttagagaggctatgaagaaaaggggcattgaagacatggatcttgtaatggttgatgcctggtgtgttggttattacaatgaagctgacgatcccaaccgtagacttactaagccacttatattttgccggggcgaaagtgacagccctatggaaaatggctatgcacgcccggttgagggaatctatgtgcttgttgatatgcaaaacatgctggtgattgaatttgaagaccgtaaatttgttcctctgcctccagttgatcccttgaggaggtatacacatggtgaaacaagaggtggatttgatagaagtgacataaaacccttgcaaattattcagcttgaaggcccaagctttcgtgtcgatggatcttatgttgcatggcaaaaggttgatgtggaatttcttctttattga

SEQ ID NO: 103816 - DNA, 402 bp, Glycine max
  Peptide Sequence Number=SeqID_220594
gtcgactctagaggatcccacggaggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 103817 - DNA, 357 bp, Glycine max
  Peptide Sequence Number=SeqID_220595
atggcaatgacaaagtatcaatggaagattgatgattgtgtttcaaaaaatagactaatcagacttgtcgaactgatgggaccgcgacttagaggtctaaccgagttgagttgtctatcagatctattatgcattgaacctagtgcaatccgatgggtgaatggtggcattgatgacggtagtagtggtggaatgatggtggtggcagccacaatgatgattgagataacaaaatgcgatgtagtggtggtggaggcagaaaatgtgaggtgtaatgacaatggcgactatggtgatggtggttgtggtggaatggtaatagtgaagatgacaataatggtgtggtggtggcagtga

SEQ ID NO: 103818 - DNA, 297 bp, Glycine max
  Peptide Sequence Number=SeqID_220596
atggcaagagtgtcaactgttatcgcctctgtcaactgttttcgcctctcgcttgttactcccccaacaccattcttctcatcgtttccaaccccgtcgacattctcacctacgtgcatgcaagaaatgaaggaaaaagaactcaagtatgcgaatttggagaagaggtcggcgaaggaaagggcttgggaggagtggtcgtgggaggcaaggcggcacttgatggagttggcgatggcaacagcgtcgggtgcaacagagggggtgaggcaactggagaggatacaaagggcgtag

SEQ ID NO: 103819 - DNA, 342 bp, Glycine max
  Peptide Sequence Number=SeqID_220597
atggatggtttatggtttagtggtggagaggagcgaattataatcttcactactaaccacagagaaagaattgaccctgcattgctacgccctggacgtatggacatgcacatccacttgtccttcctcaaaggcatggcatttcaagcccttgcttccaattatttaggcattgaaggatatcatccactctttgaacaaatcaaagagctattggagaaaatagaagtcacacctgcagtagtggcagaacaactaatgagaaatgaagatcctgatgttgctttggaagcacttgttaaatttctcaaagaaatggacaaggaaaaagcatgcatttag

SEQ ID NO: 103820 - DNA, 498 bp, Glycine max
  Peptide Sequence Number=SeqID_220598
atggtaatcgattaccagagagtaaaaactctttgctttgcttccacaccaacaatcggaaaaatcatcaacaaccaacacaacatcaactccgccccctacggcatcacgtcgcgcgccctacgctgcaacctcgccttcgagatgctccacccctcacgcgtcagcttggagtccgggttaaacgcactttacgacttcgtgaacggtggaggtgatgtttggatcaacgagaaatgctttcgcatcgtgcgccagctcggagaaggtggcttcgccttgatgcatcctttcaagaggtatgttgagattgggagggttgcccaaatcaactacggtaaggaatatggcaggctcgttgtcattgttgacgtcattgaccagaacagaggaaaacttccaggaaaccacattacaagcgaaacctcaaagagagttgggcttcgtcctcaaaaggaaacaacaccagaaaatctagtcttccatggattcaaatag

SEQ ID NO: 103821 - DNA, 990 bp, Glycine max
  Peptide Sequence Number=SeqID_220599
atgagatcatcatacatgcagaaaaacctttcttcctcttttccctcagcatcatcatcatcatggtttgaggtgtatgctgccatctccacattcatgatgctcctaagaacatcactcaatgatctcataccgcgccaaattcgatccttcgttatctcaaagctaaagagtttcttctcagagagacaattgcaacacaaccatgaggtctcacttcatatcaaccagttttgggatcgccaaacgaaccaactcttccaagctgcccaagagtatctccctgataggataacacactcttacagatccctcaaagttggcaaactaatgcagcataagaacattgtagtggccttggatggaaagcaagaggtggtggatcaatttgaagacatcaaacttttagagtggaagttggttgaaagttccaaggaggattctgatcatcatccaaagtcaaacgagaagcattcacttacactaacctttgatgagaagcacagagaaaaaataatgaacaagtacattccacatgttctaagcacttaccaagccatgcaggtagcaaaaaggaccatcaagatccattccatggggggtggtagtaggcactgctggcagaagagtgagttaacacatccagcctcattcaacacacttgcattggattttcagcaaaagcatgccataattgatgatttggataggtttttgagaagaaaagagttgtataagacagttggtaagccttggaaacgtggctacctcttgtatgggcctcctgggacaggaaaatctagccttgttgcagctatggctaactatttgaagtttgatgtgtatgatttggagctaagttctttgtgttctagctcgggcatcatgcgtgccttgagggacacgtctaaccgttccattgctgtgattgaagacatagattgcaacaggagaggtgttagatcgatcaacaacaaaggaatcagatga

SEQ ID NO: 103822 - DNA, 291 bp, Glycine max
  Peptide Sequence Number=SeqID_220600
atggcacgcagagacaaattatggtcattttgcgccttttgtcatccagaggcgatgagcccgatgacatgcagagacaaattatggtcattccgcacaccttttcgccatttagagacgatcgattccgatgacatgcagagacaaattatggtcactctgcgccttttgtcatccagaggtggcaagctcgatgacatgcggagataccttatggtcattccgcgcctttcgtcaaccgagaggaatgaattcggcagtataaggatgatgttggtcgttcggtgctga

SEQ ID NO: 103823 - DNA, 278 bp, Glycine max
  Peptide Sequence Number=SeqID_220601
atgggtgccaagcacctcacaaggaccaaagaaaggtcgcatgtcatcaagcaaagatccccggacgaaattaggggtgcggataaccgtaaggtatctccgcgggttaccagatcttgggtcatggtaacaaaaagcgacttgaaaaagtctccaccagaagatgcctacatcttcggaaagggtgcagatgaccatattggcctccgcttatcaatcacactcgaggtgcggataaccgtaaggtgtctccgcaggctaccagctcttgggtcatg

SEQ ID NO: 103824 - DNA, 534 bp, Glycine max
  Peptide Sequence Number=SeqID_220602
atgggatttgtgatgaacgcgctaagcgcgcctgttgcgcttagcctgttcatcacaactgctaagcgcgccctgtgcgctaagcctgagtgtctttctgttgaggctgagctaagcgcctgggagagatacactgacattgtcgtgcctcagttttatgagttcaaggaggaactcgagagacgccattgggatgagaagctgactgactttctggacggcaacattgatgttgccattgtaaaagaattttatgcaaacctctatgaccctgaggacaaatcacctaagcaggtgagggtgagaggtcatttgattaagtttgatgaggatactcttaacacatttttgaagaccaatgttctagaagagggggaaacattgtgtgcttactttagagttgcactcctgaggcctaatcctcaagagttagctgttaagctttgtatcccagggaggggattcgagcttaatgctaatggttatcctttaaagattctgaggaagaacatgactaccgttgctcagacttag

SEQ ID NO: 103825 - DNA, 166 bp, Glycine max
  Peptide Sequence Number=SeqID_220603
gcccagcccaacacgcacgcttagcacgcgtcacgcgctaagcgtgcaagccagcacaggcactaagcgaggcgttaagcacgaggatgcaggattcattacgcgcgctaagtgcgagccacgcgctaagcgcacgatccaacagaagcacacgttaagcctatag

SEQ ID NO: 103826 - DNA, 396 bp, Glycine max
  Peptide Sequence Number=SeqID_220604
atggagtcgttgaccgaagaagtcagaaaccgcttgcgcaacaagaggtatgttgtcttgtttgatgacatatggagtgaaacattttgggatcacattgaatctgctgtgatggataataaaaatggaagtaggattttaatcacaaccagggatgagaaggttgcgggatattgtaagaaatcatcatttgttgaggcatttcagtatagttccgatggagattgtccagaagaacttaaagatatatctcttgaaattgttagaaagtgtaaaggtttacctctagcaatagtggccattggtggtcttttgtctcaaaaagatgaaagtgcacctgaatggggacagtttagtcgagatctaagtttagacatacatggagaggaattctga

SEQ ID NO: 103827 - DNA, 432 bp, Glycine max
  Peptide Sequence Number=SeqID_220605
atgtgggaccgcacgccgctgggcgagcagcaaaccatttttggtcgtgagaagttgtccggcgcgccgctgggcatgcagcacgagcacgacgtgccggattacgcccgcgatccggacggcgagattatcgcgctggatgcgcatatccggctcgccaatccgcgcacgccgcaaaccgacagcagcctgatgctgcggcgcggctacagctattcctcggggattaccggggcagggcagctggatatggggctgctgttcgtctgttatcagcacgatttaagcaaaggctttattaccgtgcagaaacggctgaacggcgaagcgctggaagaatatattcgtcccatcggcggcggatacttttttgtcttgcccggtgtggcggacaaaaatcattatctggggcagccgttgctcgaagcctga

SEQ ID NO: 103828 - DNA, 396 bp, Glycine max
  Peptide Sequence Number=SeqID_220606
atgccgcctaccaggcaccctctagacccagataagtctaacaaggccctgggatttccggcgttgattacgggtctctgccagtcattcagggttcccgtcacacctagcaaggccacagacgcaccgccaccacctcatcaggctgatccagctgggtcatttggcatggagcggtatttacagcacttggttcgccagcaggcggccaaccacagggggcaggtgcagactcacgagtgtctctaccagctcagcctcagtctgcagagccagggtttcgctccttttccgtgccctactctagatcagtttagggctgaggtcgcatggcccggagattggcccgaggaccagacagaggaggcatctgcagaggctcctggcgatccatag

SEQ ID NO: 103829 - DNA, 632 bp, Glycine max
  Peptide Sequence Number=SeqID_220607
gacttcatgtccacatcttcagagagctgcatgccctcgcctttagagggctgcacgccctcgccttcatagggttacatgtcctcgccttcaaaggaatacacctcctcgccattagaggggtacacgtcctcatcttaagaggactacatgcccttacattcagaggattacgcctcctctccattagagggatacacgtcctcacctttagaggactacacgtcctcaccttaagagggctacaagccctcgccttcgtagggctacacgcccaagccttcagaggactacacgtcctcgccatcagagggctacacgtgctcgccttaagagggctacacgtcctcaccttcaaaggactacacaccctcacttttagaggacaacacgtcctcgcctttagagggatacacgtcctcacttgtagaggactacacgtcatcccctttagagggatacaagccctcgcgtccatagggctacacgccctcacctttagaggactacacatactcgcctttagagggctacacggcctccccttcaaatggctacacgttctcaccttcagagggctacacctcctcgcctatagaggactattcatcctccccttcaaaggactgcac

SEQ ID NO: 103830 - DNA, 729 bp, Glycine max
  Peptide Sequence Number=SeqID_220608
atgcccactcattatgtgtggttggtctcccacgtgcttcatcatgaaggtagacctgtctgtcctctacaaggtcatcacatgtgcgctgaaaagggaaaagcaaattggaatgaactcttggcaggtatgctaggagcgtccgttagttggttcccccgatggaaagaaggaggggccggagtgttgtgctcgtgtgaaggattcccaaacatccccttgatgggaacaaggggtggcattaattataatcccatgctggccataagacaactaggctaccctatgagaggtgcaccgtcggaagagactatcgtgcctttcgtcgcacggggtttcattgaaggtaatgcaaaaatacttcagagaatctgtaaggcatggagtatagtggaaagaaaagataaggagcttaggggaagcagcaacgatgtcatcggtggctatcataagtggttaaaggctaggacgcaaggggtaacttggctctcaaagctaaaagatccaagtgggaaagaagctgaagtcctcaaggaaaatgaagaagtgcaagccttgaaagtagagcttgaaagaacaagcgtggttaaggaaaagctaaagacgatagtcaccagggtccagaaagagtgtgacaagctaagggatgtcaacatgactatggacgaagcattagagtgggaaacaaagagggcccgaaaggaagaatggggcagaaacaagttctga

SEQ ID NO: 103831 - DNA, 324 bp, Glycine max
  Peptide Sequence Number=SeqID_220609
atgcattgtgaaccagatctgggatccttgagtgaggaagtcacatcagaatcaatgattaggactgtaaaagcaaacagtgctaaagtggtttcaatctctggcaccacgatcaatagattcttaggcatagctacgagaaatattcaaggtcacctttgctacaagcaaaaccaagttgaaaatcaaggcaaatctgaagtggataagacaaggaaaggacgaacccatccgagaatattttccaaggttcaacaaagaagtaagggagatcaccaacattccttaagacatcatcctgatgctagcaaaagatggagttaa

SEQ ID NO: 103832 - DNA, 1008 bp, Glycine max
  Peptide Sequence Number=SeqID_220610
agggctaacgccctcgccatcagaagactacacgtcctcgccaaaagagggctgcacgccctaacctttagagggctacacgccctcgccaaaagaggactacacatcctcaccatcagagggttacacgccctcaccatcagaggactacacgtcctcaccttcagatggctacacgtcttcaccttcagaggactacacgtcctcgccatcagaggactacacgtcctcgcctttagaggactgcacgtcctcctatttagaggactacacgtcctcgccaacagaggactacacgtcctcgccaaaagagggttgcacgccctcaccttcagaggactacacgtcctcgcctccagaggactacacgtcctcgccatcaaagggctacacgccctcgccatcagaggactacacgtcctcgccaaaagagtgttgcacgccctcaccttcagagggctacacgccctcgcctttagagggctacacgccctctcctttagagggctgcatgtcctcgccatcagaggactacacgtcctcgccttcaaaggactgcatgtcctcccatttataggactacacgtcctcgccatcagaggactacacatcctcgccaaaagagggctgcacgccctcaccttcagagggttacacgccttcgccttcagtgggctgcacgtcctcaccatcagaggactacacgtcctcaccttcaaaggactgcacgtcctcccatttaaaggactacacgtcctcgccaaaagagggctacatgccctcaccttcagagggctacatgccctcacctttagagggctgcatgccctcgccttcagaggacaacacatcctcaccatcagagggctacacgtcctcaccttcaaaggactacatgtcctcaccttcagagggctgcatgccctcgcctttagagggctacgtgtcctcactttcagtgggctccacatccgcaccttaagagaatttaaggtcctctgtccttaa

SEQ ID NO: 103833 - DNA, 180 bp, Glycine max
  Peptide Sequence Number=SeqID_220611
atggcctctgtagatttttttttcaaaagtgatttcaagaatagtgaatgttccaagcatatgatgggagatgtatccaagtttacaaccatttcccccaagaaaggtggacatgttacatacggcaacaacaatattagtaaaatctcaaaagaggtaacatctaagtcatctctatga

SEQ ID NO: 103834 - DNA, 129 bp, Glycine max
  Peptide Sequence Number=SeqID_220612
atggtgaaaaaatggggcatcaagcctaaaagaaacaactacatcacagttgatgaattgaaagaaacatcgaaggctcttgccacgtgcacctatgaggagggaactcaatggggggaagaggtttga

SEQ ID NO: 103835 - DNA, 303 bp, Glycine max
  Peptide Sequence Number=SeqID_220613
atgaagttatatctggagaaggtaaggtccacaacgtattcgatgcttcctctggaagccatgaatattcattatcatgttcggagtagtcatgaatcatatccagggaagaataatggatggatattttctcaaaagtgggaaactgatacgagcatagttaggaaagccagaactttgtctattttcatccaggaaactacgctcaagatcagacttcccattggacaatttagagacattagcctgtccgtgtcacaaggcacccaccccctgcctggatgggtagggctgctaaaataa

SEQ ID NO: 103836 - DNA, 369 bp, Glycine max
  Peptide Sequence Number=SeqID_220614
atggaaagagatggaggtttcgatgacgttggcgctgagaatgatgaaagctttgttgttttctttggagaaggaagtgtgtgtcatgcacgacgaagaagatcaaagctcttgaaggtgtacctaacgaaagaagaccaatcaaacaaacacaacacgacggggagagtgagaatgagagttcgagaacaagagtgggagttgcagcgccgcaaggagagtaaaactgagagaccaaacagaagtgagagaaacaaagaatttgggctcaagaccttctcttataaaagactcaacaacatcagttttaaaataagaatgatggttttaaaatcaaaccgatgttattcacgagaaactcaacattga

SEQ ID NO: 103837 - DNA, 1233 bp, Glycine max
  Peptide Sequence Number=SeqID_220615
atggatagagaaaatgctgtaatgggtggtgtaagagagggtgaagagcgtggtgttcgggtcactcgagcaatggcaagagctgctttgggttgggtctctgcctcttctagaccgtctttcaagaaggaatgtaaaaacaacagtaggacagcactagcagatgtatctaacataagcagaaaatcacaggcaagaggaggttacaagaagactaacacaaagggatcttccaatgtctccattcaagttttgtcaactcaagaagatgttagagcagagttagcaaaagatttatccacaatatcgatggtacagacacatgatgctattgtagaaaggccggaagacacagagctagtgcaaccctctatgtctgttatggcaggtcctctgctttcaatgcagaactctatgaagtctgatgaaatccttagccctccaaacaaagacattgatatgattactgagaaactaaaactttcagaacgtttgggcattgtggacattgattcagtggagttaaaggatcctcaagtttggagttcatatgcccctgatatatacaataatatatttgtcagggagtttgaaaggagaccgttaagtgattacatggacaagttacagcaagatatcactccaagcatgcgaggaattctgattgattggcttgtggaggtttctgaggaatataagctagttccagatactctttaccttactgtgaatctcattgatcggtttctttctcaaagtttggttcagaaacaaaggctccagttgctgggtgttacttgcatgctgattgcatcgaggttcatcctagcagcacaatcttcttacaaggtttcttatgttgaactggaatttctggcaaattatttagcagagcttactcttgttgaatacagcttcttgcagtttctaccttcccttatagctgcatctgcggtattaatcgccagatggactctcaaccaatcagaacatccatggaattcaaccatggaacactatacaaattacaaagtgtctgagcttaaaactactgtccttgcactggcagatttgcaacttgatacgaaaggctgttccctgaatgctattcgcgaaaaatataaacagcagaagttcaagagtgtggcaaatttgtctccgaaaccggtgcagtcacttttcgaggctcaagttaaaactgtaaatgatgcatatgtgaagactaaatattga

SEQ ID NO: 103838 - DNA, 177 bp, Glycine max
  Peptide Sequence Number=SeqID_220616
atggtgcgcacgcgcggtcacggggctgggacgtgcggaggagaggctctggaacttgatgttgacgaagacgtggctagagccagaaagttggagatggggggaggggggacgcgttggcagaggagacgaaggaccaggtggagccaggaagcacccaaatatttgaatctctga

SEQ ID NO: 103839 - DNA, 798 bp, Glycine max
  Peptide Sequence Number=SeqID_220617
atgatttttcgaaaatcgcctttgaagtgtctcactagctcgcaccttcttagagtctctttgcgccctctctcactcgcattgcggttaaaggtgtctagtggcactgttgaaggttttcaatgctgttgtcgaaggtgtctagtgtcgtcgttgaagcttttttccggagaagaacctccagagaagaaggttcctcacaccatcgagaacacaagggaactcgacgagatcgtttgcaagcccgccgatgataaggtttccaataacgccctcgtaggcttcgtttcattcgaggctcaggtccaggtttatgtgttccgcgactctaaggagattcctgttgaacagattcttgatcagcttggtctttctgcttccggaaagagacctcacaagggtgttgctcctagtgtcgccggtgctggtggattccccaattctggcatcacgtgcttccttttacctgctactgagtgtgaatatactcttaatgcgctattggatgaattacagacggatcaatggtcggttctgcatggtcgtcaccctgcacactacactggggttgcatttagtgtttttgctggattgccgagtgcttgtaatcctgggactagtgctagaatcatagctttgcaattaaagggatattcaacaatcatcaaactttgtgttaggaatgtgttgatgcaatcctaccccccaagggtattggatagaagactccaagaggcttgggctagagctactaaagaaggccctagggttctcatgaaccttagggtagatttttga

SEQ ID NO: 103840 - DNA, 327 bp, Glycine max
  Peptide Sequence Number=SeqID_220618
atggagaaacgcgagggaaaaaggaatgaatcagcattactgtcgtgtcggaagatgcaaacgcgcttttgcctggcgaagcagaggaatccacagcggtggtcccaacaaaaaaggttggcgcccttggccttggtgatgaccgcgatggtctcgaagaaaggaagtctgtggaacgcgatggattcagagattgagatgaggaagtctcgtgactccaccaccgtcattgagagcacgggcttcttcacgagactgttggatagatcgatctatccggtaccaacttttacacaccaaagacaaagcatttcggtcactgtgtga

SEQ ID NO: 103841 - DNA, 291 bp, Glycine max
  Peptide Sequence Number=SeqID_220619
atgcagaggctgacacagtcttctgcaccttttgttcctccggggacaacaaagtcatttacatgtggaaatttcatggtcacccgcgactctcgtcagccgagaggagcgaaattagtgtcatacactgattttcggggacctttgcttgatgacatgcgaccattctttggtccttgtgaggtgcttggcatccatcatcaggcaatttgtgaaatcctaggaacgacaagtcacggtcacccgcgactctcgtcaaccgagaggagcgaaattagtgtcatacactga

SEQ ID NO: 103842 - DNA, 651 bp, Glycine max
  Peptide Sequence Number=SeqID_220620
atgggggatcccatcagcagactctccttccctgaaaacaccgagactttttcaagtctcacaagttatccagaactacgtaggtctgagttcctcattggaggatacgtaggagcaaaagcctcgcttttgtcgaccgcgccgctttctgttaccatgacccaagagctgaggccaatgttgtcatctgcgccttttccggagatgtcagcattttccgatggagacttttcaagtctcacaagttatccagaactacgtcatgtgacgtgcacccttgtatcatccggaggcggcgggcccgatgatacgcggagataccttacggttatccgcacccttttgtcatccagaggcggcgggcccgatgacaagcagagaccaaagaccaaatttggtcattctgcacccttgtatcatccagaggcggcaggcccgatgatacgcggagataccttacggttttccgcacccttttgtcatccagaggcggcgggcccgatgacaagcagagaccaagtttggtcattctgcacccttgtatcatccagaggcagcgggcccgatgatacgcggagataccttacggttatccgcacccttttgtcatccagaggcggcgggcccgatgacaagcagagaccaaattag

SEQ ID NO: 103843 - DNA, 2163 bp, Glycine max
  Peptide Sequence Number=SeqID_220621
atgctagactcccatcctcacgacacttcaccacgctcccttgaggacattctcctccgcttgggtgacaccatgaacactgtgaccctcaaacttgacgaaatactccaccacctatccccaagctcttcttccccgaaccctcaaccaaccccaatccagccccaacctaaccctgcacctgcaacattacacaaaatgaaattagaggttctgagattcgatggaactgaacctctcggttggatattcaaaattaatcagtactttgaatatcacggcaccccggaacgagatcgactcacaattgcctcgttttatatggagggacgagcacttgcgtggttccagtggatgaccagcaatgctcagttcacctcctggctgggatttttacaggcattgcagacccgtttcaccccgtcacaatacgaggaccctacggggttgtcgctggagatacggcgcgaagttcaggccttacaacccctcaccctggtacaagcagcaggattagcacgcttgcaagaagaaaaattagctaacatccggccaccaccacgaccgcgccctccacccccaccaccagttccccctcacacaaaccttaaccctcaccctcacaaccctcgctcaccctcactaccaccattattacccgcaccaccgcgtcagcctccccctgtgatgaaacatttgtcacaggaggagataacgtcacgccgtgagcgtgggttatgcttcaactgtgacgagcgttaccaccggggtcaccgttgtgcatctagcgttttcctgctcattactgaagaagaggatcctcctttagttaatatagaccctaatgacccgcaacccaataccatacccgacccacctgatggaaccgacccatactcggcccacataagcctacactcattatcaggtcatctcgtcccggaaacgctgcgttttgaaggtgtcattcatgctcatcccctggtgctcctcgtagacggaggtagcacccataacttcgtccagcagcagctggtctctcgtttggggctaccttgccgttccacaccaccacttcgagtcatggtgggaaatggtcaccacttggaatgcactataatttgtgaagcagtttccatttcgattaagaacattgaattttctgtggacctttatgttctacctattgccggcgccaacattgtgttgggtgtccaatggcttaaaacattgggccctattctcacggattataattccttaagcatgcaaattttctatcagcaccgcttggtccagctaaaaggggaaaggacttccaccgacccgggaaaccgatcatcacatacacttgttaccccaatccgaacccgtgaatgtgcgccctaccgatatccccattaccagaaaaacgatattgaacaccaagtcaacctcatgcttcagaagggactgatccaacctagtacaagccccttctcctcacccgttcttctcgtaaggaaacacgacggcagcaggcggttctgtgtggactatagggcccttaacgcggtcatggtccgagatcggtttcccattccgacaatagatgagctcctagatgagctcggcggtgctcaatatttctcaaaacttgacctgttgcagggttatcaccagataagaatgcatggccccgatatccctaaaacgacatttagaactcaccacggccattacgaattcaaagtaatgtcgtttggtctctgcaacgcaccatcttcgtttcaggcgacgatgaacaacattttttggcaataccttcgtcacttcattatcgtattctttgacgatatactcatttatagtaattcctttgaggctcatctccaacacttgacaacagcattccaggttgaatatttaggccatatggtctcgaagaaaggagtagagccgatagccttgaaggtggaggccatccttcaatggccaatacctcaatcttcaagggctgtgcgtggcttcttggggctcaccggattctatcggcgcttcataaagggatatgccaccattgttgctccattggtaaagctcaccacaaaagaaccctttcagtggacaccccaggcacaatcagcttttgaacaccttaagacagctctgtccacaactcat

SEQ ID NO: 103844 - DNA, 1194 bp, Glycine max
  Peptide Sequence Number=SeqID_220622
atgcagaattatggcagtactcctgacaagattaagtttatagacgggtcaagagaaacccttaaactagctgtaaggatcacggatctttggttcgttgggactcccaacaagtctgaacaagctgaaatggttattgttgattctaatggagatgaaatccatgttgtttgtaagacagaccggctaaagtcttggaaagctgatttgaaggaaaattgtacttatgtcatgcataattttaaagtgatgaagaatgatggtcaattcagagtctatgagcatcaatataaattagtttttactggagttagtgttgttaggcaatccaatttagatcacctcccttttaaggaatttaaatttgttgaattttccaatgtcattgctagcgattttgaggctggcttgttggttgacattattggcgttgttgatgaggtgctcttctgccatgtctcatcaaaaaatactagggttgtttttaaaatcaaggatttgagtggccaagtgttatcttacactctttgtgaaaattattgcttgcagttcttagcctacttgaatgagactgaaaatgatggcccgatggttatcattttgacgcatgccagaatcaaagaagggcagggcaagtctgatgtcatatttgccagttgtggatcctatccaccctcagtgagtaattcgttgaaggcctcaaaattattgattaatgaacctgtgttggaaatccaagaattcagtgagaggctttcagatttaggtattgaggtcaggctagttttgacacctcgcggtcaaggaacttgcattcaatgccacaggaaaactgacatagaggcaacaccattcacatgcggatgtggcaaatataatgatcaacctgtcctgaggtatagacttaaggtgatggttaagcacaaggatgaaagcacgaaattcttgctccgggaccgtgaatgtgctgaattgattggtcaatcagctaatgaagtcaacagggtcaaaatagaagagcgtgatgttgatttaaatgcttctcctcaagcacttgatagactgctgggttatgtccttacttttaaagtcaaggcatgttccaaggttgatagtccaaaccttgattgcaatgatgccccacaagttgaatctttgtcttttgatcgccctgttgccaagttgtggaattga

SEQ ID NO: 103845 - DNA, 147 bp, Glycine max
  Peptide Sequence Number=SeqID_220623
atggataattggcgaacagcgctacgcaataacttcgcggggctccagactcgaagagaatggagaattggcgaacagcgctacacaataacttcgcggggctccagactcgaaggtggaggacacatgaacagcgctaggcaataa

SEQ ID NO: 103846 - DNA, 498 bp, Glycine max
  Peptide Sequence Number=SeqID_220624
atggcgaggcggaaaatcgtagataggattggagtaggtattgtcaaggtgaacaacgtcaacagcgggaacgtgccggagcgcgtcgcgaagcacgtgccgggacttggttgctcgctcgcacgtggcttcccacctgaagtcgccggtgtagaggatgcagccgaagtcgccgcggaaaaggagcatgatggaacctgttggaagaaaaagggagaattagaaaggttaccgaccggggcagtgacaggcgtccatgacggtgacgtggagggtgagggaggggagggtgacggtgtgggtggtgccggggtggaggatgcggaggagggagaggtcgaaaccggggaacttgaaggggaggagtttggcggtgacggcggagcagaagaggggggcgtggtgccaggagggggtgaggccgtgggtgtggtcggagtggaggtgggtgaggaagtacgcttcgcttccctctgcccaacggtctacggagattaa

SEQ ID NO: 103847 - DNA, 241 bp, Glycine max
  Peptide Sequence Number=SeqID_220625
atgatgcctcgcagtggcgaaggcctactgcatcagcccgtagacagtgacaacaactggttgttttggaggaccctcctacggccgaggaggaattggtcgacgtccaggcagaagcacctattcatgaaggtgctactgatgttgaaggaacgtcctgagttgaagttatcttcccatggaaggaaggtgactaagattgggaggcctgccccagagattgaaggccttgtgatggcca

SEQ ID NO: 103848 - DNA, 690 bp, Glycine max
  Peptide Sequence Number=SeqID_220626
atgcatcttcttggttacgatgatatttttacaacgaacacgtctcttactagagttagagcagttcctgtatatagcttcagcatcaatactgtagaggaactaaattatgtgtgcccaactataggaattatgccatcgggtcttccatggataaagaaatcccatcaaaagaatgagcttcaaaccggttcctttttgacatctcgttacaagagaggcaaattgagtgcaaatactgagacccagattgataagcaaattgtaaaaacaggatcacctgagaaaattcacaagtacatttacacagttccttactctgatcactccaattatgaggagattgaggattttgtaaagcttgtcaaaccaaccaccctcaagggtattgtgtcttcctcctcatgctatattgaacccatgtactattttggtcgactttgtcctggtaatcagcaaacagatcaggtgcatgagggttgcaaagggaaagaaaatggtaaaagagaaagagaagaagcagtcagatccaaaactttgtttgaaggtgataattttgagacaggtagagacagagggaaggctttgaagggtaggttttctggtgttcatgtgagtaggttgagtatattgagaaaaaagcgccgtggtgcaaaaattcaggaacatgatgacagttctgaatcttga

SEQ ID NO: 103849 - DNA, 2403 bp, Glycine max
  Peptide Sequence Number=SeqID_220627
atggaaggtgcttctttggtgccttggtggcgtagcctagcaggacagggaaacggaagaagaagaagaagctctttctctatacaacagtgctccttctttcattccttcaaagaggactgcatctcttatgcgtatctgtctctggattctgctggttgcaaaggaatttctttcactctggccgctataacaaagtcaaactattctcgcacctctaggaggtgggcttgtcgcttgattatggctaagggtggctttttcctgtgttgccagaagctctttctaaaagttgtgtttagatgtagctgtctacgtcattgcattgcagcaatgtttaggttttcttgtttccatgctaatgtccaaggcaacaaggcaaagaaaacagttcaaccctcttctgaagcaatggtgaagggtttgcaagatgttacggaaaatcatggctgtaaagattcatctaatcttccatgtgcatattcatccccttcgaaagaacaagcacacaagcaaataaatgtcatggagaatcatagcaattgggattctgttgggcgcagttgtaggtcagaggatctgaatagcaagttttcctttgaaaacgacaacaatgttcaccaaactaggcatattaagaagagccagtctcttcaaagtgggcttgatcaaggcatcagggaagctgatgaagatcttgggttgtcgtgtgatggtgccaaaagccagaatgagtcaacaatttctattagcagaaggtatcatgatgcaaaccccattgatcagtatggaaataatccaaacgttgagtttcaagtcagttcaggtcttgcgaatgatggctcacttttttcaataggagacccaatgccttcagataaagatgcccatgaaatttctgatactccgttatctgttgaatttgctggtgacattcctgaccagacttttgttcctggtagcctatttctaaggaagtcacgttctttacccaatatcagagcttctatactttcttctgaaagagatgcttttaaacatgcattgtcaagatcttccgatgatcttcacgctttacgcatgtggcagaaagaggaattcatcaatgagtttgatgatcaaataagggcagatcaagaaagagagaatgacatgggaaaacctgaagatggtcgtatggacagtttctttgatgatggttttgattcttatctgctttctggttcagcaaaagactgggtaatgccaattacagatgatacaagtaatgtcaaaacccttcaaggagattctttagttgactgtgcgggtgaatttcctaagaaggattttaagattaagcgcattgaggattgggtaattggtttgcagcattgtgggccacctctagaggaaacaaatgaagatttgcctgaagttattgaacctttaattgatgttaacacagtaaatggcgtgactgctgccagtgtgaatcataaggtcactccaggaatggaagcagctaaaagatatatatcttctctgagtgctaatgccactgctgctcagctgggaaatcatgggttggttgtgatcccctttttgagtgcatttgtgagtttaaaagtgctcaatttggctggaaatgctatcgtgaggataactgctggtgctcttcctcgcggacttcacgcattgaatttgtcgagaaacaagatctccactatagaaggattacgtgaacttactcggcttcgtgtcctagacctcagttacaaccgtatattaagaattggacatggtcttgcatcctgctcatctttgaaggagctgtacctggctggaaacaagatcagtgaagtagagggtctgcaccgcctcttgaaactaagtattctggatctccgttttaacaaaatttcaacagccaaatgtctaggccaacttgcagccaactataatactttgcaagctatcaacttggatgggaacccggcccagaaaaatgttggagatgaacagatgaagaaatatctgcaaggccttcttccccatcttgtctactacaatcggcagcctatgaaagtgaactctttgaaggatggagcagaacgttcggttcggttaggaatgaattcccatcagtttgatcgcagccttagagcggatcgcaagaccacaaggaagggcagccaaggtgttgcagccacaaggaggccatcaactgcttctactcatgctcgcagaagtgtggactcaccaaaactgtccaagggcaagcagactctcctgccaccaactagaaccaaagtatcaacccaaagtcggtatcattttgattctcccagcaaagtattgaacttggtgtcagagcgctccatgcgcaagagtcgcagtgagggaaattttggagttctgtga

SEQ ID NO: 103850 - DNA, 204 bp, Glycine max
  Peptide Sequence Number=SeqID_220628
atggtactttcagggttcaatgaggaaggtgcaggggcttcacaaggttcaagaggtgttaggttagacgaaatgagatgggtgaaggagccaaggaggtgttggggttggggaagggaggtgctctcattaagggtaatttggtctttaccaaattgcttagaaggtgcaggattcacaagcctaagaagtggcatacattga

SEQ ID NO: 103851 - DNA, 2490 bp, Glycine max
  Peptide Sequence Number=SeqID_220629
atgaggaacaacaagccacagttatggctttctctttctctcatcatcacatgcttctcgttccacacttcccttgctgctttgaccaccatctcagcaaaccaatctctctctggggatgaaactcttgtctcccaacatggaaacttcgaattgggtttcttcaacacaggtaacaactccaataaattctacataggcatgtggtacaaaaagatatctcaaagaacctatgtttgggtagcaaatagagaccaaccagtttctgataagaattctgccaagttaacaatattggagggtaatttagtgcttttagaccaatcccaaaatctagtttggtcaaccaatttgagttctcctagctcaggttctgctgtagctgtgcttctagatactgggaatcttatattaagcaatagggctaatgcatcagtatctgatgctatgtggcagagttttgatcaccccacagatacatggcttcctggtggtaagataaaattagataaaaaaacaaagaagccacaatatctaacgtcatggaagaatagggaagatcctgcaccgggtttgttctctcttgaactagaccctgcaggaagcaatgcatatttgattctttggaacaaatctgaacagtattggacaagtggtgcttggaatggacaaattttcagcttggttcctgagatgaggctgaactacatctacaatttcacctttcagtccaatgagaacgagagctacttcacctactccatgtataactcctctattatctcgcgtttcgtgatggatggctcggggcagatcaagcaactttcgtggctggagaatgctcagcaatggaatttgttttggtctcagcctaggcaacaatgtgaggtctatgccttctgtggtggatttgggagctgcactgagaatgccatgccatattgtaattgtttgaatggttatgagccaaagtcacaatctgattggaatcttacggattactcaggagggtgtgtgaagaagaccaagtttcaatgtgagaatccaaattcctctgacaaggaaaaggacaggttccttccaattctcaacatgaagttgcccaatcattcgcaatccataggagccgggactgttggggaatgtgaagcaaagtgcttaagtaactgttcttgtactgcatatgctcatgacaatagtggttgttcaatttggcatggtgatctcttgaatctgcagcagcttactcaagatgataatagtggccagactttgttcctcaggcttgcagcctctgagtttgatgattctaatagcaataaggggacagtcattggtgctgttgctggagctgttggtggtgtagtggttcttctaatactttttgtgtttgtgatgctgcggcgcagaaagaggcatgttgggaccagaacatcggtggagggctcattgatggcatttggctacagggatttgcaaaatgccacaaagaatttctcggagaaacttggaggagggggctttggttctgtcttcaaaggaacattgcctgattcgagtgtcgtggcagtgaagaagcttgaaagcattagccaaggtgagaagcagttcaggacagaagtgagtacaattgggacagtccagcatgtcaaccttgtaaggcttcgcggattctgttctgaaggtactaagaaactgctggtttatgattacatgccaaatggttcattggagtccaaaatatttcatgaagatagctccaaggtgttgttggattggaaagtgagataccaaattgctcttggaacagcaaggggattgacttatctccatgagaagtgtagagattgcatcatacactgtgatgtgaagccagaaaacattctgctagatgctgattttattccaaaggtggcagattttggtcttgcaaagcttgttggaagggacttcagcagggtcctcactaccatgagagggacaagaggctatcttgctcctgagtggatttcaggtgtggctatcactgccaaagctgatgtctacagctatggaatgatgctttttgagtttgtgtcgggtaggaggaactccgaggcatcggaagatggccaagtgagattctttcctaccattgctgcaaacatgatgcaccaaggagggaatgtgctaagccttttggaccctaggttggaggaaaatgctgacattgaagaggtcactagagtcatcaaagtagcttcatggtgtgtccaagatgatgaatctcataggccttccatgggtcaggtggttcaaatccttgaagggttcttggatgtgactttgcctccaattccaaggaccctccaagcctttgttgacaaccatgagaacgttgttttcttcaccgactccagctccacacagacttcacaggtaaagagtaatgcctcagctgcttcctctcaagccaaaagcaacatctcatcatccaatagtagcacctag

SEQ ID NO: 103852 - DNA, 492 bp, Glycine max
  Peptide Sequence Number=SeqID_220630
atgattatggttctaatttcaaggaaagaatgcaatcagcaatgtgtcgcaacctacccttcggcggaagggaaacacaaggctcacgggtgtatcttccaagggaggaaaacgcacggagtcgccaccaacgtttatttgaggaaaacattagaaaaacccaaaagcgggtctacgaattttaagaataaaaggttcgggagttgtttacacacagggaagaaaaatagggggaggaggttgcaacacagctcgcctaggcgagttggttgcttcatcttgaagttttccaatgggcctaggtgggcccaggggctgaggaatgcccccaaattgaccattttgcccccattttgtgtattttactcatttccttccgaaacatcacaaaaccctacagattatgcaacaattggtgttaaccagctcaacttggctggcaaaaatccacatgttgacaaacaattgcccccagataaaattagggtatga

SEQ ID NO: 103853 - DNA, 243 bp, Glycine max
  Peptide Sequence Number=SeqID_220631
atggtaactgataaagttttaaacaagcacaagtctaaaggtattatcactggaaatattatcactgcaatagtatcatctcgggcagctcaaggcaaaaatagcaaaaatgaggacacaattattggagcctccaaaactactccttttctcaatgtttcgtcaccaacaagttaccctatgaagaaaaagcatgtgaagagaagagctaaacaagtgggaagtccactagcagagcattaa

SEQ ID NO: 103854 - DNA, 411 bp, Glycine max
  Peptide Sequence Number=SeqID_220632
atgctgcccgttactacttcgggaaaatgcaataatttaatgcctgcagtctactacttaacctcctgcaacacaccaaagccaagcttatcttccaaattttgtttaagctcttttgagaaaaaacatcagcttcacgccatcctcaaaatgagcacaacatcgtcaacaacatcaagtagggtatcatctcaggtagctgaaggcaaaaataacaaaggcgagttaaatgagaaaataaattacactggcagtggtgataggagcgttcttcaaccatggtatgactttcttatcgagagcgacttcgatcatggagatgaagtgtcattctattatcagcgccatgaaaaaaattgggaaattgtcattaaaagacagaaggactggggtgatagcgataccgattaa

SEQ ID NO: 103855 - DNA, 1173 bp, Glycine max
  Peptide Sequence Number=SeqID_220633
atgaagtatatgaatttggatgcttatagattttccatttcatggtctagggtactaccgaaaggaaagcttagtgcaggtgtaaaccatgaaggagtaaactactacaacaacctcatcaatgagctcatggctaatggtctgcaaccatatgtgagccttttccattgggacgttccccaagccttagaggatgagtatggtggttttttaagtcctcacattgtggtgaaacattggattactttgaatgaaccgaggagtgtgagcaagaatggctatgcaaatggcaggtttgcacctggtcggtgttctgattggctaaaactgaattgcacaggcagtgattccagaattgagccctatttgactttgcactaccaacttcttgctcatgctgcaacagccaaactgtataagaccaagtatcaggaaattagaaaagagtgtttcaatacttcttatggattgcatttgcatttctggttaggtatatggacccactcacaaaaggtgagtatccaaaaaccatgcgatctatgttgggaaaccggctacgagttctccaaagaagaagctaggcaacttaaaggatcatttgattttctgggcctaaactactactcatccttttatgctgcctatgcacctcaccaaccttatatgaaaacttactgcaatgcttgtgatcgggaagtaacaccgtggtttgctgattttcattcccaaaatgagcaaagcaggtgtcagaagttggaggagattgatattcaacctttgaaggtagttgaaacaaaatctacagtccaagcaccctccaagagaactgaaggagaccactctactccagtagaatatagagatcatagctttgaaatggtcccgttcgcaatttgctggttgaaagactttgttggtgcaattggggaatccactatttccaaatcttctattgacccatttcctattgcaagtgttaagtcaggtgaagacttgcttgatgatttggaaacagaagatagaagagacaaatgttgtgaagcttatagtggtgattcggtttatgagctgaatgaagtggcagctgcaaagggatgtctggggcatttccctaggggagaaatgatgggaattataaagaaattcattaacttagatgcgggaactgattaa

SEQ ID NO: 103856 - DNA, 270 bp, Glycine max
  Peptide Sequence Number=SeqID_220634
atgcaggctctccctcttgaggctgagtgggtacaacacgtcgttttggtgaagccatctgcaaaaataaaggaaacaagactaagagaaattgagtgtaaagacatagagttgcaggtgacaggggcaaaaggggtagaagggaaggaccatttggtgtctctgaatttggaagaagtgaataagagtgagatgaagcaatggaagtcacttggtaatggagagacgacgatgcaggacgaaatcgagagggagatgaagcgagaatga

SEQ ID NO: 103857 - DNA, 282 bp, Glycine max
  Peptide Sequence Number=SeqID_220635
atggaggaaaaagaggcagagatgaacaggctaaaacataatgccaaaggcacaccctcgccagctttttaccgtggtcgaaaagttggcaatggtttatcaaaagattacaaagctcaaaaaggttttaagtttgaacctctatccttccttggagaccaaggttttgactttttaggatttatgtggaatcatctttcatgggtcatggaagctgtaacaatcatggccattgctttggccaatggaggaaatccagcaggcatgactttagtttcttaa

SEQ ID NO: 103858 - DNA, 2261 bp, Glycine max
  Peptide Sequence Number=SeqID_220636
atggatccatttcctacgatatcgaaaattttctcatatgtagcacaacaagaacgacaactattaggaaataatctcatgacaggtatcaatcttgaaccaaagggaagcttgatcaatgtcgtaaagtccacttgtgatttctgtggacaaactgggcatacggagaacgtgtgctacaaaaagcatggtcttccttccaattatgatgggagaagcaaaggaagcagtatcaaaagtggaaagacatgcactcattgtgggaaaagcggacatactgttgatgtatgctatagaaagcatggattccccccaagatacaagttttccaatacaaggaacactgcaaacagcatagtgacagtagatggcaaagtcacagatgacaaaacgcagcatcacgagtcacaagaagttcatttttcacccgagcaatataaggcattgcttgctttaatccaacaaccatctcatgggaactcagtgtctacttcatctaatgtcaaacaagttgcttccatttcttcatgttctactgattcagcatcaatcatgggtaaacccttgccttccgctaaccttgcacacaatttttggtgtttcgctttacttcatgctgcatacttaataaactgcattcctactccctttttgcgaaacatatcgccttatgaaaagcttcatggtgacccatgcgatatttctaatttacgtgtttttggatgcttgtgttacatcagcacactcaaagcccatagacaaaaacttgaccctcgagctcacccatgcatctttctcggtttcaaacctcataccaaaggctatgtagtttatgatatgcattcccacaatattaccgcaccatgccattgcccttcacacatgatctcaccattttttagcctttcccttcacttgcttcttcctcacccgtacccactaaccacattgacattccccaacccttgccctcacgacgctcgtccagagataaacaccttcctacctatcttcacgattatcatcgttttctcacttcaacgactgctactgcctcgaccaacgttcggtatcctctctactcagttctatcttattcttgtctttcttcttcttatcgtcattccattatgtccatttctgtttttaccgaactcacttcttatgctgaagcttctcgtcatgattgtatacaagattaagtacaaagttgatggctctatcgaacggtataaagcacgccttgttgccaagggctatacgcaaatggagggattggattttttggataccttctcacgagtggcaaaacttactactgttcacttcctgttagctcttgcagccctcaatggatggcatcttcaacaactagacgtcaacaatgtctttctgcacggtgagctccataaggagcaagcaagcagacaatggttcacccccctttcttctttccttatttctcatggttttcaacaagccgccgctgatcattccctcttcttaagcttcactggtaattcgactactgttctccttgtttatgttgacgatattgtcttaacaagaaacaacattgatgttattcgtcatatcacgactcttctcgatcacactttcaaaataaaggatcttggtattttaaaatacttccttggtcttgaagttgctctgtcccagcatggcattcatttgtgtcaacaaaaatacactctggatattctctccgattctggtatgcttggttcccgccccaacacaactcctatggactatgttactcgtttgcatgccacattagaagatacgttatctactgaagcttcatcttcctatcgtcgtttggttggccgcctcatttacctcacgaacacacgtcctgacatagcccatgctggtactcttggctcaggtattttcttctccgccaaaggttctctccagctcaaagctttcaacgactccaattgggcaagttgtcgtgattctcaccgttccatcactgaaacaatctacggtgtctcgcagttcctccgaagccgagtatcgagctttagcctcaacaacttgcgagatgcagtggctcacgtttttcacgagcacactaaacatattgacttagattgccatattgttcgcgagaaagtgcaacgtggtctcattaagcttctccctgtctcgtcttccatgcaacttgttgatattttcactaaagctttacctccatctatgtttaagaatttgtgtttcaagctgagaat

SEQ ID NO: 103859 - DNA, 120 bp, Glycine max
  Peptide Sequence Number=SeqID_220637
atggctgcaggatgtcagattgttaccggaagatattggagagctaaggccgaccattttggttgcgttcccgtgtgcttgatagagtgtacaatggaaggacacaaaactactctttaa

SEQ ID NO: 103860 - DNA, 258 bp, Glycine max
  Peptide Sequence Number=SeqID_220638
atgaaagatttggcacatttactcactccacaccaaaaacctattgaggcaccatgcattatcattgtttcctcaatgaccctatcaaagatatgtgcaagaggaaggtatgataggtatacatctttttcattcaactgcaagcaggaaaaaggaggaaaatttgtacaggaagcagagaagacaaaaacaggaaacgtttctcaaagtaagcatgccctaaatgtgcatatagttattgcagatgttgcaaagtaa

SEQ ID NO: 103861 - DNA, 207 bp, Glycine max
  Peptide Sequence Number=SeqID_220639
atgatccatgagaaatttgcgaccaccaaatccgttggaacttatccatgggagatttttgacggaaattccgtcggaaaggatctgtgggaaattttcgagaaaactccgtcgaaaagtgttcttgggaaattttcgactgaaaatataagtctgaaacttccgacggaaattgcaagtcggaaatttcccacggattatttctaa

SEQ ID NO: 103862 - DNA, 680 bp, Glycine max
  Peptide Sequence Number=SeqID_220640
ggttgcacgccctcaccttcagaggactgcacgtcctcaccttcagaggactgcagatcctcaccttcagaggactgcacgtcctcgtctttagagggctgctcgccctcgccttcaaaggactacaagtcctcgccatcagagggctacacgccctcaccatcagaggactacacgtcctcgccttcagaggactgcacgtcctcaccttaagaggactgcacgtcctcgtcttcagagggctgctcgccctcgccttcaaaggactacacgtcctcgccatcagagggctgcacgccctcaccttcaaaggattacacgtcctcgccatcagagggatgcacgctctcactttcagaggactacacgtcctcgccatcagtgggctggacgccctcaccttcagagaactacacggctacacgccctcaccttcagaggactacatgtcctctccttcagagggctacatgccctcgcctttagaggactacgcatcctcgccttcagatgggctatacgccctctccttcagagggctgcaagccctcgccttcaaagggcgacacgtcctcgacttcagagggctgcacaccctcacctttagagggctacgcatcctcactttcagagggctacacatctgcgcctttagagaaattaaggccctctgcccttaa

SEQ ID NO: 103863 - DNA, 702 bp, Glycine max
  Peptide Sequence Number=SeqID_220641
atggtgagaaccccgagctgtgacaaaaatggactgaagaaaggaacatggacagcagaggaagacaagaagttggttgattacattaccagatatggccactggaattggcgactactccccaagttcgcaggtcttgcgagatgtggaaagagttgtagacttaggtggctgaattacctaaggccaaacctaaaaagagggaactacactgaagaagaggaggaaactattatcaagctacaccgacgtctgggtaacagatggtctaccatagctgcacggatgccaggaagaacagacaacgaaataaagaaccattggcacaccaacctcaagaagagatctcaacagcataactcagtagccacagaatctcagatctcaaactcaaatgaccaatctccaactgaaccaactgaagatactgctttccaaaactttaacagtgccactcaagactgttccccactttcccagcattcatcatcatccacaagcacagagtgtaccacagtggccagcaccgaaaatctattgctgctggaagatgaatttgccttttgggatgcagacacagatcttgtgagtggaaatttctggctagaaccgtatatgcttgatatttcctacctccctgctagtgaacccgagtactttagccaagtgtttgatgtagaactttggagccatgatacttaa

SEQ ID NO: 103864 - DNA, 1983 bp, Glycine max
  Peptide Sequence Number=SeqID_220642
atggcttctccacctgcctcctctcctccttctcctcctcttcctcctcctccttctgctccttcggacgtatcggcttcgccgtctgccgtgaagcggacacacaaagcctcacgtctacgatcgttatctactagaccacctggtgttgagagaccagtggtccatgtaaatcctgttatcggtaaggccgacggtccccacaggaagaaattaagaacatatttggggattgtggcacgtgataaggtggacgtcacctacgagaactggaaggaggtccctactgctcagaaggacctgatttggaaggatattcaggatgtgcgcaaaaaggcacaggccatccagaagcagaacactgcctcccacgttctgtctcgtgggggttatgactatttggagcagaagcagaacactgcacagtcaggaaacgttgatggcgtcatcgaccctccatccccggtcagatgccacgtgaagtggaagatggcccgcacgaagaaaataggggagatgacgactgaggccccaaaggaaatcgctgagaagatcgattcctttgaggagcaggcgacacaaggatccttcgtcccccatggacgtcaggatgttctcaccgctgctattggatgtctagagcaccctggacgtgtctgtgctgctggagccggtgtcaccatcaagcaatactttggatcggctccacgaacgtcccgcagctcttcctccctgcctcctgaagaattgcagcagctgacccagcaaatcagggaccagttagaggagtccatcacagaaaaagtggcgcggcagctcatggcatccttcagccagatgcagtcccagattcagtcgcagatgcaatctcagggacttgcactgcctcccgagcctttggttggtccctccggtcctcgagtaagcacaaaggggagttgcgttgatccctcaggaaacgatcctgagacgggtgactcagataggttcggcttgtacatcaaagcagatcctgcccgcttggttgccctggggagagtttatgagggatccactattgttcataacactcctttgttgcctggccaagtaatggtgagtgtggaggaggttacagatgcagatgctccaatttctgtacccactgatgagttttccttaatggggcacacacttcacaccttccttgcttggccgacacatctggtcaagtctttatcacaacatgtagctgtgtctccggcaaaaccacctccaaagcccgatccggaggttgatgatccgctttatctgatgacattgaccatcccagagcttttcttgaggccttatcaggttacatgggatgctaccgtgttcggggtctttaatccaaatttcccgctctacataaagcacgaagacctctccaaaatcgcacacggtggtcaatgtctcaacatattagtgcatctcactgatacaagtatgccagcggggaattctgatatctatggattactcaagccacagtccattcagaggtctgggcaatcgcagtttgagtctaaaagttacataaagacttggatgcagagttcaaaatgcgatgcctatcttggagcctacctaaatagcgaacactggcagatggtggtcatcctgcccagggaacacctagttgtctggttttgttcattgcataacaggccagacaactaccttaaggggattattaacagtgctttaaaaggtcttgatgatgctccacagcctaaatcaaaggctcatgctaggtggattgtcgtcaagtgtaatagacaaaaagaaagtactgagtgcgactactatgtcatgcactggatgtccaccatcattttaggaacttttaggaataactgggaagcgtattttaacgatgctagaccattggagccagagagattaaaggcgttgcagatccaatgggcacagtattatctccgagttagagatcagacctag

SEQ ID NO: 103865 - DNA, 192 bp, Glycine max
  Peptide Sequence Number=SeqID_220643
atgcacgaaacacaatgtggaccactacgggcacatagaatgaatcgaaaagcttggttcgaggggaggtggttgccgcccagctcgcccaggcgagcagggttgcttcctccagaagcaaccgccttctggaggaatattccggagggcccaagtgggcctgggtgctatttgcacccccatttttactaa

SEQ ID NO: 103866 - DNA, 366 bp, Glycine max
  Peptide Sequence Number=SeqID_220644
atggagataagtgaattggaaccgccaagaaatgtaagcaatttagatgatgatgaagatgaagatgatgatgattatcttgtgtctaattcatacattgaagaatctttaggtgaagatgatagtgttgatggtatatctgatacagatgatgaagtcactcacatggttgaaccagttacaatttttcaaccaagagaaggtgtagaaggaattcaaaattcattttggaatgatgttttgcattataacaatatcaattggagtcatcctgatgaggaggacatttgcggtttggagatgccatcgagttttaatgttggacaagaattatatgttggtatggattttgatagtaaagatgcg

SEQ ID NO: 103867 - DNA, 402 bp, Glycine max
  Peptide Sequence Number=SeqID_220645
atggctactccacctgcctcgcctcctcctcctcttcctcctcctcctgcagatgcatcagcgtcttcgtctatgttgaagcagacacacaaggcgacatggctacgatcgttggtcactagaccacctggggcagaaagacctgtggtcaacattgatcttgctaccggcaaggccaacggtccccacaagaagaaattaagaacatatttagggattgtcactcgtgataaggtcgacgtgacatacgagaccttgaaggaagtccctgctgctcagaaggatttgatatgggaggatattcagcggaatttgaaatccctgaagcttctgacagtaggacaaagaagaaaactcttcagactgtcggcgagcggtggaggcagcttaaatctgacttga

SEQ ID NO: 103868 - DNA, 588 bp, Glycine max
  Peptide Sequence Number=SeqID_220646
atggcatttttaggagaaactagcagtcagacgattgtcaactcaagctatccgacaaacaatttttggatgaaattcactaccggaagccattcaccgatacagttattatgcaccgttggaagaacaccagatggaataataaacttacttgaacgcattatgcctcgtactcatgacgcgatcctgtattacaacgggaaatggaacatgccaccgcagaacaaatttgttggatgcgcgttcacaggaaaaaatcctaagaaatttcaaattccttcaacatgtaccatcgatgaactcaagaatttaatcaagcaagttgcacctaaagggattccccctcttggaattcacgaatcacaaacggtaagacgattgtttttccgccaaccagctcgatttgcgtattcagatacggttataaaatatgaaataaatgagctgatcaccaacgaagaactgctgaaggtgttagtacaatctaactactggaaaaaatatggaccaatagaaattttagctgtctttactaaatatgttgtgaaaatcgaagacgaggtcactgggacgtcgctaaacaactga

SEQ ID NO: 103869 - DNA, 813 bp, Glycine max
  Peptide Sequence Number=SeqID_220647
atgtatgcacgccctagcctttacagggctacacgtcctcaccttcagaggactacaccttctcgccttcagaggactacacgtcctcaccttcatagaactacacctcctcgccttttaagggctgcacgcccttcgccttcagagggcaacatgccctcacctttagaggactacacgtccacccattctgaggactacagaggacaacatgccctcgccttcagaggactacacatcctcccctttagagggctgcatgccctcgcctttagaagactgcacgccctcgcctttacagggcttcacgtgctcatcttcagaggactacacatcctcgccttcagagggctgcacaccctcgctttaaaagggctacacgccctcgccatgagaggattacacgtccttgcctttagagaactacatgtcctcaccttcagaggactaaacgtcctcgccttcagaggattacacgactacacctcctcgccttttgagggctgcacgcccgtcgccttcagagagctacttgccctcacctttagaggactacacgtcttcccattcagaggactacaggtcctcgccttccaaggactacacgtcctcatcttcagagtactaaacgtcctcgccttcagaggattacacgtcctcgcctttagagggcaacacgccctcaccttcaaagggttgcacgacctcaccttcaaacggctacaagcactcgccatgagaggactacaggtcctcgccttcagaggactacacgtcctcaccttcagaggactacacatcctcgccttttga

SEQ ID NO: 103870 - DNA, 314 bp, Glycine max
  Peptide Sequence Number=SeqID_220648
gtgaaggagatatcctcaccacttgtgtttttgcagtctttcatcttgctcttctctttgttgtaaaggaggtttccggactatggaaagctaaatcctctgttggatcttcccttggaaactggtttgattctaaagtccttgatagtacgggactaagttgttgtgctatcacgaggaatcgggtcttggttgagtttagtcttacaagaggaatctgcggacgaggcttgatcaggactaggttaggctatcatgaggaatcggggtctagcagtccaggagacaacataggaactcataatcattgttag

SEQ ID NO: 103871 - DNA, 575 bp, Glycine max
  Peptide Sequence Number=SeqID_220649
gattctttggaggagcaggcgtcacagggttcatttgtcccctatggacgtcaggatctcttgactgctgccattaggcgaccagaacaccctggccgtgtgcgtgctgctagagccagtatgcagtcccagttgcaatcacagatccaatcacagggacttgcactgacttcggagcctgaggttggtccctcagcagctcgtgtcagcacaaaggggagttgtgttgatccctcagcgaccaatccaaacacaggtgactcagacaaatgtgggttgtacatcgaagaaaatccttcccacctggttgccctaggaagagtttatgagggatctatagcagttcacaacatccctttgttgcatggccaaatgaaggttggtgttgaggaggttaaagatgcaaaggctcccgttcctatacccactgatgaggctattttagttatgtgggatgctaccgtgttcggggtgtttaatcaagacttcccgttgtacataaagcacgaagatctgtctgaaattgcacactgtagtcaatgtctcagcatatctgttatacagttatggattct

SEQ ID NO: 103872 - DNA, 903 bp, Glycine max
  Peptide Sequence Number=SeqID_220650
gcgaagcagcaggcagagcagcagaaggcggctgaagcagcagcgaagcaggcgcaggagcagcagaaagccgcagaagcggccgcagcgaaagccaaagccgatgccaaagcgcaggccgatgctcaggcgaaggccgcagcggacgcgaaagccaaagcggaagagcaggcgaagcaggccgcagccgacgcgaagaagaaagcggaagagcaggcaaaagccgccgcagccgaagcggcgaaagagaaagccgcgcagcaggcgaaagccgcagctgaagcgaaagccaaagcggaggcagaagccaaagctcaggccgcggcagatgcgaaagccaaagctgcacaggaagccaaagagaaagctgcggaagccgcgaaagagaaagcggccgccgaagccaaagcgaaagctgaggcagcagccaaagccaaagcggatgcggcggccaaagctaaagctgccgccgatgcgaagaagaaagcggctgccgaagcggcgaagaacgagagcgatgtggatgatctgttaggcggtctctcttccggtaagaatgcgccgaaaagcggtgcggcgtccggtggtggtgcggcggcaggtcagggcaatcagaagaaggccggtgcctcaggtgctgaggtgaacgcgtatctgggtcagatcaccagtgcgattcagagccgcttctacgatgccgatctgtatcgcggtaaaagctgcgatctgcggattaaactggcaccggatggtttgctgattgacgtgaaagctgaaggcggcgatccggcgctgtgtcaggcggcgattaccgcagcgaagcatgcacgcattccgaagccgtcttctcaggcggtatatgaagtgtttaagaacgcaccgatgcgtttcaaaccagaataa

SEQ ID NO: 103873 - DNA, 348 bp, Glycine max
  Peptide Sequence Number=SeqID_220651
atggctgcaagtgacattgctattctcagagatagagcccacataccaacaaagaaaagccttctggaacttacatcacaagatgcattgttggcacagaacaagttgttgtccaagcaattggaagcattgaccaaaacactaaggtgtgccatttgtggtggagctcacaattctggctgttgtatccctaatgaagaaccaactcatgaagtcaattatatggggaaccaaccaagggatagtggtggaatcaccctggaaaccagatcaacaaagaccaaggtggtccatctacaaggccacaacagcaagagcctagtctctatgatcgaacaacgaagctag

SEQ ID NO: 103874 - DNA, 576 bp, Glycine max
  Peptide Sequence Number=SeqID_220652
atgaattgcgttttcgttcatgtgtcctccaccttcgagtttggagctttgcgtagtgattgcttagtgaaattctccattctcaacctttttcggagccccatgaattgcgttttcgttcatgtgtcctccaccttcgagtttggagctatgcgtagtgattgcttagtgcaattctccattctcaacctttttcggagccccatgaattgcgttttcgttcatgtgtcctccaccttcgagtttggagctttgcgtagtgattgcttagtgcaattctccattctcaacctttttcggagccccatgaattgcgttttcgttcatgtgtcctccaccttcgagttcggagctatgcgtagtgattgcttagtgaaattctccattctcaacctttttcggagccccatgaattgcgttttcgttcatgtgtcctccaccttcgagtttggagctatgcgtagtgattgcttagtgcaattatccattctcaacctttttcggagccccatgaattgcgttttagttcatgtgtcccccacctccaatttggaacctatgcgaagagatggctaa

SEQ ID NO: 103875 - DNA, 603 bp, Glycine max
  Peptide Sequence Number=SeqID_220653
ggacacgctttacgacgcccttaccgaactcgtgctagagctagagtaatggatgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttaggaagtacgggcggcccccatgatgtgcaaattcaaaacgagcacgccttcccgtcatatggcttgcctctcaactatacgccacccaatgtggcgtacactcccaataagaatgtcaataactccactcctatacccattgaaagccagcaaccccaaactgatcatgcacatggcaagcagttggtggtataccctacaaaaccctttggagggcctcagtatcacccacaactgcacctcttgcattccacagcggttaaaaacccttatgactatggcaggaatgggaaagttggatcatctagaggaaaggctcagggccattga

SEQ ID NO: 103876 - DNA, 410 bp, Glycine max
  Peptide Sequence Number=SeqID_220654
ggtcggcggtgctgggttatggccccgtgctaagtttcggattggttggccccctcctcccccccgtgatcagttttgttgccaggattttgccaactttggcttgcgccccggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacg

SEQ ID NO: 103877 - DNA, 1052 bp, Glycine max
  Peptide Sequence Number=SeqID_220655
atgccgatcaggccctcgatggccccatcgaccaccagcgggcgcttgcaggtgcagctccatcaggttctcgatcacctcgccggacagcacgcgggcgtcctggtcgacgtagtccgcactgagcccggtcgggtagatctcggccgcggtacgcccgatcacgtccttgcgcgcgcgcaggcccagccgccgcagcatggtctggttgacgtgggtgtaacgcccctgaaggtccttgatgaaaaacagcacatccgggatggcgtcgaacagggcttcgatgtcggcgggctcgactcgcatggagcaagcatacccgagcctgcttttgcctgtacgttcacctctgccggacctcggtttaacggggctggttccagtgtcgtggttccttctgatgatccggagccaacgtcaatggccgccagcaagccgaccggcaagcgcgcaaccgcccctgccgaaaaccaccgccggggcgatggcgatgaactgcaccagcaggccgggggcacccatccggtgatgaccaccgatcagggcatcccggtggcggacaaccagaactccctgcggcaggggccccgagggcccacgctgctggaggacttcatcctgcgcgagaagatcacccacttcgatcacgaacgcattcccgagcgcatcgtgcacgcacgtggcagcgcagcacacggctacttcgagctgacccggtcactggccgcccatacccgcgcgcgcatcctgaccgaggtaggcgtcaagacgcccgtgttcacccgtttctcgacggtagccggcggcgcgggctcggtggataccccccgcgacgtgcgcggcttcgcggtcaagttctataccaaggagggcaactgggatctggttggcaacaacattccggtgttcttcatccaggacgccatgaaattcccggacctggtgcacgcagtgaagatggaaccggaccgtgcgtttccgcaggccgccaaggcccacgacaccttctgggatttcatctcgctcatgcccgagtcgatgcacatgatcat

SEQ ID NO: 103878 - DNA, 1184 bp, Glycine max
  Peptide Sequence Number=SeqID_220656
atgaagcgccgcctccgcatcgccgggctcctcgccctcccgatgacctggctcatcgggatctacatcttctccctggtcatgctcctggtgaccgccttctggatcaccgaccccttcacctcgaaggtgaagcccgggttcacgctgcgcaacttcgagcagctcttcgtgaaccccgcctacctctccacctcgctgcgcacgctgggcatcgccctcgcggtcaccgtgctcgccatcctggtctccatcccgctcggcatcttcatggccaagatcgcctcaccgtggctgcgcgccctgctcgcggtctcgatcaccctcccgctgtgggccgggtaccctggtgaaggtgctcgcgatgcgcatcactttcaccgagcagggcttcgcgaattggctgctggcgcccttcggcatcacgggaccgggtttcacggtcgtgaccgtcgtgctcaccctgacctatctgtggctgccgtacatggcagtgccggtgtacaccgccatccgacaactgccgccgaatctgttcgacgcatcggccgacctcggcgccggcgcctggcgcaccatcgtcacggtcgtgctcccgctgatcaagcccgcgatcatcgccggctccgtgttcacgttctcgctgagcctcggcgactacctcgtcgcccggttcgtcggcggcgacacccagatgatcggcagcgtgatcgcctcgaacatcaacctgaaccccccgctggctgctgcctactcgctggtgccgatcgcgttcgtcgtcgtctacctggatgtgagtcgcgcatgctgagactgtcccgcacctccaagatcgtgctcggcgtcgtcgtcgccgtcgtcctcgccttcatgtacatcccgctcgcgctggtcgtgctgaactccttcaactccgctcgcatcgtgagctggccggtcgccgggttctccctcgaatggtggggcaaggcgttcaccagcgagcccgtgcggcaggcgctgctcaattcggtgctcgtggcgtcgggggcgacggtgatcgcggtgatcctcggcactctcgtggcgttcgcgttgcagcgctactcgttcttcggtcagcgggccgtgaacctcttggtcgtgctgccgatcgcgctgccgggcatcgtcacgggcgtcgcgctgaacaacacctacaacca

SEQ ID NO: 103879 - DNA, 975 bp, Glycine max
  Peptide Sequence Number=SeqID_220657
ggacaaattccacaaataatatcaagccttcagaacataaaaaatctagacctgcagaacaaccagctcagtgggccacttccagattcattaggccagcttaagcatcttgaagttctaaatctcagtaataatacctttacttgtccaattccctcaccatttgcaaacttgtcatccttgagaactttaaacctggctcacaaccgactgaatggaaccattcctaagagttttgagctcctcagaaacctgcaggaactacgtttgtcttggacaaacttgttcctcagtgtcaactctggatgggttcctccttttcagcttgaatatgttttactgagctcctttggaataggtcctaagtttccagaatggctaaaaaggcaatgttctgtgaaggttttgacaatgtctaaggcaggtatcgcagacttggttccaagttggttttggaattggactttgcaaattgaattcctggatctgtcaaacaatcagttaagtggagacctatctaacatctttctcaattccagcgtcataaatttgagttctaatttgttcaagggtacattgccaagtgtgcctgcaaatgttgaagtgctgaatgttgccaataactcaatttccggaacaatttcttcctttttatgtggaaaggaaaatgctactaataagttaagtgtgcttgatttttcaaataatgtcttatatggtgatcttggtcactgttgggtgcattggcaagcattggtgcatttgaacttgggtggtaacaatttgtctggtgttattccaaactccatggggtatctatctcaacttgagtctttgtcgttagacgacaaccgcttctctggatatattccttcaacactgcaaaattgctctacaatgaaattcattgacatgggcaataaccaactttctgacgcaataccagattggatgtgggaaatgcaatatctaatg

SEQ ID NO: 103880 - DNA, 213 bp, Glycine max
  Peptide Sequence Number=SeqID_220658
gggcaggatcaccttgggctaccttctggagtagagacaaaacatgaacggcagaaaccaatcaaggtacttaaggacgaacgcaagtggggatggggtcacgaccgaccgatcgttgcccttctctgtgcgaaacaagcaaagaatgtcgctgcaaagcagccccgtatcctttgtattttgcagctttcttttactatttgtttgttttaa

SEQ ID NO: 103881 - DNA, 441 bp, Glycine max
  Peptide Sequence Number=SeqID_220659
atgcaagcaacagatcaagaagaaactgcaacttttgcacagtggattatagatattggtgatggtattattggagatgaaaatgatggctatgctactattgaaattccacaagaactattaatcacagaatataatgatcctattcatagtataattagctctacatttccatatctatctcatcatcacaatgatcctgaatacttccaaaccagagcaatattagcttctacaaatgaaacagtacaacaagttaatgattatatgcttacaatgataccaggtgaacaaatggaatatctaagctctgattcagttgacaaatccgaaaccattgaaagttgtcatttccgctcactgacaactgaatttctgaattcattgacaacatctggcttacccaatcactgctcaaactcaagattggaacaccaataa

SEQ ID NO: 103882 - DNA, 192 bp, Glycine max
  Peptide Sequence Number=SeqID_220660
atggacctagcactttgcttacctttggctttggacttggttgcctattgcgcgcttattgcccgctgccggccatccccaagctgctgtggtgtttcgccctgcgcctgcctgggggtgcaatacttcttgatgaaagcccggttaataggggggctgatgaacttgctgggggcgacaggcactccgtag

SEQ ID NO: 103883 - DNA, 315 bp, Glycine max
  Peptide Sequence Number=SeqID_220661
tcagttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggacgtggtgtttccagtggcggaccgg

SEQ ID NO: 103884 - DNA, 477 bp, Glycine max
  Peptide Sequence Number=SeqID_220662
atgggaacaaatcaaaccgacaagaggttctaccaagtcaaggtcaaaagcctagataccaccagcatcaaggaattagggcggttgatggaacccctccaaatgcaagccttccgcaagacttacggaaagatcttagagttgaccatagcagaggtgtccataaaagccattgcatcacttacccaatactacgaccagcctttgaggtgcttcacattcgcagacttccaattagtaccaaccattgaagaatttgaggaaattctaggatgtcctctcgggggaagaaaaccatatctttcctccgggtgtctcccctctttgagcagaattgcaactgtggtcaaagattcagcaagaggtttggaccgcataaaacagactcggaatggcatagcgggcctaccacagaagaagacaaagcgaggggtatggccaatcaaggagaatgggtcccatttatggatgtgttag

SEQ ID NO: 103885 - DNA, 378 bp, Glycine max
  Peptide Sequence Number=SeqID_220663
atggccaccgccaaagccttggagcgagaaaccaagagggcccggaaggaagaacacgaccgaaacaagtttcaaggagtcgtatggggtaggaacagtgagcttaaactccaaagagacgaaagggatcaatcacgagtcgaatgcatgatcttgaaggatgagttaaaggcttatcttaggtccaagaggagtttgtcccaacagttaagtgagacagaaggaaacatgttggccatcgttgataagtacaaagaagagctaaacctagcggtagctcatgagcataggctagtggatgagtacgccaaggtatctgtggtaaaggaagcaaggggaagggtgaccaattcattgcacggagaggtaatgatgtag

SEQ ID NO: 103886 - DNA, 435 bp, Glycine max
  Peptide Sequence Number=SeqID_220664
atggccgacttcgccgtgattaaatggtggatgagcctacgctcgagacctatcacgtgcgagccggtcagttctggacccatcgacgaccctttgcgtgctacgcacgctcccaacgagacctcagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaacggatgggggccggcgatgtgtcccggtcggatgtggaacggtgagagccggtccgccgatcgactcgggacattgaccgacgcggattgcgatggtggcccaagcccgggctgttga

SEQ ID NO: 103887 - DNA, 150 bp, Glycine max
  Peptide Sequence Number=SeqID_220665
atggacctagtacttttgcttacctttggctttggacttggtcgcctactggtcgaccacgggaggcttgatgaccttgctgggggcgacgagcactccgtagaactgccagaggcccgtgatgtgccatcattttcttctattttctaa

SEQ ID NO: 103888 - DNA, 189 bp, Glycine max
  Peptide Sequence Number=SeqID_220666
catctcgagcggttccctaagattcctccagtttctcctccgactgctccgatagagttcccaaacttaagacatgatatcaaaattcccaacggtgagaattctcagaattgtgttgcgaacgtggttctcaaatttcacaacgatccaacggtgaatgagtccgagatcgttgtttttctgagacag

SEQ ID NO: 103889 - DNA, 318 bp, Glycine max
  Peptide Sequence Number=SeqID_220667
atgatggcacatcaatgttcaactaggaggaccatgatcatgaaagcagatggagaaatcactagtgaatctgaaaaaaatgagaaagaagaagaagtggaagaagagcttgaggaggaagctatgcagggtgatatgctaatggtgaaaaggctattgggaagtcagatgcaaccactggacaacacccaaagagaaaatattttccacaccaggttagtgtccaaactaaatatggaaactaaaccccatcctaggccatatagacttcagtggcttagtgaagatgaagaggtaaaagtgactgaacaggttgag

SEQ ID NO: 103890 - DNA, 860 bp, Glycine max
  Peptide Sequence Number=SeqID_220668
acccaccgccgttcggcgggcggcctgtgcttccttcccccttgttcatcgcatggctcgcgcggccgcctgtcgcgcggacgtcgtgcgcgcctgtctggagagagccttatgccgttcacccgccgccacgccctgggcgcgcttgccgcgctgccgttgatgcctcgcctggcgcatgcccaggcccaggccaatttccccacccgtcccgtgcgcctgctggtcggcttcgcgcccggcggcctgaccgacatcgccgcgcgcgcgctggccgaacgcatgggcaaggtcctgaagggcagcgtggtggtcgagaaccggccgggcggccaggccatcatcgccacggtggcggtggcgcgggccgaacccgacggctacacgctgggctttgccggcaccaacggcatgatcctgaaccccttgctctacaacaacctgccgtaccagcagtcggacttcaagcagctgggttcgatgggcaagtcgccgatgctgctgatcgtgcatccggcgctgggcgtcaagaacgtgcaggaattcatcgcgctggccaagaagaagccgggcgacatcacttgcgcccatgccgggcgcggcgtcatcaaccacctggcgctgctgcatttccagtccaagaccggcacccagttccaggacgtgccctacaagggcagcggcccggcgctgctggacctgatggcgggcacggtgcagagcaccttcgatttcccgacgtcggcgctgcccaacatccagtcgggcaagctgcaggtgctggcggtgacggccgaccagcgcctgtcgagcctgccggacgtgccgagcatgaaggaggccggcgtcgacggctttga

SEQ ID NO: 103891 - DNA, 255 bp, Glycine max
  Peptide Sequence Number=SeqID_220669
atgtttcccttttcaaggttgaggatttggaggccggagaatttgttggcaacggtgaccacgtgtgcaggcgagtgtggcgggaatcccatcaaaggagggaatcttgtttccgtgcatgacgtggatgacactatatatgtacaaaaaagtttcaattggcaaaggttggagagcgaaatgatgaggacgaatttgatgttggaaggagaggaagttgatgagggggataatgttgaaagttttggtccttaa

SEQ ID NO: 103892 - DNA, 1458 bp, Glycine max
  Peptide Sequence Number=SeqID_220670
atgggtgagaacgataacaaaaccaaaaaaaacctcctctccctcctaacagagccaatccaatggatccaaagtctctcctcacagctcaacccaaccttcgtaatcggcgtattcataatctacggcataggccaaggcttctccggctcgctcttcaaggtagtctcagactactactggaaagacgtgcagaaaattcaaccctccaccgttcaactctacgtcggcttttacttcatcccgtgggttctcaaacctctctggggaatcctcaccgacgccttccccgtccgcggctaccgccgccgaccgtattttattatctccggcgtgattggcgccatctccgccgcggttgtcgcattcgccgggaacctcgccgccgttgccgcgctgatgtgcttcctaggcgtgtcggcgtcgcttgccatcgctgatgttacgattgacgcgtgcattgcgaggaacagcatcgagatgaggaagctcgcgccggacctgcagagcctctgtgggttctgctccggcgccggcgcgctcgtcggatacctcgccagcgggttcttcgtgcaccgtcttggaactcaggagtcgttgggtcttatggcgctttctccggctttgacaattgtgctgggttttgtgatttatgagaacagaacaagtgcgtcgcatattgaaaagcaggctgtggagagtgtaggaatgaagattagaagcatgtaccaaacaatgttgtatcctcatgtgtggaagccttctctttacatgttccttgccctgactctgaatgtaaccactcacgaaggacatttttactggtatacagatccaaaagccggccctgcattctctcaggagtttgtaggggtgatctatgcaattggtgcagtggcttcattaataggggttctaatctaccacaaggctctaaaagactaccaatttagagacctagtattctatgcacaactcctatatggcatatctggtgtgttggacctgatcttcatcctccgttggaatttggtcattggaatccctgactatttctttgttgtccttgaagaaagtgctacaagaatcacaagcaaaatcaggtggatgcccatgatggtactcagcacccagttgtgccctttaggcattgagggaaccttttttgctctgttaatgtgcattgatagcattggtgcccttttctccaaatggggtggagggatgcttcttcgtgtcctccacatcactagaactgactttacaaacctttggctggctgttcttataagggacatgcttaggtttgctacacttgctttggtttttcttgtccctaagacagatcaatatgaggaactgcttccttctgaggtttcaggaaagaacacgagtgaaaaggtacatgaagaagagactttggagcttgtccccatccatggcaagactgaagtttag

SEQ ID NO: 103893 - DNA, 426 bp, Glycine max
  Peptide Sequence Number=SeqID_220671
atgtcgaaattagcaggagcaagcgagtttcgctattccactctgctgtgtgcgtgtggtcggtcactgcaaacgcaaaaaccagaacattctcttcagcttaacccttctttttcgatggctaatcggcacacgattattcttatgcagacctcgcagaacagagcaactaggacgttcatggattatgaatccataactcaggccatggatggcatatgtgcactgtatgaaaggaaactgaaggagttgaacccgaccataagaaatctctcgtatgacattactgatctctacaacttcatagatggtcttgcagacatgagtgccctagtgtatgatagttcaattcacgcttacatgccgcacgatcgacagtggattaagcaacgaactttccaacatctgaagaaattagcacactga

SEQ ID NO: 103894 - DNA, 132 bp, Glycine max
  Peptide Sequence Number=SeqID_220672
atggtgaagtcacacatgaatttggtgtggagggggcttgtgcaaggtggagggagagtggatctggtggaaggaggtgacaacatgacaaggagggaagaaaaagtgagtggtgatggttgcacgtggtga

SEQ ID NO: 103895 - DNA, 503 bp, Glycine max
  Peptide Sequence Number=SeqID_220673
tcttgcagcaattcttcgggcataacaccaatgagaggccaactagatctaacttctctcaggttacgaccatcgtggtctacgaggatgtgggagatttcagcgacaatgaggatctcatgccatctgagatcactttctaccgagatgtctgcggtgaagagatatttgagggaaaaatggtttcgtctgacgagaagactaaggagtatatgcttgtgtataggagagttgacaacttggaggttgtgaggaatcttatgacaggacttcgcattgtggactttattgctagcccactgaaaattttttgtgataactatgttgctccattttatacaaagtgtaataagacttctagaggatctaagcacttggagttgaagtatctgactgttagagatcttgtgaaagatggttcgatagtggtagatcatgtggacacaaattcaatgttggttgatcccttgaccaagggattaaggcttgttgttttcaaatga

SEQ ID NO: 103896 - DNA, 318 bp, Glycine max
  Peptide Sequence Number=SeqID_220674
atgttggaatacactgtttcaaaggcacggaagaagttcttccacacgtcttcacggaagaaccttcttccgcagttgatattaacaactgcagaagaacattcttccgtgcattcctgcggaagacttcttccgcaggaatgcacagaagaaggttcttccgttgaagtgttttttggtcaattgaattatgtagttataatcttgaaattagtcagtacaagtgtaggaagaaagaatttgttagaagagacacaggcattaggaaatatggttgtcccttcaagcttcgtgggaaaccagtgcatggaggagaag

SEQ ID NO: 103897 - DNA, 765 bp, Glycine max
  Peptide Sequence Number=SeqID_220675
atggatggagttattggggaatgtgtcaagttgagggatttctctgcccaaagaggaacattttttaactttgtgtatgcttatggattaacctatttgaggtgcaataggttgagtttgattgctatcactatctttgaacatcttctaagtggtctatcagagaaagcgataattaaggaattctttgatgctctaggaaagaggtaccaagtgtcagataacgctgagtttggatatctaatggagcggttattgaacatgagatatgataatgtagggggtgtaaaggaattcattatgaagatggggcataagaaatttgattgtggaaagttcaaggcttggctagagaacaagcagaaatcaagaggtaataacttagcttttgtctatcttgagtctaatctagttgatgttcctatagattcttggtggcttgatagtggttccataacccatattgttgtgtcttttcaggggttcaaaaatttgagggagccaagtctgagggaaaacaagttaaggcttgatgtggtagaccctattgttccatctgatgatattgatgtcaattcgcttgagactatttctttgccattacctattccaatttttagtgtttcgattgttgtttcgattgagactggggtcccgatttttccagttgagaccataattgcaattggagatatagttgactcccaagccaatgatatgcttgatcttcctactgcgaatgagagtgcacaaccagttgagtag

SEQ ID NO: 103898 - DNA, 387 bp, Glycine max
  Peptide Sequence Number=SeqID_220676
atgtggaagaaaaggaatggaacaatctggaaaggatccaagaaaccacatagagaaagaaaggataaggagaaaagttccatcatatgctttgagtgcaagaaaccagggcatttcaagttagaatgtctagatcttgataaatcagcttacaagaaaaagtacttcaaatcaaaggacaagaaagtgttaatgaaaacatgggaagaactggacgacacattgttcgatgtagaaatagaagaggaagaagaaaccaacctttgtttgacaacaaacactgcatcaaaaggatcagattcaaaatcagatgaagaggttggacacatgacatccaagtgtagacatctaccaaagattagatcgtccaatgcttttgagaactaa

SEQ ID NO: 103899 - DNA, 836 bp, Glycine max
  Peptide Sequence Number=SeqID_220677
atgaggctagatcaatacagagtgataaaaactaaatgcacaggtgatgcagcaattctcaaggaaattattgagcatgacagagtctacaacttccttgttggtatgaattccgagtttgatcaaatcaaaattcaaattttggaaaaacaaattacatgtgtcaatgacatgccagttattacacaaagtgaagatggcaggaattttcctatatcattggctaagtcaaaaggagaccatgaagctcaagttcttccgcaagaaggatttccttcatgtggaagaaccttcttccgtagaaacatatggaagaaccttcttccgcgactatgtgcggaagaaggttcttccgcacgttcacatgaccttcgtcttcttccttgcgcaacaagcaaaacacaaaggtcatctaacctaaagccagcatacacgattaaaagagaaaggaggattattattcagaacggaaccattgttctcaactcagacatcggcaatggagttggacgagccacctatggccaacctctgtgcttcaaaaactcttctaacggacatgtcacagatttttctactcgcttttcgttcaccattgatgtgtccaacaaaacctttttcggtgatggctttgccttctacgtggcacctcatccctaccagattccactcaattcaggtggcggccgcctcggcttatacgatgataacgcaccggcaccacacagtaacatcgttgctgtcgaatttgacacttatgtaaaccgttatgttgatccaaatatgaggcacgtggggatcaacaacaactctgcgatgtctcttgcttatgacag

SEQ ID NO: 103900 - DNA, 804 bp, Glycine max
  Peptide Sequence Number=SeqID_220678
atgttggctacctctgcatgtttccactacttagaaacttttcttcttttgtgcacccttatgatccttcccattgttaaaccacaaccaccactttccttcaacataaccaatttcaacgacagtactggaatcgccagcctcattggatgtgtaggcgtagccaggattggcaacggaactatagtactcaccaactcactcaacaacaacaacgacaacaacagtagttttgattttggacgagccatctatggccaacctatgcgcctcaaaaacacttctaacggacatgtcgtcgtaacggatttttctactcgcttttcattctcttcattctccatcgatgggtccactgaatccgatttcggtgaaggcttcgccttctacatggcacccattgcctaccatattccgctcggttcaggtggtagtcgtcttgggatatacggtgacaaagtacacgaccctactaacattgttgctgtcgaatttgacacctttcaaaacgttggttttgatccaccactaaaccagcacgtggggataaataacaactctgtggtttccctggcttacgcaaggttggatattgagggcaacatagggaatatggggcatgtcttgataacttacaatgcttctgccaaactccttgctgtctcatggttttttgagggaagaaatagttctagttctgcgcctgaagcttctctttcacaccagattgacctcggggaaattctaccagagtgggtcactgttgggttttcgggtgggaacgggaattccaaagggaaaaat

SEQ ID NO: 103901 - DNA, 573 bp, Glycine max
  Peptide Sequence Number=SeqID_220679
atgtctaacacagggattattgattctattccaacacagatgtgggaagcactttctcaggttttgcattttaacctctctcataatcatatccatggggagcttgtgactacattaaaaaatccaatatctaaccaaattgttgatctaagcacaaatcacttacgtggtaaattgccctatctttcaaatgctgtgtatgggttagacctttcaaccaattcattctctgaatccatgcaagattttttatgtaacaatcaggacaagccaatgcaattacaatttctcaatcttgcatcaaataatctgtcaggagaaatacctgattgttggattaattggccatttctagtggaagtgaatttacaaagcaaccattttgttgggaacttccccccatccatgggttccttggcagacctgcagtctttacaaattcgtaacaacacactctcaggaatatttcctaccagtttgaagaagactggccaattgatatccttggatcttggagaaaataatctttcaggaagtattccaccatgggttggagaaaactctcaaatatga

SEQ ID NO: 103902 - DNA, 3276 bp, Glycine max
  Peptide Sequence Number=SeqID_220680
atgatgatgaaatctaagtttgagtgtggaaaccaagatgctattgttgatgatggagaaattagtttgaataatggtcagctgctactgcaagacattcaagaaataagcaaagctctttatgccccttctagaccttccttctcctcagttcataatcgatccaagtctgcgggaaaaacccatttgtcgaaacctcaagttgccctaacccccggatttctaaaggaagatctgtttcctagggacaagaaattgtcttcagcatggaattggaagaagcctttgaaggttttgacccacattggtggtcaaaagttcaaatgttgctttaaccttcatgtccactctattgagggccttcctttgagttttgatggcattaggttgtgtgtgcattggaaaaggaaaaacaacattctgcagacacgcccagcaagggttttccagggtgttgtggagttcaatgaaactttgagtcatggatgttctgtttatgctagtcgtgctgtgtctggtcactctgtcaagtacgagtctaagcgtttcttgatatatgcctctattgcaggggcacctgaacatgacatagggatccatcaggttgatctcacaaggcttttacctctgactttagcagagttagggggtgatagaagttcggggaaatggagcacaagttttaggttgacaggaaaagctgtaggagcgagcctaaatgttagtttcagctatcaagtaatgaagcatgagttaatggaatttggtggtgataatttgaatgttctcaaccttgttaatctgaagccaggcaggccaagcagcacaagcagtgttttggattttagtcctatcccttttcattctgatgatatgattttatcccgtgaaacattgatgaattccagctcaagtctttccaaatcaatcagtttcctatatcaaaaacttgatgaggggaacatccacaattcagcacaagcagactcggagcattttggaccacttaaatcccatgttgttacagaatcagagtcacctctagaatcaaatcaacatgaacctgatgacaatgaattttccattattgaacaagtagaaacattggaaggggattccttggaacttggtcagataggaaatcaaacagttgatttgtcaacagttgaaatcattgatgtggatgatattattaaggaagatgacatatttattgacaagaacacgagatttgattcaatggataacatatgcactagttgtgtaaatgacactatggcagatgacagcaaacataaacgcagtagttcatgtgtcagtataacttgcatcaaggatgctgatatacttcctgagacatcaaagtttcttgaccaagaatgctaccttaatgttaaatcaaattataaatcacatagaatggaaaaaaaatcaagtagcttggattttatcactgaatctattgcaaatgatttcttaaacatgctggccatggagagtggttcatttggctcaagttgcgatggtgatcccaagtctcccagagagaagcttttaagagagtttgaagaagaggctctagcttcaggtaacttcacctttgatttcattgcaaatgaagaggaattggggacaggtacagttgtagatagttatggggattgtactgtggactcagatttgtctttatttattcaagctgctgaagaggagcatgcaagggagaatcagttattgatgcagagaaggaaggccaaaattcttgaagacctggaaactgactcattgatgcaactttggggtttaaatgagaaggattttgaaaattctcagggaacttattctggtggttttggaagtccaattgaactacccaatgaagaatcctccgtattaccttcaattggacaggggcttggttcatttgttcaaactatgggtggaggctttctgaggtccatgagtccttccctgttcaggaatgctaaaaattgtgggaacctcatcacccaggcttctaatccagttgttttacctgcaaaaatgggtaatgacatactggagatactgcagcatgtggcttctgatggagttgaagaactgtgtcatcatatctataaattaatgcctttgcaggatatcactgggaaattcattgaacatattgtgcagaaagcgacaacagatgaaggggctcctgtaaggcaggggtcatggcagcatgatttgtttgaagaatttccatgtggttatttaacagatgaaggcacgagcttggacactgtgtctcctgaagctgtaggtcccatgactgttaataagattgaagcccgtttgatcgatgggttaagaatacagtctggcatgttgaatgaggaggcaccatcatatatccgtccccaacatgcaaagacacctgctgttggaggcagaagaaccaactggaaggggtttcccacatcagagagaattgctaaattgcaactagaagattgtggagaaagtggcaatgataatgatggattaatggggctgtcaataacatttgatcagtggttgagattggattctggcaccattgaaggagatcagaattcagagcaaattttgaagatccttgaagtacaccattctaaaatcagagagttagatgaattgaaaaatgccacggactggttaaaatcatatggcagaaagctcggacattatggactcttagggaaccatctaacagtggcttttatgatccagctcagagatcctctacgaaattatgagcctgttggtgttccaatgctggttctgactcaggtagaaagagtttgcattagtgcaacaccacaagactacagcgattttcttgatgaaaaggaaaagggaatggacaatgaggccctgctaaatgagacaagtagcaagagtatggaatatacgaatactgacaacgaagccactcaatttcgttttaaaatcaaagagattcatctctcaggagtcctcagcaaagccggaagcaagcaacgttggggtactgcaactcagcaacagtctgggatccggtggttacttgccagcggcatggccagtgctgccaaacattcatcttcaacatcaaaggcaattgtattatcatcccctctgtttaccaagaagttgctgaatgaggatgccctgtggagcatttcttgtgttaatagtatcatggggcctaatagtaaagagctgccagctgaaaatgtacacattcggaaccctgatatcatcttcccaagttga

SEQ ID NO: 103903 - DNA, 207 bp, Glycine max
  Peptide Sequence Number=SeqID_220681
atgccattgaggcatttcaccaaacacttggtgggcgtatgtttaggcatgaaaatcaagggaatgggggcaatgtggcatgccccattactccagaatacaacccctcaattcaacgaaaacaagcaacaatcaaaggataaatccctcacgtttttgagcaaacacatacacttagagcaccaaaatacatcaatggaaagctag

SEQ ID NO: 103904 - DNA, 219 bp, Glycine max
  Peptide Sequence Number=SeqID_220682
ggtgatagggcactggtaattgattaccagatgggtgtaatcgattacacagtgttacctgctactgcgcagttgatccatgatcgcgttgtgatggagtacctagagggtgtttgggagaccctcgaaggcaatgagaggtgccgatttcgtggtacaattcaactcactgctacctcattagtacatccggagaaactctggagggacaacgaatag

SEQ ID NO: 103905 - DNA, 326 bp, Glycine max
  Peptide Sequence Number=SeqID_220683
atgacagacaaaataccaaaaccaccaccaccagatacacctgacagtgatgatttcaccaaccagtggccttttgagctctctgagtacttgaaattcgatgataatcagtggatgcatgatggtcttgagtcatttgcttctgagaatgtctcaaaccaggttcatcaagtcagtaatgcagaagatactagcagtggacgtgagaatagggaagttagagagagagttgcattcaaaataatgtcagagattgaagttcttgatgatggctacagatggaggaagtacggaaagaaaatggtgaaaaacagtcccaatccaag

SEQ ID NO: 103906 - DNA, 1023 bp, Glycine max
  Peptide Sequence Number=SeqID_220684
atgagttcgattccaacaaccacctacgaagattcttcagcagttaacatttcagaattccaacctcaatctcacgcaccgaaggaaattgagtggcacatgctcgacaagtcaaagttcttcttcctgggagcagccttgttctcctctctctccgccgccctctaccccgccgtggtcttgaagacacgtcagcaagtttcctccgccaaaatctcgtgccgcaacatgtcacgcgccatcattcgctacgagggtttccgaggtttctaccgaggtttcggcacttccttaatgggaacaatccccgcacgtgcgctttacatgtctgcgcttgaagtcacgaagagcaacgtcggcaccgccaccgctcacttggggttttccgatgcgtcggccgctgccatcgctaatgccgccggaggcgtagcttccgccatggcggcacaattggtgtggaccccagttgatgtcgtgagccaaagactcatggttcaagaaagcaacaaaatgtgttacaggaatggttttgatgcatttaggaaaattctgggtgttgaagggccaagggggttttacagagggtttggggtttccatagtgacttatgctccctctaacgcagtttggtgggcttcgtattcaatggtaaacaggcttatttggggcgtgtttggtggttgtggtaattcaaattttggacgcgattcgaaggtgatggtgggtgtgcaagggttgagtgcagttatggctagtggggtttcgactattgtgactatgccacttgacacgatcaagacgaggttgcaagtgttggatgcagaagagattaatggacgaaggaggccattgactcttgtgcaagcggttcataacttggtgaaggaagggggaatcttggcttgttacagaggcttgggaccaaggtgggcttctatgtccatgtctgcggcaaccatgattactacctatgagttcttgaaacgcgtgtctgctaagaatctggatagattcattgtgtag

SEQ ID NO: 103907 - DNA, 444 bp, Glycine max
  Peptide Sequence Number=SeqID_220685
atggatttcagggtgatgagtttggagtctccactgtttcacacgctgcaacacatgatggacatgccagacgactctgcaggggacaacaagacatacaatgctccgacacggtcatatgtgcgagacgccaaggcaatggctgcaacacctgcggatgtgaaggagtattcgaattcttacatgttcgagatagacatgcccggtttgaaatctggggacataaaggttcaggttgaagacgacaacgtgcttctgattagtggggagagaaagaggaacgaagaaaaagaaggagcaaagtatctcagaatcgagagaagggttgggaagttaatgcgcaagtttgtgctacctgagaatgctaacacggacgctgtttcagcaaaattgcctcctcctgaacctaagaagcctaagactattgaggttaatgttgcttga

SEQ ID NO: 103908 - DNA, 347 bp, Glycine max
  Peptide Sequence Number=SeqID_220686
gtgtgttagcaggggttcttaattcagggaaagggggggtgaattatttaagtgattgtcctttactaagtagtgtgcgcggttctgaatcaaagtacacaaaagcaatgcaatccaaggacgaggacgatgaaggtgtgggtgtggaagaggaagacgaagatgaacatggagagactttgtgtggggcatgtggagagagttatgctgccgacgaattctggatttgctgtgacatctgtgagaaatggttccatggaaagtgcgtgaagattacccctgcaagggccgagcatatcaagcagtacaaatgtccatcttgcagcaacaagagagctcgaccttga

SEQ ID NO: 103909 - DNA, 351 bp, Glycine max
  Peptide Sequence Number=SeqID_220687
atgggttccacactagtaataaagaaagacaccaaccaaaatcccattaacaatgcaacacaatcctattatttcaactcagttaatttttcctcaaatgagccaaagaacaccatactgaaaaccagttgcaactgtcaaggtagacaacattacatgaggcaattaaggacattcagtactacacacgtcccaatgatccaaacagctggcccaagcctaagctacctaaggttggtgttatcaacaatggtggatggtggaatatggccgaaggacaaaattcctccattgcagcctgtggcacaaccaacaggcctcccttcacaaattgcctatggcggtgggtaa

SEQ ID NO: 103910 - DNA, 207 bp, Glycine max
  Peptide Sequence Number=SeqID_220688
atgtggacccactacgggtacatagaaaggaatcgaaaagcttggttcgagcaaaataggggaggtggttgccgcccagctcgcccaggcgacctcagctcgcccaggcgagcagggttgcttcctccagaagcaaccgccttctggaggaatattccagagggcacaagtgggcctgcgtgctatttgcacccccatttttactaa

SEQ ID NO: 103911 - DNA, 396 bp, Glycine max
  Peptide Sequence Number=SeqID_220689
atggcggccgaactggcaccggacgtcaaactggtgcagcagtttccggcagtgtatctggaacgcgagggctgccatgccgccacggcgatcctctcgctgacgcatgatgcgcgtattgacgatctcaccatgatggaagcggtcaatctgccagcattttatctcggtgcgatgggctcgcagcgcaacagcgcaaaacgcaaagcgcgcctgagcgcgattgcggagctgacgccggcgcagttgcagcgcattcaggcaccggttgggctggatatcggcagcaaaaccccggcggagatcgcgctggcaatcatggcagatattgtgcgtcacaaaaatgggttagcggcaacggatgcgctcagcccggtgcacgcggcgtctgaatga

SEQ ID NO: 103912 - DNA, 276 bp, Glycine max
  Peptide Sequence Number=SeqID_220690
atgccggtgagcatggtgatcaggctcactcgggtgtgccggactgcttgccgtccggcggaaactgaatctgctgacatactttgctttactccgctgagataccttactctgtccggtgatagtcatacccaggccgtaaaatcgcgtggtgaagatgtgaaaaacttccttacccgccagcgcgcgcgtattgatccgcagatctatggcttcagccggcaaaaccggcgcgtcagcggactgcggcgcgaagaagtggcacagctggcggcg

SEQ ID NO: 103913 - DNA, 1080 bp, Glycine max
  Peptide Sequence Number=SeqID_220691
atgggtatcggccgcttttcactcacgccgcagatcccgctgatgatcgccaacggtcacctgacgctctccagcgctggtgtgctggcggcgatgaattatatcggctatctgctgggcgcactgcacgtgagccgcatcaccgcccatcacgtgcgctacctgaaggccggtttgctggccaccgcgctggtgactctgctctccggctttagtcatgcctgggtgctgcagtgcctgttccgtgtggtggcgggtatcggtggtgcctgggccctgattatcgtcacctcctggacgcagatggtgctggcacagcagcaggccccgcgcatgtccgccgcggtatttgccggcccgggagctggcatcactctgagcggcgtgctggcgtggcttatcacccggttacacctgaatgacgatcgcgcctggcaatgctatggcgtggtagcgctggctggcgtgctgctgctgtggcgcgcgctgcccgcgtcgctccccgcccggcagcgggaaagtgcgtcggcggcaccgggtcgcgcggtgaaacggctatggctggcctatacgctggccggtttcggctacattttgcccgcgacgtttttgtcacaaatggcgcacagcctgtttgctcagggtcagctggcagcgcttttctggccgctgtttggactttgcgcagtggctggtgtggtgctgattatgctgttttctgcgcgcctgaatacgcgcctcagcctggcgtgggttatgatcctgcaggggttgggcgtggccagcggcgtgctcatcccgggcgtgagcgggctgctgatctcaacggtgatggtcgggctggggtttctttcgattatgcagctgtcgatgcagctggcgcacgccgtctccaatatcagcgtggcaaaaaccgtggcgatattgacgtcaggctatgccactggccagctaatcggtacaaaaccactacgccgccagcgtgcagattttttgcttccctgcaccccgcgctgctgctggccgctggtgaactgggtgctggccggactgctggtgctgcgcatccgcccgcactga

SEQ ID NO: 103914 - DNA, 1461 bp, Glycine max
  Peptide Sequence Number=SeqID_220692
atggtgatgtatctgcgtcgtcccggcggccagatgcagttcagccgctttcacctgcagtccgtcagcgagtcggggccgattgctcagttgcagagctggatcgccgcccatctggcggaagacctgtcggtggagaaactcgcagcccaggtggcgatgagcccgcgtaactttacccgcgtgttcagccgcgaaaccggcgtttcaccggcgcgctatgtggcagaagcgcggctggcggcggcgcgcgagcggctggagcagacgcgcgagacgctggaacgcatcgccaccgccaccggctttggcagcagcatcaacctgcggcgcagcttcgagcgccagctgcatctcacgcccaacgaatatcgccagcgctttcacagccgcaaaatggccacgcctccggcctacagtgactgcagtaacttcactaaggagtcagtcatgatcaaggtaggcattaacggttttggccgtatcggacgtaacgtattccgcgccgcgctgggcagcagcgacatcgatattgtggcgattaacgatctcaccgacagcaaaacgctggcgcatctgctgaagcacgactccctgctgggtcggctgccagccgaagtcagcgctggcgacggtgaactgcgcattgatggcaaaccagtgcgcgtgttcagcgagcgcgatccggccaatattcgctggcgtgacgtgggcgtggatatcgtcatcgaagccaccggcttttttaccgagcgtgacaaggccgcggtgcacatcacgcacggcggcgccaaacgcgtgatcatctctgcgccgggcaaaaatgatgatttgacgattgtgatgggcgtcaacgaccagcgctacgatccgcagcagcactttgtggtgagtaacggcagctgtaccactaacggcctggcgccggccgcgcaggtgctgcatcaggcgtttggtattgagcacggtctgatgaacaccacccatgcctataccaacagtcaggcgctgcatgaccagccagagaaagatctgcgcggcgcgcgtgcggcggcgctgtcgattgtaccgtactccagcggcgcggctaaagcgctcggccgggtgattccggaactggaaggccgcttaaccggttactcgctgcgcgtgccggtgccggtggtgtcggtggtggatctgacggtgacgctgaaacgcgacgtgacggccgaagaggtgaatgacgcctttaaagccgctgctgctgccggcccgctgcagggtatcctcggctacagcgatgagccgctggtctccagcgattatcagggcgatgcgcgctcatcgatcatcgacggcttatcgacgctggtgattggtggcaacctggtgaagatccttgcctggtacgataacgaatggggcttctctaaccgtctggttgacctcgcgcgcctgatggcacagcgcggtctgtaa

SEQ ID NO: 103915 - DNA, 327 bp, Glycine max
  Peptide Sequence Number=SeqID_220693
atgtgtgcttatcatggaggagccccggggcattccattgagcattgtatgaccctgaagcgtaaggatttccaagtttatgccattattgtaaaccatagttacaatgctaaaatagatgaatttgacatccttgtctctctcatcctttcacaaacacatctttgcttattcaacttccactggaatgtgagtgttgtgaaaacaaagatggatacctcagagccctacactggggcaatgaggggcatcgtgcatgaacctcaagtgaacctaggggcagattataaattcccacccaataggttccctgctacaaggtcatga

SEQ ID NO: 103916 - DNA, 1026 bp, Glycine max
  Peptide Sequence Number=SeqID_220694
atgaactctcttgaagttctttacctatctgataacaaactgcaaggcgagattccatctttctttggtaacatgtgcgcattgcagaggttagacctctcaaataacaagttgaacggggaattttctagcttcttccgaaattcttcatggtgcaacagagacatatttaggatgttgcgtttatcttataaccggttgactggcatgttacctaaaagcattgggttgctatcagagttggagtatcttaacttggctgggaattctttggagggtgacgtcactgaatcccatctttctaatttttccaaattaaaatacttgcggctatcagggaactcgttgtctctgaaatttgtcccgagttgggttcctccattccaattaatacagttgggactccgttcttgcgagttgggccccacttttcctagttggctcaagactcaaagttcgttgtatgagcttgatatttctgataacgggattaatgactctgtaccagactggttttggaataagttgcaaaatatgatattattaaatatgtctcacaattatatcattagtgcaattcctaatatatcattgaagcttcctaacagaccgtctatacttctgaattccaatcagtttgagggtaaaattccgtcatttttactacaagcttccgagctgatgctctctgaaaataatttttcagatttgttttcattcttatgtgaccaaagcacagcttcaaatttggccactttagatgtgtcacgcaatcaaataaaggggcaactgccagattgttggaaatcagtaaagcaattactgttccttgatttaagcagcaataaattgtcagggaagattcctatgtccatgggcgcccttgttaatatggaagccttggttttacgaaacaatggtttaatgggtgagttgccttcttctttgaagaattgcagcagtttatttatgctggacctgagtgaaatatgttgtcgggtccaataccatcatggattggagaaa

SEQ ID NO: 103917 - DNA, 270 bp, Glycine max
  Peptide Sequence Number=SeqID_220695
cttctcgatatattatgcgccagaatcggacttccgtgtgacaagttacaaccatttgaatttctcgagagtattcgttgtttaatttctagcgtctcgatatattatgtgatgagaatcatgaaactggccaaatacaggctaaaggcccaagtggagaagaacgaaggcccaagtggagaaggacaaagcccccgagtggagaaggatgaaggcccagaggcagagacactatcaagactattaattgatgctgaatgcccagattaa

SEQ ID NO: 103918 - DNA, 303 bp, Glycine max
  Peptide Sequence Number=SeqID_220696
atgactgctaatcttcctcacgagttgattgagcttcttgaaaagattgtgctacaaaatttttcttttagtggaaacttcaatatgcaaaatttgttgatccttactgcaatcaaggcagatccttctagagttatggattacaaaaataggttggacaactttgataggtctacagtagggctgttaatgtcctactatataacctctatactattgattgtgctgtggagtttgctttctaggtcgaagaagatgttgtttggcgccaagtggctaaagcactacttaacaaaggcttag

SEQ ID NO: 103919 - DNA, 468 bp, Glycine max
  Peptide Sequence Number=SeqID_220697
aataacactgtgtataattttccaaattggttcctccaatggtggaactacttcggaccaattccacagatatttccagaagaagtccaacagggattccaacaattcaccaagctcttcaatagcaaggaatcaagaattccggcagatttaaaatatggaaaaaccgaaaacagcaaacaatatccaccattgcagagacatgcctttgtaaagtggtggtcacaatttgatacctcaaaggctgctccagaacaatctcaacttgcagcattcttagcaagctcaaaatctaaagagagtcttgctcagaatcttaaggaagttctccagctacttcaacaggaagaagaagaagaaccccccaagaaggaagccgaatcatccgagaataatgatgaccaagaagatgacccattctaccagaatgaggatgactgttttggtatatcgttagatgatgattag

SEQ ID NO: 103920 - DNA, 1254 bp, Glycine max
  Peptide Sequence Number=SeqID_220698
atgtacaatttagagaagccacagagagatgataaacagtttctaactccctctttctcttccactctcctcgaccaaatttatcgttccatcgacgagggtgaaagaaaaaacggcgaaacaaagttctacagacacactactatgagcagtagcaagagacacaacagaagcgattcgaaatccatggacgctggagacagaaaaattgtcggcggcgcgaaaaacaacaacagaaaacatctgcaccgcgacgaggatgtcatgttcttcagctccacttcgatttcctccacagattcctccagccttggattctcctcctccgacaccgaatccatctcacgcgcctcgtgtttcgcgccacaggtggggcgcggaggaggaggaagcgcttcattccgttccgagaaacagggaatgcgcatcttcgacagtttctgtcgaacctcctcccatagatcgtcggaacacgcgcattcccaattctgcatcacaagccgtcgtcatctgtccgtgtcagaagatcataaacaaatcagacacggacacagacaggtgacggcttgtgacgaagaagaagaggccttaatgatcaaatccaagtcgagggccttaaagatttacaacaaccttaaaaaagtgaaacaacctatttcccctggcggcagggtcacgagtttcctcaactcgctcttcgccaacacgaagaaaaccaccaccactactacttctacaagttcccgcacgtgcggcgaagtgaatactccttcttcttcttcttcatgttattattcttccacgtgttcctctgcttcttcgttttcacgttcttgcttgagcaagaccatgtcttccgaaagggacaggttgcgcaatggggtgaagagaacggtgcgtttctacccagtgagtgtgatcgtgggtgaagatagcagaccctgtgggcacaaacgcttgtgcgaagagaaagaagcttctagagagttcttaagagagtacaataaccgacacaaccccaagattaagagcaatgataaattggtcttgaaggacttgtctttaaggactactaacgttgatgttgatgataacgatgacgacgatgatgcatcgagttatgcgagctcggatctcttcgagcttgatcatttggctgtgtttggaagtgataggtatagtgaggagcttccggtgtatgaaactactcatgttagtactaaccgcgccattgccaatggcctcatagtataa

SEQ ID NO: 103921 - DNA, 243 bp, Glycine max
  Peptide Sequence Number=SeqID_220699
atgagtttcaagaacagtcctaaaattcagcacataggagcctctccaaacgtgtctcgccaatcatccacttctagttttagggacaaacaacagaagaatgtggagccaccaagccctttacctgttggatgctgcagaggcttcagcattgccaagactattgggtcccctgcctccacatcacaacaaaatatgcaacagttacaataccaaagacttgaagtaaagaattcattctga

SEQ ID NO: 103922 - DNA, 255 bp, Glycine max
  Peptide Sequence Number=SeqID_220700
atggaaaggactcaagattacttgaggaactgccttcagatagcacaagaaaatggaatattagatgtcattgtgaactgcaaaggtgaatttcaacaatctccagtctctatccacaccataagctccattaccagccctcaaattcaaattcccactccaccacaccatggccaccacaccaatcttgcgtccatcatagatcaagcaaaaatcaatggatggtatattgatccaaatgaggttagtaagtag

SEQ ID NO: 103923 - DNA, 645 bp, Glycine max
  Peptide Sequence Number=SeqID_220701
atgggcgcgtgcatcgaccctccccgacgcgcgtgggtggtcacagaacatctcagcaccacgttgaaggagtggctgcacgggcccgggaccaggctcagagagcgaatggtgccacttccactcttcaaagacagagtcattagggcccttgaaatagcccaagccatgcagtatctgcacgagcaaaagcccaagctcgttcaccgtgacttgaagcctagcaacatttttcttgatgatgccatgcatgttagagtcgcggattttggtcatgcgcggttcttgggtgatgaggaaatggctctcactggagaaacaggaacatacgtgtacatggcaccagaggtgatccgatgtgaaccttatgatgaaaagtgtgatgtgtacagttttggggttatgttgaacgaacttttaactggacattacccatatgttgagacagaatatggtcccaccaagattgccattgaagttgtggagggtaacctgcgacctaagcttccgtgtgatgatgttggccaaccgagagagcttattgaccttatatgcctttgctgggacaaaaatccatctactcgaccatcttttgctacaatcaccctttgcctcaaaagttatgccaagaaaaatctcctttaa

SEQ ID NO: 103924 - DNA, 564 bp, Glycine max
  Peptide Sequence Number=SeqID_220702
atgctagccatcaccctccttctcatgttctcggtaactggtagtctcaagctctccaaactctgctcccacaaccaccaactcgacaccgagactgtggtggcggcttcggcggtgctcctctccctggccgctctgtacgtggtggacttcgcgtgttacaagccagagaaagaacgcaaaatatcggtggaggggtttctaaagatgggcgaagagagtgtggggttcgaggaagagtctcgccaattccagaggaagatttccacaagggcgggtttgggtgacgagacctactttcccagaagaatcacttcttgctcgcctaagctctgcatgagcaaagcgcgtctggaggtagaggccgtcatgttcggcgccctggacgctcttttggtcattacgggggttgttccaaaggacattgacatttcgatggtgaattgcagcctgttcaacccaacaccatctctccctgccatgattgtgaaccactacaggccgagaagcaacataaagagctacaacgctcacaatcacactatttttggtaatcaagtgtaa

SEQ ID NO: 103925 - DNA, 744 bp, Glycine max
  Peptide Sequence Number=SeqID_220703
atgaatctggcactggtcaccggcggtagccgcggaattggacgggcaacatcgctgctgctggcacaggcgggttatcgcgtggcaatcaatttccggcagcgcgaagcagaagcgttgcaggtggtagcagatatcgaagcgcagggcggcaatgcgtttgccttacaggcggatattgccgatgaagcgcaggtggtgcgcatgttccgccagctggatcagcagccgggcgcgctgcgcgtgctggtgaataacgccggtattctcttctcccagtgccgggttgaggatctggatgctgcgcgcattcagcgcgtgctggcaaccaacgtcaccggcacgtttatctgctgccgcgaagcggtaaaacgcatgagcaccgcacacggcggccagggcggcgccattgttaacgtctcgtcagcggccgcgcgtaccggctcgcccaatgagtatgtcgattacgcggcgtcgaaaggcgcgatggatacgctgaccagaggattgtcactggaagtggcagcgcaggggattcgcgtcaatagcgttcggccagggctgatctacaccgatatgcatgccgacggcggtgagccggggcgcgttgatcgtctcgcggcatcgctgccgatgcagcgcggcggccaggcggaagagatcgctgccgccatcgtctggctggccagtgacgccgcttcctacgtcaccggcagctttattgatgcgtcaggcggccgttaa

SEQ ID NO: 103926 - DNA, 756 bp, Glycine max
  Peptide Sequence Number=SeqID_220704
atgcaggtttatcacttcatcatcaaacaccgggaaagtgtcagttatatgaccatccgcgaactggcggcgcaggcgggcgtctcgaccaccacggtgctgcgcttctgccgcaaaatgcactgtgacggctggtcagaattccgcatccgttttcgcctggcgcaggagcaaagcgcgccggtgctgctgccctccggcgtcggagaaatgctgagcttttttaaaagcatcaataacgcagaatttgatcagcagattgccaccgcggcgcaaatgattattgaggctgagcacattttctttattggtgctggtacttcaggcagccttggcaaatatggtgcgcgctatttttctaatattggaaaattcagccatcacatcgatgatccttattacccggtgagtaagagcgcctgggaaaatgcgctggcgattattttatccgtctctggcgaaaccgaagagatcctgcgctttgccagtcagttcagcctgcatcactgtaaaatcatctccatcaccaatcacgacaactgctcgctggcgaaaatggcggatttcaatctctcctatcatgtgccgcaggagaaactgcctgaccgcttcgatattaccacccaggattgcagttacccagcggatttctctggggcggcgcggtggcagcccatcaggttgagggcggctgggatcagggcggcaaaggcgtcagtatcgccgatgttctcaccggcggcgcacacggcgtag

SEQ ID NO: 103927 - DNA, 756 bp, Glycine max
  Peptide Sequence Number=SeqID_220705
atgcaggctgaactgactggcaaagcgcaggatctcttcgccgtcacagtgcattttgcggcagaagcgcagcaccgtggtggtcgagacgcccgcctgcgccgccagttcgcggatggtcatataactgacactttcccggtgtttgatgatgaagtgataaacctgcatctcaaggtcattcaaacgggacagaataattttagcgtacatgtgtactctgaaattgttcttcgctactctggtgcacagaaaaagcacaactttcgttacgatgttcaggaatccgacgccatggtacagaaccgacttattgcccagggctattcactggccgaagagatcgccaacagcatcagccacggcctgggctgcgtgtttggcatcgtggggctggtgttgctgttgacccaggccgttgaaatgcaggcgaatatcaccgccattaccagctatagcctgtacggcggcagcatgattttgctgttcctcgcctcgacgctgtatcacgccattccgcatcagcgcgccaaatactggctgaagaaatttgaccactgcgccatctatttgctgatcgccgggacttacacgccgtttctgctggtcgggctgcaatcaccgctggcgcagggattgatggtggtgatctggagtctggcgctggcgggcatcatctttaagctgaccattgcgcatcgctttaaagtgctgtcgctggtgacctatctcagcatgggctggctgtcgctggtg

SEQ ID NO: 103928 - DNA, 1917 bp, Glycine max
  Peptide Sequence Number=SeqID_220706
atgttaaaagagcagtgcgccattgcaacctgtttgcggaatctggcgcacaaatcgcgtgataaccctgtaaccggtggcatggctgtgcgtcatcgcgcgcagcgtctggttgcacgcctgcagcgcggcgaaaaagcaggtacactgagcgccactgttatcagctgtggaagaagacacatggatattcatgacaaagcgcgcgtccagtgggcatgccgtcgcggcatgctggagctggatgtctcgatcatgccgttctttaaatatgagtatgattcgctgagcgacagcgacaagcaggtgtttgtcgcgctgctgaagagcgacgatccggacctgtttaactggatgatgaaccacggcgaaccggccgatcctgacgcgcgggtgctgaatgtgacgctgttcgggctgtgtggcgcgctgttgctgagctgtcgctggccggcgggctgggcctgggttcagatcgcggtagtgattctgctgacactgcagtgctggcgtaacgcgcgtcgcctgcagcagcgctccggagcgctcatgctggatgacaagggtgactggtactggcgcgcgctggcggctgtggctgctgcacgacagcatgccgcccgacgcgtggcgcgcgctacgcgcccgctgttttttgctggatggcgcgacgccgcattaaagcagcgcggcggtttcggtcagaatctgttcacaccactgctcgacgcgctcttcgctcagctcaaactgattaacatcgtcgagcgccagaccgacaaactgctgaccatcggcggtcagcggttttttactggtgaactggtagccgtcgagcggccagtaaccgacaaactgcacgcccatcggcagcagcagttcgtgcagcatacccagcgcatcaaggaaccattcgctgtactcgatctggtcgcccatgccgtacagcgccacaattttgccctgcagaagcaggccagtttcaggcataatgagcacgatttcacacggcgaggggcaacagtgcaggacagcgatctgatagaacagtttctcgacgcgctctggattgagcgcaacctggcgcagaacacgctggcgtcctatcgtcaggatttgcagacgctcactgcctggctgcaccaccatgagcgcacgctgctgacgctggaagccgctgatttgcagcagtttctggctgagcggattgagggcggttacaaagccaccagctcagcgcgtactctgagcgcgatgcgccggctgtttcagtatctgtaccgcgaaaagctgcgcagtgacgatcccagcgcgctgttatcagcgccgaaattgccgcagcgcctgccaaaagacctgtcagaaaatcaggtcgagcgcctgttacaggctccagcgacggacataccgcttgaaacgcgtgacaaagcgatgctggagctgctgtacgctaccgggctgcgcgtctctgagctggtcggtctgacgttgagtgatgtcagcctgcgtcagggcgtggtgcgcgtcatcggtaaaggcaataaagagcggctggtgccattaggtgaagaagcaatttactggctggagcactatatggaacatgggcggccgtggctgctaaacgggcagaccattgacgtgctgttccccagcaaccgcgcgcagcagatgacacgccagaccttctggcatcgcatcaaacactatgccacccttgccggcatcgacagcgaaaagctgtcaccgcacgtgctgcgccacgcatttgccacacatttactgaaccatggtgccgatttacgcgtcgtacagatgttgctggggcacagcgacctgtcgaccacccagatttacacgcacgtggcgactgagcgcctgcgtcagttacatcaacagcatcatccgcgcgcctga

SEQ ID NO: 103929 - DNA, 123 bp, Glycine max
  Peptide Sequence Number=SeqID_220707
caatccatgtctgtgacagcagaccatgatccactgtttaggctcccattgacacctacaaagcggcaggcatttcaagattgtgatgatgaagcagggagctctcaaatttcacctgcatag

SEQ ID NO: 103930 - DNA, 327 bp, Glycine max
  Peptide Sequence Number=SeqID_220708
atgattaatttgaggaagcttgttcagaggtcactgtctttagaagcacttcgcaacttggtgcctcatattgaagccttagccttatctgccatgaactcttggggtggtgatggccaagtcattaacacatttaaggaaatgaaaaggtgggatagtgatagcaattcagcaacagaacaccacataggccacattgcagaagctactaacaggccaagaagattaggggcacaacacaaagctgtacacacctgcacttctcttttgctcttgataccaattgtatatatattggtggtttctaatctaacagcagcaaattag

SEQ ID NO: 103931 - DNA, 192 bp, Glycine max
  Peptide Sequence Number=SeqID_220709
atggcgggtcacagcagctacacttctgggagatgccacacagagagagcgaagggcacaacagagagagtggttagagttagggcacagcagagagaggggagagagcaaggttcagcagagagaagggagagaacgaagggcacaatgttgtggaaagagagagtgaagttcagcagagagaggggttag

SEQ ID NO: 103932 - DNA, 807 bp, Glycine max
  Peptide Sequence Number=SeqID_220710
atggctgaattcacagaaaatttgcaaaacatttcctcatcatctccattcttagacattgatccaagcatggaactcctaaaccaattcatagggatgaaccaattatatgtgctagacaactcaaacttgatgccttatttctcctgtgataccttcttgggcccccaagaacctgagtttccaggaaacttggaagaagattttccttttctcttccatcatgtcaaccacaatgcacctcctgtttccctccccattttccaagcagaaaatgagatccatgaaggtaataagaggaaatcaatggatcttcttgagaccagttttgctaattcaacttctgcagtttctgagactggaagcaagatcaaacatagttctggaagaggaaagagactgaaaaacaatgttacagaagaagaggagaaagcaaaggaagtggttaatgccagggctagaagaggtcaagctactgatagtcacaatttagcagaaagggttagaagagggaaaatcaatgagaaattaaggtacttacaaaatattgttccaggatgttacaagacaatgagtatggcagtaatgttagatgaaatcataaactatgtgcaatccttgcagcatcaagtagagttcctttctttggagcttacagcagcaagtaccttttatgacttcaattccgagatagatgcttttgaaacaatgcagagatcaagggcatacgaggcaaaagagttaggcaagtataaaagagaaggacatggaggagtttctctccttcaaccaacatggcacctttga

SEQ ID NO: 103933 - DNA, 246 bp, Glycine max
  Peptide Sequence Number=SeqID_220711
atggcgttttggagatccctcgcgttctctgcgatccttctctcgctcttcatccatggcgctctctgcttctacctccccggcgtcgctccacaggacttccagaagcaagagttacggtattggtatctggagattattgttgcagtgcatttaatacgtagaagtgttgttgtcgttgctatttgtgttaatttcactttgatttggtgtcggtggagagatttagatacttcggtgatgtga

SEQ ID NO: 103934 - DNA, 693 bp, Glycine max
  Peptide Sequence Number=SeqID_220712
atgaatatcttgacggcacacgatcaagagtgggaacaagagttaagtccttacaatcaatatgaagaagaaagaactcctaatcttgaaagtgtgtttgaggaattcatggcataccataccagctcaaaagctaatcaaaactcaatgaaaaatcatgaaattcattttggtaagagctactcaatagaaaactttcacgggggaccaaagttacaaccttaccatcaaaatgaagcagaaagaggatccaatctagataaattgttgatgcaattcatggaaacaactaaatcaactcaacaagcactccaaagtgtagaaatccaggttggtgagctggcaaaagcaatgactcaatttgtggtcagacaagaaaaatcctttgtagaggttgaagctcaaaagaaaagccctgtaaaagagcatgagtcaagagaaaaagatgaggagaaagatgaggaacaagcacaacaacaatgggagaaatactcaactgtagaaaaccaacaagaaaatattctccaaaccaataaccttcctcatcaactgattgacaagaaaggaaggcaaggagaacataaggaaaccttaagtgccattctttctttaataattaacacctttcttgaaatgatttggaatgtccttccagattatatgaagttcatgaaatttctagctaaaaggtga

SEQ ID NO: 103935 - DNA, 129 bp, Glycine max
  Peptide Sequence Number=SeqID_220713
atggcgccaaaaacttgttcgcaaccggcaagtataccggatcacgcaagtagtataaaatggcatttaaactatctaggcaaaaagaaagaaaatcatgcaagagaaatactgtgtaaagacaagtag

SEQ ID NO: 103936 - DNA, 305 bp, Glycine max
  Peptide Sequence Number=SeqID_220714
aagtgaaactggattctgatcaacttactgtcattgagaagttgaagcaaaagcatctcgagcaagagaaaagggagctacttgtcatggaacaagaaggtggattatgtgatgggaaagaagttgatcagtttcatcaaccgtctggtagtaatgaggttgccattgctaatgaggatggtatttcatatggatcagagctcatagaggttgacaaaatggtgctctctgggatattttttggagacagggatgtccctaagttgcaggaaatctggaagaagaatttcagagagtttaggcat

SEQ ID NO: 103937 - DNA, 509 bp, Glycine max
  Peptide Sequence Number=SeqID_220715
atgcatagggttagggttagggttccggtgtccgtggcgcaggttctgaagcacgagccgcggctaatttcccttgcagtggaagggttctacgatagagatatagacacgatgaagttcgcgtcgaggatggagaggtttgtggagagagggaaagcggaggagttggtgtgcgtttcggtgaagatgtcgagggcgatgtacgcacagctggtgcagcagaggtttcaggctcccaagtgttacccggggatgccggctcggagcgagaaggaagggtttgcggaggcggagctggggatgaagatagcgtgtgggttggagatgatgtatcagcagcggaagcgcgacggggtggaagggaaagggagctcttgggaggcgtttaggaagagtttggagagtagtgggtacttccaagggatgcttccgggttcctctgagtatcagagattgatgcagagtgctcaagagtattatagaaatacttctctgcactctaaggccag

SEQ ID NO: 103938 - DNA, 822 bp, Glycine max
  Peptide Sequence Number=SeqID_220716
atggcgggcaaaaccctgtatgaaaagctgatcgaacagcatgtggtacgtcaccttgacgatgaggggcacgtgctgctctatatcgaccggtcaatcctcaatgaatacaccagcccgcaggcgtttagcggtctgcgcgaccggtcgcggcgcgtgcgccatcctgccaccattctactcaacgttgaccacgtgaacccgacgcggccagtgcgcgatgcggcgatgaccgacgcaggcggtcagctgcaggtcgattacttccgcaaaaatgcggagcactttggcatcgagctgtttgacgtgctcgacccgcgacagggcattgaacatgtggtggcacacgagcaggggctggtgatgccggggatggtgattgccgccggcgacagccataccaccacttacggggcgtttggcgcgctggggttcggcatcggcacctcggaaatcgagcacctgctggcgacacagacattgatttatcgcacgctgaaaaccatgcgcgttgaagttaccggcgagctgccgtttggctgcgccgccaaagacatcgtgctggcgttgatcgaacagattggcgcatccggcgctacgggatatgcgattgagtttaccggcagcgcgatcgatgcgctgagcatggaagggcgtatgacgctgtgtaacatggcggtggaagccggtgcgcgcggagcgattatcgcgccggatgacaaggtctacgcttacattgccggcaaaccgcaaatgccggtgggtgagctgtggcagcaggcgctggccgagtggcgcacgttgcgcagcgatgatgatgcg

SEQ ID NO: 103939 - DNA, 138 bp, Glycine max
  Peptide Sequence Number=SeqID_220717
atggagatggaagagacattcaactcatgctttctccatgttttcttagctactataactccaatagtaaaccatgaggaccttcgagttgctgctgtctggggatgcacatcaacctccatgatcacatcaagatga

SEQ ID NO: 103940 - DNA, 1893 bp, Glycine max
  Peptide Sequence Number=SeqID_220718
accgtgaagcaggtggcacacgataaatatcagctcgatgttgatgtggtagcgtttaatgattacgtgcagccgaatgaagcgctgttcaacaaagatgtcgacgccaacgcgttccagagcctgccttatctggagatgcagtccaaagagcgcggatataaatttgccgtcgtgacccataccttcgtgttcccgattgccggcgcagggcctgctgaaggtgaaacccgaagccggtctgctgccgaccacgctggatattaccgacaacccgaaaaagctgaagattgtggaagtggatacgccgcagctggcgcgcacgctggacgatccgcaggcaaagcgtcgccatatgtgaatgcgattgtggcgcgcgaagataataaagacagcccgaacgtgcagaagctgaaagaagcgttccagtcacagccggaacaggattaccgcacccatcgtagcggcgcaatttattgcgcattcgggcagttgtgcggtgtttcactcagcgcgataaatcgcgccgctacaatgtgtgcaggatggtggatggtggtaccgaaatacaatgccgcacggatcgtagcggcgcaattcattgcgcattccggcaactgtgaagtcatcgctatttcctgcatttttaatcatctcgctatctgcgctcccccatcccattttctgccagtcagcccgcttctgctgctgtctgaatcgtctacacttcaggttgaaaaagccgcagcggtgaaatgtatgagtcaatcagagaaacagtctctgcctgctggcatgctggccgccgccggcatcgtgtttggtgatatcggtaccagcccgctgtataccctgaaagagtgtctgtcgattttgccggacggcgcgccgtcggcgctggcggtgatgggctttctgtcgctgatcttctgggcactaacgctcatcgtcacgctgaaatatgtctgcttcgtgatgcgcgccgaccacgatggcgaaggcggcattctcaccctgatgtcgctggctcgccgcaacgttggccgcaaagccggtcatatcatcgtgctggccggtggtctcgcccgggctggaaaaatatgtggtgccgctggcgctcaccattctcgcgctgctgttcattatccagaaacacggcacggaaaaggtcagccgggtgtttggcccggtgatgtttgtctggtttgtggccatcggcgcacttggcatacgcggtattctgctcaacccggaagtgctgcacgcgctcagtccgtcctatgcgctgaccttcctgctcagccacaaagcgctctcgctcgcggcaatgggcatggtggtgctggcggtgaccggcgcggaagcgctgtacgcggacatgggccacctgggcaaagcgccgattcgtctcgcctggctggtgattgccatgccggcgctgatactgaattacttcggccagggcgcgctgattccactgattgtgctgtcaacgctggccacggtcatcgcggcgcaggcggtgatttccggcgtctataccctgacgcatcaggccattcgccaaggctttttaccgccgatgcgcatcatttttacttcgcataccgagtccgggcagatttacattccggtgtcgtcggcgttgtcctcggcgtacggcatcgtagtgaccggcaccatggtgatcaccgcctgtctggcgggcgtggtggcgctgcgaaactggcgctggccgctgccgctggcgctgttgttcctgctgtgtatgctggtggtcgacgtgccgctgttcatcgccaacctgatgaagctgctgtccggcggctgggtgccggtgctgctggcgctgaccatgatgggattgatgctgatctggagcagcgagcgtaa

SEQ ID NO: 103941 - DNA, 684 bp, Glycine max
  Peptide Sequence Number=SeqID_220719
atgcgcttacacagcaatctagaatcagttgatgaacaagaaactgccacatttgcaaaatggattctagacattggagatgaaattatagatgatgaaaatgatggttatgctacaattcaaattcatgctcatctactcattactcaatatgatgatccaatcagtgctatagtcaaatcaacattcccagacttagatcagcaccacaataatcctgaattctttaaatcgaaggcaatactagcttcaacaaatgaaacggtagaacaaatcaatgattacgtgctatccttcattccaggtgaccacatggaatatctaagctctgattccattgataaatcagaaaccaatgagaattcgtatttccaatcaattactactgaattccttaattcattgaaaacatccggtttgccaactcattctatcaaacttaaaattggaagtcctataatgctgttaaggaacctcgaccaaaatcaaggtctatgtaatggtactagattagtggtaacaaagatggcaaaacatgtaattgcagctgaaattatctcagaaaaacccaagatgagtacctcatcctccaccgcttcaaccagaatcagatatgcaattgtgagaccacctgcaatcaagcaatttagagtagctttccacaatgaccaggttatagtttaa

SEQ ID NO: 103942 - DNA, 552 bp, Glycine max
  Peptide Sequence Number=SeqID_220720
atggcctgcacccgccagttgctcactgccggcggctataaaagctttagctatgccgatattgccgcccaggtggatatccgcaaggccagcattcaccaccattttcccggcaaagccgatttggtgaaagcggtggtagaggaatatcgtgctgaagcgcaggcgggcatgcaggcgatggatgaacagatcaacgatccgctgaacgaagtgaaagcttacgtcgattactgggcgcactgcattaaagagggggcttcgcctttctgcatctgcgcgatgctggcggcggaaatgcccacgctgccgccggatgtcgccactgaagtcagcggccacttcagcgatctctccggctggttagcgcgccagctgagcaaaggcgccgccagcggcgttttccagctcagcgacagcgccgaaaacgaagctaaaacgttgatggccagcgtgcacggcgcgatgctggcggcgcgggcatttaataacgccgggatgtttgagcagattactcatccgctgctgcataagctgatcaaaaccgcctga

SEQ ID NO: 103943 - DNA, 459 bp, Glycine max
  Peptide Sequence Number=SeqID_220721
atgaacgagtgcgtgttccggccggttaaactggcgcagttaaccacgattctgagccagattcacagcgccagcgcgctgtcggtcggtgatgatttttctgactgggtggatatcgccgaaatcgagaaatatatgcccaacagccccggcgcgatcgcggattttctcgacatcgtgattaatgaagcacgcaccgatctgacgcaggcgattgacgtggtgcaaagcggcgatctcgtgactgccgccagcctgtttcatcgcatcaccggatcgctgcgcgtcaccggtatccgtcagctgacggagcagtgcgaaatgctggaagagctagcggaaatgcaggaagacagggaaattatcctgctgcatttacgggaagcgctaacgctggtggacaggatggaagcctcgttgcgtcagcaaaccacatccgcccaggccggcgcgcactga

SEQ ID NO: 103944 - DNA, 228 bp, Glycine max
  Peptide Sequence Number=SeqID_220722
atgactatatgcaaaatgtacaacatcagcaaggatatgagaaagaaggcacaggtcattcagaaacaaaacactttccctcacgtgttgtttcatgggggttatgaatttctagaaaacaagttgatagagcagaagaaaagcaaacaacttgaggaagctgcaaaattcggaagcactgacaccgtcattgatcctccatctcccatcagacgacacgtgacatag

SEQ ID NO: 103945 - DNA, 408 bp, Glycine max
  Peptide Sequence Number=SeqID_220723
atgggtgaagtagaggaggtacaagagaagatgaaggccgacatggaggccatgaaagagcaaatggccacgatgatggaggccatgatgatcatgaagaagataatggaagccaatgcggttgcagttgccgctaccagcactgttgctaaggtgaacccgatgcccccatctggcctcaaccaaatgaatcatccaaccttagctatggtaggaaaagatttgggaagtacgggcggtccccatgatgtgaaaattcaaaatgagcacgcctttccaccatatggcttgcctcttaactatacgccacccaatgtggtgtacactcccaataagaatgtcaataactccattcctatacctattgagagccaacaacaccaaactgatcatgcacatgtctcttaa

SEQ ID NO: 103946 - DNA, 210 bp, Glycine max
  Peptide Sequence Number=SeqID_220724
atgaaccggcaagaagccttccagtcatatccgcttggttggtacaaaccaatcggcgggcatcatgtacagagaaatcaaactttcaattgtcaatcagtgcaccctcaaatgagttttttcgagatttcaatcggttcaaatgaaagggagtggaaaaagaagaagtttgggctttgtgggggagtgatttggacaagaattgagtga

SEQ ID NO: 103947 - DNA, 204 bp, Glycine max
  Peptide Sequence Number=SeqID_220725
atggctgtcatcccagaccaaaccactgcaacccttgcatttgtgagtcaagataatctggttttcgaggaaccagtgcctctagagggaaataaggagaagagaaggaaaggatatgctcataacagaatggattctgcactatggaattggcaagcaagcaagggacaagattgtcaggtcagctttagccgttacaagtag

SEQ ID NO: 103948 - DNA, 144 bp, Glycine max
  Peptide Sequence Number=SeqID_220726
atgttgtggaaagagagagcgaatggcgcatcagagagaggggttagagttagggcacaacaaagagaggggagagagcgaggttcggctatgttgtggaaagagagagtgaggttcagcaaagagaggggatgtgcgacttaa

SEQ ID NO: 103949 - DNA, 248 bp, Glycine max
  Peptide Sequence Number=SeqID_220727
ccgcccagcgcagattccgaccgccgggcagcgtaggagaccaagacgagggagaggagaaggagacagtgcattggaaaaacgcggttaacgggcttgtcctgagtattctcgtttgggctagcgcattggcaaagccaactacatttgatggtgttgaagttggaagccagaaagcaaactcggttgctattcctccagggattataagaataagagggtgcacatgcatagttcctgctatgtga

SEQ ID NO: 103950 - DNA, 537 bp, Glycine max
  Peptide Sequence Number=SeqID_220728
atgcagagactaacatcgtctactgcaccctttgcaatcgcggccaacgagcccgttgacacgcagagatttacgtcgtcttccgcgctgtctgtcatactgaccctgaagtcaggtgacgtgcggagatacacaaactcaaagcacgatagtgcgcaaagaccaacatcgtcttctgcaccttttgtcgtcctgacccgtgaagtcagtcaggtgacatgcgggggttaccgtatggtcacccgcacctttcgtcaacaaggggaaaacgagcccgttgacgcgaagagactaacatcgtcttctacaccttttgccatccagggacagcgagtcaggtggcaggcgaagataccttatggccatccgcacctttcatcaatcgaggggaacaaattcgacggttttactctcgtcgtccggaaacattcaagcccaacgacgcacgagattcttttctactgggcagggacgatcgagtgcaatggcgtagggaagtgttgtggttgtcccactttgtcgctttcaagacgttga

SEQ ID NO: 103951 - DNA, 487 bp, Glycine max
  Peptide Sequence Number=SeqID_220729
agcatactgtcgggaccgaaagatggtgaactatgctgagcggggcgaagccagaggaaactctggtggaggccgcagcgatactgacgtgcaatcgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 103952 - DNA, 234 bp, Glycine max
  Peptide Sequence Number=SeqID_220730
atgacagcaacattaacaaattcacaaaggcatagaatagagtgtaagaaagaaggtaccgctaaaggttatgccagaggatgccacaacacaggtttggatgatagtgttctcttaccttgtgaagggttgcctcaacatgttagatttctccaaataccctcccaagattttaagacaatgtattttacatgcgataacactaagtataaatatttcttaatcatggcatag

SEQ ID NO: 103953 - DNA, 276 bp, Glycine max
  Peptide Sequence Number=SeqID_220731
atggaaaatcttcacgaaatcgcttacgaaaacgtctcggaagcgggaaatgagggaggtggttgccgcccagctcgcccaggccagctaggttgcttcctccagaaggcaccgccttctgttggaacaccctggaaggtccaaattgtgcaacaatgcttcctttcgactttcggcacatcgcggaacttcacggattgcctaacgatgggtgttaagtacctcaaagcagtcaagcgaaggttgcatcccaccaaacaaatggtccccaaatga

SEQ ID NO: 103954 - DNA, 379 bp, Glycine max
  Peptide Sequence Number=SeqID_220732
atgcctagcccactgaggagggggttcgggacatgcgctcaagggaagactagcagtgcaaattcagccagaggaggagccaggaagacggtttcgatgaggaagccatcgcccagctgctgtgcgtaccggggcaggatttcgcctggaccactgcagggaggcagcaatgtcttgcctagcgaccacaactccgacctccctctgcctaagtgccagttggtgtatgccatcctaacatggatgagcgttcacgtggcccaggaatggcgcctactagcaccctttggacccagagaagtccaacagggccctggggtttccggctctaatcacgggcctctgccagtcctacggagttcctgtcacccccagcaag

SEQ ID NO: 103955 - DNA, 531 bp, Glycine max
  Peptide Sequence Number=SeqID_220733
atgagggtcgatgcactacgtcgaaaaggcttatctccattgcagaagtgcacaactactattcatatattggcttatggatcacctgctgacagtgtcgatgaatacgttcgaattggtgaaaccactgcagtggaatgcttggagcgatttgtattaggcatctgcaccatatttgggaatgaatacttgaggagaccaaataatgaagacatcaaacgcctactacaaatgggagcagcacatggatttccaggtatgttaggttccattggttgtatgcactgggaatggaaaaattgtccagttgcttggaaaggtcaattttgtcgagatgatcatcgcaacccaacaatcattcttgaagccgtggcatcacaagatttatggatttggcatgcattttttggaaccgccgatgacatttatccagactttgtcacgtttatgaagaccatctcaatgtcacaaggagaaaaacgaaaattatttgcacaacgacaagaatcggcaagaaaggatgtagaatga

SEQ ID NO: 103956 - DNA, 380 bp, Glycine max
  Peptide Sequence Number=SeqID_220734
atgacagagaagtcaacgaggaagcgaaaaatgggagacacagaggagacggctccgaagaaacccgcggcaaaatggcctctcatcaaacccaaaaagaatcttcagattagccacctcctagatttcgatctcttttcggtccagaatttcttctcctctgctgaatcaaaggcattcgttaaaattgctgaagaaattggttttgctcatcaagggagtcgaggtggcgaagcatacagagataatgatcgaatttcggtggatgatcctgtccttgcagatactatttgggagtctggacttagcaaacttttttctgatattaaaattcgaggaaaggttgctgtaggtctcaatccaaatgttagattctatag

SEQ ID NO: 103957 - DNA, 312 bp, Glycine max
  Peptide Sequence Number=SeqID_220735
atggatggaataagggaatatacccttttctgtggtctgaataatagctaccataaatgccactttgctggaagtggggatccaaggactagggagatggcgaggggaaaggttcaactgaagaagattgaggatacaacaagccgtcaagtggcgttttcaaagcgtcgaagtggtcttctaaagaaagcttacgagttatccgttctttgtgatgcagaagtggctgtgatagtcttctcacagaacggaaggctctatgagttctcaagttctgagtacgttttccttcactatacttgttctgcttaa

SEQ ID NO: 103958 - DNA, 186 bp, Glycine max
  Peptide Sequence Number=SeqID_220736
aaaaagttgaagtctgtgaagctcttgcttagcgcgcaagacaggtccagcgcatctccacacttagcgcgaagaaaatccacgaagaagtccaaaggcgcgcttaacgtgaaagcccgcactaagcgtgaggtcgcgtcgaaattaaactatcttaataccaatccctacgcaactacaaactga

SEQ ID NO: 103959 - DNA, 282 bp, Glycine max
  Peptide Sequence Number=SeqID_220737
atgcagcaactgaagttagactccgtaagcatgacaaagaagattgagcttcttgaacattctaaaaggaagctgctgggacaaagcgtgagttcttgctcttttgatgaactcaaaggaattgaggagcagctgcggacaagtttgcaaagagtcaggcagagaaaaactcaactatatacggaacagattgatcgactacgatctcagggtgaaaagcttatcttcagtgctatttacatggaaatgcttactagtgttattgaaatcctttgcgcctga

SEQ ID NO: 103960 - DNA, 942 bp, Glycine max
  Peptide Sequence Number=SeqID_220738
atgaaacgaagaactcggattaactacacgccagagcagaaggcgattatctgggacagatataagcaaggtgattccctgcatgatatcgccagaatgttcgacagatatcattcttctattatgcccactatccaccagactggtggataccgcccccctgtccgaaagcggcatccgttagcgctttcacttgatgaaagagaggaaatatccagagcgctggtagcaaaaatcagcatcagggcgatcgcaaacaaactatcgagagccccctcaacgattagccgggagataaagaggcacggtggtgcaaatcaataccgtgcatcaaaagcggatactgctgcgtgggaaaatgctctgagaccaaaaccttgcaagctaattgaaagacccacactgtgtaaaatcatcgcagagaagatgcatcaggactggtcgccggaacaaatcgccggttggctgaaacgctgttatccggataatcaggaaatgcatgtgtcacacgaaacgatatataaaacgctttttatacaaacccggggtgcattaaaaaaagagctgcagcaatgcctcagaagcggaagagtcgtgcgtagatccagaacatcatcgcttaaagggaaaggattagggtcaatccgggatacgatctctatcagcgaaagaccacctgaagccgctgacagagccatacccggtcactgggaaggtgacctgatccagggctctaaaaactcctatatcgtcaccctcgtagaacgtcattcccgttttgttatgctggccaagatcagggacaacaagaccataacggttatatctgcactcatcaaacaagcccgggaattacctgctgagctttataaaacattaacatgggaccggggcgctgaaatgaccagccacacccggtttactgtagccacagatatccag

SEQ ID NO: 103961 - DNA, 609 bp, Glycine max
  Peptide Sequence Number=SeqID_220739
atggtgcaaaataaggacaaggaacttagaggcagtagcaacgggcccatcggtggctaccataggtggttgaaagcctacatgcaagttgaagttccggaggaggacgaagaggtgcaggccctcaagacagaaatcgagaaagcccaaatagtcaaagaaaagttcaaatcagcagctcttaagatccgaaaggagaatgccgaactgagagacgtaaatatagccaccaccaaggccttagaacaagagaccaaaagggcccgtagggaagaacatggccggaacaaattccgaggggctctgtggggcagtaacaacgagcttaagctccggagagaggaaagggaccaatcacgagtagacagtttgatcttgaaggatgaattgaggatttgcctaaggtccaagagaagcttgtctcagcggttatgcgagaccgagaccaacatgttagccatcatcagcaagtaccaagaagaattaaatctagccacagcccacgagcacaaagtggcagacgaatatgctcgagtgtacgtggaaaaggaggctagaggaagggtgattgactcgttacatcaagaggcaacgatgtggatggactga

SEQ ID NO: 103962 - DNA, 1116 bp, Glycine max
  Peptide Sequence Number=SeqID_220740
atgggcaaggagtggcatcgggatggaaggtcctccaagagaggtggaggtgctcaaacagaaatcccttccggttgcatgtgtgcaatgtttcaggtatttgattatcatccttttcacttttccattgaccagcaacaatcttctttcaagtctcgcaccccagaagaccacactgtccccaaaggagttgaagcaccaaggagtagcttggagtcagaaactggtactacagtgtcatcaatctcaaaagaggaaaattttaaaataccaaagaacattcgaatcaaaacaagagggagcacaagatcaagaacagaaagttttagtgatttttcctcagaaatcggtgcctctccagggaccaagacaccaactttggttgcaagattgatgggtcttgatcttcttcccgatgcacattcctcttcttccccatgcctttccactccaaaccttcacaaaccacagcaacacatcaaaataatcaaacatagaaacagcactggcagtaacgccttgcctgagactcctagaatgtcctctgcaagaagatcagatgttgagcatagacaatctctccaaatcaacaaggagaacaacacagtcccctatgaggattctgagtctcctcggttttcattttcaaagaggaaatatgatgagaacaatttcaggagtccaagccactatgccaggcaaattgtgaaacagattaaagaaagtgtgagcaggaaggttggactagacatcaccaacactgtcaagaacagagaacaaggaagagaagaatctgtaggccaattcaaattcaagaaaaaatctaaaacttcagtgaatgaatccagccctgtaaaacactcaaactcatcttactccccaaggctcaacagattcattgataccaaacacaaaccaagcactacaacacaatcaccaactactccaaaaaatcaaaacatacacatactaaaaccaccatcaacaactactccaaaaaatctaaacacgcactcagtactaaaaccaccatcacctcctcctgttgtcaacattgaaacacagctttcaagagtttctacaaagccaaagcctcaagcatcgcctgagaccgag

SEQ ID NO: 103963 - DNA, 849 bp, Glycine max
  Peptide Sequence Number=SeqID_220741
aaccaaaaatcagtaacaaaaggcaagaacactggcagtggaaagttgagttcccgggtcaacaagcctccacagacatcaatcagaaacaagcaagaagagtcatttattactcgtcctccatcagccactaaagcaaatgacatcaaaaccaaaagcaagagaactcatccactttcaagcaatcttcttaataacctcaacacggttccaaatcttctccctgtcaagacaggaccttctcctcaaaaacagtcacagccgcaggtacgtgatgatgatgctcgagatgaaagacgcagcgcacagttatttagtagttcgcgcccgacgtacaaacaagaagcgccacgatcacacccaccccgaggagcaaccaccagcagcgatgacgacaaacttcacggcacctccgccaccaccaccggcgcagacgacgacgaaggaccagaatatcagtacattacaagcattctaactcgtagtaccaccactggaccccacaacagcaacagcgctacagcactaataccccacctccagtttcagtggttctctccgacacaccccttggacccttccgtttttcactgtctcgagcactacccaacatccaattcctttgtttccttccccggcgacaacaaagattgcatctttcagcggaaacagcatctgggtccgcgctgcaaccgtagattgctgttcgatttggtcgacgagttgctgtcggagattctggttcggccgaggcgttacagagaggcgttgttggagacgacggtgtgggagagggttcggagattcccacgtgcgaagtgtgaggttttggaggatatgatgcgttga

SEQ ID NO: 103964 - DNA, 405 bp, Glycine max
  Peptide Sequence Number=SeqID_220742
atgtgcataataggaaaaaaatacattcaagaaaactattctaaaattcgcaatgtggagcgtgagcttgcaaatctttcactggagatgaaacttacagctgggccaaaaaaagcagctcttgaacatttgagaaagaaaatagaggaatcaacagaaagaattcgtgtggccaagctaaaggaagaacaggcacggaaggtgtgggaatcagcatcaaaagtagtaagagatgaggaagcattaaagcaaaagttatgtgaagacttgagtaatctggttcaagagagcagtaactctcagtttgctcggctggaggaattaaaaagaagattggaagctttgaatccaactcgtgcatcaactaatctttatcatatctatttagttagtggtggcttctaa

SEQ ID NO: 103965 - DNA, 213 bp, Glycine max
  Peptide Sequence Number=SeqID_220743
atggatgatttcaatccttttactcgtttgcacgtccttaacacgttagccagtcacaaattgacgcagaaagtttttaaacgagaatccttggcaaaaacggaaattagattatttaatttctacctagttgacgctaatgcacttgcacttgcacctgccgactaccgtgccgcaccagcatcgcagagttctcaacgttttaaaaattag

SEQ ID NO: 103966 - DNA, 476 bp, Glycine max
  Peptide Sequence Number=SeqID_220744
gtgcagagagaggaattgaagctagcatgggaagaggtaaggtggttctggagagaatacagaataagatcaatcgccaagtaaccttctcaaagcgcagaaatggtttgctgaagaaagccttcgagctatctgtgctatgcgatgctgaaatcgctcttatcatcttctccagccgtggcaagctttttcaatacagtagcactgagtatttttcttccctcatcttatatattcccagcattaacagaatcattgataagtatcgtcaatgctgcttcaacatgtctcagactggcgacgtaactgaacatcaatcggagcaggagcttttgatattaagagtcaagcatgaatcactccagcggactcaaaggaatcttctgggagaagaactagagccacttagcatgaaagaattgcatagtttagagaaacagctggatagaacgcttggacaagctcggaagcaccta

SEQ ID NO: 103967 - DNA, 445 bp, Glycine max
  Peptide Sequence Number=SeqID_220745
gattggtttcgagaattacaagaggggttcaacaaatcagacttgccaagtcaatgcacttatagatataaggtgtacattgaaggttctgcttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacatcacagagaaaggaaagctcaattcaacaagttgaatcatgggagaaaagttactgcgataatcaaaccataacatcttaa

SEQ ID NO: 103968 - DNA, 153 bp, Glycine max
  Peptide Sequence Number=SeqID_220746
atgaattcattgcctggcgttgttcatgtgtcctccgttatcaagcgcggagcctctgaaaaaagaaggagtagagacgagagtcgtcatcacggaaagggcaggacggaccaaatcagtgtcttatctttgctttcctcttatctccgatga

SEQ ID NO: 103969 - DNA, 288 bp, Glycine max
  Peptide Sequence Number=SeqID_220747
atggaaataaataccattccttgttgtgcatctgctagcaatgaaagtgacatcaataatatctttcccaatggctgcttgaaagtgatgaaatcctatttacttgttaaggataaccttgaaaagaaacagttatgtgacaacacaataacattacaaatagttagtcagataaggatactgccttggactacagggagcaagtatggttcaagttgctggaaagcacaggattgcacacttattggaatcaaggccctgcttgtgatcaataatttagaagcataa

SEQ ID NO: 103970 - DNA, 339 bp, Glycine max
  Peptide Sequence Number=SeqID_220748
atggcagttgcggctgagagtggggcaaatgcacgccctgccggcgatctgccaagtggcggttgccgaaaaaatggcatggactcatcgatggcgtttgtttcctacactctcaccattgcatatcttatatcacccattacattattacactgtgaaaagtccattccaataatttgcattaaatggaaagtgtgcaataaccctgatccattggggagagaaattgatattggttcctacaaaattgcttttcacccttaccatgaatgcatagattatcacccttttgcttcttcccttccatgtcggcaaaccaactctccttgcgttacataa

SEQ ID NO: 103971 - DNA, 387 bp, Glycine max
  Peptide Sequence Number=SeqID_220749
atggcccgagcaactgtgtcaacaatttccttggacattgcctttattatggctttcggactagcatgtttgggggtgatagtaagggtatccaaacatgctatcacacttaatagaaaatctcttgctcccatcttcattgatagggagaatgggcggacaactagttttaaggaagctgttaggaaagtcatgctcaaaataaactttggagaacctcataagcgtgtttctccgaagtctttctatactaattcctggcctgaatgtttctgtcaaacatctgcacagaaccctgcagaaaaatgtctcccaaatgatattctaaatattatgaacaacgaattagataaaacaaagacagccgcaaattctacaatatcttga

SEQ ID NO: 103972 - DNA, 1860 bp, Glycine max
  Peptide Sequence Number=SeqID_220750
atggctttctcttgtaaacttgactgcttcattctccctgcctataaaccccaaaactccattctcccactttcaatccaaccttcctccttcctcccatctccttcttccttcaagcctcaaaagcttcccttcggaatccgctatggttctaccatcagagtcacttcatcatcctcaaccccttccacaaccattgccgaacctgaaggcattaagattaaatcgattccaaccaagcccatcgagggacaaaagactggaaccagtgggcttcgaaagaagtatatggattgtgttagtgttgatatggatggaggcgaggttatgattggtgatacatttatgcttgaaaatgaaataaagttgaaatgttgggtgaaagtgtttatgcaagacaattacctcgcaaattggatccaggccctgtttaattcattgcctcccgaggattacaagaatggcttgttggtgttgggaggtgatgggcgatactttaatcgggaagctgcacagataataatcaaaattgctgctggaaatggtgttggaaaaattctagttggacaggaaggtattttgtcaacaccagccgtttctgctgcaaatggtggatttattatgagtgcaagccataatcctggcggacctgaatatgattggggtattaagatctctgtgataaagatagctgacattcttgatgttgacatatcaaaagttggggttacaaagtttggaagcttcagtgtggaagtaatagacccagtctctgactatctggagctattggagacagtattcgattttcagctaatcaaaggtcttctttcacgtccagattttaggtttatatttgatgccatgcatgcagttactggtgcttatgctaaacccatcttggttgataaactcggtgctagtctggattcaatttcaaatggaatccctttggaagattttggacatggccatcctgatcctaatctaacatacgcaaaggatcttgtcaacattctgtatgctgaaaatggacctgattttggagctgccagtgatggggatggtgatagaaatatgattttaggaagaagtttctttgtaactccttcagactcggtagcagttattgcagccaatgcaagagaagcggttccatacttcaagaatggtgttaagggtcttgctcgatcaatgccaacaagtggtgctttggaccgtgtccccactggttggaaattttttgggaatcttatggatgctgggaatttgtcggtttgcggggaagaaagttttggaacaggttctgaccacattcgtgagaaagatggcatttgggctgtcttagcttggctttctattattgcacatcgcaacaaagacaagaagccaggggagaaattgatctctgtatctgacatcgtgacagagcactgggcaacttatggaaggaatttcttctctagatatgactacgaggaatgtgaatctgaaggtgccaataagatgatagaacacctacgagatattgtgtctaagagcaagcctggtgatcagtatggaagttatgtcctccagtttgcagatgattttgcatacactgatcctgtagatggaagtgtggtatcaaaacaaggtgttcggtttgtttttacagatggttcaaggattatatatcgtttatcaggtactggttctgcaggggcaactgttagagtgtacattgaacagtttgaaccagatgtctctaaacatgatgttgatgctcaaattgccttaaaaccattaatagatttggcaatatccatgtcaaagctcaaagacttcacagggagggagaagcctacagttatcacataa

SEQ ID NO: 103973 - DNA, 1152 bp, Glycine max
  Peptide Sequence Number=SeqID_220751
atggcaatagactgcataacaagtatacccatgatgcctcaagcaccaccccaagaaacaaccaaagaacaacaagaacagcagccactggtgtttgatgcctcagtcctcagacaccaacttcacataccctcacaattcatctggcccgatgaggagaaagcatgcttggacgaacccgagttgttggtcccattcattgacttgggagggttcctctctggtgatccagttgccgcagcggaagcctcaaggcttgttggtgaggcatgccaaaagcatggcttttttctggttgtgaatcacgggattgatcaacggttgatatctgatgctcatctttacatggagcacttctttggtcttcccctgtctcagaaacagagggcacagaggaagccaggggagcactgtggttatgctagtagcttcactggcaggttctcctcaaagctcccttggaaagagacactttcctttcagtactcagctgacaaaaactcatcaccaactcttgtcaaagactacttgtgcagtaaaatgggcaatgagtttgagcaatttgggaaagtttaccaggattactgtgatgccatgagccgtctttctttaggtataatggagcttctaggaatgagccttggagttggtagagcctgctttagggagttttttgaagagaatagttcaataatgaggctcaattactaccctccttgtcaaaaacctgacctcactttgggcactggacctcattgtgatccaacatctttgaccattcttcaccaggaccaagtgggtggcttgcaagtttgtgttgacaatgagtggcattccatcaagccggatttcaatgcttttgttgtcaatgttggtgataccttcatggcactttcaaatgggagatacaagagttgcttgcatagggcagtggtgaatagccagacaacaagaaaatctcttgctttctttttgtgtccaagaagtgacaaggtggtaagtccaccatgtgaattagtggacaatttgggcccaaggctataccctgattttacatggccaatgctgcttgagttcactcaaaagcattaccgagctgacatgaaaacccttgaggcatttgccaactggctgcaacggaaaagtaactga

SEQ ID NO: 103974 - DNA, 354 bp, Glycine max
  Peptide Sequence Number=SeqID_220752
atggaccggctaccggcggcgtacgaggacgccatggatgcattgcactggatcaaaaccaccaacgaggacttctttacttcgcacgttgactattcccgatgctttctgatgggagagcgcggagggctgatattggttcagccgtttttcggtgggaccaagaggaccccatcggaggggtgtgatggggacctactggtgaaccgtcgggtggggttcgagaaatttctggaggagaagggtgtgcatgtggaggggcacttcttccgtggaggctatcatggggtctttctcagtgacccttccatggaaaacaatttgtaccatctcttcattcaaatccaaaaatga

SEQ ID NO: 103975 - DNA, 1995 bp, Glycine max
  Peptide Sequence Number=SeqID_220753
atgggtctcactacaggtccatccttcatcaccaccaccatcatgtcaatggaccaccaggaacgccggaagaagaccgtatcacagtcgcctccttctaccttgatggagttgcgctcagctggttccaatggatgtttaggaacgttgatacaacgcggttccgtcacggagtttgaaagattaacgaatcgcatcgtaggtctctccccacctgtgttgctgagttgtttcatctccgatctcaacccaaagattcgtcgagaagtacaagcattacaacctacgtcattacctcacgctacggctcttgctcgactccaagaagataagctcaacgatcgtcagaaatactctcgttcctcttttccttctccagaaccacgagcctcagcaccccttaaccaaagccagacacctcgacttaagactccatttattcagcgtacccaggaggatatggcctataggtgtgagaaaggcctgtgttacaactgcgatgagaaatggaactcatctcatcgttgtaagggtcgagtcttgttcttcattgccgactttgaggacccttttttcccggaacccagctcactagaaaaaccaccttccccaactgtcgaacctactcaatcctttgacccctcctcactgcaccctcacatcagcttacacgccatggctggcgtccctgctactgatacattccgcctctacggagttgtcaatcatgctcgtgtcaccattttggtagacagtgatagtactcacaacttcgtacaaccacgagttgtgaagttcttcaatttattaatggaggatatgatgctccttcgagtgcagatgggtaatggctctgttctggattgccgacagctctgctcctccacaactttgctcattcagaatcattctttcacggtaacattgtgtgtcttaccgttaagtggcgtcgacatcgtattaggggtagaatggctacgcactttgggcctaatcattactgattactcctccttcaccatgcaattcacccaccttggtcagcctattacccttcgcactgatgttcaatcaaatattgagccagctttggcccaccaggtaaaacgcatgatccacacccattcgacatcaacacttttccatttgtctctcttacccgttagccagcccgaaccatccatagacccggtccacctcatttccgccattaacaagcttttgctgaaatttagctcattatttcaccaacccacgaccctacccctaccttgccaacacgaccatcacatcaatcttattccctcagctaaccccgttaacgttaggccttacaggtatcctcattttcagaaaatcaaaattgagaaacaggtaatggctctgcttgactccagccttattcaaccaagccgtagtcctttctcttctctggtgttattggtgaaaaagaaagatgggatgtggcgaatgtgtgtcaactatagggcgcttaactccatcacggtaagggatcgttttctgcttccaactatcgaagagctcattgatgaattaggtcgtgctttgtggttttctaagcttgacttacgtcagggcttccatcagattttaatggtggataaggacgttcctaaagcagtttttcgaacccaccatggccattacgatgaatctcttgcagatcaccttcaccacttagagtgtgtttttaactccttatcgcaagcccagtattacctcaaactctctaagtgtttgttcggccaacgtcaacttgattatttgggccacgtcgtctccggtgagggcatacaacctaacccttctaaggaatcccaagctgcgttcgatacgttgaaaacaactatgactaaagccccagtgcttgccctccccaacttcacccttcctttttgccctggaaaaagatgcttcgggcactgctatgggtgtcgtcctccatcaacggagtcaccccatcgcattctttag

SEQ ID NO: 103976 - DNA, 636 bp, Glycine max
  Peptide Sequence Number=SeqID_220754
atggccactgacgtcaagacattcattcgtcagtgcaatgtttgtcaacaagtcaaacacgttgcacgcaaatcagccgacctgctccaaccaattccaatacctaatggcatttgggaggacctgtccatggattttgtcacgcacctcccaagctctcacgggttcacggttgtcttcgtagtagtggatagattttctaaaggagtccaccttggtgcattgccaacacactttacgatgttcaaagtggccaacttgtttcttaacaccgtatgcaagctccatgactttccccacagtatcatctctgatcaagacccgattttcatcggctccttctggcgagagctgttcaggttaagtggtacgacactatgcatgagcactgcttaccatccacaatcggatgaatgggcatataacacatcccaacatttcagcattggcgtcaccccttacgaggtagtatacggcaagcctcctccttccattcctagctatctcctaggttcttctcgcaatgatgtagttgaaacgatgatactcacaagagaggagatccacgctaccctcaggcgtaaactcctcaaagcccataacgctatgaagcactttgctgataagaagcaatga

SEQ ID NO: 103977 - DNA, 285 bp, Glycine max
  Peptide Sequence Number=SeqID_220755
atgtgtataggtccaatactaaagcacagtcatgaacaagaaaccagactttcaggcacgcagatcacctcttacgtccatcaaacagctagctgttcgttgaaaccattggtcactacggaaataggacaaagtagtatcatagcaggaaatacaaaaacgatacttcgtgtaacgatgcagatggctatgcctcaagcatgtcattcaccacttatggttatgcctagcacgatgcagatgtgtctgtttaatggctttttggatggaccaaaggttctctaa

SEQ ID NO: 103978 - DNA, 183 bp, Glycine max
  Peptide Sequence Number=SeqID_220756
atgacgacaaagggctctgccttggaagtcaaggactttgaacacaagccaattcatcgaagttgcagttttatcacgttttatggtattgcaagaagttgcaaacaaatgcagctgatatataaccacaattttggttgcgttgcgattataaacatgccaaaaaccttacgttgtggttga

SEQ ID NO: 103979 - DNA, 285 bp, Glycine max
  Peptide Sequence Number=SeqID_220757
atggatcaccccaagcatctagaagcatttgctcaactgagtttggatggaacagatcacagaatggcacttgctgaggcagggacaattccaattctcatagacttgatgaatgatgttgatgaggttgaggaactaagggataatgatgtagaggctcttgtcaattattatgttgatccattgtatcatgatagagtgtctgatgcgattaagattccttcgttcagaaatatgcataataagattgactcatattcgtgcattgaacgagcacatggctag

SEQ ID NO: 103980 - DNA, 315 bp, Glycine max
  Peptide Sequence Number=SeqID_220758
gagcaaaagccctgcttttgtcgaccaccccactttttgttaccgtgacccaagagtccggtggcatgcagagccacatgaccgtgggatccccagatccatattctcttttatgtttcctcttttatctgctctcaatgagtataggagtggagttattgacattctcattgggagtgtacaccacattgggtggcgtatagttgggaggcaagccatatggtgggtgtcgcaacctacccttcggcgggagggcgacgcagggctcataggtgcgtcttccaaggaaggaaggcacacggagtcgccaccaac

SEQ ID NO: 103981 - DNA, 120 bp, Glycine max
  Peptide Sequence Number=SeqID_220759
gactatgctattcagctacatgatgctattgacaaaaaccttctgcttcaggaaccattggttgttatgttgaccttaggtaaaatcaaggatgctacaagtgtgtctggtgttggttag

SEQ ID NO: 103982 - DNA, 516 bp, Glycine max
  Peptide Sequence Number=SeqID_220760
atggctcaagagaatcaacatataatattggttacatcggacaatgatgagaggaagatcattcgtagggaagttgaaaaacaaaggaggacaaacatgtctattctatgtgcatctctccgctcttcactcccttttgaactcatcaagggaaagcgttcggcatcagatcacataggcgaggctgtaaattatatccaaattttgaagcaaaagattaatgctctccaagtcaagagagataggctcaaactaatggttaattcaagtttattggaaactagtatcgatcaaccagaacattcaggtgcagtagtgaagtgtgtcaacatcaatctcattccagggggagtggaaattgccatatgtagtagtggcttagaggagggtagtaattcacctttatcagagttcatggaaatattgcttcaagaaggatgtgatgttgttagctgtgtttccactcttgctaatggaaggatatttcatgccattaagtgcgaggtaccttgctag

SEQ ID NO: 103983 - DNA, 189 bp, Glycine max
  Peptide Sequence Number=SeqID_220761
atgccgatctccccctgcgaaaggatcacgctcgcaagacacccagtggacccgaagaagtccaacagggccctggggtttccaactctggttatgggcctctgccagttctatagggtgcccgtccccccagcaaggtcatgccatcgtgacataggtaagtatgcacttctctcaactgatttctga

SEQ ID NO: 103984 - DNA, 694 bp, Glycine max
  Peptide Sequence Number=SeqID_220762
atgcagccgctgcgcgcagcgggcggcgatagcagtcaggttcatcgcgcccccttagaacggcgaattctggataaaggccagcagatcggcgttgaagcgatcgggatcgacctgcgccaacccgtgagcgccgtcggcgtatacgttcagctccgcctgttgcataagcttagcggctttcagcgccgaggcgccgatcggcacgatccgatcggcgtcgccatgcaccagcagcgtcggcctgtcgatcgccagcagatcggcggtgaagtccacttcggagaacgcgctcacgccgtcgtactgccctttcatgccgccctgcatgcccatcagccagaagtggtcgatcagccccgcattgctctccacctcgtcgcagtggagaccgtagaacggcaccgccagatctttgaagaactgcgagcggttgcccgccacgccgctgcgaatgccgtcgaaggccgccatcggtgtgccttccgggttgaccggcgtttgcagcatcagcggcggcacggcgcccaccagcaccaccttcgccacccgatcgctgccgtggcggccgatgtagcgcgccacttcgccgccgccgatggcgtggccgaccaggatcagatcgcgcagatccagcgtttcgatcagcagggccagatcgtcggcgtattggttgatgtcgttgccgtgccag

SEQ ID NO: 103985 - DNA, 768 bp, Glycine max
  Peptide Sequence Number=SeqID_220763
atggaatttatgcataaggctccagtgccgccttggagtttgatagtcaccgttttcggtgtgtcgagcaccaatagcgcttcgaggccatcaagggatggtctttccacagggagagacaagtatcctgacttccaaggagatatctcttgcagacattgggcacgactagtgacccctatggctaaatttgacccggagatagtcatagaattttatgccaatgcctggcctactgaggagggggttcgggacatgcgctcacgggtgaggggtcactgggtcccctttgatgcagatgtcaacagccagttcttgggtgacccactgattttgaagaaagaccagcaatgtgaattcagccagaggaggagacaggcagacggtttcgatgaggaagccatcgcccaactgttgtgcatgccaggacaggatttcgcccggaccgctgcagggaggcaggtatggatcatgcgcaccaacatgactaccttgacccagatatggatgacactgctgcatagcaatgtcttgcctagcgaccacaactctgacctccctctgcctaagtgtcagttggtgcatgccatcctgacacagatgagcgttcacatggcccaagtgattgctgatgccatttatttgtttgctggaatggcgcctactaggcaccctctggacctagagaagtccaacagggccttggggtttccggctctgatcacgggcctctgccagtcctacggagttcctatcacccccagcaag

SEQ ID NO: 103986 - DNA, 438 bp, Glycine max
  Peptide Sequence Number=SeqID_220764
atgcaatcacagggacttgcactgcctccggagcctgaggttgctccttcagggcctcgtgtcggcacaaaggagagttgtgttgatccctcagggaacgatccaaagatgggtgactcaaacaagtgtgggctgtacatcgaagcaaatccgccccacctggttgcccttggaagactttatgagggatcaacagttcacaacattcctttgttgcctggccaagtgaaggttggtgttgaggaggttaaagatgcacaagctcccgttcttgtacccactgatgaggttaccttagtggggcagacacttaacaccttccttgcttggccgacacatctcatgaaggctttatcagtacaacgtaattatttaactatgtttgatcagcaagcagttgtttctccagcaaaacctccacaaaggccggatcctgag

SEQ ID NO: 103987 - DNA, 303 bp, Glycine max
  Peptide Sequence Number=SeqID_220765
atgtctcgggcgtcatcctcctcagcttttgttttaccgaagaacactcagaatttagaggcaatctgtgttgtacgatgtcagaactcaaaccgagcatatcttggtatgaccaagcaaagatgtcttggtagttctttagcagggccatcaattcttcacggatgggccccatctctcggtccttctgagcgactatcttctccaactccgggggatgtcccacatcctcatctgtcataccctaatttcgtccggggacctttgcttgatgacatgcgacctttctttggtccttgtgag

SEQ ID NO: 103988 - DNA, 192 bp, Glycine max
  Peptide Sequence Number=SeqID_220766
atggatcgtacatggacggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 103989 - DNA, 375 bp, Glycine max
  Peptide Sequence Number=SeqID_220767
cagttcgaaaggttgactatatcgggaatccccggatctacgcttattttcaactccccgaagcatttcgtcgcttactacgcccttcctcgtctctgggtgcctagttcacgagttggagataagcggactcgaaccgctgacatccgccacagggatccagctacaggagaaccgggaacggagagcttcccccgccccccttttttttccgcccgactctttgctcttaagaatactgggttctatggtcggtccgcgacccctggatgccgaaggcgtccttggggtgatctcgtagttcctacgggggagatagtgcatcaagctgttcgcaagggccagcttgatcctcttccccaggatcccaaatga

SEQ ID NO: 103990 - DNA, 477 bp, Glycine max
  Peptide Sequence Number=SeqID_220768
atggtggagacacatgaaggaggcggagattatgcctttgctaacatggcagagttgtgcctagtacccgatgtcatcatccctccgaagtacaaggtgtcggacttcaataagtacaaagggactacttgctccaataatcacccgaagacatactgcaggaaaatgggagcatatgcgaaagatgaaaagttattgatgcatttcttccaggaaagtcttactggggcagccgtcacctggtatactaatttagaaccttcccgagtccgttcttggaaggacctaatgctacaacacatgtgcaagaaggagcacaaatctttcaaggaatacacccagaggtggagggacttggcagctcaagtagcgcccccaataacagagaaggagatgataacaatgatagtggacacgttactggtgttctactatgagaagatggtggatacatgccttcaagatttgccgatttag

SEQ ID NO: 103991 - DNA, 531 bp, Glycine max
  Peptide Sequence Number=SeqID_220769
atgaggttatcatttgcccaagagaaatgccttctagaggctattttagttgtaggggtccaaatcaccatggcaaatgcacttccagaagcttcaacgagtttcaagagtcaatttcaccatggaaagatcgggtcttttgaggccagatggcaaggacaaatagttagtcatacaaggagtcaattccttctaagaagaggaagcaaccaaaggaggcaacatctccaaagcaagctactaaagcttctaagcctcaataacctcaagtgcgagatgaacctactaatgacactgagaggtttttcaacaagtatattgaagctatatattatgccaatctcaagaggggagatctacaatgaaagaataaagctcaaagaggatgagtttcctaacgagaaacaagtttttgaggatagaggttggaaccaactgatgaaactaggagtttgcaatgaatccctagttagggagttttatgccaatgttgtactcaacaatgttgaacaagtggcctcaataacttaa

SEQ ID NO: 103992 - DNA, 267 bp, Glycine max
  Peptide Sequence Number=SeqID_220770
atgacctctcaaaaaaggtcatcctcaaagccgacgtgtaaggtctgggaccccacattcgccgcatcaaccctgacgtgtccaggttctggatttcggttagaacatttggcatccaccgtggagccgcgcactcggtctggcctcagacgcgagacccctctcgaagactctcatcctcattcggcagctgtggtagacatggacattttacggctgctccaaaaccgcatcgcaagatggagcaacgccatgaagaggagttga

SEQ ID NO: 103993 - DNA, 636 bp, Glycine max
  Peptide Sequence Number=SeqID_220771
atgtggggaatgaacatactgagaccactgtcaaaggtcacaggagtagtcaaatacttactggtcgtcatcgactacttcatcaagtggatagaagcaagaccactgtgggaaattatggctagcgaggtggaaaaattcacttggaagcacctcatctgcaggatgggcatcaagcacctagtcacctctgtcgaacatcctcagactaacggacaagcagaggcagctaacaaagtcatcctcagggccatgtgtactagactcaacaagtttaagggcctatggatagatctctatagcatactttgggtgtaccactgttcaccccagacaaaaaccaacgaaactccttaccgactcacatatgacacaaacgtcatgatccgcattgaagtcgggaaaccatcgacaaggagactattgttccagcaacagcaaaatgaagaaaatatgagggtagaacttgaaaccaccgaagaagtcaaagaaatggcaaggattagagaagatgctaccaaactccaagcagccaggagatacaatataaaggttcaaccacaaacctttcaacctagttccatcaaaccctctacacatcccatcacatctcattcgctcacccttcgagcttaa

SEQ ID NO: 103994 - DNA, 2454 bp, Glycine max
  Peptide Sequence Number=SeqID_220772
atggtgcatgggaggctttgtctggatctgattcctagcatgcttcatctgatgctagcctcttctctagctcattacctgttcttccgcatgaaaaatgtatgtgatgtgaacttgaatgaaactgcaaatggttatcaatctattgatgacatctcatctggttttaagaagctccatcaagatgcagatggaaatggttcacttgaagatggtgatactcatgcaattggacctgcccttcctgatgatgaggaggagcttttagctggcataacggatgattttgacctaagtggcttgcctggttcccttgaggacttggaagagtatgatctttttggtagtggtggaggtatggaactagaaactgatccacaggaaggtctcactgtggggttgtctaagttaagcttcgctgatagtaccgttggcaatggtttgcccccttattcatttcccaatggtgtgggaactgttgcgggagaacatccttatggagagcatccttctcgaacattatttgttcgaaatattaacagtaatgtggaggactcagagctgagagccctttttgagcaatatggtgatattagaaccctatatactgcatgcaaacatcggggatttgtaatgatatcctattatgatatccgtgctgctcgaacagctatgcgtgcattacaaaacaaacctctgcggcgcaggaaactagacattcatttctctataccaaaggataatccatcagacaaggatatcaaccagggaacattggtagttttcaatttggatccatctgtttcaaatgaagacctgcgtcaaatatttggggcttatggagaggtcaaagagataagggaaactcctcacaagaggcatcacaagtttattgaattctatgatgttagagcggccgaagcagcacttaaatcattaaacaggagtgacatagctggtaaacgcataaagcttgaaccaagtaggcctggaggagctcgtagaaatttgatgctccaattaaatcaagagcttgaccaagatgaatctcggagtttccgataccaagtgggttcacctgtagctaactctcctccaggtaactggttacagttcaacagccctgttgagcagaattcaatgcagactatcaattattctcctggttctaggatcataagcccaacaacaggcaatcatttacctggattagcttcaattttgcaaccacaagtatctaacactgtgaaggctgctgctattggcaatgacttggaaaggagcagtcaaggagagcacatatttaccggtatgaattcatcacacggagctacttttcaatcgcattcacttccagagccaaaattcagccaatatcgtggagcattgtcctcaattggtccatcaacttcaaatggatcctcagtggaaactttgtctgggccacagttcctatggggaagcccaactctctactcggagcataccaaaccttcagcttggccaagatcatctgtggggcatccatttgcatcgaatggaaagagccatgccttcccatattcaactcagaatagttcttttgttggttcatcacagcatcttcaccaccatcatgtcggctccgccccatcaggtttgccttttgagaggcactttggtttccatcccgagtcatctgaaacttcattcatgaataatgttggctatggaggcattggtccagggcataatgatggaaatcacatggttaatgtgggtggatctgttaatcctaacattactatcccgagaaatatatctgataatggttcatcaaacttcagaatgagatcttctcctaggcttagccctgtctttttgggaaatggcccttttccaggactgccacctaccactttggagggtttggctgaccgtgctcggagtagatggatagagaacaatgggagccaagttgatagcaagaaacaatttcagctcaacttggataagattaaaagtggtgaagatacaaggactacattaatgataaagaatatcccgaacaaatacacctctaaaatgttattagctgccattgatgaaaatcacaggggtacttatgattttctctacttgccaattgactttaagacattcaatgggaagaaatgggagaaatttaatagtgaaaaagttgcttctttggcatatgctagaattcaaggaaagtctgccctcgtgagccattttcaaaattcaagtctgatgaatgaagataagcgatgtcgtcctattctcttccactccgagggttctgaagtttgtgatctgattgtacaagaccaccaccttccctccaactccaacaatctaaacattcaggcaccaaggccaagtgagttctattcaagtgattttgctgggagtcctccaaaggcaggcccttctgcaagcttggatgcaaattaa

SEQ ID NO: 103995 - DNA, 309 bp, Glycine max
  Peptide Sequence Number=SeqID_220773
atgggctctttgaaggtgcctgagcccgatggtttccatgccatcttttaccaatgcgagtggcatattgttgggaatgatctggttaatcttgtgcataatttttattggaattcccaccaggtggataaggtcaatggtgcccacatctctcttatccctaagaccaacaatgttaacaaactatataaggtggtgactaagatgttggctagtcgacttaagagtatcattcaaaagttggttaatccttgtcagtgtggttttgtccctaatcatcaggcctctgataatattattgtggcttag

SEQ ID NO: 103996 - DNA, 1274 bp, Glycine max
  Peptide Sequence Number=SeqID_220774
gtgtcttcttaaagaggtatttctctctcatgaagacagatcagtacatcaagaacattggaaactttgtgcagagggaacaagagagtctacctgaagtctggaaaaggttgcaagagatgatcaaaagttgtccacaccatggcattactcaacagagattggtccatatattctatggtggagtgtccttacacaatatgacaagtttagttgttgcttgtaggggtaaccctatgataaaaccccttgttgatgccattaggatcattgaagatgtgtgctttaacccctataacaactcaggggataggaggactatgaagagagtcaatctcccttcacaacctgaaccaaatcctaagaaggaggatgtcaatgttgtgatgattaaaagcaagaggattcaagaggactccaaggataaaaaaggttcctacacttatgagaacccaatgccaaagaaggaaggggatgcaaagaaggacatattgacatctcttcagataagtcttccctttccttatagagttaagaatagtcagcgagatatgcaatttaagaaatttcttgaagttatgagtaaagtgcacatcaatctcccttttgttaaggctatttcacatatgtcatcttatgccaagcatttaaaagaaaatttatcaaacaaaggaaaattggcaaattttggcactatgggtcttaatgaggatttgacgccttattctttctttaagaaattgagcataacagacttagagcctacaaacatctttattctccttattgatcactcagtggtatatcctagaggagtgattgaggatgtgttggttaaggtgaacaagttcatctttttggctaattttgttatcttagatatggaggttgatgaggatatccctatcatattaggacaacctttccttagtacttttgatttacttgttgagcttagggaccttgactgggaattgaatcctaaagtggaggaaatactgacgtttctccattctcaacatggtcctggaccacccagttttgagaggatgggatggggcaatgttccaaagctaacaactcttgttgaggaacctcttggactagagttaaagccccctccttccaaccttgaatatgtttttcttaaacctccatcttctcttctagttgtgattgctgcaagtttacatgaaaatgaagaggagaaattgttgcaagttctcaaggagaagagaaaattgttgtcattgggtggagcattcgtgacatga

SEQ ID NO: 103997 - DNA, 117 bp, Glycine max
  Peptide Sequence Number=SeqID_220775
atggggccagggatgcaatgtaggatgaccatggccgttattgatgccgatgaaaattggttgggtcgtggccagttgagcacaactatagtactagcaggcatattgtcttattaa

SEQ ID NO: 103998 - DNA, 828 bp, Glycine max
  Peptide Sequence Number=SeqID_220776
atggagagtggcatgccccctcccggcaccactgatgcagggcccaaggatgtgagaccaccatgggcacgaggtgggtttgacaatatgctaacgagatcttttgacatgaaggatcttggtgatgccttggggattgagattcacaaagatagatcatgccatacactcaggttatctcaaaaggcttacattgttagagtcttagagagattcaatatgcaaaattgtaaacctggagatattccagttgtcaaaggtgacaaattcaacaaggaccaatgtcctaagaatgagattgagcgggcaaagatgaacgacaaaccttttgggagtgctctgggcaacctcatgtatgctcaggtgatgaggtacttgaaaaagactaaaaagtatatgcttgtgtataagagagttgacaacttggaggttgtgaggtacacagattcagatcttggtgggtgccttgatgataggagatcaacttctggatacatctttatgatgattgggggtgcgatatcctggaagagacttcgcattatggactccattgctaagccactgaagattttttgtgataacaacactgttgggttttatgcaaagcataataaaacttctagaagatctaagctcttggacttgaagtacttgactgatagagatcttgtgaaagatgattctatagtggtagattatgtggacacaaattccatgttggttgattcgttgatcaaggcacttaggcttgttgttttcaaacaacatgttgaaaatatgggcattgtgagttcttttgatatttttggtcagtgggagctttag

SEQ ID NO: 103999 - DNA, 309 bp, Glycine max
  Peptide Sequence Number=SeqID_220777
atgtcaagggtctgtttcgaaacaaatttcaatgggggtcttttatttacgtggattccgccattcctaccggcggcaagcttgtatcgtcattggcatcagcggtacacttgtatcgccattggcaacagcggaaccaaagctgactcactgcgcccatgccgctattcagactggcgagacatgctgagtcactgcatgttgccattggtactggcgggacatgccaacgtgggcagtcccgccattggcgcctgcggaacatgtaggggatggcatagcatgtgcgtttgcagtgtttcggtctga

SEQ ID NO: 104000 - DNA, 270 bp, Glycine max
  Peptide Sequence Number=SeqID_220778
atggtaacacacaatgcaattggcatgtccgatgtggtgcgcgaatggcgacaaactatagaagtggttctcgctgagatggcgactggggttgcggcttctactgacttgacaccaccactggtcgacattgacgtggtggaaagtgttataagtcacaacatcaaacaaggtttcatcaaacaaggtctcactcgagaagtttggaattggaaacctgagtctaagattaggattgaaaatttaggattggagaagaaggaaacatga

SEQ ID NO: 104001 - DNA, 873 bp, Glycine max
  Peptide Sequence Number=SeqID_220779
atgagttttggaagtagagggaagctgaaagacacaagcttgagcacatcagctgaaagcaacacgaacaccaagagagacaagatactggctcagtacagtgcagatgctgagattctggctgagtttgagctgtctggtgtgtctggcaaatcatttgactactcaaggatggttcttgatccttccaggttagtgtctgagcagaaaatgactgcatatttgtccaaaatccaaaggggtggccttatccaaccctttggatgtatgcttgcaattgaggaatccacttttaggatcattgggtacagtgataattgctttcaattgttgggtttggagaggcaaattgattcaaagcagttcatgaatctaattggggttgatgccacaacccttttcactcccccttctggggcttcacttgcaaaagctgcggcttccagggaaatttcactcttgaaccctatttgggtctatgctaggacaacccagaagccattttatgccatactgcataggattgatgttggggttgtgattgatttggagcctgcgcggatgagtgatccgacattgtcacttgctggggctgttcagtcacagaagctggctgttagggctatttcaaggctgcaatctcttcccggggaagatattggactgttgtgtgacactgttgttgaggaggtgcagaagcttactggatatgatagagttatggtttataagtttcatgaggatgatcatggtgaggttgtatctgagattaggaggtctgatttggagccttacttgggtttgcactatccggccacggatatccctcaagcttctcggttcttgttcaagcaaaaccgggtcaggatgtga

SEQ ID NO: 104002 - DNA, 228 bp, Glycine max
  Peptide Sequence Number=SeqID_220780
atggctaggtctaccaaaccgtccacgtttagaaagaggacaaccccaaagattagcaatgctaatatgtccacaaacgagacccactcctctcgattcgccatatcccttgccttgccttccaagtacttccgtgtctccaaacatgaagcatttcaaaggctggtcatagtattgggtgagcgatacaacggcctccgtgaatatctccgctatggtcaaatctaa

SEQ ID NO: 104003 - DNA, 501 bp, Glycine max
  Peptide Sequence Number=SeqID_220781
atgccccgtggtgacaaatccgcatataccgagaaacagaagcgccaggccgagcacatcgaggaaagcgaacgtgatcgcggcgcgagtgaaggcaccgccgagcgcattgcctgggccaccgtgaacaagcaggacggcggcggcaagcgtagcggcggtgcacgcaagggcgcgaagaaggcgaccagcaagaaggctgccaagaaggcgcctgccaggacgtcggccacaaagaaggccacaaagaaggccacgaccaaggcgacggcagcgaagaaggcacctgcgaagaaagcggtggcaaagaaggcacccgctcgcaagactgccacaaagaaggccgcaaagaagacggcgaagaaggttgcggccaataaggggagtacggccgcctcgcggagcgccgccgcaaagaaggcggcggctacccgtgcccgaaaggcagcgacacgcaagaccgcagcgaaaaaggctgcccgaacgcggagcagagattga

SEQ ID NO: 104004 - DNA, 2349 bp, Glycine max
  Peptide Sequence Number=SeqID_220782
atgaagatgctcttgataccacatgatgcaagctccaatggagcttgcatcaggatgatctgtgattgccatgcaaagccggttaaggttattcagagtgaagaactaaggcaacctctttgcttggtgaactcaacccttaggttaccacatggttgtcacactcagtacatggccaacatgggctcaattgcctctctggtgatggcaattatagtcaatggaaaggatgcaacaaggctttggggtttgctagtttgtcatcacacttcaccacgctctgtgtctttcctggttcgctatgcttgtgagttcctaatgcagacttttggactgcagctttacatggagattcaattggcatcacagatggcagagaagagaattcttaagacacaaaccttactgtgtgacatgctccttcgtgatgcaccattcggcattgttaatcaatccccaagtatcatggatcttgtgaagtgtgacggggctgccttgtattatgaaggaaactgttggctgttaggcacaaccccaactgaagcacaggtgaaagacatagctgaatggctacttagtaatcatggggactcaacaggtttgacaacagatagtttggccgatgctggttatccaggcgctgcttcactgggcgatgcagtttgtggcatggccacagcaagaatcaattcaaaacatttcttgttctggttcagatctcacactgctaaggaagtgaaatggggaggagccaagcaccatccagaggataaagatgatggaggaaaaatgaacccaagatcatcatttaaagcttttcttgaagtagtcaaaagcaaaagtttgccttgggaagtgctggaaatcaatgctattcactcattgcaactaataataagagattcattccaagacacagagaacactggtccaaagactttaagttatgtacagaaaagtgacactgcagctggagggatggatgaactcagttcagtagcacttcaaatggtgagattaattgagacagcaacagtcccaatttttggggttgatttaggcggtgtaatcaatggatggaatactaaaatagcggaattgacaggtctacaggccagtgaagctatgggaaaatccctggtaaatgaaattatacatgcggactcgggtgacacttttaaaaatactctaagcagagccttgcaaggccaggaggacaaaaatgttgagttgaaaataaaacactttgggcttgatcaacaacaggaagttgcatgtctcatggtcaatgcttgcattagtagggactacacagatgctattgttggggtatgctttgtaggtgaagacatcacttatgaaaaagtggttcaagataaattcatcaagttggaaggtgattacaaagcaatcatacagagtctgagtccactgattccacccatattttcttctgatgagaatgtctgctgctctgaatggaatgcagcgatggagaggctaactggttggaaaagagatgaagtcataggaaaattgcttcctggtgaaatttttggaagcttttgtcgactaaaaggtcaagatacactgactaattttatgattttactataccgtggaataagccgtcaagattctgagaagttaccatttggattttttcatagaaatggagaattcatagagacttacataacagcaaacaagaaaattgatgctggtgggaatatgcttggctgtttctgcttcttgcagattgtaatgccagacctgaatcagccttctgaagaacacaatcctagaggcagggaaagcatttctgaatctgaagaggcatatatactacaagagatgaagaaacctttaaatggtatacgattcacccgcaaacttttggaaaatacaactgtctcggaaaaccaaaaacaatttcttgacactagtgatgcatgtgaaagacaaatcatggcaattattgaggatacacacttgggaagtattaacgaagacactttgcagctaaacgtggaagagtttgttctgggaaatattttagatgccattgtcagtcaagtcatgatgttgataagagagaagaacttgcaactgtttcacgaaattcctgatgaaataaaaatgctttctctatatggtgaccaaattaggcttcaggtggtcttgtctgactttttgcttaatgtagtcagccatacggcatctccaaatggctgggtagaaatcaaggtttcacctactttaaagataatacaggatggtgatgagtttatccatctgcagttcagttgtccactatggaaattgacattggtcacaaggtgtaggtag

SEQ ID NO: 104005 - DNA, 546 bp, Glycine max
  Peptide Sequence Number=SeqID_220783
atgttggaggagaggctaagggccgtagaaggtagcaactatgacgttggggaggttgttgattttggaacaagttgtccaaaaggacatctgatgatgtactatagaaagatggcatcacatgcttgtaatgagaagctactcattcattgcttccaagatagcttaactgaggcaactctcaattggtacatgcatataaagcaagcacatattcgttcttggaaagatctagtatatgctttcctaaagcaatacagatataacatttatatgactctagataggttcgagttgcagatgatgtcaaagaagaacggtgacacattcaaggaatatgcacaaagatggcaagaagtggcaactcaagtaaaacctccttcgtctgacaaggaaacaatgatgctttttattgatactttgcgagcaccattttatgacaagatgattggaaatatttcttctagcttctcagatatagtggttatcggggaaagagtggagaatggcttgaggagtggaaagatcacccttgattttttctag

SEQ ID NO: 104006 - DNA, 282 bp, Glycine max
  Peptide Sequence Number=SeqID_220784
atgggtacaatctcagggactaaattgcctattcactcaattgcccattctggtcaaggtattccttccaatgttattcatgaaatggttgaaggagggaatcaatggactacacaggaaggtctaggactatatatgtccaggaaaattctcaggaggatgagtggtcatgtccgctaccaaagaggacaagatatgtgctattttctcattgatcttgaaattagaacaagaaaagaaaggcaaaggaatttgcatgcaaagacaagcatgttaagttag

SEQ ID NO: 104007 - DNA, 1644 bp, Glycine max
  Peptide Sequence Number=SeqID_220785
atggtagaagaagatagggagaaaaccatattcattacaccgtggggcactttttgttataaggtcatgccattcaaactaaagaatgttggggcaacataccaaagagcgatggtgacctttttccatgacatgattcataaagagattgaagtttatgtagatgacatgattgccaaattgaaaaatgaagaagatcatttggaaaagttattggggtttgtagtcagccaaagaggaattgaagtggatcttgacaaggttcacacaattctggacatgccacctccttgcagtgaaaaacatgttcaattccctggaaagcctctgattatgtatctgacagtgttggatgggtctatcggttatgtgttaggacaacatgatgagtctagaagaaaagacgtgggcacctcattgcttaaggaaatacatgctaagccatacgacttggttctcttattggagtatgagattgtgtatgtgactcaaaaggcgattaaagataaccttgaaaaggctagcaatgagtttctttttgaatggagatgtgttattaggagaaatcatgtcatggtgttactcatattcgtagatatagctgaagcacaaaggattatcaaagaagttcatgaaggcttatttggcacccacacaaatgggcatgccatggcaagaaagatcttgagagttggttattattggttgacaatggaggttgattgctttagttatgtgaggaagtgtcataagtgtcagacgtatgcagataatatcaatgctccacctacttccttaaatgttttggcttcccctaggccattctcaatgtggggaatggatgtcattggtcccatcaaaccaaaagcatcaaatggacatgacttcatcctagttgcgattgactacttcactaagtgggtggaagccgcttcatatgctcgtgtaacacagaatgtgatagtgaagtttatcaaaagggagttgatttgttgctatggcgtgccaagcaagctaataactaataatgccaccaacctgaacaacaagatgatgacaaaattatgtgttgattacaaaatccaacgtcataattcttctccatatctcctaaagatgaatggggcaattgaagcagcaaacaagaatctcaagaagataatccagaagatggtggtgacatacaaagattggcacgaaatgctaccatttgctttacatgggtatcatacctcagttttcacttcaacaggtgcaactccatttttcttagtatacgggatggaagcaatcttacccattaaagttgaaatcccttctttaatagcgatttgccatggccagttataccaaaagagattaaagaaagcatttgaaaggaaggtatatcccaaggaatttcaagtgggagatttggttctgaagaagattcttccaaacaaaaaagacaggcttggtaaatggacaccaaattataagggacactatgtggtcaagaaaacattcttaggaggagctttgatcctcacaaacatggatggtaaacaattctcatatccgggcgatctaggcaaagttagagtaacctaccaagttgaaagggacatcttgagaaggtgtggagcaagaaattggggcaaatga

SEQ ID NO: 104008 - DNA, 1422 bp, Glycine max
  Peptide Sequence Number=SeqID_220786
atggataagaaattagtgcaagtaggatattgtgaaagcaatgcatcgacgattgacacatcaccgatgtttcctaagcctttagttatccattatactaagggtgtcacctccctaactcttagcacaccacgtctatcactatacaagtatcgaaggctttcccatagaaagacaacaaagcagtgccatggaagtatggtgtggaagtttgtgttgatggatatgatggaaaagaaactcctaatacaaagtgagtatgcagtgatagaccaactgaatcgcattcctgccaagatatcactattgtcacttatactgaattcaaaacctcacaggaagatgttgttcaaggtattgaatgaggctcattttattcatgatatatctgaagagaaatttgaagggattgttggaaacatcactactagtaaccacctcacatttactgatgatgagatacatgtggaaggagcaaggcataataaggccttgcacatatcaatgaaatgcaaagatcatatcttggcaaaagtgctagttgacaatggttcttccttgaatgtgatgccgaggacaacactcaccaagttaccatatgatgaatcctacataaggccaagtgctttggtggttagggcttttgatgggtcacatagaaaggtaattggtgaaataagcctacctatccacatcggtcatgttacctttgaggtagtatttcaagtaatggacattgtaccagcttatagttgccttcttggaagaccttggattcattgcacaagggctctaccttttacctttcagcaacatgtcaaatttgttgttgatgaaaaattggtaattattttttatgaagaggacttgctggttagcaaaccctcatttcagggacttgaaattgccaatgccacttatgtgaaggagggaaaaaccatctcaaaattccaaccatcaagtgcatccatgatggtggcaaaagttatgcttgagaatgagtatcactatcggaatggattaggaagaaatgcacaaggcttaagcccgctgcctaacttgattgaaaataaggactgctttggtttgggctataaacctccaaaggaggacaagaggaggattgcacatgagaaaaaaagaaaagaggatgaacacatcaactgggttcatgcttgcccgccaaatgctgagcttagcaattgggagattattgagcttcatatgattttcaattcaaaattaaattttgagtgccttgacaatcaggtggatgaggaaattgaggatgatttggaaccttcccttgaactactgagattggtggaacaagaggctaaagagatcaatccccatgaagaaacgactgaggtggatatgccaggtcttgatgctaggataatggagcataagttgccatga

SEQ ID NO: 104009 - DNA, 700 bp, Glycine max
  Peptide Sequence Number=SeqID_220787
atgtgtcctccacctttcgagtctggagccccgcgaattgattgcctagcgctagtcgccaattctccattctccacttttattcggagccccatgaattcattgcctagcgctggtcatgtgtcctccaccgtcgagtctggagccctgcgaattgattgcctagcgctagtcgccaattctccattctccacttttattcggagccccgtcaattcattgtctagcgctgttcatgcatcctcaaccatcgagtctggagtcccgcgaattgattgcctagcactgttcgccaattctccattctccacttttattaggagccccatgaattcattgcctagcgctgttcatgtgtcctccaccttcgagtctggagccccgcgaattgattgcctagcgctgttcgccaattctccattctccacttttattcggagccccatgaatttattgcctagcgctgttcatgtgtcctccaccttcgagtctggagccctgcgaattgattgcctagcgctattagccaattctccattctccacttttattcagagccccatgaattcattacctagcgctgttcatgcatcctccaccaacgagtctggcggcccgcgaattgattgcctagcgttgttcgccagttctccattccccacttttattcggagccccatgaatttattgcctagcgctg

SEQ ID NO: 104010 - DNA, 780 bp, Glycine max
  Peptide Sequence Number=SeqID_220788
atgcagaaaaagggtagggacattcatccacaacaagcacaacaaactcttcatatccttacaacagcacatcataactgcttctctagcatcacaatcattcacctgccccttagctttcagtattcacacgccacaatgaatgatctacacttcccgagccactccaatagccgccagttacaaccctttagaaaaaccagccatcatctttttattacctgctacctgagtccaactgctcacgccaaaatacaacttttccctgatacttcacttgtcgttctcaacacaatattggtgcttataaaacaatcttcatctcctcgccattaccaacatgacttcacaatcatccactgcctcgagcactacaacggaggcactcaccaaatcaaagtcaggcaacaccacaagaaattttacttcgctgatggactgacggagttcagaagagacttgcaaatttatgaatctactaccatcgacttttacgcttgcgaccaaaactggatattcaacttacatttcacaccgccactagaacagcaaacgtgcggaagacctcggctatctacaagaaaatatgtatggactgtagaagctactcaatccatgctcggtgccccttatccactggcacttccaccctgtgttgtaccgtatgttgatgcctgtgttcaacatatgataatcctgagaaaatatgtccctccccttcaatggaacgtgaccatcattgaccctggcattggcgaaaaatccattgttcgaccttag

SEQ ID NO: 104011 - DNA, 1875 bp, Glycine max
  Peptide Sequence Number=SeqID_220789
atggcgagagatagattggcacatagtgaagtacataatatcaggctaaaattgattgctgaccatgaaaaagatggtcgtatatataatgtgcctactgtttcagaagtagctgcacttattgcaggtgattttgatacatattcaagaagagatattattcttgagactcggaatggccaattaaaaaggatagatgaattgcattctagctatctaggtttacaataccatctattatttccttatggcgaagatggatatagacctgacatacttcatcgtgctacatcaagtggtcaaaaaagaaagagaaatcgtcttacaatgagggagtggtttgcttttagactacaatgcatgtcaaatgaagcacaaactttgttgcactctaggaaactcttccagcaatttgtggttgaagggtatactatggttgaatcaaaaagactttccttcatcagaaacaaccaaaaaaaacttagagttaacaagttttgcagcttgcaacagtcattggatgctggtaccaccaaaggcttacaaaaagaatttcaaaaacgaggacttcctcatgtccatttattgttgtttttacaccccgacaataaatatccatcttcagatgatattgatcaaataacatcagcagagataccttcacaggaagatgacccagaactgtatacattagtacaaaaccatatgtttcatggcctatgcggaattctgcgaagagaatctccatgcatgaaagaaggtaggtgtagttgtttctatcctaaaatgtttcagccccatactgatgctgatggttatctagtctatcatagaagagacgatggtcagacaatttccaaaaatggtgttacaattgataacagatatattgtaccttacaatccaaaattacttagaagataccaagcccacatcaatattgaatggtgtaaccaaaacacttctatcaaatgtttattcaagtacataaacaaaggatatgatagagtcattgttgttatagttcatgatgacaatgatgcaatttaccatgctacaacccagaatgatgagatcaaagaatatctagattgtatcatgaacaaacctaaagaagtttgggaccaaacttggcattggttagctgatgacattgcatatcataataggaaaacaacaacaaatacagatcaacaagcatcaatttataaacaaattattcaagttgtcaacaaggatgaaggtgccatgtttttcctatatggatatggaggtacaggaaaaacattcatttggaaaacactagcaagttcattaagagcagacaacaaaattgttattatgattgcttctagcggcatagcttctctattgttgcctcgagatagaattgcacattccaaattcaagatccctgttccaatttttgaagactcaacatgtaatatacaccaaggaagtcaactagttgaattactaaatcaaacatgtctaatcatttgggatgaagcacccatgactcacaaattttgttttgaagcacttgatgaaagtctaagagatattattaaaggtaaatcaagttcaaatcagatctttggaggtaaagttatggtgttaggtggagatttctggaaaattctaccagtcattcctaggggcagttgctctgacattgttcatgcaacaataaattcctcttatctatggaatcattgtcaggtattaacactaacaaaaaatatgcgtttacaaagcaacacacaagcaacagataaagaagaaattgccacatttgcacagtggattttagacattggagatgaaattattggaaatccaaatgatggttatgctatagtggaaatcccataa

SEQ ID NO: 104012 - DNA, 283 bp, Glycine max
  Peptide Sequence Number=SeqID_220790
atggttcatggcccatgtggaacttcgaaccctggatctccatgcatgaaagaaggcaagtgcagccgtcacacaattgagaaaaatggtgttataatttataacagctacatctatcttcctgacagatacatatgtccctgtgaatctacttggagaatctttgggtttccaatacatggcagagaacctgctgttgaaagattgcacttccatcttctaggccaacatagtgttgtctacgaagaccatgatgatattgatgatgtattgtctaagccaa

SEQ ID NO: 104013 - DNA, 156 bp, Glycine max
  Peptide Sequence Number=SeqID_220791
atggagggagagagaaaacgaaactacacctatgaattaaggattctgcacttgatcttcaagcctttggacctttattcgctcgggcgaatgaacaacttgttgtggctagtttctcttacttccaaggtctttagctttgtggactcacggtag

SEQ ID NO: 104014 - DNA, 573 bp, Glycine max
  Peptide Sequence Number=SeqID_220792
tttgtccagtgggatatctccaatccgctgccaggaagccagaaattcgactacgtgatctgtcgagcagccctgcaccacacgccggatccggccaagacctactcatcgttggtgtcccaactgaagccaggcggaaaggtcgccgtgtcggtgtacgcaaagaaagccccgatgcgagaagcgcttgacgatgctttccgtgccgcaattgttcccatggggaacgacgaggcattcgctgtggcgaatcagtttacaaggctgggggccgacctgcaggcttgcgcgggggagatcaggataacccaggatctgccgttccttggcatcaagacgggcacgtattcaattcaggagttcatctacgatcatttcctgaaatgttggcacaacaagaatttctccagcgagcattgtgatctgatcaattttgattggtatcaccccacgttcgcttatcgctattccgcggccgaagcggtcgcatttgcggagcgcaatggcctcgaaatcgtgaggttcacatccatcaaggcacagcattatctggaagcgatgctggctgaatag

SEQ ID NO: 104015 - DNA, 651 bp, Glycine max
  Peptide Sequence Number=SeqID_220793
atgtcgaatgcgggacggactcatgcaggtacgctacttgctcagggcttgccgccagtgcgtatgttctttccaggagaagctgcaatgtcccttgtcgtgtttgactcccatgccccgacggcgccggccgtcaccaaagccgaacgatgtgcacggagtacgctagcggctgcacagcggctcctgtacccggaaagtaacttgtcgcccatgtcacaggtggagctggaattggcgcgaagcgcacgtcggcgcccgggatatcccgcttccaggcctcggcgccggcgggcaggaaaaagggatcgttcttgccccacacggccagcagcggcggctggtgcttgcggaagtacgcctggaactccggatacttctggacgttggaggcgtagtccagcagcaggtcgagctggacgtcggtattgccgggccgggaaaccaggtggctttcgagcgcaatcgcgtcgggggccacaagggtctggtccggaacgccttcgaggtattgccaccggatcgaggccggcgtggcgaactcgcgcagggcgtcgcggttggcgtgcgatgggtccttccagtatttctggatgggcgcccagcccgtccccagcccctcttcgtacgcgttgccgttctgcgaaatga

SEQ ID NO: 104016 - DNA, 516 bp, Glycine max
  Peptide Sequence Number=SeqID_220794
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 104017 - DNA, 114 bp, Glycine max
  Peptide Sequence Number=SeqID_220795
atgaatgaaggaaatagcctaagcatgtccatgcgacactcacacttaggaaaactggacaacaagtgtcaaggtcaccctgtcatgcacagtcaactccctcccccatggtga

SEQ ID NO: 104018 - DNA, 648 bp, Glycine max
  Peptide Sequence Number=SeqID_220796
gtcgactctagaggatcccacaaagggctacatgccctcaccttcagagggctgcacgcccttgcctttagaggactacacgtcctcgccttcagaggtttacatgtcctcgcctttagaggactacacgtcctcaccttcagagggctgcacgccctcaccatcagaggactacacgtcctcgcctttgtagggctacaagccctcaccttcagaggactacacgtcctcacctttaaagggctacatgccctcaacttcagagggctgcacgcccttgcctttagaggactacatgtcctcgccttcagaaggctacacgtcctcaccttcaggggacaacacgtccttgccttcagagggctacgcgtcctcgccttcagaaggttacacaccctcaccttcagagggctacacgccctcaccttcaaaggattacacgtcctcaccatcagagggctgcatgccctcgccttcagaaggttgcatgtcctcgccgttagagaactgcatgtgctcgccttcaaaggtcgacacgtcctcgacttcagagggctacacgccctcgcctttagagggctacacgtcctcattttcagtgggctccacatccgcaccttaagagaatttaaggtcctctgcccttaa

SEQ ID NO: 104019 - DNA, 771 bp, Glycine max
  Peptide Sequence Number=SeqID_220797
atggcggttaaagaattatttcactcatcagatcaagaagcgggatatgaagaaagcactctactgcagcagcaggtagatccatacgaagaagaagaaactctatctctttctgaccttccaatttacagtactagtggctcaatttcagctagatggggtggtactgatgatttctccaaagaagatggaaaagactttggtggtgaccacgacgacaacaacgatgataatttgttcgagttcttcagtgaagaattcaccacatcatcaactaataattatgcaaccgcagagaacataatcttctgcggcaaactcattcccttcaaaaacattaatattcctccacgtgctgatgaaaggaatattattaatactgaacgcatgatcaatgtccaaaagggtattgcaaagcgcagttcaaaaggttcaaagagtagttttgaatcatgtgactactcatcgcttgggaaggtgtcgctggtgaggagtcccacaaattcaagatggtttttgttcatgtttgggatgtcaaagttgtccaccaccacagagatggaactcaaagatattagaaaccggcaaagccgccggaggggacccgcggcgacgatgattccggcgccggagaatggaaaagatgaggtggctgtgaaggagaagagaagctgcaaagggatgtggaagatgttgaagtcaatctctatggtgttaggttgccacagtagcaagattgcaaacgacgtagtaaaggctgcttttgtgtga

SEQ ID NO: 104020 - DNA, 198 bp, Glycine max
  Peptide Sequence Number=SeqID_220798
atggatattccttttgtgtatcatggcttgatggtgggtgggaatcctaggaaagcttctataagggatggtttcctagaggagtgcaggagtaaattggcgaaatggaaaaaagaattgtgtggtggaggaggtggggtaggtggattaacggtgcttgggaatgggattggtttactagggagtgccaagaggtga

SEQ ID NO: 104021 - DNA, 918 bp, Glycine max
  Peptide Sequence Number=SeqID_220799
atgggtgccgctccgctccgccccgccgctatagcggccgctacggccgctattgacaactatggtttagctcttgccgtccgagataagcttgagtcactgtgcagagagttacaacgccaaaataaaatgctgatggtatttttctattgcactgctaccttagaaactgattgtataatcatcatatttacaccacctttcagtttccaacttacttttccaagcattcaaaaggaagaatgcaaacgtgtatcaactgaggggcaaaacttaaggctggacttgtcagccaagtttcaagatgcaatcaaggatgtcagcaataagcttgaggagcgaaaggatgagtgcctttctcagctaaaggagaatgacatgttaagaaacaagctaagacagctagttgaacaatatgaactctctgagcagcaacatgcacagaagttgaagcaaaaatcattggaactacagcttgctgatttaaaaattaagcaacatgaggaaaaattggttcaagaacggtcacagataaaagtatatgcagaacaagtatctcagttattagcaactgagaagagtttacggttgcaactgacaactgatggagaaaaattccaacaattccaggaagcattgtctaagagcaatgagatttttgaaacattcaaacaagagattgagaagatggcaaaatcaatcaaggaactcaagaaggagaatcaattcttgaagagtaaatctgagaagtctgatgttacactcatagagttagttgatgagcgggagcgcatgaagaaacaactggagaaaactaaaaatcagaaagaaaaactggaatcattatgccggtcacttcaggcagaaaggaagcaaaattcttcagagaacaagagcaataactcggttcaaacatga

SEQ ID NO: 104022 - DNA, 216 bp, Glycine max
  Peptide Sequence Number=SeqID_220800
atgattcaaaaaggacaaatacaaggatcagaagggacaaaaagcacgagaaagaggacaaaactgaaatatttcacattccaaacacctttgtatgagaatcaaaaatctctctgcaaattaaggcagcaaagatccccaaccataacggttggtccacccttgcctaaaagtacattgactatattcctaggcttcctcttcggacagagttaa

SEQ ID NO: 104023 - DNA, 1143 bp, Glycine max
  Peptide Sequence Number=SeqID_220801
atggtgtcagggagcgacccggttgagtcttttttcaattccgttcaggttgtgaaggattcgctgtcgccacttgaagtgggtattcgcaaggcggcgaaggatcttgagcattgtttggcagggtcaaagaacaaggtcaatggtgtttgtttgattgccccagtgagggaaagtggtgaatttcagatctgtaatgtgaagaagaagaaagggttgtcaatgaaggttcctttgaaggctttatggggcatgttttcacagaatggtactggtaatggtggtagtagtaatagagctcaagtgggtaaggaagatggaccctcttgcaccaattgcttgcagtttgctgtgacttggtctttgttggttaatgggttccttcagtctctgccacttcctttcaaatctgggaagaagaagtgtcagaaagtgtgtgatgaagacaagctgtgttcttgcacgaagcctactgtttcatcatgtgaagtgaagcaaaatgaatccaaggggggtcagtttggtagagcagttagggagaagggtgtgaggaggaaggatgggaaaaatgtttcacttgagtgccttataggttttatctttgatcagctatctcagactcttcagagtctggattatggggtgcatgaaaacaatgatgaccttgacaatgggaaaactagtctgccccaaccttctttttctcattttggtcatgtgaatgcactcgcaggtttcttggaggagcacaaagtatatgtgaatagcttcttggggaatttgaggtttgcaaaggtgggtggtgtgccatcaagtgtgcctggagaagaaagcccttcaacaaacggagagggagatattagtagtaacaatggtaataatggtaatggtaataatgaaaacaaggatgaaaacggaggaaattcgccgcagaaggttgccaacaacatattcagtattcctctctctaacgtggagcgtctaaagtctacactttccacagtttcattgacagaattgattgaactgctaccgcagctggggagaacatccaaagaccatcctgataagaagaaactaatctcagtacaagatttctttagatatacagagactgaaggtatgacatcttatataggatag

SEQ ID NO: 104024 - DNA, 462 bp, Glycine max
  Peptide Sequence Number=SeqID_220802
atggctagaacacgaggtttaggtcgtgccataggtagacttgtaggcagagatagacatgatgaccatgctgcagctgatgttcccgagaggcgtaggcctactgcctcagcccgtagacaacaggttcatcagatgactacagatgcacgttatttggctgaggaagttgctgacatgactgatgatgtccctgatctggctgaggaggcacctgagatgcttgcggacgtagagggtgctgatggtgctgaggggtcagatgctgatgatgctactgagggattccctggtaggccacgtgacccgtcagtgctgacatcatttgcggaccatgttgcacatgctgtttggagtggacatgaacgtcctgatttgaagttggtgttacatgggaggaaggtgacactgattggaggccagtgcctgagattgaaggactggttgctgccacaggattaa

SEQ ID NO: 104025 - DNA, 237 bp, Glycine max
  Peptide Sequence Number=SeqID_220803
atgggggtgcaaatagcaaccaggcccacttgggccctccagaagattcctccagaaggcggttgcttttggaggaagccaccttgctcgcctgggcgagctggaaaatccgagccgaggcgcttccgtaaggtttccgtggggattttcgcgaagattttcagccgttcttcgacgttcttcgttcgttcttcatcgttcttcgatcttcaaccggtcattttctcgcctaaataa

SEQ ID NO: 104026 - DNA, 211 bp, Glycine max
  Peptide Sequence Number=SeqID_220804
ctctgaagaagccggcgggcgaattctgcattttggctccgtgtcggaagttcttgaaggcgatgaagtgcctctgccattagctggcgtatttgagtttccaactctcaaccaggcgttagccttctacaactctgaaaaatacgcacctatcaaggccgaacgccgggaagctcaggaagcacggatgttcatcgtcgaaaccgactga

SEQ ID NO: 104027 - DNA, 204 bp, Glycine max
  Peptide Sequence Number=SeqID_220805
atgattcagacttcgtggaatggttcgggaatgtgttgcatattggagatgaggttgctacaaagtcccatcacatggagtccacctccaatgggggttataaaggccaattttgatgcctcttcggtgaggagaggtaccgctaagagcaaggacttgatctttagaaatcaccttgggggggttatattcggtgaaacgtga

SEQ ID NO: 104028 - DNA, 937 bp, Glycine max
  Peptide Sequence Number=SeqID_220806
gagtatctggtttgaagctgcgacagtagttgctgttccaccagctgttgaaattcctgctggaagtgtgctgagatctgcattggcaggtggcctttcttgtgccctgtcatgtgcattactgcatccagttgatacaattaagactcgagtacaagcatcaacaatgtccttccctgaaataatttctaagctgccagagattggaaggcggggtttatacaggggctctatccctgcaattcttggacagttttcaagccatggcttgcgaactgggatatttgaagcaagtaaattggtgttgataaatattgctcctacactgccagaactccaggttttcagattttgtgcattatataatttagtattagttaaagctgttagaaaagtggttgagaacatagctaaactctgtgctgtacggatcccctgcgaagtgttgaagcagaggttacaggcgggtctttttgacaacgtgggcgaggcttttgttgcgacttgggagcaggatggtcttaggggtttctttcgtggaaccggagctaccttgtgccgcgaggttccattttatgttgctggcatggggctttatgctgaatctaaaaaggttgccgaacgactactagagcgggaactcggtcccttggaaacaattgctgttggagctttatctggtggcttggcggctgttgttacaacgccgttcgatgtcatgaaaactagaatgatgactgcacagggccgatctgtgtcgatgactttgatagccttctctatactaaaacatgagggaccccttggcttgttcaaaggagcagtacccaggttcttttggattgctcctctaggtgctatgaactttgcaggctatgagttggcaaagaaggccatgaataaaaatgaggagggcaaggcaggccgttcagagtaa

SEQ ID NO: 104029 - DNA, 399 bp, Glycine max
  Peptide Sequence Number=SeqID_220807
atgtgcacattgagggtactcccatctcatcacatatccaccaaacaaagtaacattgaagttgaaagctcgtatagtcaaaccccaaaactatacatatttcaccaactagtttcatactctaataaaattagtttaagagtgcttttgtgtgaaagttacgacaatgatgatggtagtagtggtagtgacaatggtagagatattagtgatgatagtgataatagaagtgacaatggtggtgataacgatatcgatggtgtcggtgacaatgatagcgatggtggtagcagtataggtgtcaacagggtagtggtgattggtgattgtggtggttattacaaaggtggtattggtagtgatgtgatggtaatggtaacggtgatggaggtggtatag

SEQ ID NO: 104030 - DNA, 312 bp, Glycine max
  Peptide Sequence Number=SeqID_220808
atgggtctcaagacatggcactatcagcagcacgattacacgtccccacttcttttgctacatttcaaaatgaaatgttcaaacgtggtagttcctttccgaagacagtactcccacacgttgtttaatttccctctctcccaatatccacagaattgggtaccttgttttgtaagcatcgtccccaaaatagtgggtgtagctactatatctgtatcacaacagtggcatgcaagaacggattctatgcacatgaaaattggataccatatgaaggggaccaaaacaactgttattccatcaggattttga

SEQ ID NO: 104031 - DNA, 273 bp, Glycine max
  Peptide Sequence Number=SeqID_220809
atgcaatatgtcatcgtaaaggtgcgcaaatcaaacctagggtttcttctcagtgaagagtggttggtgaagcatgaattgaagcgttgtcttcttgtcgttgccgaaaaatcctgcgacgaagttgacagcggaacagacaagggcatttttcgtaagcccctatgctacatcatgaccaaagaagtggataagaggaaaaaggggataaggggaagaaagggaaggggaagaagaggagaaggggcgatcggtggtggtggcttccattag

SEQ ID NO: 104032 - DNA, 533 bp, Glycine max
  Peptide Sequence Number=SeqID_220810
cccgtgctcacgaagcttctactaatgtggcacggtgggacctctcttgcttgcggtcttggctgtgggccctggcccttgttcctcctttccaagatgtttttccttacatcggggatgactcccaccgagtgaatccatggttggtccaacaagcaactataggctgggttaatatccatcacttgaaaggtaacccggtaggtgtggggccctatatgaattgggaggtcgatctccccttttacttcccggcgactgccaatgaaagcccgtaccactatggagcttggcctcaggctcaagccgttgtcgatgatcaccttggccatgatgtgctccatgcatttgaccgatacatgcagagccctattatgccctcgtccttcggcaggaatctcctcctcgtcgaaggtgaggtagttgttggctgtgatgttgttgatagtcccctcgaagccttctacgaagatgtcttaggccacatgggccttgttcaaaaccttaaccaacaatgctcagtgaggctctaa

SEQ ID NO: 104033 - DNA, 333 bp, Glycine max
  Peptide Sequence Number=SeqID_220811
atgcaaccaagcctcacagccttgtcggctccgcttcctatgcctgctctttatctccccgatcttgatcgcgttcgtgccgccactttctttgacaacctcttcaacattgttctttgttatggccatgtagcagcacctcatgacaaaccttgggaaaatagagacatgactttgtttgagatgggacctgagtcctatagggctaccatggtcgcacgcaagcgccaaccagctacctttatcaatgcatgtatgactatgatgtctgaagaagttaatatgaatgaagaaaatggagaggaagctgatgtgaatgaagaaaatggatag

SEQ ID NO: 104034 - DNA, 390 bp, Glycine max
  Peptide Sequence Number=SeqID_220812
atgaggtccttcaatgctgatttttcaccatggagatgcagcggaaggcaaaggagaagaggagaggggaggcaccatccactagggaataagccatggaagaaggagcttcaccaccatgaatgtacctcatataagaagcttgaagaggatggtttaatggaggaaaagaaagagagaaggggggagcacagaattgaaggaataaaagagggagagaagtggaactttgaagcaaagggtcacttcggggcagttgcagctcacccaggcaagctgaaacttaaacttgaagtagtgagctcacctaggcaagctgttttcttcaccatgaagttatttagtggcccaggcgagccaaatgctagcttgggcgagataggtccataa

SEQ ID NO: 104035 - DNA, 756 bp, Glycine max
  Peptide Sequence Number=SeqID_220813
atgactagcaaagggttgctgagaggagcttcgttaactgcaaacgcagtttggcatagaagcagtttcttcccaaaggtaacggttagcgtccaccccaagttggtgaaatttcagagcttctcatcaaccaccgcttgctcctctcttccacccccggatttgcctcgtttggcaaaaactgctcaaatttcacttaccccaaacgaggttgaagaaattgctcccaaaattcaacaagttatagaatggtttggacagctgcagggtattgatcttgaaagtgttgaaccctcgatcagagcagctgagaatgcattgttagtgtgtttgttttatgctaatcctgttttcgaaggcacatcaaacgtcaaatcctcaatcccatgctcacggattaattcctggtttagggatcgaacttctaacctcatgcttaagtcacatggttatttgtcaactataccagaccacattgagactgaaaacaatttgcgtggtaatgctcctgaaacatttgaccatagggacgccttgatcgcttctgtcccgagctatgaggagccttatattaaagttccgagggtcttcccaattccacgtaaaggtgcaatgggtatcgagaaggctaaaatcaacattgtgatggttggtcatgtggactatgagaagtcaatcactattaaggaactcaataagcctgttgcagagaaacaaattgctgagatgaacttaactgccatatataaggcatga

SEQ ID NO: 104036 - DNA, 1026 bp, Glycine max
  Peptide Sequence Number=SeqID_220814
atgggctttggttggaccaaaccgggtttcacaactatggacccagtcacctacagcgaattgaacgtcgtgacagatccttgcaaataccgggtaattgatggtggtagcttcccacaagtgacttcgaaaggtgagaggcttgtgctggagtgtacagatgtattgtatgaacattccgtgagggataagaatttaaaccattgtgatggcaatcctataatgaagtcgagagacaagtcttcccatatggacgaagggattggtaaaggattgcctccatcaaatggattaacctcaatccaggtggtcatggaccgttattcaaaaagggcccattttggtgctcttacttcccattacactgagcacaaggtagtagttctttttcctggatatggtctgcaaatcacacgggttcccacaccatcacaatggtttaaattcttgtcccttgcggaatggtcgtacaatacatctgtacaccccagcacaggcctctcacctttcgaagtcacttatgggaagccaccaccatcaattccccagtatttgcaaggatcttctcatgtagaggcgataagcaccgttcaattcgttgtcaatgactgggtctatgtaaggcttcatccttactgccaaacctcgctgacactagcatacaccaagttatccaaacgtttctatggcccattttttatcaaggagtgcattggtcccattgcttaccgtctcaagttgccggagacctctaaaattcacccaccacttcaagttctcgaatggaaatggaataatgcaaatgtgtcacccatcaaactggctctagtacaatggattggattggctcccaaagacaccagctgggaacattgggacaatgttcgggtatcctataaccttaaggataaggttcttctcctggacggggtgatgatagcattagtgtcatggccactaacagaccaaggaggaccaccaggaggccaacacacctcagcaattacgcataagggacaactctag

SEQ ID NO: 104037 - DNA, 282 bp, Glycine max
  Peptide Sequence Number=SeqID_220815
atgcaggaagaagaaagaattagtgaatttgttaacgagattgtggaaatattctggatgcttgtccttttcttgagctgtcccttatgcataatcgctgaggtgtgttggcatcctggtggtcctccttggtctattagtggccatggtcctccttggtctattagtggccatggcactattgctatcatcaccaccgtccgggagaagaaccttgtcctcaaggttataggatacccagatattgtcccaatgttccccgctggtgtcttcgggagctaa

SEQ ID NO: 104038 - DNA, 247 bp, Glycine max
  Peptide Sequence Number=SeqID_220816
atggatccgacagtcgcaactagagatgaagctggtaggcctattgatcatgtcccttccacctttactagagagatcgtgaaggttttgctcatgactcgccttacaattccaatagaggaaaaggctataggggcgaccaccgtaggtgcaaagtcaagattgtgcgtgtgggctaccacaagtactcaactcacgtccatgtcacctacctcctctaccttagcaacctggatgactgcaattg

SEQ ID NO: 104039 - DNA, 177 bp, Glycine max
  Peptide Sequence Number=SeqID_220817
atgaggatcaaactcacatcctcatatatttactccgacttcttcaccacaaagccaacctatcatgcccatgctcttatatgccatggtgcggaggaaggaaaatggatgattgaaatctcaagcatgcactggagcaagaacccctcaaattgcctctatgaaaccatcttttag

SEQ ID NO: 104040 - DNA, 150 bp, Glycine max
  Peptide Sequence Number=SeqID_220818
atgaagccagtctcagcagcagctattttacacaagcaagccaaacttccaatcaagcctacgaggaagggaatcaccaagaataggaaatcatccccaagtgtgaggggtcctccagcatcatctttgccaccagataacctgcaatag

SEQ ID NO: 104041 - DNA, 1452 bp, Glycine max
  Peptide Sequence Number=SeqID_220819
atggacggccatatgggaatgaggaaaatcagctctcactgctctatccctgatttggatgattctgatatcttacgtttgcttgaaaagccaaagttgaacattgagagacagagatcatttgatgagaggtcactcagtgagctctccattggtcttgcgagagcgggcttggataactatgacacttattctccaggaggaagatctggcttcaacacacctgcttcgtctacacggaactcgttcgagcctcaccccatggttgccgatgcctgggaatccctcagaaaatctctagtctattttagaggccaaccggttggcacaattgcagctgttgatcatcaatcagaggaagttctgaactatgatcaggtttttgttcgagattttgtgcccagtgctctagcctttttgatgaatggtgaaccagagatagtcaggaacttcttgttgaagacactgcatcttcagggttgggaaaaaagagtagatcggtttaagcttggtgaaggtgtgatgccagctagtttcaaagttcttcatgatcctattaggaaaacagatactcttattgcagattttggtgaaagtgcaattggaagagttgctccagttgattctggattctggtggataattttacttcgtgcctacacaaagtctacaggggatttatctttggctgaatcaccagattgtcaaaagggaatgaaacttatactgactctatgcttgtcagaggggtttgatacatttccaactttgctttgtgctgatggatgttgcatggttgatcgaagaatgggcatttatggttatccaatagagattcaagcacttttcttcatggcattgagatgtgctttgtcaatgctgaaacaggatgacgccgaaggaaaggaatgcgtagagcgtattgtgaagcgtttgcatgcactaagttatcatatgcggagttacttttggctcgacttccaacaactaaatgacatttatcgatataagaccgaggagtactcacatactgcagtaaataagtttaatgttattcctgattcaatcccagaatgggtgtttgactttatgccaatgcgcgggggctacttcattggaaatgttagtccggcccggatggattttcgatggtttgctttaggaaattgtgttgcaattctatcttctctggcaactccggagcaatcaatggctatcatggatcttattgaatctcgctgggatgaattagttggagaaatgcccctaaaaatatcttatcctgcaatagagagccatgagtggcgaattgttactggttgtgatcccaaaaataccagatggagttaccataatggaggatcttggccaggttcttcctttctgctcatatattcaaactttaaaatgcatttaatgtgggatttggttaattgggattttgaccggtag

SEQ ID NO: 104042 - DNA, 336 bp, Glycine max
  Peptide Sequence Number=SeqID_220820
atgtatatgaatcatgaagatgttggatgcatgagtgattttacaaaagagggttgcaccactcaacacatttatcataccacatatcatagggatttagtgcctcataataccttttttgggcactgtcgcaacctacccttcggcgggaggacgacgcgagagctcatgggtgtgtcttccaagggaggaaaatgcacggagtcgccaccaacgtttattcgaggaaaacgtcgaacaaatcagaaagcaagatatattttaaccgaacaaaaggtcattaaaggcgttggaccattaaacgatcttttgattttgaaaggagagaaacgttaa

SEQ ID NO: 104043 - DNA, 731 bp, Glycine max
  Peptide Sequence Number=SeqID_220821
tcctcacctttagaggactacacatcctcgccatcagagggctacacgtcctcgccatcagaggactacacgtcctcacctttagaggactacacgtcctcacctttagaggactacacgcccttgccatcagaggactacacatcctcaccatcagagagctacacgccctcgccttcgtagggctacatgtcctcaccttcagaggactacatgtcctcaccttcagaggactacacgtcctcatcttcagaggactacacatcctcgccttcagaggactacacgtcctcgccatcagaggactacacgtcctcgccttcagaggactacacatcctcgccttcaaaggactacacgtcctcgccatcagaggactacacgtcctcaccttcagagggctgcatgccctcaccttaagaggactacacgtcctcaccttcatagggctacacgcccttacctttaggctgcacgccctcgccttcagagggctgcacaccctcgcctttagagggccgcatgccctagccttcatagggctagactcactcacctttagagggctgcacgccctcgccttcagaggactagacatcctcgcctttagagggctacacgcctttgctttcagagtactacacatcctcgccttcagagggctacacgttctcgctttcagagggctccacatctgcactttaagaaaatttaaggtcctctgcccttaa

SEQ ID NO: 104044 - DNA, 189 bp, Glycine max
  Peptide Sequence Number=SeqID_220822
atgccgatctccccctacagaagtatcagttggtctgtgccgtcccgacataggggtcgcacccacaagacacccagtggactcagagaagtccaacaggaccctggagttgccagctctggttacgggcctctgtcagtcctacagggttcccataccccccagcaaggtcacgccatcatgacatag

SEQ ID NO: 104045 - DNA, 213 bp, Glycine max
  Peptide Sequence Number=SeqID_220823
atgcttgatcatgtgcacttccagcactctgctatgcacttaagtaacaccaaagctcataaagaaagtgttgtgaggatggtgggaaaggaaatctttgagagtttcctcgggaaccttaggcttcttggaacctttgtaagatgtagggctgttgagctcttgaggtggatgagaaaaagatttgtggaatataggcaacattttgattaa

SEQ ID NO: 104046 - DNA, 723 bp, Glycine max
  Peptide Sequence Number=SeqID_220824
atgcagtcctctgaaggtgaggcgtgtagtcctctaaaggtgaggatgtgcaggcctctaaaggtgaggacgtgcagtcctctgaaggtcagggcgtgcagccctctgaatgcgagggcgtgtagccctctgaaggtgaggacgtgtagtcttctgaaggtgaggacgtgcagtcctctgaaggtgagggtgtgcagccctttgaaggcgaaggcgtgcagtcctctaaaggtgaggatgtggagtcctctgaaggtgaggacgtgcagtcctctgaaggtgaggacgtgcagtcctctgaaggtgagggtgtgctaccctctgaaggtgaggacgtgtagtcctctaagggtgagggtgtgcagccctctaaaggcgaagacgtgtagccctctgaagatgaggatgtggagtcctctgaaggtaaggacgtgcagtcctctaaaggtgaggacgtgtagtcctctgaaggtgagggcgtgctaccctctgaaggtgaggacgtgtagtcctctaaaggtgagggcatgtagccctatgaaggtgaggacgtgcagtcctctgaagtggagggcatgtagccctctgaaggtgacggcgtgtagccctctgaaggtgaggacgtgcagccctcagaaggtgaggacgtgtagtcctcagaaggtgaggacgtgtagtcctctaaaggtgagggtactagtacccaagggtccacccttatga

SEQ ID NO: 104047 - DNA, 273 bp, Glycine max
  Peptide Sequence Number=SeqID_220825
atgtcatctactattcatagggatcgcgtccataagacacccaatggacccggaggagcccaacagggccctggggtttccagctctgtccaacagggactattgcagtcctacagggatcgcgctcgcaagacacccaatggacccggagaagtccaacagggaatattgcaatctccctttgccatctggagacaatcaactccgatggcacgtagagacaaatatggtcattttcctcttttgttgaagactccaatgtctttcgattaa

SEQ ID NO: 104048 - DNA, 312 bp, Glycine max
  Peptide Sequence Number=SeqID_220826
atggtcatttgccctttttgtcgaagactccaatgtcttgcgaccgagactattgcagtctccctttgtcatccagaaacaatcaagttcgatggcatgcagagacaaatatggtcatctggggccttggccgaagactccaatgtctttcgaccaagactgttgaagtctcccttttacatctggagacaatcaactccgatggcacgtagagacaaatatggtcatttgccctttttgttgaagactccaatgtctttcgaccgagattattgcagtccgcctctttcatccagagacaatcaagtctga

SEQ ID NO: 104049 - DNA, 288 bp, Glycine max
  Peptide Sequence Number=SeqID_220827
atgttggaggtacctctgcctacgaaccctctcattataacatatatgatcttgcaagacttggtcgaggattctctttacagggaacatcgtggtggtggtgatggagacttccttaccatatggatctcggattggggttccttgcgggaaagtgaggcttacgtatctgtcgcaatctgcccttcgatgggagggcgacgcgaggctcacgggtgcatcttccaaggaaggaaaacgtgtggagtcgccaccaacatttttttgacgaaaacgctagaaaaataa

SEQ ID NO: 104050 - DNA, 471 bp, Glycine max
  Peptide Sequence Number=SeqID_220828
atgcttaactcaaaagctcgaaatgctttaccgtgcgctctatcaaaagaagaatatgcgaaagtccacaacttcagaagcgcaaagcagatgtgggacatccttgccataagatatgaaggttcattgcaaaacttcaaacataatgaaggacttaagaaagagatgttctggcttttagcattcaaaagaacaaaaaggccttattgtccaaagggtcatcctcaaaatcactgtccagaagctcatccaaagctcttagagtggaaaactcctttaatgaagaatatgaggatgagtttgactaagataagctcattttcatctccagaaagatctgtgaaatatggaagaataaaagcatatccaaatggtggaactcttccaaaaaggtgttcaatgagaggaaagataaagacaaagctccataatatgatacaaatgaaagaggcttggacactacaaatctga

SEQ ID NO: 104051 - DNA, 450 bp, Glycine max
  Peptide Sequence Number=SeqID_220829
atgagagtgaaattcagctgcgacacaggaatgagcgtaattcatcgttgcacagaaaaagagacagatctgagaagacgaaagggaaataaacggtactgtgaagtaaaacgaggggagaacctgaaggaggatggcaacggtgagagagacttgccggcggaaacgacggtgactcgccggcgactgcgccggaaaacggtgcgcggagagaatggcgaaatggagagaaagagaagggaaaaaatgagcagtagctcagaagccgttatttatagaaggagacgaacggtagaaagagagtcctggagagggtgcaaccaacggaccgtaccgtcctaccccgtttttggataccgtgtaagagatttaacggtaacagccggtagctgggcgaaggggttaccagcaccgtccacgtgggcgcaacgacgccgtttctacgaatga

SEQ ID NO: 104052 - DNA, 780 bp, Glycine max
  Peptide Sequence Number=SeqID_220830
gccttgagagggctacacacccttgccgtgagagggctacacgccctcacctttagaagactgcttgccctcaccttcagaggacttcacgtcctcgccttcagaggactgcacgccctcacctttagaggactacacgtcctcgccttcagagggctgcacgccctcaccttcagaggacttcatgtcctcgccatcggagggctgcacgccctcaccttcagaggactacacatcctcaccttcagaggactacatatcctcacctttagaggactgcacgttcttaccttcagaggacttcacgtcctcactgtcagaggattgcatgtcttcgcctttagagggctacacgtcctcaccttcagagggttgcacgccctcgccattagaagagggctgcacgccctcaccttcagaggactacacgtcctcgccatcagagggctgcgcgccctcaccttcagaggactagacgtccccaccttcagaggactaaacatcctcgccttcagagggctccactcactcagctttagaggattacacgttctctccttcagaggactacacgtccttaccttcagagggctacacgccgtcactttccatggacaacacttcctcaccttcagagggctacacgtcctcaccttcagaggactacacgtcctcgcgtttacagggcttcacgtcctcgcctttggagggctacacaccctcgccatcagagggctacacgtcctcaccttcagagggctacacgacctcactttgtga

SEQ ID NO: 104053 - DNA, 322 bp, Glycine max
  Peptide Sequence Number=SeqID_220831
ggaacagggacgtgccaggggccccaccactagtggaagtgcctgccaggctaccactagtggtcgcgcctggggccctaccactactggtagcgcctggcaggtaggcacgactggtagcgcctggcaggcaggcacgaccacccctgtcacatcgtcctgtccagacaagtcacgtgtcgcgttctggtggaacgcgctcctcaggatgaagggaattgggaaaggacctaacaacatactggaagagaaagacttaattggaggagtgaggaacataataggacaagtggcacaaagagagggggcaagtggagtttag

SEQ ID NO: 104054 - DNA, 1767 bp, Glycine max
  Peptide Sequence Number=SeqID_220832
atgtatattttggttgacaacagaccatggttgttgagtgaccttggttcacggggagtacacatttggcaattgatggttactaagtcaaggctatctccctttgcatattccaaagctcgaagagagaggaaggaaggcaaggagatttgtcctcaatcaagttcaagtaaaccaaagaaatttatgagatggttcccgttgattgaagcagtgatgttatcaagaaagaaagttttgcttcctgtgaaaaacctgaggaattctttacaattgagcagtgaattgcatagaactctgtatggctttattgtatttgaagttgcatgggctggtgttcgtggtattaactactataatgaacttcagactgatacatcactagctatagaagctaaactgatgaaaagatgggaatttgacagtatagctcaagctgcaggctgtatgtcttcatggttctcaggaacaccttctgaacagctgcttctgaaagaacatctggattccgcctcaggggacatattttatgatgctagtgaagatttttctggcactgtatctgttgatgatggtgatgataatatctgcagaattttgactgttgaagatagtttgggtaccaatgttggagtatatactgatgatacagaagaaacaacagacatgctacatgcacctcctccttctggaccgaataagagaagaaaattaatgaattcctttagtgctggagttgaagttgatagctactcgacagctgaaattgataactcattggattattctcagacctctagctgtgtttctgatgatacagttgaaaccactcaagatgatacacttgaaaccactcaagatgatatagttgaaactactcaagatgatacagttgaagcaacacaatatagtgatgttctactgtcatttaggtttgatgatcatgaccttccatttaaattcagggaagtcatagtatctgatctgcgattgcttactttgttggaggctggtcttccatcttgggtcatcttccttcagtcatatccagtgttatgcaatctttatcgtccttggatgtgcccacttgcaagacttttatattttttgatctcatttgttactgtcctcattggattctatgatttatacaaaaatgttcctgttctcaaggcaactgcatctcgtttatgtgggcctcttcttgattggattgaaacttgggagatggtttcaagggtcaaatacttaggcacaatgctgtttctacataacttccagaaggctgttaggtggtttcttgcctttacacataccatgagatcatttttttccattcttgttcaacctcttgtagagtcactggtggagatttttggatttcttctcccaagcttgaagtttttgtttgaattagcagaaagcatcttttctgtcatttggctcgtagtggatacttcttttgatatagtgggaaatgtactggagctactcttttcaccattgtggtttgtcctcaatgttgtttggagcattgctacttgtatcttatatcctctattttgggttctttgggaattactatatgctcctgttcgtcttgttctggtgatattcagttttgtggcttccataagttcatacatttgtaatacgcttggcaacacatggcagtttgttagcagcattttccagtttgcagcgtcttctgaagcaacagtcagtgtttctgaagtttctatgtggcaaagaactctttgggaatga

SEQ ID NO: 104055 - DNA, 589 bp, Glycine max
  Peptide Sequence Number=SeqID_220833
atggctccgagaaagctcccaaccaagaggtccataaaagacaccgctggagatggttccagtgcagccccacgggcagacgtggagttcgatagacacagggacgaggagtatgttgagttccaagaggagataggctggaagcaatgggctcagcttgcatcacccatggctaagttcgatcctgagatagtcatggagttttatgctaatgcctggcctacagaagaaggagtcagggacatgcactactgggtgaggggtcagtgggttccttttgatggggacgccattaaccagtttctggggcatccattgatcttggaggaaggccagcagtgtgagtatagccagagaaggagtcaagccttaggctttgatgaagaggctatcgaccagttgctatgcgtgccggggcagatctggatgacgtttctgcttagcaacatcctccccaatgaccatagctcagaccttcccctaccgaagggttacgcctccgagacacccagtgaacccggagaagtccaacagggccctggggtttcctactctgatcacatgcctctatcagttctatggagtatcg

SEQ ID NO: 104056 - DNA, 1195 bp, Glycine max
  Peptide Sequence Number=SeqID_220834
ggtggatcccgaaggaaatacaatgaatactgaatcaactacaacagacaaaaggaaaaatgataaagagttgtcttcctttacagacgaaatgaagatgacattagctgcttctgtcataaaagaagatcttagttcagaaatttctaaattttctttggatggaactcaagttcgtagtttgaagaaaagactaattgttcttgatataaatgggttgttagcggatgtagtttctcctcctccaaagggtcacaaagcagatgcaaccattgcgaggagagccatattcaagaggccctcctatcttgagtttctagagtttcgcttcgataaatttgaagttggcatatggtcttcaagaatgaagaaaaatgttgatcgagtcattgattatttgatgggagacatgaaaaaaaggttgcttttctgttgggacctttctcactgcattgaaacaaccttcaaaactcttgaaaataagcataagagtgtggtttttaaggatttgaggaaactttgggataaacatgatcttgatcttccatgggagaaaggatatttcaatgaatcaaatacattgttgttagatgattctccttataaagcattgtttaatcctggaggttgggagaatgatgaaactgttgaggaggctgcagttagagaagctattgaagaagcaggagttcgaggagacctaatggttacttggtttcaagattttcttgggaactatgaatttaggagtaagaccctccaagatgagtgtagtccagaaggtttatgcaaagcagcaatgtttgcattgtttgtgaaagaggaacttgagtcatggcctgagcaaagcaccagaaaaaggagttggctggctgtatcagaggcactagcaaactggttgaagaagaaaaaggaggatgatgctggaccaaatcacctttcatgcaagaatccttggcatttgtatattgcacctcctaatatgaatcctacacctttcaaaaagcttcaatggccaaaaataccctcagccctaacacctctccctctttcctatgctacccaagcattctctcttttggaatatgaatgcggcatcgcccaagggggggcgggtcctggaaactatgttagaatgacaatggtggtggttgggcttggtgagaaggtggtgcacgatggtgcagaggtgtag

SEQ ID NO: 104057 - DNA, 3438 bp, Glycine max
  Peptide Sequence Number=SeqID_220835
atggaatctgaaacctcctttactaccatttctgtacccgtatttgatggactaaactatcaaatgcgggctgtcaaaatggaagcatatcttgatgctaacaatgtatgggaagcagtagaagaggaatacgaagttcttcctttgccaaataatcccactgttgcccaaatgaaaagtcacaaagaaaggaggcttcgaaagtccaaagctaaatcaattttgttcacagctgtatctctagtcattttcaacagaataatgacgatgaaaacggcacacaaaatctggaattttttgaaggaagagtatgaaggcagtgagaaaatcaaaggaatgcaagctttgaatctgattcgagaacttgagatgcagaggatgaaagatttggagacaatcaaagattatgcggacaagctccttggcattgcaaacaaaatacgtcttcttggcactgaaattcctgactctcgaattgttcaaaaaatacttgtaacaattccagaaaaatatgaagccacattgacttccttggagaactcaaaagatctttctactatcaccttggcagagcttttgaccgcacttcaggctccagaacaaagaagactcatgagacaagaaggtactactgaaggggctttggtagctaaatcactggacaaaaaaaagaagggcaagtcaggaagtttcaaccacaaaaatggtagcaaatcctctcatgattttccatcatgtcctttttgtaaaaaaaacaatcatccacagacaaagtgttggtggaggccagaagtgaaatgccataaatgtggactattagggcatgtggagaaaatctgcaagtcatcacaaaaacaagagaatgtacaagctgctgttgaagaggtggatgaagaagaactttttgttgtttcttgctttgctatcgcaagatcaacagaaagttggctaattgacagtgggtgcacgaaccacataacttacgatcaagaattattcaaagatcttgatgcaatctacaacacaaatgtcagaattggaaacggagaaaaaatagcagtgaagggaaaaggaaccatcgtgatcgagggttgcacaggtctgaaattaattcctgatgttctatacgttcctgaaattaaccaaaacttgttgagtgtcggccaacttctagagaaaggctataaagttctatttgaagataaaagttgcatgattaaagattcagataataaagaattattcagagttcaaatgaaaggcaaaagctttgccttgaatttgattgatgaagagcagcttgctgtgcacaaggttgaagacaacatgctggtttggcataaaaggatgggtcattttcgtcatggcgctttgctctatttgaggaagaatgatcttgtacaagggctgcctgaattggaagacaaatcacctgtatgtgctgcttgtcaatatggaaaacaaatgaggttgtcttttccaaaaggcaaatcttggagagcaataagcaagctacaaatgtgttggatttatttcatgaaaaacaaaactgaggttgccatcatattttacaagtttaaagcatgggttgaaaatcaaagtgaaagaaaaatgcagatattaagatctgataatggtacagaatatacttctgataagttcagcaagttttgtgaagatgcagggatagaacatcaattgacaacaccgtataccccacagcaaaatggggttgtggagtgcaaaaacagaacgatcttggaaatggcaagatgtttacttcatgacaaagatcttccaaaaaaattctgggcagaggctgcaagcacttctgttaagagagacaaacttgataaaaaggcggaagcgggaatctttgtaggctatagctcaacatcaaaagcctatagaatattcttgccacaaagtaataaagttattgttagcagagatgtgctattctttgaagaagaaaaatggagcaaggaaagtgagaagcttcaagttcaggaggagagcgaagaagatcctgtagactacaatgaagctacaactgattcgaagtgggtaagtgcaatgaaggaggagcttgatatgattgaaaaacatcaaacatgggagctcacggagaaacctaaagataaaaatgtcattggagtgaaatgggtttatagaaccaagcttaatgctgatggttctgtaaacaaacataaggcgaggcttgttgtgaagggatatgcgcaaatgttcggggtagacttctcaaaaactttttctccggttgccaggttggataccataaggctgttgttagctcttgctgcacaaaaaggttggattatacatcacatggatgttaaatcagcctttttgaatgggcacttggaagaagaaatttttgtagagcagcctgaaggatttgtagttcatggacaggaggagaaagtttatcggctgaaaaaggccttgtatggcttaaagcaggccccaaggtcttggtatggcagaattgatgcacatttgataagcttaggctttgaaaaatgtctaagtgagtttaccttgtatgtcaagaagacagatgttggaatagtcattgtttccttgtatgttgatgacttacttatgacaggaaggtcaaaggagctgattgaagagtttaaaggaggaatgaaagaagcctttgaaatgactgatcttggaaaaatgtcatttttccttggtatgcaggtgcaacaagatagaggtgaagtctttgtaagtcaagaaaaatatgcaaaggaaattcttacaaagttcaagatggaggaatgcaagccaattgcaacgccaatgaatcaaaaggagaaattcagcaatgaagatggagctgaaaaggttgatgaaaaactgtacagaagcttaataggatgtctgatgtatttgactgcaaccaggccagacattacctatgcagtaagcttgctgtcacgatatatgcactgtgctagtgagattcattttaaggcagctaaaagaatcctgagatatatcaacggtactattggttatggagtgaagtttcagccagtaaaagatttcagtctttatggatattcagatagtgattgggctgggaatgtcatagcacaatctaccgctgaagccgaatacgtagcagctgttgcagctgcaaatcaagcaatttggcttagaaaacttatggctgatctacacatggagcaaaaggagagtacacaggttcttgttgataatcaagctgcaatttcaatttctaagaaccctgtgtttcatgggaaaacaaaacattttaagataaagttgtatttcctaagggaggtgcaaaagcaagtatcttcgacaaaaacttggtgtatgttgccgttgagtcaaggaggagattgttgggattttgtgactccaacagcatatggttga

SEQ ID NO: 104058 - DNA, 279 bp, Glycine max
  Peptide Sequence Number=SeqID_220836
atggaatacgaacgggtttacaaaatagggcaacatcaaatggagttagaatggccccaaactttaggggtggcatcggaatggagagacgacaacaccggtggaagcgtgaccggaaaggtgctgccacgtgccagaggaatatttccactaggctgttcggcgcatagagaaacatctataatcatgtacaggagttcatccaaggattatatcgtacgtgccaaagatcaagggaagacgactctagagacagtggaaaaacttgtttgccgctga

SEQ ID NO: 104059 - DNA, 387 bp, Glycine max
  Peptide Sequence Number=SeqID_220837
atgaaatttaaaaggaggtgtttctatctcttctttgtggggtttgaagtgtttcatccatatttccaagtggtggggttttggccaatagacgagatttggctgtttggtggtggtgggggttgtcgtgatggtgtgatctgcggtgaggatagtgcaactacaatagtcttgaaggagaggatgagaggcgtcaggatcagagccatgattttgctagtggccaagggagcaggaagagaactcgtctttgctattgttcttggctatgatgatggagagactgttgttggtgaggagggggttggagggcccgttgacatggttggggttattgtcgaaggtgtgcgacttaaaggtcgaacaccacctctaggcttagtctga

SEQ ID NO: 104060 - DNA, 258 bp, Glycine max
  Peptide Sequence Number=SeqID_220838
atgatgtgtgacgatgctcaatgcgacaatttgagatgtgctaaggctgcaacaatgtgcgacaatgatgtgagacgtgctcaggttgtgatgatctactatgtgctcaaactgccaagaggtgcgacaatgaaaggttgcccttgtgattttgaaatcgtgtatttggactcccgtgataagagcaacaataatggtgatatggatggaggtgatggtgccaagacattatcattgtcatcgtctatggctgcctaa

SEQ ID NO: 104061 - DNA, 147 bp, Glycine max
  Peptide Sequence Number=SeqID_220839
atggtaccattactagaaaaagcttcccctaatgcacctatcattacagtttcttcctatggaatgtatactactcctttgaccaaggatgtaaagagaaagcatggcaccaaagccaatggaagtgaaggagtccaagaagggtag

SEQ ID NO: 104062 - DNA, 165 bp, Glycine max
  Peptide Sequence Number=SeqID_220840
atgaaagatggagactgtttagtgacaccaaacagactggaaatgggtcgtggggtcagtgctggtggtggacagagttccttggattatctctttggcagtggggtacctgccagcagtgcaaatggtgctcgcactcaaaatgcaagtgctccttcaccaccg

SEQ ID NO: 104063 - DNA, 261 bp, Glycine max
  Peptide Sequence Number=SeqID_220841
gccggacggctgcgtcaggcgctgtttgacgatgcgactttgcagcagattgcacaacagaagggcatcagcatcgctcagttgctgctgagctgggtgattcgccagccgggcgtaatggccattcccaaggcgggcagcgtggcgcacgtgcaggagaatgcggcggccctgaatatcaccctgaccagcgatgagctggcgctgctggatcgcgcctttccgccgccgcagcataaactggcgctggatgtggtgtaa

SEQ ID NO: 104064 - DNA, 645 bp, Glycine max
  Peptide Sequence Number=SeqID_220842
atggctaaagacaccgcacccgaggcaaaaattgcccagctgtcggaaatgcagcgctacgtcactcagcatcgtggaaccgaaccgcctttcaccggcgcgctgttgcacaacaagcaggagggtatctatcactgcctggtctgcaacgcaccgctgtttctctccgaaaccaagtatgactccggctgcggctggccgagcttttaccagccgtataacgatgaagctatccgctatctggaagatgactcgcacggtatgcaccgcgtcgaaatccgctgcggtaactgcgacgcccatctgggccacgtcttcccggatggcccgcagccaaccgggcaatcagcacgagggctgagcatgaagcaggaactggaagcaatgctggcggcgatgacgccggaagtctacgagcgcctcgccaccgcggtggaaactggcaagtggccagacggcgtggtgctgacgcaggatcagaaagataactgtctgcagctggtgatgctgtggcaggcgcgccataacgacgaaccgcagcacatgaccatcagtaaaggcggcgagatggtgatgaagtcgaaaaaacagctgaaggaagagtggggaatcgagtccgacgtgacgcgcatcaacctgcattaa

SEQ ID NO: 104065 - DNA, 792 bp, Glycine max
  Peptide Sequence Number=SeqID_220843
atggctgcggcggttaaaaaccgcgcagggaacagcgatattgtaaaagggccgtgcggcggggtatccgctttcgcccaagctccattagcggtaatcgcgccagccttccgtgctgaacgccgccggcttaatccctgtttctacagtggtttatctcgggcggtggtattttacagcggacgtcgacggccatgccagattgcgagtcagatcacgcaatgcgggctaaatactgacctgttgcgccaggcggcgaatgatggcggcggtcagcccccagataaactggctgtgataccaggagagataaatgcggtgcgtgcggccggcgcgatgaatatccagcgggtagtaacgcgacagggtcagcgcttcccgcaggggcatctcgaacacgtccgccacttcaccctcgttggcgcgaaactgcacgtccggcgggatcaggccgacgataggcgtgacctgaaatccggtgctgctgtcgagcggcgccatttggccgaggacggtcaccgcgtgcggcggtatcgccacttcttcctgagcttcccgcagcgccgtgacgatcgccgatccgtcttcggcgtcggtcttgccgccggggaaggccacctggccggcatgtttgcgcagcgagtcggcgcggcgggtcaacagcagcgtcggctcggcgcggcagacgatcgggataagcaccgccgccgggcgcacattgtgcgagatctgcgccgcctgcggcagctgcagttgaaaacggctgataaaggcgtgcagcgaggccggtga

SEQ ID NO: 104066 - DNA, 1192 bp, Glycine max
  Peptide Sequence Number=SeqID_220844
atgggattgccgggagatggccgaagggccgaacagcatatgcaacgccagcgggtggcggggagggctgaggcccttcactccttagtgatgaaagaaggaattactgtatcaggatttttctgggggacaaagcggctttttcaacggcggtttaggcgagtggcaatagctattatcatcggcacacacggggctgcagcggaacaactgctgaaaacggcggagatgctattgggcgagcaggacaacgtcgcctttatagacttcgttcccggtgagaatgccgagacgttaatcgtcaagtacaacgaaaaaatcagtgggttggataccagtggcggcgtgctgttcctggtggatacctggggcggcagcccgttcaacgccgccagccgcattgcggtcgacaaggaaaactatgaggtcgtcaccggggtcaacattccgatgctggtggaaaccttcatggcgcgggacgacaaccccgccttcgatgaactggtggcgctggcgttggaaaccggccgcgaaggcgtgaaagcgctgaaaaaaccgcaggaagaacccgcaaaacccgcagcacccgtcgccaaagccgctgcccctcaggcgccgctggggccgaatgaccacatgaaaatcggcctggcgcgcatcgatgaccgcttgattcacggccaggtcgctacccgctggaccaaagagaccaacgtcagccgcattatcgtcgtcagcgatgaagtcgccgccgaccatgtgcgcaaaaccctgctgacccaggtcgccccgccgggcgtcaccgcccacgtggtggacgtggcgaaggccatccgcgtctggaacaacccgaaatacgccaacgaccgcgtgatgctgttgtttaccaacccgaccgacgtcttgcgtctggtggagggcggcgtggatattcaatccgtcaatatcggcggcatggcgttccgtcaggggaaaacccaggtgaacaacgccgtttccgtcgatgaaaaagatatcgaagcgtttaagaaactgaacgatcgcggtatcgagctggagagcttttttggtcataggagaagtgcaatggagatcaccactcttcagattgtgctgatatttatcgttgcctgtatcgccgggatgggttccgtcctcgacgagtttcagttccaccgtccgctggtcgcct

SEQ ID NO: 104067 - DNA, 171 bp, Glycine max
  Peptide Sequence Number=SeqID_220845
attgctgatgtgaagaagaacacagagacatcgcaaggtgttgatgtttaccttattacacaacaaatgcttattcatcatgggaaggtgcttaaggatgccacaaccctggaggaaaataaagttgttgaagataattttgtggtgatcatcttaaacaaggtgatgtaa

SEQ ID NO: 104068 - DNA, 426 bp, Glycine max
  Peptide Sequence Number=SeqID_220846
atgtgtctccattgctaccttttcgaggccaaactcgtcgatctccaccacaaccacagggatcctaacaacacagattcgagtgtgcctctggcttgtcgggttttagtgggtgcacaacgaagttgtcggggtttggtgggtgcacaacagagttgtcggggtttggtcactgacgacgatgtgtcaccttgcagatctaagccgatcctcattgtatgcgacaaagagatggttttggagagtgtggagcatgttccggtggtggcgaaggagaaggaggttgtgccgtttgatgattggggaggtagcggaggcgagttcaacggtggtgttgtcgatgtgtgcagcagaggaaaggaggaagcactgtttcaatgtaggcttgagggtgggtttgagagagagcaacatgagggtttctaa

SEQ ID NO: 104069 - DNA, 1395 bp, Glycine max
  Peptide Sequence Number=SeqID_220847
atgttgtctaaaagaaaacccctttacagattcccactcattcctgtttctgcccttatcatatgcctcttcttcttggttttgtatcactaccatgcaaaacctgattcccagttccatggattgtccaaaacttcatcaacatcatcacatacccctcgatgctccgggcaagccctcgccttgggggagaaattcgtgtcgtatgcacctcacagcgggttcagcaaccagctttcggagttcaagaatgctgttctgattgtggggatactgaatcggactttggtggttcctcccattctggatcaccatgccgttgccctgggtagttgtccaaagtttcgcattgtggatccaaaggatgttcggatgtctgtttgggatcatgtgattgaggtcatccagagtcgaaggtatatctccattgctgaaattatagatgtctcgtctttagtttctccctctgttgttcaatcctctgtttctgaaaggctaaagcaatgtggatctctgctagctggggtccatggtagtattggaaagtgtatatatgctgtcaatgaagattgcagaactacagtatggacttaccataaatatggccatgaagatgacaagttggattcattccaagcagatgaacaactgaagcaaaaaaagaaaatatcatatgttaggagatggaaagatgtatttaagactcttggacctggttctgaagttgaatcagcctcactactggtatttggaagccttttctctgccgcatacaaaggttctgaactacatgttgatattcatgaatctcatcaggaccagaggtttctatcattgatgaagaagattaaacgtattccatttgtcctagaaattatgattgccggaaagcagttcgttaaagaaaccataaaggctccatttctttgtgcacaacttagactgctggatgggcagtttaagaatcatcaaaaggctacatttcacggattaaggcaaaaaattgaatctatgaggaaggaaggccttctacccattcatatttttataatgactgatcttcctggagataattggactggtacttatttaggtgatttaattagtgacaaacgtaattataaggtgcatttcttgaaagagaatgataagctggttaggcgagcagccgtaaaactcatggcagtgggtcatggacagaggttcatttcaaattcagatacttcaattagtaaaaggtattgttccagtcagagattaccagatctacttctttatgttgagcagactgtatgtagctgtgcatctcttggttttattggaactcctgggtcaacaattgctgaaaatatagaactaatgagaaagattggctcaagctctcagtactgttga

SEQ ID NO: 104070 - DNA, 255 bp, Glycine max
  Peptide Sequence Number=SeqID_220848
atggtattttgcttgcaaacctctagaacaacatgttgtgctccaaccaaaccaacacattacaagttggcagccaccattgatagctttagtgtcaatctatttgttggaacccatggagcttttatacaagctagaactttgctctttcttggtttaccagaaccgcaggagattgaagcatggggattgctcgaagcgcttaagtggacgaaatccatgaaccttgcgaatgtcacatatgagctagactag

SEQ ID NO: 104071 - DNA, 348 bp, Glycine max
  Peptide Sequence Number=SeqID_220849
atgaagagcggtgttgaagaagttggtcacaccgtccacgcaaacacgttcacaagggcagcgcagaaaaatgcgaaagagagaagaggtggagcgaagggttccaatgcgggtgaaacagaggaaggggtaacggtggcggaaggtgtgtgtggcataggtctcgtcactggtgctggagaaataagcttgatagggtttcttcaatttcactggcgaaataagtttgataggatttcaccaattccactggcgaaacaagtacagaaatgtccgtttgaggtccataatatgtcaaaatgctcgaaattgaacaaggagtcccctgacaaaaatatcacacgctag

SEQ ID NO: 104072 - DNA, 282 bp, Glycine max
  Peptide Sequence Number=SeqID_220850
atgttcacggatcacttgatccataaagctcccagcgatttccgacagcggtttccgccatcgccggcaacactggaccaaaaaagcaccaccgcaacaatggcggcaacctcctcaacgaagaagaagaataagaggcacaaagaagacgcgcaattacagtgtgtgatccaagttagagatgagccgggaggaatcacggtagtaaagagtgaccatttcttcaacgaagttaggattagcatgatattttatatcatacaactactattacatcactag

SEQ ID NO: 104073 - DNA, 204 bp, Glycine max
  Peptide Sequence Number=SeqID_220851
atgacgaaagaagaacacccaacaaagaacgatgtagaaatcgatcacggtcgcgatttggaaatgagggggtttgggactttggcagctcgccctggtgagctgttgcttcaacccgaagtaaccttgcttgcccaggcgagctggttacttcaccctaagctatttgggggcctaggcgagccagggtccaaaaaattctaa

SEQ ID NO: 104074 - DNA, 336 bp, Glycine max
  Peptide Sequence Number=SeqID_220852
atgccagttggtctacgctatcttgacccagggatcacacctccaagacacccagtggactcgaaaaagtccaacaaggcactaggattcccagctttgatcacaggtctctatcagttctatggggtgccgattacacccacaaagctcatccagcctcccattaacaagtcattcattgaaaagtattgcatgccaaggcagcagatgaccaaccataggggccaggtgcagttgaacaagagcttttatcagtatatcctgcatcaacagcgccaggaccccaatccttacccatggcctactcccgagcagttcaaggccacaattgcatga

SEQ ID NO: 104075 - DNA, 366 bp, Glycine max
  Peptide Sequence Number=SeqID_220853
atgaaaaagatttttcttaaggttttaaggcttataaagagactccctagcttaactagcaaaccatatcctcctttgtccgtgagaaaagaagttcccaagaagaggacacaccacaaaatgaagaagggtctcctcattgtgttgctcatcattcagatccactacaatgttgttgtcaacggcaatgagttggaatcagagttctcatttgattcccatgtggccagaatgctctatgatctgttagatgtccacaaagcaaaggttaccgtagctgcttgccatccagaaatggacgacgtggccctagacaacgttgtgctgatttcactagggtttgctaaaaacatgtttcagtcttga

SEQ ID NO: 104076 - DNA, 408 bp, Glycine max
  Peptide Sequence Number=SeqID_220854
atggggtcgaaccaagcaccctcttttaaaaaaaggttctatcatgtcaaagtcaagaacctagaactagccagcttgcgagagctagggcaacaaatggatcaagttcgacatcaagccttcagcaaggcgtatgggaaaatctgggatttgaccatgatagaagtgtctgttgaagccattgcatcccttgctcaatactatgaccaatcgctcagatgcttcacgtttggggactttcaattggtactaaccatagaagagttcgaagggatcttgggatgcctgctaggaggaaggaagtcatatctttttttcagattccacccttccatggcaagagtagcaaaagtggtcaaaatctcagcacaagagttagaccgagtgaagcaaaacaagaatggggtg

SEQ ID NO: 104077 - DNA, 743 bp, Glycine max
  Peptide Sequence Number=SeqID_220855
aatttgatgaatttaggagagaaattgagaggaggaattggcataaggagctcactaacttctcattgggaagcattgatgttgctattgttaaagaattttatgctaacctctatggccctaaagacaaatcgcataagcaggtgagggtgcgagggcacctaattaaattttttattgacaccctcaacaccttcttgaagacaccagtggtcataaaggaaggggagagcttgctcacctactctaggtttgctaatctgaggtctgttcctcaagagcttacaacctgtctatgtatccctaggaggggatttgagctgaatgcagacgggctgcctctgaagatcttaaggaagaatctgactactctggcccagacctggagtgttctatctttttctaacatagccccgacatctcacacttcaaatattactttggatagggcaaagttaatctatgggcttgtaatgcatatggatatgaacttgggatccctcatctcaggtcagatttctcttatagtacaacatgactcctcgaggataggttttccagccttgattactgccttgtgtaaggcccgaggagtcacatccgattctctgacctttgaatctctgagcctaaccattaatttggcttatattaaaaataattacgggaacatggatgacccttcggtcactttttggggaacactacataggaggacactacagcagttaccccataagtga

SEQ ID NO: 104078 - DNA, 114 bp, Glycine max
  Peptide Sequence Number=SeqID_220856
atggcgccaaaaacttgttcgctttcggcaagtgcatcggatcgcacaagtagtataaaatggtgtgtatatggccacaaggaattgggcttagctggcatgagtagcacttag

SEQ ID NO: 104079 - DNA, 318 bp, Glycine max
  Peptide Sequence Number=SeqID_220857
atgaaacatgcatcatggagtgccctagttgtagatcctctgcccacgccacaacaatctcaacctcaatacacaaaggatatgatttatagataccctttaacaacaggtcaagggttacttagaagtatgaaacatgcatcatggagtgccccagttgtagatcctatgcccacgccacaacaatctcaacctcaatacgcaaaggatggtgcacctattgaagaagttggtccaatcagtgaagatgacaaagaaataaatttgaacaatgacgatgtagacgaggatgacaaccaaaacctaaatatcgagtga

SEQ ID NO: 104080 - DNA, 456 bp, Glycine max
  Peptide Sequence Number=SeqID_220858
acttatcaaggtaatccttgtggcgtctaccctgacttatcttccttcaccggaagtggcgtctaccctgacttatcttccttcactggaagtggcatcatccaaaaactctacagtctgtatcaagcaatccgctcctactcaggttcacatcacaaattaatcaacaacgtttacaagctcaattatgtgtccaatgtttacaacagatcatttggccaaatgaagcacgcatcatattggccaaaatatgaagggccaactatgtgtcatgatccacaaatatggaagagaaaaaatgaccacccaagatcaacccgtatacacactaaaatggaccaaagagaaagggagcaacctaagtgttgttcattgtgcaaaactgttggtcattccaagaacaaatgtccaaatactcggggaagcacaagtcaaagtcgtcaatgtacccattaa

SEQ ID NO: 104081 - DNA, 756 bp, Glycine max
  Peptide Sequence Number=SeqID_220859
atgaagttcatgaaacttggaacaaggccagatactttctacagtgaacaagctaccagcaccatgtactacgttatttcttcatttccatatctaaaaattcagaacctactcgcagatgatatggaggagagagagccgctgaaattcccgacaaaatataacattcaaatgggcatgaggtggctgattcagggtagccagtcaggggattcattgttaatgtcatccgactgtttagataggcagttgggaccgaggcttcatgggaggactgatgattcaggggtaaataacagatttacatacaaaactacttcataccaggatcctgttgtagagattaactatgaacgtgctgatataatcatcttgaaattgaagatgaccatagcaagtttgagccctgattgtcttctccagcaaagctcaactgtagaagattcaatttctttcaaattttcttatggtataactgaatcagttccatgctcatacactgaatttgccgagcgactggtgctgccgcaatataaaaatttacctgacacagaggttaaagagttccatagaagagatggttttgaggtagcaagtgctgacaagatggctaagtcatgcatgatgacaagggagctgaaagaggaatgccgagcttcaattctcagttacccaattccaattcatgggttgaggatgttacaagagtttgggatccttgcagtgactagggttgaggattttaccaagagttga

SEQ ID NO: 104082 - DNA, 543 bp, Glycine max
  Peptide Sequence Number=SeqID_220860
atggcggaaagaatccacgcggtggagaaagaaagtggagagtgggtcacagtggagcagcgaaacaccgactacccacggcggtgcagtagcaatcttgatgatggacagcacgacgaacaacgcgctatactacccagtggtcattcacaaaaaccaatgggtaatagtattatccggcagacaacaacgaattggcagaaaagtgaagcagaggagactataggggtaaacattgtagaacaggtggcaagtcattcaagggggagtgagaccaaccaggatgatgagagtggtgaagagggtagcttcgtgggatctccgacagcggagagaacccaagtggtggagaaagaagttggtgagtgggtcatggtggaaagaacccacgtggcggagaaagaaagtggagagtgggtcatggcggagcagccaaacagcgaagacccacggcggtgcagtagcggtctcgatgatggacataacgacgaacagcgcgttacactacccagtggtcattcacacagacctatgggaaactcg

SEQ ID NO: 104083 - DNA, 318 bp, Glycine max
  Peptide Sequence Number=SeqID_220861
atgaaccacatagcctttgtttcaatttcttttcaaaaaaggaggggaaaacaaaatgaagaaaggtctctacttggtgtcggtgatcattctgatcatccacgtacatctaagcatagggcaacctcatcggaggaggtaatgggcaatgacttggaatcaaagttctcatttggttcccatgtgacaagaattgatgcaatcctccctaggaagggaccaatcactagaaccatgagcaagaggctccaagaagattgggctagagctgctgaagaaggccctagggttctcatgaaccttagggtagatttctga

SEQ ID NO: 104084 - DNA, 1470 bp, Glycine max
  Peptide Sequence Number=SeqID_220862
atggcaacaatatctccaatgtggttcatacttcttggaataacttgtttctgtgtgactgattcttatggggcgaacatgcctctaaggactctttatggtggcactcatcaagaagcattgcttggacttgaggcattcaaggcctctataactaggcgtgactccattgcttcaacaccaccttcattctcaccctctcctagtccttctcctcttccatcacaggatctcaagaaatcacatgtgtaccttgtgacatcttatggtgcagatccaacaggcaattcagacagcactgaagctcttcttgcagccatagcagatgcagccaaaggtccaagtgtagggttcttaatgaaggacatcaaagaccttggaggtgctcagattaatcttgagggtggaaagtacataattagcaaaccactgcagttgccactggccggggttggaaacctcatgatacatgggggaactataagagcctcatataattttccaccagatgggcatctcatagacttgtccacctcaggagaaagcaactcctacaattatgagtacataactctcaaggacctcttgctagactcaaacttcaggggagggggcatttcagtcaaaaaaacacttagaatcaacatagaaaattgttacatcacacatttcaacaccactggaattttagtccaaggtggccatgaaacctacataagaaacaccttccttggccagcacatcactgctggaggggacaaacatgaaagggacttctcaggcactggaataagccttctgggaaatgacaatgcagtaacagatgttgtgattttctctgctgaaataggaataattgtcactggccaagccaacactctttctggagtacattgctacaataaggccaccggcttcggtggcaaagggatttatttgaagcttcctggtttgacacaaactaggattgtgaattgttacatggattacaccaatattgtcgccgaagatccagttcagctccacatctctagcagtttcttccttggtgatgctggtattgtgttaaaatcagtcaatgggattgtaagtggtctcaatattgttgataacatgttctccggcttgaataaaggggttgatatagtcaagttggaccaatcaaatagtccttttaatcaaattgatcaagtttttgtggctagaaatgttgtgaggggtatgaacttaaaggccacaactgcaaaaatgtctttgcttggtaatggaaccacatggacttctgattttaccaaagttttgcttttccctaaccttatcaaacatgttgtgtactccttaagtgccaatggcaacaccttcccaaatcatgctctcagaaacgtttctcagaatcgtgttgtgatcgaaacggatgaggctgtgaatgcaaatgtttttgtcacagtggatcaaggtaatgcaagttga

SEQ ID NO: 104085 - DNA, 1836 bp, Glycine max
  Peptide Sequence Number=SeqID_220863
atgtttgtaaacaaagtcttgacaggaacaaatgattggactgcttataaggttggtgctcatgcagcgtgtcagggtgaatggttgctagctactaatatattcaggacgttaatagagaaagtgaagtctgattcttgctgtagctggttaaaagcattattccattatgctcattctgaaggaaaaatccaacttcttagtcaaccaaaacagggaaccacctcaatggagttgatggagactatcaaatttcctataacatcatgtgattacaagggtgatacatgtccaagacttgctaggagtatcaatgattgtaattactatgatcagcttactcagtctcatatggcagttttctcttccttgaaaattttagaagcgtccgtgacaagttctcaagcattttgttttcagaggtggtttttatcattaagagctagagtgttggaaaatttagtgggtgtgcttggagctttgagggaagtttcattgaatgtagctcagaatttcaatcaggtagagattgagagtagtgataagcttcaatgcctgaaatcttatcaagatattactcaagcttctttacaattgttcagactagtagaagaatttgatctacttagagcatctttcattgggatggacagtgaaacttctgcagtccttgcagctcatggtctgagttgttcaatattagcatttgcaactgcttttggagtgtctaacatagaccaacattctcagagaattttaattggtggcaaaacctctaatttacaggctttgacaatacaaagtttaaggaggctattttggagtgtggatcatgaaacccgagcaagtttctctttgctgttgaattattttcacccaaatgagaactgtttatccccgctgcctagttaccaaaattggaacattggttataaagacagagaggtgctaaatgtttgtagttatgccatctctggtgctgtccgcttgtttgagaaaattgcacctcagtttactgagaacgctttatcactaactttcaatactttgatgaaatggatgcacattcattttcggcttcccaggccattcattgggtcgaagctttttgtccacaataaggactctagtaatggggttgatatatctgtttcgcaaggctcccacctaacactgaatatttgtcttcaattgaagaatgtgccaccaaaactcctggttaagtcaactaagttgtactgcatccttcatgtcccatgtggacaaagacaagccccagggaactcacactctggatatgaagcttggaaagatgatgaaattgttgaaatgaaccagaagttgttttgccttgtcttggatagtgcggcaggcaagagaagaattggcatgcgtagtaggggccatggtaatagtagggccgtggagacatttatggattttagacctaatgagaaagggcaggggttttcacattgctcacttgatgtgtctaactttccctttctttcattgagaagtgtagaaaggaaactgcaagtcatgctaaaacaagtttgtctgctggcatccgtggagttcagtcatatagttgagtctcctgttattcaaactgaaatttcaactgttcctttgggatggaataatggaggagtaaaagatggagaacctctgaaagtttatattactggttttgggtggcatctatgtacacatgtccaagtgaatgaaagaagaaatggtttggttttcttaaaatgcacagtcgtgagtattttacattcccaagaatgtaaaacatcatttattgttgaagggttgatgggagtgctatga

SEQ ID NO: 104086 - DNA, 1371 bp, Glycine max
  Peptide Sequence Number=SeqID_220864
atggaaccaacttccgttgctcaagccatggaatggagcattcaactagaaatgggtctccgatctaccaaacctggtgttcctgtgaaagccatatcagatatggagcctcgccttcagcaatggagtacagagcctgaatttggcattgctccctatgccatgtttggtcttgttccaggtgaagataagttatttgccaataccatcctcttgcgccttgttgatgcctttagaggaggtgacatagagacaaaactttcagttgttagggttttcttgtctgaacggaaacaccgtgataaagagaagaaaaaacagtgtaaaggattgctgtcagaggccaaagtagctaatcacttggagttgttgaagagagtgaaatctgtttttgatagtggggaattgaagtcgaaggcattggctttggttctgtttggttgttgggctgattttgtgaaagacaatgctcagatacgatacttgatattttctagccttgtttctcctcatgattgtgaggtgagagcatctttgtatgccactgggtgcatttgtgagatatcagatgattttgcatctatttcagtggagatgctattcaatataatgaattcatcttcagtgcctttgcctataaagttggatgcagctcaagttttggcaaaatgcaaatcttcttattcagttgcttataaagcatataagacaggtatggagttggtactaaattcctcggatgaagaatttttggttgccatgttattctcactctcaaaattggcttgcattttaattccttgtatctcttatcaagtggactttcttctttcatttctcaaccgagacagaacttcacatgtacaagacacgacgttaaaatgcttgcattttttattccgaagaggattgtatgaacactcagataatttaggtctaattcgggggttattttccataatggagggacctgaaatttcattggccatgcaatataaagctctaagggtcttgcacaaggttcttctttcaattccaccttcttcacttcacaaggaacttcgtgagtttgtcaggcttctaactgttgttgagaatgcaagtcaatatccagcctcaaggaagaggtgtttgtcaattcgtattctggcagatttgtgttgtaggacgaaggatatagcagatattgacgaagttttttgttgttctttgccatcgcgtgttatctccctaatcaaagatcatatcaaacttttgttgaagacattgttggaaggttgtcaaaatgatttgacaatttttcaagagctccagggtttgctaaagattcttctaaatattgttgaaagacaccctaatcttggttctttg

SEQ ID NO: 104087 - DNA, 1104 bp, Glycine max
  Peptide Sequence Number=SeqID_220865
atggattttctgcggtgcttgctattggttattattcttccgttgtgttattctattgatgctgcatgttctaatggaaaatgcaagcttgacgatgaatgctcgtctaacggtgattgtggagccggactctattgtttctcgtgcccacatggcttttcaggctctaggtgtgtgagatcttccatcacagatcaattcaagctcataaatgactctctgccattcaacaagtatgcatttttgacaacacacaatgcttttgccatcaatggagaaccatctcacacaggagtgcgtcgagctaccctcagtaatcaagaagacagtgtaacacagcagctaaaaaatggagttcggggactaatgctagatacatatgattttgatggagatgtgtggttatgccattcatttcgaggccactgtcatgacttcacagcttttgaaccagccatagatacactgaaggaaattgcagcttttctatcctccaacccgaaagaaattgtcacactcatattggaagattatgttgaagcaccaaaaggattgacaaaagttttcactgatgctggtttggtgaagttttggtttcctgtgactagaatgcctaaaaatggaggagattggcctctagtgagcgatatggttgctaaaaatcaaagattgctactgttcacttcagtcagttctaaggaaaaaagtgaaggcattgcataccagtggaattacatggttgaaaatcagtttggggataaaggaaggaaagcactcaaagaaggaagctgtccaaatagaaaagaatcttctcctcttgacgacaagagcaagtccttggtgttggtaaactattttcgcactattcctctgaagccaatctcatgtgaagataactctggaggtctcattgaaatgctacaaacctgtcaccgtgctgccggcaacaggtgggctaattttgttgctgttgattattacaagaggagtgaaggaggaggttcgtttcaagctgtggacactctcaatgggaagctcttgtgtggttgtaatgatgtccatgcgtgtgtgcatggatctactgcaaaagcttgctcagcatag

SEQ ID NO: 104088 - DNA, 519 bp, Glycine max
  Peptide Sequence Number=SeqID_220866
atggaagctacgcttgcaaatttgtattggcatggtgcacaggctgcattatcttcacaaattagttgtaactgcacaatcatccacgatgaagtgaaaaccaccaacatcttgttggatgaggactgggtggccaaggggagctttgggtatatagacccagagtattacaaacggaagcatttgacggagaagtttgacatgtactctttcggggtagtgttgtttgaggtcctgtgtgctcgtttggctctgatttgcaccacagagtcgaatcaggagtctcttgcttattgggtcagatactgttaccaaaatggaaccatagagcatattgttgcccccgagtgcttcaagatgttttgcgagattgggatgatgagttgtttgtctgggacagagaggtcgtccatgaatgacattgttcggatgctgcaatttgcgttaccgatatttagtagccaagacttctttctccgagattatagacccaaggctgtgtttggggaatcaaattaa

SEQ ID NO: 104089 - DNA, 759 bp, Glycine max
  Peptide Sequence Number=SeqID_220867
atgggtttcaagctcatgggaattgacacgctgtatggcttaagaaccaacactgcactagagatagagtatagaatcaaagtgggagaaataaatgatctagcaactaacatgaacagtaagatgaacataatggtgaatcccgattacgtggcacccaaggaactgtacagaacaactcgtggcatgggtctgaacaagagcctcgagttgacttgggagttccctgttgactctggtttcacttacatggccaggttccatttttgcgagcttgacccaaatattactaacattggagacatggttttcttcacttacatagggagcgagttggctgaggaccacgctgatgttataagttggagccagaaacagaaaggcctagctgtgtacaaagattatgcgattttaatcccaagaatgatactcataaaaagtttactcttgttgtcaaccaacacgcaggattacaagcttccaaccaacatgtgggattataggctgccaaccaacatgcaggattacagcgaaaaatgttggccatacaatcgcctctgccaatgcttttccctcgacgaaatcaaagccgccacaaacaacttcgacaacacctcagttgttggtgaagggggattcgaccatgtgtacaagggctacatagatgacatttccatcccagtagatatcaagcatctcaaaccaggatcaaagcaggggtttgaagaggtcctggccgagattggaatgctctcatag

SEQ ID NO: 104090 - DNA, 234 bp, Glycine max
  Peptide Sequence Number=SeqID_220868
atggagtggaacgcaaaaacgacgtcgtttaggagattggatttggagaaggttgaggaggaagaggatgaggatgaggtcgaggaagaagatgatagaaaagaaggaggcgatggcctctctttgctccgatggtctcaatgtgcagttgctgccatcgttgccattgaacccctggtcggttgtcggagaaagagaaaccaggtggaagcaacgcgttttctgaaaatgtga

SEQ ID NO: 104091 - DNA, 150 bp, Glycine max
  Peptide Sequence Number=SeqID_220869
atgggtgctagtgagtcatggtggatgatagagatgacaatggatgctggtgatttcttgggtcctaaagtagaggagaagaactggggttttgcagggaagagaaatgcgaggaggaaaagtgtggtgcttctatgcacaagaatgtga

SEQ ID NO: 104092 - DNA, 477 bp, Glycine max
  Peptide Sequence Number=SeqID_220870
atgaatgctattcttggattccaagaacttgatgagattaaaatttcaaaggttgcaacctcgaagcaagcatgggacattttgcaacaagtatacaacaatactgggagaacaaagaaggtcaagctacaatctctcataagacaatatgagttgttatcaatgacagagcaggaaaccatcacagactattttaatcgaactcaagtagtgacaaactccatgcaagcctgtgatgaagcaatggtcgattcaaagattgtggagaaggtgctcagaacattaacacccaaatttgatcacattgtagtagccattgaagaatcaaaagattgtgagaatatgactatggaagaattggaaaactccttggaggcacacgagcaaagggtgctcgaaagaaagagtaatgataaagttgcaaagcaagcacttcaagccagaaccaaccacaagtctagcggtcgtggtggctag

SEQ ID NO: 104093 - DNA, 180 bp, Glycine max
  Peptide Sequence Number=SeqID_220871
atgccgagaggaatgagaataagggctacatgggggtacgtgagcttagttgaaggtgggcaactggggatgagtggtacctggagatatgtcgcgggggttaggagaccttggggacgtcaggtggggtgctattgcccaaaaccaagcttgatcaatcccgacccatcccgggcatag

SEQ ID NO: 104094 - DNA, 288 bp, Glycine max
  Peptide Sequence Number=SeqID_220872
atgcggaaattgattaaggaaaggatggaaaataaggtggttaattttgtgggtcttaataaggtggtttctggcataaaatggatgaatgggatgaaatatagaaatggcaataacggaagctacagggctccaaatgaggtgattccaaaacgagaggtggattttctggaattgtggtttgaaagaacaagggtggagatgataggaaggaaagaatcactctttccagcgagggcaacacacaaaggttgtgaaagtcctttgatacagccagggtgttcttga

SEQ ID NO: 104095 - DNA, 330 bp, Glycine max
  Peptide Sequence Number=SeqID_220873
atgcaccgcgaagaggaagtcgaagaggtagccaccaatggttctcctcgacggccgcaccggcttcgtggaggtgcgcctctatggcgacatggtgctccgctacgtcagcttcaaggacgtcgggccgcaagcgccacacgcagatccatcgcggtggtttttgctgggattcaaggcctcagcgtcgtcatcttcgtttccagagctagaccacgggattcggcagctggaccacgccatcgggattcgaggccttgggtttcagagtcgccgcgctccctcacttggcttcgactcgctctctcaatcgctggttccactcgttaa

SEQ ID NO: 104096 - DNA, 153 bp, Glycine max
  Peptide Sequence Number=SeqID_220874
tgccttgataggggaagtgtagatgacgcgctggccattgtagagggacatgccaataacatgcaatgccaccatggttttcctagcaaaggggtcgagagggaaagagaagttcttggcggattctacagtggtgtgagtttgagaagaagg

SEQ ID NO: 104097 - DNA, 276 bp, Glycine max
  Peptide Sequence Number=SeqID_220875
atgacaaaagataacgattgtacctcaaagcctaacactggggcaatgaagggcatcgtgcatgagcctcaagtgaacataggggcagatcaaaagttctcacctgtcgatgtggacccttgggtactagtacctatcacctttagaggactatatgtcctcgccatcagaggactgcacatcctcgcctgcagagagctgcacaccctcgcctttagagggctacgtgtcctcattttcagtgtgctccatatccacaccttaggagaatataag

SEQ ID NO: 104098 - DNA, 207 bp, Glycine max
  Peptide Sequence Number=SeqID_220876
atgaggacacgtagccctctaaaggcgagggtgtgcagctctctgcaggcgaggatgtgcagtcctctgatggcgaggacatatagtcctctaaagattgactgtccttttgaaaaaggtgataattcatgcaaccttattctatcttttgcaaatctctccgggaactccctcagagtgtatattctgtttgatttagtcacttga

SEQ ID NO: 104099 - DNA, 387 bp, Glycine max
  Peptide Sequence Number=SeqID_220877
ggcgcagaagacgacattagtcaatgcgtgctatcaggcttttcatcttacagacagcaaaaagtttatacggataaccactcgggtatttccgcccgtcagcgtgactcaaaagtcagtatgacagatcttgtgagcgcggaagatgaccaacaaaaagtttatacggataaccactcaggtatttccgcccgtcagcgtgactcaaaagtcagtatgacagatcttgtgagcgcggaagattacaagacgacgttagtctcctgtgctatgaggctattcggcttacagcaaccaaaagtttatacggataaccactcgggtatttccgcccgtcagcgtgactcaaaagtcactatgacaaatcttgtgagcgcgaaagatgac

SEQ ID NO: 104100 - DNA, 105 bp, Glycine max
  Peptide Sequence Number=SeqID_220878
atgcctatttcgggaaaagagctctggaggcaacaagaggagcaacttttgcagagatacctaggtttttctaggcctaatcttacaagagggatctacggatga

SEQ ID NO: 104101 - DNA, 444 bp, Glycine max
  Peptide Sequence Number=SeqID_220879
attgacaacaacaatgcccatagaaaatacaagaagaatgatcaggcacacttggcacaggaggaagatggatctgattcagatcaagttttgcttatggttaccacgagcagtaaagaagactactcttcctggtatcttgacaccgagtgctcgaactacatgacaggcaatagagactggctggttgatttcaatccaaatgtcaccactagtgtgaggtttgtagataatagcaccatccttgcaaaaggtatagggaagcttcttgagaaaggatttaccatggcaatgcaggaaaactatattgagatcttttatgataaacaaagactagtgctcaaggtaccattatccagaaataggacattcaaggtgaatttaagtattgctgccattcaatgcttgtccactattaacacagaagaagatagctggcaatag

SEQ ID NO: 104102 - DNA, 1065 bp, Glycine max
  Peptide Sequence Number=SeqID_220880
atggcaccacaaagagccaaacaacctcttagaatagtccattcagacatgtgtggacccttcgataatccatcccttggtgttgaaagacaatctaaattggagctaaagatccttagaacagatggaggaggtgaatataactctaaggagttcaaagaattctgtgaagttaaaggaattgaacataagggagaagctgtcaccacaacaacatatgttttgaacagatgtcccaccaagagacttcaatctgtaacacctgaagaagattggaccggggacaagcccatggtgaatcatttaaggatttttgggtctcttagctacagacacatcccagatgaaagaagaagaaagctagataataagagtgaagctcttatcctagttggatatcatccaattggtgcatacaaactttacagtcccttgaagcaacaggtggtgattagtagagatgttgtggtagatgaaacagcagcctggaagtgggataatgagtctaaaattcccagctcatttattctcgaggacaacccaagaaccaaggatgttaaccctgctagctcaatgcaacctcctgccttggatatcagagaatggaaggctgctatgaaagaagagttggatgccatagagaaaaatagaacctgggagctggttgatctgccacataataaacattcaattgatgtgaggtgggtgtttaaagtaaagctcaaaacagatgactcaattgcaaaacacaaacccaagctcgttgcaaaaggattccttcagaaacaaggaattgattatacagaagtatatgccccagttgcaagaatggaaacaatcagattagtaattgttgttgccagttctagaaattggaccatatgtcagcttgatgtcaaatatgattttttgaatgggccactagaagaagaagaaattcagcacaagaacttgctatttgtatgcttgtatgtgaatgatctgatcattacaggagatgcgaatgaagaaatcgagcaattcaaagaaaagatgaagtcagagtttgacatggcagacctttga

SEQ ID NO: 104103 - DNA, 1066 bp, Glycine max
  Peptide Sequence Number=SeqID_220881
aggacttcacgtcctctccttcagaggaccacacgtcctcgccattgtaggactacacgtcctcgccttcaatggactacacgtcctcgccttcagcgggctacacgtcctcgccttcagaggggtacacgccctcagcttcagaggacttcacgtcctcgccttcagaggactacacgtcctcgccttcaaaggactacacgtcctcgccatgagagggctacacgtcctcgctttcatagggctacacatcctcaccttcagagaactacacatcccccccattagagggctacacaccctgccttcagaggactacgcgtcctccctttcagaggactacacgtcctcgccttcagagggctacacgtcctcgccatcaaaggactacacgtcctcccctttagagaagtacacgtcctatccttcagaggactacacgtcctcggcttcagagggttacacaccctcgccttcagaggactacacatcctcaccatcagaggactacatgtgctaccctttcagtgggctacatgtcctcaccatcacagggctacacaccctcacctttggagggctacatgccatcaccttcagaggactgcacgtcctcgccaacaaagggctacatgccctcaccttaagaggacttcacgtcctctccttcagaggactacacatcgccgccttcataggactatacgtcctagccatcagaggactacacctcctcgccttcatagggctacatgccctcaccatcagaggactacacatcctcaccttcagagggctacacgtcctcgcctttagagggctacacaccctcgaattcagaggactacacgtcctcgcctttagtggggtacacgtcctccccttccaaggactacacatcctcgccttcagagggttacacgccctcacctccagaggattacacgtcctcgccatcagaggactacatgtcctcccctttagagtattgcacgtcctcctctttagagggctacacgccctcgccttcagaggagtacacgtcctccctttcagaggactacac

SEQ ID NO: 104104 - DNA, 303 bp, Glycine max
  Peptide Sequence Number=SeqID_220882
atgccaccaaccgcctcctcgttgaaaaccgcttcgccttccaagacattgtctcttgtctcgtcgctgcctgctgcttcgaccacattcaccactagatttcactccaccacatcaaaacaaagggaccaaattgagggacttaccaattttgtaggtgactgtggcagccgtggcagccgtggcagtcgtgcgatcgtggcttcgtgcagttgtgcgacgacggaagtgagaactagggaagtgaaggttttagaactagggaagtatgggtttgagaatgagggagtgaaggagtcataa

SEQ ID NO: 104105 - DNA, 510 bp, Glycine max
  Peptide Sequence Number=SeqID_220883
atgtatgaaataccaacaagcgttggcacactaagccatacacacccccacgatttaagtaaagaggagaagagaaagttagagagagaaaaaagaaaagaaggaatcaggttagagaaaaggaggagaaaaagtaagaagaggaagaagaaagggctacggtgccaagacccaatgcccaaaaatcatttccacgtgttaccagaggtgagtgcttcctccattgtccatctcttccttaaatttgttgttttcttttttctccctttgaatcctaagcttggaggtaaagaaattttgaggattataaactccatttttggacctaatgttgaattcaactcagtttgtaggccaaagaagagaaggtgcaaaaagctgctgatgaactcgcttagcgaggcagattggctaagcgagtctcattcgcttagcgaggcagccagctcgcttagcggatgggaaaccctagaagaggataagtcagagatccacgccctcgacacgtga

SEQ ID NO: 104106 - DNA, 315 bp, Glycine max
  Peptide Sequence Number=SeqID_220884
atgggaaacagcagtactggtacaagaggagcaaatgaggaatcctctcgatcacatgctatacttcaactttgtatcaagggatcagctgatgggactaaatcaaagcctgctcgacttgtgggcaaactatcttttatagatctggctggaagtgaacgtggtgcagatacgacagataatgataagcagactagggatcctctttcttcctcaaaccttagagactctgctgtgttgcctggctcttcagttttatctcatgatgataccttggaggatgaagtaacatatgtttccggtgacaagaattga

SEQ ID NO: 104107 - DNA, 336 bp, Glycine max
  Peptide Sequence Number=SeqID_220885
atggtgggttacacaccttcaagctttgcggatttggtcttcaccggaaagaggatcaaaatgtgtttggaaagaggtatatctgatcatcctgctttaataaatgcaaaaactggggcaaatgaagaggatgagaatgagggagaaacccttgctatgactgccattcctacacggtcaaatttcccatcagcccaacaatgtcattactcagccaatatctgtccttctcattacccaccatctagtcatccagaaaggccatccctaaatcaaccacaaagcctgcccgccgcacatctggtgccaaaacaccaaccaaaaggaattttgtag

SEQ ID NO: 104108 - DNA, 585 bp, Glycine max
  Peptide Sequence Number=SeqID_220886
atggctttggacaaggtttccaattgtggttgtgaaccattaatcatggtttgttttggaggcctctgcaaccatattgcgattgcaattgcagctgcttcagacacatttttctgcaattgtcagacaccagagctatcagatgcatacagccatgaaggttcatctgacagtgaagagaataagaaaggaaagtctctgtcaagcaatgagatcctgaagaaactgaggagatatggaatttctggaatcctatcctatggacttttgaacactgcatactatctcacaacgttcctttttgtgtggttttacattgctccagcacctgcaaagatgggctatggtgcagctgtaaaaagatttctcaaagtgatggccatggtgtgggctggtagtcaagtcactaaacttgtaagagctggaggagcattggcactggcaccttttgttgacagaggattgtcctggtttactcataaatttaagtttcaaacacaagggaaggctttcatggcaatagtgggactctgtcttggattggccctcattgtattttttgtcatcacactgctttgggcatga

SEQ ID NO: 104109 - DNA, 228 bp, Glycine max
  Peptide Sequence Number=SeqID_220887
atgcttacactgtcattgctgaaacttgaacaaagccttcttccatggaaggtgaggcacaaacggctattgttcttcagttcagggaagtgccatggcatgaaaagggtaccagcccttttctcggagaagcgagggaagccctctaacgcaaacttgagacatacccagacagcagaaaacgaaaaaggtcataaatttggattcaaatggcaaaaaagggtgtga

SEQ ID NO: 104110 - DNA, 775 bp, Glycine max
  Peptide Sequence Number=SeqID_220888
aacccaggagtggaaaacctacatcgacagccgtaacagcggtaatttcgatgtgatccgcgcttcgtgggtgggcgattacaatgagccgtcgaccttcctcagcctgctgaccgccagccacagcggcaatatttcccgcttcagtaacgcggaatatgatgcggtgttgagtaaagccagcaatgaaaccagcgtggcggcgcgcaatgccgattacaacaaagccgagcagatcatcgctgaccaggtgccgattgcgccgatctaccagtacaccaacgggcggctgatcaagccgtggggcggtgaacgacccggcgagtacgtgaacgtcattgaaggaaaagcgctgcaggtgtcggatgcgattgtcgcctgccagttcgacggcaagggtggcgttatcgccattgaagataaagatgtcatcaactgcgagcgtcactgctggctacacctgaactatacccagcggcaaagcgccgactggttgcagcacacgccgctgatccccgatgcggtgcgggatgcgctggccggcgacagcatgcgaccgcgcgtgacgcgtctcggtgacggctttatgatcgtgctgcgcagcgtgaatcataacgccgattcgcgcccggaccagctggtcgcgatgcgggtatttatcaatgacaagctgattgtttctacccgccgtcgcaaagtgtatgccatcgatgaagtgctgaccgatctgcaaaacggcaacggcccggtggacggcggcagctggctggtggac

SEQ ID NO: 104111 - DNA, 150 bp, Glycine max
  Peptide Sequence Number=SeqID_220889
atgtcacctaacttcatgggtcaggatgacaaaggtgctgaagacgataagacgacgttagtctttgcatactaccagactctgagtttgacggatagcgaaatagtgtttatacggataaccacttgggtatctccctctgccacctaa

SEQ ID NO: 104112 - DNA, 155 bp, Glycine max
  Peptide Sequence Number=SeqID_220890
tacctttcgtggtctttacgtgtacctggtcatgtcttggcaagatcaatcccttgtgtgttcatgggatgcatggacaggatctcccaccctgagttagcccttgtagtgggcgtaaaccttaagtttgaacaagtttacggaagtgagaagtg

SEQ ID NO: 104113 - DNA, 282 bp, Glycine max
  Peptide Sequence Number=SeqID_220891
atggcaaaggggtgcggaatgaccaaattttgtctccgcatgtcatcgggcccgccgcctctggatgacaaagagtgcagaatgaccaatttttgtctctgcgcgccatcggacacggctgtgtctgaatggcaaaggggtgcggataaccgtaaggtgtctccgcgggttaccagctcttgggtcatgacagcaaaaagcggtgtggtcgacaaaagcgaggctcttgctcctacgtatcctccaatgaggaactcagacgtagttctggataacttgtga

SEQ ID NO: 104114 - DNA, 270 bp, Glycine max
  Peptide Sequence Number=SeqID_220892
atggagattataaggaaggatgaattggtgttatggatgcttcagatggtccgtggcggcgatggccagcagcagaggtggtggaggacgttccctttcgcttcttcgatgattctgccatttgatgaagttttaatgaatttcaatcggtggaatcgaaagaggagtgaaaatgaagaagattgggctttgtgggacgtgatttggttaagaattgagggagatatgaaggctactgtaatcgattacaggctatctgttcttgtgtaa

SEQ ID NO: 104115 - DNA, 345 bp, Glycine max
  Peptide Sequence Number=SeqID_220893
atggtgtggatcaataaggtgcagacgaacctggaatcaaaaagcagagagagagagggaggtggtaactgtgcattgagagggagggagagagagcgctggatcaataaggttgcacttcttgatctggagctagtggatgagcacgacgttgttgaggttgctattgatgacaaagatgtcgacgcggtcaaggagatattggggtgcacgcaaaagccatttttcttactcgaagaatcccttcctgcagctcgagactcgtcaaagattgccccaacaccaccttctagattcaggaaacccgcacaagcccacaaatcaatgatcaatgacgctgcaagg

SEQ ID NO: 104116 - DNA, 198 bp, Glycine max
  Peptide Sequence Number=SeqID_220894
atggctgcagcagccaccgcgaaaccgcttctatcactgtcgtttgtgcttctgttaccgtcatttctttcaatcgccgtcgcttacagacccgacgacatcattcccatgagctgcatggtcgtgaaccgtgtggcagtacctcattggccgccactgccccatcttcgctgtgaattgcgaggtgtgaaaaattga

SEQ ID NO: 104117 - DNA, 369 bp, Glycine max
  Peptide Sequence Number=SeqID_220895
atggcaggtagggctggatatacaaatcgactgcgtgcgggcggtggcggctcaacgccgccgcaacggctggcagttgcgccactggtggcagcaggcgctgccgcaggcggttttgcgcgatggctgcctgcaaccttccgaattcctgatccgggcgctgcggcaatggcgcgtccagctgccgcgacatatttccttacgcattgctctaccggcgcaacgcgtgttacagcagcgcatgacgcagccggacgcgcggctgcgcgagccggaacgcagcgactatatcggtggccacggtttgaagcagttcccgctcgacggccagacgttggtgctcgactatcgcgccgcgccggcggatga

SEQ ID NO: 104118 - DNA, 639 bp, Glycine max
  Peptide Sequence Number=SeqID_220896
atgtccaaatcttttgaatttgggatgaccgactctctcgatgagtcgatctcttgctttctcataaggatggaccctcggaggactgcacgccctcaccttaagaggactgtgtgtcctcactttcagaggactgcatgtccttaccttcagagggctacacgccctcgccatcagaggactgcgtgtcctcaccttcagagggctacacgccctcgccatcagaggactgcatggctacacgccctcacctttagaggactacacgtcatcgccaacagagggttgcacgccctcaccttgagaggactacacgtcctcgccaacgtagggctacacgccctcacctttagaggactacccgtcctcgccaacagagggctgcacgccctcacctttagaggactacacatcctcgccttcagaggactacatgtcctcaccttcgtagggctgcacgccctcacctttagaggactacacatcctcgccaacagagggctgcacgccctcacctccagaggactacatgtcctcgccttgagagggctacccgccctcgccttgggtactagttaccctcaccttcagaggactacatgtcctcaccttcgtagggctgcacgccctcacctttag

SEQ ID NO: 104119 - DNA, 345 bp, Glycine max
  Peptide Sequence Number=SeqID_220897
atgggtgactcagacaaatgcgggctgtacatcgaagaaaatctttcttgcctagttgccctaggaagaatttatgagggatccacaattgttcacaacatccttttgttgcatggccaggtgaaggttggtgttaaggaggttaaagatgaagaggctctcgttcctgtacccactgatgaggttcaactagtggggcaggcattgaacaccttccttgcttggtcgacacatctcatgaagcgtgtatcaaaacatgcagctgtgtctccagcaaagcctccagataggccagatcctgaggtcgatgatcccttgtatctgatgacattgaccatcccatag

SEQ ID NO: 104120 - DNA, 312 bp, Glycine max
  Peptide Sequence Number=SeqID_220898
atgcaaaggataccaaaaagcaggggcaaaagggtctttttattgagtttccgggaccttagctcgcccaggctagcctctggctcgcttggaccacccacaaacttcaatgttaagaaaccagctcgcttgagggttgaggaaggggggggggagcattcggtagtaaagaaaattgagagaattaggagagaagaaaaagaaactaagtcgaggtggtaccgaatcctggcgattgtgatcaacctctacatcgttcctcgttcagtgttcttcgtgctaccgtcggttagttttgtttttgaggattga

SEQ ID NO: 104121 - DNA, 976 bp, Glycine max
  Peptide Sequence Number=SeqID_220899
atggggaactcccatatcaacttggaaatctctcacagttgaggtatcttgatcttggtgagaattcattttcgggagcactccctttccaggttgggaatcttcctttgctgcacactcttggacttggtggcaattttgatgtgaaatctaaggatgcagagtggttgacaaatctgtcttccttgacaaaacttaagctaagttcactacacaacctttcctcttcttggctacaaatgatcagcaagcttattccaaacataagagagttgaggctatttgattgttctctttcagatacaaatattcaatctctgttttattcaccttccaactcttccactgctcttaccattgttgatctttcttcaaataagctcacatcctcaacatttcaactgttgtcaaactttagtcttaatcttcaggagctttatcttcgtgataataacattgttttgtcatctcctctctgcccaaactttccttctcttggtatccttgacctttcctataataatatgacatcatcagtctttcaaggtggtttcaacttcagctcaaaacttcaaaatcttcatttgcaaaattgtggtctgacggatgaaagttttcttatgtcatcttctttcattatgagttcttcatcttctcttgtgtcccttgatctctcctcaaatctgttgaaatcatcaacaatattttactggctccttaaatccaccacagatcttcataaccttttcctttatgataacatgttagaaggtaccattccagatggatttgggaaagtaatgaactctcttgaaattcttgacctcgccggtaacaaactgcaaggcgtgattccatctttctttggtaacatgtgcacattgcagttgttagacctctcaaataacaagttgaatggggaaatttctagcttcttcaaaaattcttcatggtgcaacagagacatatttaagag

SEQ ID NO: 104122 - DNA, 366 bp, Glycine max
  Peptide Sequence Number=SeqID_220900
atgcctatgatggatcctacagacctcccatggggtggcctaggtaagatttacttccctcacatagctcaagagatgaaaaccttggagtcagaagaatgtaataataacaaggtaaatcgtgcattccctgatgaattccttggaagtaaaggcaaaattgtcaattgggttgaattgaaattagacaagggtggaaatggattaatactgaagggagagataaggaagaaggtggaccaattgcttgggaatgaagacatcaaagctagatcgttgaaactgaaggaattgactgtgaataactcagttaatggtgatcaatcttcaaagaatctagaaaagtttattaactgggcaaagtag

SEQ ID NO: 104123 - DNA, 375 bp, Glycine max
  Peptide Sequence Number=SeqID_220901
atgggtgagaaagagtcagagaagctaatttgggaacaaatgagaactcccacagttgccactcccattacaccacaacacccaacattaccaaaacttcttgtccttctcattctcttcttctttgtcacctacatcatatacacgctcaagcttgtctccacctcacgcacctgcaaagacaccctattctccaccgacaccttctccaaaaccatcatcgccgtcaatgccatcgcctccgccatcgcagttctcaaacgaggctcccgtgagacaaatcttgaggaccggaccaacctcttccacttggtgttcggaatcgcggcgtcgaccaagctatgggaccaaaggaaaagctacatcaaactctag

SEQ ID NO: 104124 - DNA, 303 bp, Glycine max
  Peptide Sequence Number=SeqID_220902
atgcttaagtacacgaacaagcaagggcatcggtcggcgattaggatctcacggatcgtgtcagaggcgctgcgactggggatgaaggacatgcagtggttcatgatgagcgatgacgactccattttcttcaccgaaaacctaattcacattttgagaaaatacaatcacaatcgttctattagatggggagtttgtcggagagtcacttgcaaaacattttcttctcttacaacatggcctatggcggaggaggttcatgcccatagcaacttgggtaatcttatgaaagctcaaggctag

SEQ ID NO: 104125 - DNA, 576 bp, Glycine max
  Peptide Sequence Number=SeqID_220903
atggataaccctaaacaaacacttgggagtttcgcagtggtaacactactctttgctggggttattttgctgtacaactggtccacctctttctccaatgaattagtgctatcccagaaggaaccactatgcgagcaatcaaattctaccaccaccaatgttgaagcatatggagatagccttgactatgctttggccaaagcctcaatgggaaacaaaacggtgataattgctatagtaaacaaggcatatgtagagcaagatgtagagagtgacaccaccatgcttgatatatttcttggtagtttttggcttggagaaggaacaaggtctctcattgatcacctcctcatagttgcggttgatcaaacggcctataatcgatgccaatttttgaggttgaattgcttcagattagaaacggatggtgttggttttgaaggtgagaaaatatacatgtctcaagatttcatcaagatgatgtggagaagaactcaattcctcttggaagttctcaaacgtggctacaattttgttttcacgatttacagatatgcagttgggatatcgatctga

SEQ ID NO: 104126 - DNA, 1869 bp, Glycine max
  Peptide Sequence Number=SeqID_220904
atgggaatagtttcaactaggaatgatgatgaagaggaggttaaggagtccatagatgaatatgagaaagatgaacgcttagatttggaggataatgatcctgagtatgaacctgaggagtatggtggagttgattatgatgagaaggaaattgaacaagatgagggtcatgaggtaggaaatgaagtagaggaagaagaggctgaagataatgtaggtgaagaagagggtgatacaggtgaggaagaagtcgaagatgttcatgacgaacttgagggtgaagaggagcatgagcatgctggtgaggagcgtgagcatccagactttgctgacgttgaggaagaggaacaccgagaagtcgtgaaggagaggcaaaagcggaaagaatttgaagtttttgttgggggcttggacaaggatgctactgagagtgatctgaggaaggcttttggtgaagttggggtggttacagaggtcaggttgatgatgaaccctcaaactaaaaagaacaagggatttgcattcttgcgttttgaaactgtggaacaagcaaaacgagctgtagcagagctcaaaaatccagtgattaatggcaaacaatgtggtgtgactcctagtcaggacagtgataccctctatttgggaaacatatgcaagacatggacaaaggaagctttaaaagagaagttgaagcattatggagtcaccaatgttgaggatttaactttggtagaagatactaatgatgaaggaaagaaccgtggatttgcgtttttggaatttccttctcgttctgaagctatggatgcctttaagcgactgcagaggagggatgttgtatttggagttgataagcctgcaaaagtttcttttgcagattcctttattgatccgggtgatgaaattatggcgcaggttaaaactgtgtttattgatgcattgcctccttcatgggatgaagattatgtccgggatcttctcaggaaatatggtgagattgaaaagattgagcttgccaggaacatgccagctgctcggaggaaggactacgggtttgtgacatttggctcacatgatgctgccgtaaaatgtgctgatagtattacaggcacagagttgggtgagggagacaagaaggcaaaagttagagcaaggttgtctagaccactccagagaggccgcggaaaacacattagtcgtggggactatcgttctagtcggggatctggaatgatgacgcggccttcatggagccgacctgcacctcgttcttttccttctcgtagtgtaagaggagttggaagtcgtgctccacctgtcagaccagttagtgtgagagatagacgccctatgatgtccatacctgcaagaagtaggccagtgcctcctccatctagatcttatgataggagaccagttgctcctgcatatccaaaaagtagcatgaagagagattatggtcggcgtgaggatataccacctccaagaagtagagttgctgtagattatggctcaagggttgcttctgaaagacgaacatcttacagggattatcctgctcgtggtcctggctacaccgagctccctagaagcacatctcgtgctgcaccaaggagaggctatgtggatgatgggtatggccagagatttgagagggctcctcctcctcctcctcctccccatctaagttaccgtgaaggacgtccccgagattatgatgctctgtctggctcaaaacgttcttatgctgctatagatgatgttcctccacgatatgctgatactggtgctcgccaatcaagagctcgactggactatgactatggcggtagtgcttcacagtatggagatgcttatggtgataggtaa

SEQ ID NO: 104127 - DNA, 196 bp, Glycine max
  Peptide Sequence Number=SeqID_220905
gttggtggcagctcatattcatcaatgtattctggaaggggtgtgggtggtggtagcagttatatgggtggtggcggatcaggatcttattattgagcatctcttatttttttcacaagtgccggcgaaggttgcactctggtcaccagtgcatttgtctgtgaacagatctgatatgataaagtggctgctgtag

SEQ ID NO: 104128 - DNA, 840 bp, Glycine max
  Peptide Sequence Number=SeqID_220906
atgcatgcatttttctataccacatgcattaaaacgcggttaattgattctagagatttcggtttgacgttcaactttcggtgcagcaaaacgcggtttcatattgaatttcgccatcaacaccacgatagcattggaaaaaattgtttaaggtgtgttttggtttcagactttcacatatcatcaagttggagcaaaatttaccgtgcgagagagttggattcatgcgctgggaactactaccaaatcatgagtgtgcctaattcctcctgttttgaattgacaaatctttttgcgaaaatcttgaaccaaaggcagaatatccatgaaaaggaggagcaaggagacgatgagaagggcaagcttgtatcattaggacaaatgaatagtttaagtagcaagcaagatgttccaatgttagacttagttagagccatgtgcagtgtccacgatgagaaatcaggacaacctttagcttttgagtacacattgaacacaattatgcattttgttctggttgtgtgtagtgaggtgaaagaggatagtagaacatcaaagaacattagttctgaaggtgaaagaagaacaccagaaatcatgggaagatgtgcatcctggtgggcaaccttcacattttttgtgtgtttgtgttcattaaaattcagcaaaccacttctccaaccacaaggacccaattcactatggcttgccatattaggaatgttcagttttactgtgtttgtatctgctgcttctgttatggttgttgttgaagcacagttcactcgtatgcagataactgttatgctcagtgccttcttggctctgctgttagcttaa

SEQ ID NO: 104129 - DNA, 252 bp, Glycine max
  Peptide Sequence Number=SeqID_220907
atgacaaaaaatgtccttgatcctaacacctcctcttcctcttccctatgccacccaagtacaatgccattggaggcaacggagtttttgaggacgatgtcattggaggcgacgaagaaggcaagggggtgggtggtgaagtcacaatcattgtcaatgaggatgggtggtggaggtcctacgagagggtttgagtttcaagaagggaagaagggttccaccgcctattctagaacaactattcttgaatag

SEQ ID NO: 104130 - DNA, 243 bp, Glycine max
  Peptide Sequence Number=SeqID_220908
atggcaatgctgtatagcaaaatccactatcatgaacaaatagcaatgctatatacttcaactcagagatatcctgcggtagacgtcgttccagcgcacgatggggcggcgctcgtagtcgacggtgccgtagctgtggatgttggagatggagcacgtgaccaccgagaggcgagggtggaagcacgtgtgagcatgggtgagagtggtggaggaagaagaagagtggttgaagtggagtga

SEQ ID NO: 104131 - DNA, 666 bp, Glycine max
  Peptide Sequence Number=SeqID_220909
atgggtcatgatcccaagttgttggaagaaaaggaaaatcgccattctcatccccccaaccatgctgtgataaagattgacgataatggggtgttgaaggtagataaaagagagacaaagagattgaacacatttttgaagttttatgggaacagaatattccaatcacattctactgatgaaaatcgtgttgctaaatgggctgcattgcatggaatgcaatgggcccaactatctgttttgggcaatccccttgacaagttatcccaatccacaggcattgacacaatggaattaagtatgggaaaagcatgttccatcacagtatggacatcaatctttttcctgaactttctttttgctgcaatgcttacatggtcattgcctcttcgtataccagcatactcaatgctgggattttctttactctattacattttagcgttaattgttgcaatgtctggatatagtgttgcatggggtggttcagctaaaatgtcaggcctattgtttgtgtttggaggggccacaagcttagtgctacttcttagcatcataatcatagttgtgctctatgctgcatggtgctcctctcctaatgaagttggaggagaactaacagagaaacactcccctgagtgtatcattaagttccaggacaactga

SEQ ID NO: 104132 - DNA, 1509 bp, Glycine max
  Peptide Sequence Number=SeqID_220910
atgttctgcgcgcgtcccaccaatacggtgacgcatccgtctttcaaatcttcttctgaaatgcaaacctccatttccccttttctctctcttcaccctcagtctcactcgttccttccttccacgcgccacactctctcactctccgcgccacaaagctacgcgcctccctcttcgccgccgctactgatccaccccagaccgccgcgtttcgattatgccccttcctacgagacgcgtccgaacggtatatacctcaagcgcaggaaggtagaacttgcgcgccaagtgtttgatgaaattcccaaacgagacgttaatgcgtggagtaccatgatcaccggtttcgcgcgcaatggaatgctgagggaagtttgggagtacacgaggttgatgttagaggaaggaataaatccaaatttggtggtaatgacagttattcttgatgtcataggaaaatttggtggtcgaaatttaggtagggaggctcatggttttgtgttgaagatgaatatttattacaaggaattgtcgattcaatcggcgttgattgatatgtattggaactgtggtgatgttggctcagggagccgggttttgtatagtgtgatgaagaggtatggtgattgttggattggattgatgtcgggtagacttgaggtggaaatgaggtctattgttcggttgaagaggttccggcctggtgctgttgcggttgcttctttgcttccgatttgtgcacaattgagggctctgaagcaagggaaggagattcatgcttatgctttgagacattggcttctgcctaatgtgccgatagtgtcttccttgatggtgttgtactccaagtgtggcatgattgagtattccttgagattgtttgatggaatggaacagaagaacgtggtttcatggactgccatgattgattcgtgtgttgaaaatggacatttgtgtgaagcaactggtgtcatgaggtcaatggtattgacagagcatagaccggatacagttaccgtggctaggatgttgcgtgtttgtcaggagctgaaagttttaaagcttgggaaggaggttcatgggcaggtattgaaaagggggtttgtgtcggtccattatgttgctgccgaactgattgatatgtatggaatttgtggatatgttgataaggcgaagttggtgtttcgtgcaattcctgtaaaaggttcaatggcatggagtgctcttataagggcctatgggtacaaagaatggtatcaagaagcagttgacctttttgataacatgatatcaaatggttgctctccaaaccgcttcacttttgaagctgttctatctatttgtgatagagctggatttgttgaagatgcttttaggatatttgatttgatgtccagatataaaattgatgcatccgaggaacactgcacttgcatgattcgacttcttacccgctatggcaaactagatgaggttcaaagatttgttgaaatgagttcttccttatag

SEQ ID NO: 104133 - DNA, 558 bp, Glycine max
  Peptide Sequence Number=SeqID_220911
atggcttccagttccaaatcgaagatttttctacagcgatacggttacgattttctgttgggatcaatcgctgctgtctacgtaatcactgtgccttacactaaggtcgaagagagtttcaacgttcaggcaatgcacgatattctccatcacaggctgaacttagacaattatgatcatctggaatttcctggggtggttcctcgaactttcctcggtgctttgcttgtgtccataattgcatcaccgtttgtgttaactgcaagtttgctgcatttgccaaagttttatgctcttctcatagttcggatggccctagggggcatagtactatacacgctaagattctttcgacatcagataaggaataagtttggacatcaagtagaagccttctttgtgatattaactgccactcagtttcattttctgttctattgtacccgtccgcttcccaacattcttgctctgagccttgtgaatttagcatatggatactggttcgagggacgtttttatgcggctctaaactctctgagacaaattcaatgcccttga

SEQ ID NO: 104134 - DNA, 243 bp, Glycine max
  Peptide Sequence Number=SeqID_220912
atggttgtgaagatgatacatggatacaacccaagccttcaatttgcatttagagactatccagatttgtgtccttgcaagccagtgattattcctccaaaagaagtctcaataatttaccctcaaagaaattgtcacctggaggaacaaactggcgaccatttcatccttcttaacgatccagccaacattatatctcttaaaggagggagggttgtgataaaccctgcaggccattgttaa

SEQ ID NO: 104135 - DNA, 186 bp, Glycine max
  Peptide Sequence Number=SeqID_220913
atgtatatcaggatagagagtgtcacattgctggtgagtgcccaactattctaccacttctacagcctcatcaacatcttcgtcacgcgtttcggtcgcaaccctcctcctcctcctcctcccaccaccaccgccgccgccgccaagtcctccgatcaagacgcgccttcctcaaaggactcttga

SEQ ID NO: 104136 - DNA, 708 bp, Glycine max
  Peptide Sequence Number=SeqID_220914
atggctcagaaaaagctttccgagaagagatctaggagggacgccgcggctgaagggactagtgccgctcccgagtttgatagccactgtttcaggagcgccgagcatcagcagcgtttcgaggccatcaaaggatggtcgttccaccgagagagacgcgtccaactcaggaatgatgagtacaccgactttcaggaagagatagctcgccagcgttggacgtcgttggtcactcccatggctaagtttgacccagatatagtcctagaattttatgctaatgcttggcccacagaagagggagtgcgggacatgcgatcatggccagttcctggggacccgctagtgctggaggaaggccaggagtgtgagtttagtcagtggaggaacagggctgatgggtttgacgaagaggacattgcccagctgttatgcataccaggtatgccacccactaggcaccctctagacccggataagtctaacagggccctgggggttcccgtcacacctagtaaggtgatccggccgccgatcacccgagccttcattgagaagtattgcacgcctaggcagacgcagggtgatgcgccacaggccgcacatgcaccgccaccacctcatcaggctgatcctgctgggtcattaggcgtggagcggtatctacagcacttggttcgccagcaggcggccaaccaccgggggtag

SEQ ID NO: 104137 - DNA, 225 bp, Glycine max
  Peptide Sequence Number=SeqID_220915
atgggcatcgaagatcaaatgatcagcttcgatctatttgatgaagaaaaacaacttttggaccaaaatgtctgcttgcaggtgaaggagtttgaggaaaaggttctgaaggggttgaacagcttctttgaagcaatggacgaaaaaattaactcagaaaaattttcagcagtccactcgctaagcgcacatcccgcgctaagcaaattttccttcttgtgctga

SEQ ID NO: 104138 - DNA, 1449 bp, Glycine max
  Peptide Sequence Number=SeqID_220916
atggtgtatagccagaaagaaggtaagtggaatcaatataatgcaggatcagaaggtcatcattatcattttgaatattttgatatcagagaagaaggctcttttgaaaacgagcagagttctttacaaaaaataggagatcgtctccaaagcgccgtcaatatagaatccggaatattattccatataggacatgtttcgatgagtgatggtgaccgaatcatattggttattcaccaccttgtggttgacggagtttcctggaggattttgcttgaagatttaggaagcttatatgaatcgggaatgaaaggagtatcttatgaacttccttccaaaacagattctttccagagttggggagcagcattggagaagtatagcaatagttcttctttatcccaagagcgtttgtattgggaaggtatagaatcagagatttatccggttattccaaccgattaccctgcaaaaggcaaacatattttagatagcagcatcagcttttccttaaatgaattgtctacgaaattattacagacgcgtgcaggtaagaaatacagtgcagagattaatgatgttttattgacgggattggccttatccttacaggatcagtttggtattaacaagaccaaggtgctgatggaaggtcatggtagagaggtgatgagtactgaccttgatatcagcagaacagtaggatggttcaccagtgtgtatcctttttcgttagacatcagcaatgagagtcagccggctttggtgagtgtcaaagaaaatttgagaggtattcctcataaagggattggttacggagtattaaattatttaggggattcattttcttcaacaggaagtcctactattcagttcaattatcttggagattttgatgatacaataggatcagcatttaattatagctcagagtttatcgggaatccggtatctgaagaaaatctaggaaccgatattctattggatgtttcaggaatcacgatgagtggtgccatgactatcacgatccgttattcaggagatctctttactgaagctacggttcagaaactgatggatagctatcagaatcaattggagaaaatgattggtgagagtgaagactcagaggtgattttaacaccatcagatcttacttataaaggattgtcattcaatacgattcaggagatcaataagaaaggggatattgaagatatttatgagctttcgccaatgcagcagggcttgtattaccattggcttgtggaacccaaaggagccacgtatttcatgcagacttcgtacaggacaaaatccgaggattttgatctgtcagaagtagaaaaggcatttggaatccttgtcaatcgctatacggttttacggacttcttttgataatcgttatggagaagttcctttgcagatcgttcacaaaaaagcacaa

SEQ ID NO: 104139 - DNA, 774 bp, Glycine max
  Peptide Sequence Number=SeqID_220917
atgggtgcaagggtttcatcattcatgaacaggggtaagccagggatccctggcgtgacctcgggtgtctcctctggtgtcacctccggctctggctacggctcctgggctgtaggagcctcacctccccccgcaggagaaggttggactcctgtggaggggctagatggtgctgtgagtgctggaggggctggagcaggagctggtggtggtgctggtgctgaggtagaagctggagtagaggtggaggcatcagaaggtccccgagccctagtcttgggggtccccgaaaaggtgatcgtgggatcatctgggttccaacaattctttcgaatatatgccaaattaatggcaaggcacatagactcaaaggccatctgtgagatctggcctgagatgatggagcctaattccatgtctatcttcatcaccaacctcgccctgtccatattaagatcggacgagcttctagggtgctccctcaacattcagtacaaaacctcgccctggaatagacaatctggcggcgagctcctaagggtctgggtgcatgcggtagaaactggaggccacatctatgtggttatcaggctgcctggtcaaggctttatgccatctcctcctctcgagctacttgcggaactcgttatattgggtcacgtacaagtcaacattcctctttgggaggatgtttccggaatgcacgctcgcttagcgagacaggctcgcttagcgagacaagctcgtttagcacgccttccaaaaataacatga

SEQ ID NO: 104140 - DNA, 357 bp, Glycine max
  Peptide Sequence Number=SeqID_220918
atgactcgctcagcgaggcagatccgctcagcaagtggcatccgctcaatgaggcatacagctcgcttagtggattgggaaaccctagaagaagataagccagagatttgcacgctcagtgcgcagccagcctgcccagcaaggacgttgtctcttctcacgctcagtgtgcccagtctcgctaagccaaaactcacttactcttgcttagtgagccttcagaagctaaaaggtccaagagcctttataacactgaggttgacggatttgaaaaagagagtacatagagaacaaaagagagcatgtttttggaagaacaagagacagaaagagagcagcagagagagcttaggttaa

SEQ ID NO: 104141 - DNA, 135 bp, Glycine max
  Peptide Sequence Number=SeqID_220919
atggctaagcgagcatggctcgctaagccttattcaaaaccagagaagaaattacgcttagcgatgggacagggtccgcttagcgtgttcatcagaaaacccagaaattcatccaaaatggatgaactcgcttag

SEQ ID NO: 104142 - DNA, 498 bp, Glycine max
  Peptide Sequence Number=SeqID_220920
atggttctcaactttcttgttgctactcgatgtggaacttcacctcacacttgtactccaacagttttccctccaagtatgagtctcttccacatggtagcctccccctcgagcagtagtcattttcaattcacgagtatccaatgcccagaagctctgactcttcctcctcctctactacctacaactatcggtggccaccacgagccaccattgcttgctgttggaccactgcacgaagaggaacactttaatcagagtgaaatcttgagattctatctcaaggatttggtggagaacaaactcccaattctttctttcgtagtttttcttagacttgcgttgtttgaagtcctggggagtgtgaatctcaggcatgaaatttatgtgtatggtgcagtgaccaagttagatatccctggtgggggaaatagagtggttaaagagttcaaacatctctggagtgaaggtttggaactcccttatgactccggttga

SEQ ID NO: 104143 - DNA, 255 bp, Glycine max
  Peptide Sequence Number=SeqID_220921
atgcatggagcccaggcagtgtgccccgcgatcatgacttggtggaaagcatggtggtgtaaggattatgctctaaaggagactaccatgtggaaggggtttacacctgaaggggagattgttggaatacaaccaatggatccatcaactaaaggaaggaagtcgaaactcaaagtacaaatcttgttgcacattctgcatgagcaccattgtagtggtagcaatcctgctagttttagtcaagttgtagtctaa

SEQ ID NO: 104144 - DNA, 101 bp, Glycine max
  Peptide Sequence Number=SeqID_220922
gacactgatgtaatgtggctaagaaatccatttataagattgagcaagaatgagacagaagacttccaaattagcacagactcgtatcttggtaatccttg

SEQ ID NO: 104145 - DNA, 426 bp, Glycine max
  Peptide Sequence Number=SeqID_220923
atgtggatgttgtgctggggaatcccactacatgcatgggatatggagaacattaagaagattgcatcgacggtaggggaagtggtggaggtggatgatgatgtggaagaactccaacggctagatagggcacgagtgctaattaaaacaccatggtaccctataatccaacatgttgtagcagtttcgatcaatggggaggaatacagggttcatatggctgaagaaacatgctataactttggcagatgtaaatgttggacaaggagtttaatagggtcgctagaagaaataagctctgaaaagagcgaaatcaagactccattactagtcgatgatgtctcatcgaaaaatgagtgttcgtcgataattaccaaagtgattgcagacgaaacagagttgttaggggaagttggagagttatga

SEQ ID NO: 104146 - DNA, 942 bp, Glycine max
  Peptide Sequence Number=SeqID_220924
atggtgtgtaggtatttgcaagatgtgtttaaggttcctttggttatacagctcactgatgatgagaagttcttctggaaaaatctttctatagacgagtgccgaagacttgcaagggagaatgcaaaggacatcattgcttgtggttttgacatttcaaagacattcatcttctctgatttcaattatgttggcggttccttctacaagaacatgtgtgaggttgggaagcgtgtgacttataaccaggctgtcggcatatttggttttgttggtgaagatcatattggaaaagttagttttccacctgtgcaggcagttccatcatttcctagttcgtttcctcacctattttctggaaaagagaatcttcgttgtttaattccttgtgcaattgaccaggatccatattttagaatgacacgtgatgttgctcctaaaatgggtttccacaagccagccttgattgaatcattattcttcccagcattacagcctctttgcatatgcaagggtaaggctgcgtacaacatccctcccccataccttcgcatagcgaagagcctctgggcaatgggcaatacagatcagggggaaacaggaaaaatgtctgccagtgatcccaattctgcaatatatgtgaccgattctgcaaaagatataaagaacaaggtaaacaaacatgcgttttctggtgggcaagattctatagagaaacataggcaattaggagcaaatcttgaggtagatataccagtcaaataccttacttttttcctagaagatgatgatgaacttgaacacataaagaaggaatatggagaagggcgcatgctaactggtgaggtaaagcagcggctaattcaagttttgactgaactagtggagaggcatcgcagagctcgggcttctgtgactgaagaggtacacattcaacactaa

SEQ ID NO: 104147 - DNA, 603 bp, Glycine max
  Peptide Sequence Number=SeqID_220925
atgaaaggagtgtttgttgatggatgctggattgatgatcctggcaaggtgaaagaagaaatttgcttgttctttaagaagagatttgaagaggttgaatgggagcgacccaaattagatgaggaatgcgggagtgacaagagccctgggccagatgggcttaatttcaaattcattaagaaattatgggagattatcaaacctattgtgctctgtttcttggacgaattcatcgttaacgaagtttttctaaagggaagcaatactttattcctagcactgattcctaaggttcatgacccacaaaatcttaatgagtatagacctatttcactaataggttacatgtataaaattatggccaagttacgagcaagaaggttgaagaaggtgctaccaataatcatagatgaaacacgatttgccttcattgagggcagacatatgttacacaacattcttattgctaatgaagtggtcgaggaagcaaaaaggtgtaacaagtcatgcctggtgttcaaagttgattatgaaaaggtattaagactcggtctgttgggatttcttgttgtacatgctgaggaggatgggtgtttactctaa

SEQ ID NO: 104148 - DNA, 627 bp, Glycine max
  Peptide Sequence Number=SeqID_220926
atgggtagaggactgaaggaattggttggatggaaagaccagaaccatgaacatcacataataaaggttccaacaacaaccaaaagtcctaaaacctatgagcatgggacacaaatgaggttgaaaggttgtgaaatcgggaggactaagaaggagcagatagataaagttgtgtgccaagccctatggggtgattcaaagctcaatggccatggtttcatttatttggatggcatctgggttcttgatggccaaaaagtaactatagttaacatatactcaccatgtgatatggctcagaagaaaaatatgtgggagcacatcaaacagctgagaaactcaaactttggaggactatgggggctagatgagagaagtgcaaaggaattcaatgaatggattacagacatagaggttgaagatacaaccaacccgataagggactggggaggatatgtgctaaaagaaaaaataaaacaaattaaggtgaggctgaaagcgtggaacaaagatcaatttggtgatatgcagaagaagctaacaaggataaagatggatttaaacaagctggaaattgaaggagatgaaaggaagttgtctgaccaagagttaatggcacccaaatag

SEQ ID NO: 104149 - DNA, 921 bp, Glycine max
  Peptide Sequence Number=SeqID_220927
atgtcgcctaacatcgtcggagaagaagaagctaacaacgttcatgctaatcgcaaatggctacaccacctagctctcctcctcctccttctactgacaagaaaggtcacatgcctaagatcattggggactagaccagttggggtagacagacccctagtccatgtggatcctactaccgggaaagcgaacggtcccctcagaaagaagttaagaacatatttggggatcgtcgctcatgataaggtggatgtgacatacgagaattggaaaaaaagtccttgctacccagaaggatttgatatgggaggatattcagtcgacaaggacaatgtcgatgacactgtatgcgaaaagtgtggcaatagcaaagagaagtgggctcaattttgtcagagccacagagacccttcgtgggaggatgtgcgaaaaaaggcacaggccatccagaaacaaaacactgcccttcacgtattgtctcgtgggggttatgaatatctagaaaacaagttgatggaggagaagaaaaagaaacaactggaggaagctgctcaatctagaagcactgacaccgtgatttatcctccatctcccatcagacgacacgtgaagtggaagatggcccacaccaagaaaactggccaaatgacgtctgaggcaacaaaggaaattgctgacaagattgattcgttggaggagcagacctcacagggttcctttgtcgcccatggacatcaggatttactgactgctatcattggacgactagaacaccttggtcgtgtgtgtgttgctggagccggtgtcacgatcaagcaatactttggaccggctccaaggacctcccacacatcttcatccatggctctcgaagacctggagcagctgacacaaaaaatcaaggaccagtcaatcacataa

SEQ ID NO: 104150 - DNA, 651 bp, Glycine max
  Peptide Sequence Number=SeqID_220928
atgcacaatcttgttaaagaaactgctgggattgatttcaatgaattggcaaatgatcttgaggttgcaaagcgagttactctggatacccttggaaagaatcttgataacaaggataaaggttccattgaagcatgccaatccgttggtcacctccttaatgaggtttttgagagttttgtagaaccaaagctcatccaacctacatttgttttagactatccaattgagatatctccactggccaaaccacacagaagatccacaggtttgactgagagatttgaactcttcatttgtggtcgtgagttgggcaatgcattctctgaattgactgatcctatagatcagagaggacgcttagaagatcaaattaggcagcatgaaaagaagagagcagctgtttcaacaaatgacgataaaaaggaaggaacggaagatgatgatgattcatatgaagtgactcttgatgatgactttctcacagctttggaatacggaatgcctccagcttctggaatgcttttaaaatgctatttacaaagatgttctttccagggacttggaattgataggctggtgatgcttttgacaaattctcccagcattcgagatgttattcccttcccagtactcaaggtccagcaatag

SEQ ID NO: 104151 - DNA, 315 bp, Glycine max
  Peptide Sequence Number=SeqID_220929
atgagggatgtgtacctaggagcctacttgaatggtgcacattggcaaatggtcgtcattttgcctaaggaaaatgttgtcatctgtgttttgaaaggacttgacgatatcccacaaagtaaatccaagactgcagctaggtggattgttgttaaagttatacaaaaaggaagtactgagtgtgggtattacatcatgcactggatgccaactataatcttagaaactttcaagaataattgggaaatgcatcgattttggaaaatcgatgttaatgataatactttcaatgttggtactttcaacattggttaa

SEQ ID NO: 104152 - DNA, 480 bp, Glycine max
  Peptide Sequence Number=SeqID_220930
atggattctttaggttttgttgaagttgaaactccagttttgcagggagcagctgggggagcagaagccagaccatttattacataccataattctcttggaagagacttatatctgagaattgcaactgaattacatcttaagagaatgctggtgggtggttttgaaaaagtatacgagattggtcgaatatttagaaatgaaggaatttcaactcgacataatcctgaatttacaactatagaggaaaaagaaagaataaccaaagagggtaggaggtggaaaattcggttagcgtatagagagaatgtcataacaaaattgggacaagtggcatgtgagaagaggatgtacgaagcatactcggattatcaaagcatgatgaatttagcagaggagatcgttactcgatgtgctcttgcagttcatgggaagcttaccattgattatcaggaaaggatgcctaagccactagaatga

SEQ ID NO: 104153 - DNA, 329 bp, Glycine max
  Peptide Sequence Number=SeqID_220931
atgagcattaatgagtttgcaacttcagtttcacgtgaaaaagatgaagaaatagaaggtgcagtagttggtgtctcgctaagcgagatcaatgcacttagtgagtatcatccgctaaacgaggcatcagcacgcttagcgagtcaaggggaatctggaagagaatctgtcacgcaagcacgcactcaatgcgccatcagcttgtccagcgagtcatttgtctcttctgcgcttagtgcgccttgctcactaagtcaaaaggagtttttggaggagaaaaagagaaaggagaggagtgtgaagaacagagaacaaaagcgcaaagcaga

SEQ ID NO: 104154 - DNA, 1170 bp, Glycine max
  Peptide Sequence Number=SeqID_220932
atggaagagttcaacgagttttgtgattccatggaacttcttaacataccaatgattggaaggactttcacttgttataggaactacaattcgtctgaagagaatggttttcatgagtttgttaagttaacatatgagaatttccaagtcataggtcgagggctctacaaggtaaaagaaaagttgaaagcttttaagaaagaaataagggattggaacaaaggcaaatttgacaaccaagaagagagagtgtttaagattcagaaggatatagttgtattcgatttaaaggatgaaaagaatagcataataagtgaagagacaaagaaaagaattcatttatgggaggagcattgggagatatctgagaagttggaatctcttctacaccaaagatcaagatgcgcaaatggctacaagaggaatgggtcttggctagatgatccgaaaaaggttaaagaagaaataaagactttttcccaacaaaattacaaagaaaaagtcgatgtggctatcaagctggatggagtgttcttcaaatcccttggcgtggaggataacgtatctcttactcgtcctttctttgaagatgaaattaagtgtgcagtgtgggattatgatgtagtgtgtgctcttagagagttccttgcaaatggaaaaattccaggttgtgctgaggagaggaaaatttattgggtcaaattatctaaagtgtgtctatctaagaaaaagggaggtctaggggtaaaagatttagccttgttcaataaggcgtttgtgggaaaatggggttggagattgttgatggaacaagattccttgtgggctagagtcgtctattctaagtatggacaccttcttgaacacaatattacacaatcccaaagactacaatccctatggtggagtgatgtgaagtacttatgtctgggggaagaggaggaaatatggtttaaaaataatatcatgagtttgatgggaaatggagacttgactgagttttgggaacattgttgggtaggggagagacctttgagggatacttttcccagactgcattctatttctctccaaaaagaattgcggattagtgaggccggagatgttggcgtcattgtcattcaagtcggagaaagcggcggcgccgaaggcatccacgacagactttag

SEQ ID NO: 104155 - DNA, 1617 bp, Glycine max
  Peptide Sequence Number=SeqID_220933
atgaataaattcagtggaaatccatttgaaagtcttggatcactctctaaattgtcatcgctttttattaatgacaataattttcaaggagttgtcaacgaagatgatcttgcaaatcttacaagtttgagggcgtttgatgcatcagggaacaatttcactttaaaagtgggtcccaattggcttcctaatttccatctttcctatttggatgtgacatcatggcatataggtcccaactttccatcgtggattcagtcacaaaacaaacttcgatatgttggactgtctaacacagggattttagattctattcccacttggttctgggaagcacagtctcaggttttgtatttaaacctctctcataatcatatccatggtgagcttgtgactactataaaaaatccaatatctatccaaactgttgatctaagcacaaatcacttatgtggtaaattaccccatctttcaaatgatgtgtatgagttagacctttcaaccaattcattctctgaatccatgcaagattttttatgtaacaatcaggacaagccaatgcaattagaatttctcaatcttgcatcaaataatctatcaggagaaatacctgattgttggattaattggccatttctagtggaagtgaatttacaaagcaaccattttgttgggaacttccccccatccatgggttccttggctgagctgcagtcattagaaattcgtaacaacttgctctcgggaatatttcctaccagtttgaagaagactagccaattgatatccttggatcttggagaaaataatctttcaggatgtattccaacatgggttggagaaaagctctcaaatatgaaatcctccgctttcgatcaaacaatgagtcttcttcaggttttagaccttgcaaaaaatagtttgtctggcaatatacccagctgtttccgtaacttgagtgccatgacactagtgaaccggagtacatatccccttatctattctcaagcaccaaatcatacacaatacttttcggtatcaggtatagttagtgtgctactatggctaaaaggaagaggagatgagtatggaaacattctgggtttggtaacaagtattgatctgtcaagtaacaaattattaggagaaattcctagagaaatcacagatctaaatggattgaactttttgaacttgtcccacaaccaattgattggtcctattccagaaggtattggtaatatgggatcgttacaaaccattgatttttcgaggaatcaaatttctggtgaaattcctccaaccatttctaatttgagctttctgagcatgctagacgtgtcttataatcatttgaagggaaaaattccaacaggaacacaattgcaaacctttgatgcctccagctttattggcaacaatctatgtggtccaccactgcccataaactgcagctccaatgggaaaactcatagttatgaaggaagtcatgggcatggagtgaattgcttttttgttagtgcgacaattggatttgttgtgggactttggatagtgattgctcctttgctgatttgtagatcatggcggcatgcctattttcatttccttgatcat

SEQ ID NO: 104156 - DNA, 166 bp, Glycine max
  Peptide Sequence Number=SeqID_220934
gcaactgagacatgagatcgtctatcccgatgttgatatgctatttttcaaaggaggtcgtcatgacaacattttgtctatcagtggttcatttgccatgacaaaagatatacggatttggttaggcatgttctgtattgattgggcaatagaaattgccaagtaa

SEQ ID NO: 104157 - DNA, 114 bp, Glycine max
  Peptide Sequence Number=SeqID_220935
atgaaggtagccctacgtgattggaagaaatttaagaagttggaggccaactccacagatgcggatcctctcctgctagattgctctcctgcagcatcgttgtgcgttggatga

SEQ ID NO: 104158 - DNA, 558 bp, Glycine max
  Peptide Sequence Number=SeqID_220936
atggctagagcaattgcagtttctttcttggttctgcttctggctttccccactgtatttggagctgaccatgaagttggtgacactggtggatgggccctaggggttaattacaacacctgggcctctgggaaaactttcagaattggtgacaatttggttttcaagtatgactctacccatcaagttgatgaggttgatgagagtggctacaacagctgcagctcaagcaacatcatcaagaactacaaggatggaaacaccaagattgaattgacttcaactggcaaaaggtacttcttgtgccccatttcaggccactgtgctggaggcatgaagctgcaaatcaatgtggtggctggcacccccccaaccaccccaagtggcaccccaccaacgaccccttcaaacccttctccttctcctccctctgactcaggatccaccaacaccacttcaccaccaaagcctagtggagctgtcactgtttccagtggcattggacttttggtggggtctttctttgcgtcagcaattatgtttggtttcatgggctag

SEQ ID NO: 104159 - DNA, 567 bp, Glycine max
  Peptide Sequence Number=SeqID_220937
atggatatacctaaacaaacacttggtagtttggccatggtaatattactctttgctgggattattttggtgtaccactggaactcttccttctccaacgaattcgttctgacggtaaaggaaccactttgcaagcaatcaaatcttaccactcccaatattgaagcaaatggagatggccttgacactgctttggccaaagcctccatgggaaacaaaacagtgataattgctgtagtaaataaggcctatgttgatcaagatgtagagagtgacaccactatgcttgatatatttcttggtagtttttggcttggagagggaacaaggtctctcattgatcaccttctcttagtagcggttgatcaaacagcctatgatcgatgtcaatttctgaagttgaattgcttcaaattggaaacagatggggttgattttaaaggtgagaaaatatacatgtctcaagatttcatcaagatgatgtggagaaggactttcttccttttggaggttctcaaacgtggctacaattttgttttcacgttgattgctctttctcatgtttaa

SEQ ID NO: 104160 - DNA, 420 bp, Glycine max
  Peptide Sequence Number=SeqID_220938
tcaggtgacatgcggggttaccttatggttacccgcacctttcgtcaacccgggggcaaacgagcccgttgacgcgcagagactaagatcgtcttttgaaccttttttcgtcgtgacccgggcaaacgagcccgttgacgcgcagagactaacatcgtctcgtgctccttctatcgtcctgacccgggcaaacgagcccattgatgcgaagagactaacatcgtcttctgcaccttttgccatccagggacagcgagtcaggtggcaggcggagataccttttggtcatctgcaccttttgtcaaccgaggggaacgaatttgacggtatcaggatgatgctggacgttcgggacgatcgaatgcaatggcatagggaagtgtcgtggttgtccaactttgtcgcttccaatacactgaa

SEQ ID NO: 104161 - DNA, 594 bp, Glycine max
  Peptide Sequence Number=SeqID_220939
atggtggaaaggggaaaatttgatgatataaaggaaaggttgagggttattgaaggaggcggaaattatgcctttgctgacatggcagagttgtgcctagtgcccgacgttgttatccctctgaagttcaaggtgtcagatttcgataagtacaacgggactacttgccccaagaatcacttgaagatgcagtatcagtacaattctgatatgactccggatagaatacagctacagaacatgtgtaagaaggagcatgaatctttcaaagaatacgcccaaaggtggagggatcttacaactcaagtagcacccccaatgatggagaagaaaatgataacaatgataatggaaacattacaaatgttctactatgagaagatggtgggttacatgcctttgagctttgccgatttagtgtccgctgacgaaaggatcgaagtgggtctgagaagagacaaatttgattatcttgctttggtgaataggaagcctggggaaaatggagagaataagaaggagggaggaacccatgttgtgactgtcattcctacatggccaaatttctcaccagctcaacaatatcaatactaa

SEQ ID NO: 104162 - DNA, 292 bp, Glycine max
  Peptide Sequence Number=SeqID_220940
gttccagccttgttttgggaagtttttggctactgccacaggaaataatatcaaaatatttgatgtggagaccgacagtcttctgtacaatctagagggacatgttaaagatgttcgttccatttgttgggataaaaatggaaactatgttgcctccgtcagtgaagatagtgcacgtatctggtcatcagacggacaatgcataagtgaattgcattcaaccggaaacaagttccaatcatgcatatttcatccggaatatcataacctcttagttattggtggttatcag

SEQ ID NO: 104163 - DNA, 216 bp, Glycine max
  Peptide Sequence Number=SeqID_220941
atgatagccataacctctactaggtttcctcaacctccatttttcggaggatacgactcgaacgcaacatgtgcatatcatagaggagtaccgggacattccattgagcattgtaggacctcgaagcgtaaggttccctgctacaaggtcatgaagaaagacaacgattggtacctcaaagccttacactggggcaatgaggggcaccgtgcatga

SEQ ID NO: 104164 - DNA, 348 bp, Glycine max
  Peptide Sequence Number=SeqID_220942
atgagtttcatgccgctgctagagaatgaagaagaagggctttgttgggcttcgcgggcttgcgggtctgggtcattgacccgagagggaggtgtggaggtggaagcatgttcttgcaaagggagaggaagcgagcctcaatggtttcctcaaagagtagaggattttgttgaagaaaatcttgagcggagagttacatgcacgtcgttgatggtggctgccatttgccactcgtggctcttgggttataggcaaaaggagaacgagggtggaagcgagcgtgcagtggtggggcctgtgatgaatgtgatgcgaagctccatgtggaagttgaagcaggctgcgtga

SEQ ID NO: 104165 - DNA, 2655 bp, Glycine max
  Peptide Sequence Number=SeqID_220943
atggaagtagaaaacaaagtcatcatagtgaagctttctaattttgtgtcatccctttcattaattcttcaccttttccttttcaccctcgctaaatgtgactcttctttctcaccaaatgttaactatctcattgattgtggctcctcccaccccactcagctcaaagatggtagaatcttcaaatctgatcgtgaaactacttctctcctatccacaactgaagatttgcacatatcacttaactcaaatctctccccttctattccttctttatcacttcctttgtatcaaaccgcaagagtttttcaagaagaatccacctactccttttacatctccaaaagtggtagactttggattcgtctctacttcttccctctccctgacccttcctttaacctaacaagtgctgttttctctgtccaaaccaatcatcatgtgctcttgcatgagttctcagcatggaacaatgacacacccgttttcaaggaataccttgttaatgtttctgatagtattttctcgcttgaattcaagcctaagaaaaactcatttgcgttcatcaatgccattgaggttgtctcagcccctgacactcttatctcagattcagcaactgcactttccccacttggagaattcaaaggcttgttgaattctgctcttgaagtatcctacagaataaacgttggtggtccagtcataactcctgacaatgacactttgtctagaacatgggaaactgatggatcttacaacattttcccacagggttctgtgaatgtttctgtctccaacaaaagcataaagtatcctcgtacgggtatacttacacctttgattgctccaaactcagtttatgcaagtgctgtacacatgaaagacgctagagttatggaaccaaatttcaatctaagttgggttgtgaacgtggaaagtggctactcttatttgataagaattcatttctgtgacattgtgagcaagagtcttaaccggttatacttcaatgtgtacatcaacgggattgagggtgtgtcaagtttggatctttcattgcaaaccaaagctctagccactgctttttacaaggactttgtgctaaatgcattttccatcacaagcggttccattttggttcaggtgggaccagccaatctacaacatggcatgaccgatgcaattgcgaatggaattgaggtgatgaagatgagcaacaacgcagacagcttggatggttttttctctgttgatggcaaatacaaagggccaagttcaccaaccaaggcaatcaaaatctttgcatgcgttggaatagctttggctgtgacaacaatgttgttgctagcaatgatttgtataaggtggaaaaagaggcctcaagattgggaaacgcataacaggttctcatcatggctcctccctttccattcagctagaatggtttcaagcaaaagcagttttcgaagctcaaatgcattcagttcccacaagagcaataagcatggccatggtgtttcccaaaaagggcgtgaaaggttcttccccttcagtgaaatgctccaagccaccaataatttcgatgagaagaaagtgataggcattggaggattcgggaaagtgtatcttggaacgttggaagatgggacaaaggttgctataaaacgaggaagtggtagctcagaacaaggcatcaatgagttcagaacagaactagaaatgctctcaaagcttcgccatcgccacctagtctctttgatgggtttctgtgatgaaaattcagagatggttcttgtgtatgagtacatggctaatggcccctttcgttctcacctctatggctccaacctccctcttttgtcatgggaaaagaggcttgaaatatgcattggtgctgctcgtggcttgcactatctccacactggtgcagctcaaagcatcacacaccgtgatgtgaagacaacaaacatcctcttagatgagaactatgttgccaaggtttctgacttcggtttgtcaaaagctgtcccagagaaggctcaagttagcacagctgtgaagggtagtttggggtaccttgaccctgagtattataggacccaacaactaactcagaaatctgatatatactcttttggggtagtcctaattgaggtactttgtgctaggccagttatttgccctacacttccaagagaggagattaacttggctgattgggcaatggcacaacatagaagacgagtgcttaatgaagtaattgatcctcgtattatcaaaagtattagtcctcaatccttaaatgtttttgtgcaaattgctgagagatgtttatctgattctggtgttgataggcctagtgtgggggatgtgttgtggcatttggaatatgctttgcgcctacaagatgatgccacaaggattaaagaacttgatgaaaaaattgaaagtatagtcacaaatgaatgtaatgataatgataatgtagcaggtcactcgggtgatccagcaagtgatgtgtctaatagcacagatgctaattctgctttgttttctcagatagccaactttcaaggaaggttcaaaggcaaagtgactaaaggagttggattagttgcgccactcttccttgcggctaatattcagttctga

SEQ ID NO: 104166 - DNA, 756 bp, Glycine max
  Peptide Sequence Number=SeqID_220944
ttgatgaaggtgccaagggtggagtcaaaattaagagtatttgcattcaagattcagtttggttctcaggtaacagaatttaagaagagtttaaacactgtgaactctgcctgtgaagaggtccggaattctgttaaactaaaggagataatgaagaaaattctttatttgggtaatacattgaatcaaggaacggcaaggggatctgcagttggattcaagttggatagtcttttaaagctcactgacactcgtgcttctaacagtaaaatgacactgatgcattatctttgcaaggtcctggctgataaatcgcccaggctccttgatttccacctagaccttatacaattgaagtcattagcagaagagatgcaggcaatcatcaagggattagaaaaggttaaacaagaatttgctgcatctgcaaatgatggacctgtctccgaagttttccataagacattgaaagaatttatagctgtatctgagtcagaggtagcatctctaacaaacctatattctgtagtgggtagaagcgctgatgcacttgcactatattttggtgaggatcctgctcgttgccctatggagcaagttaccacaaccctgctaaattttataaggttgtttcggaaagcacatgaagagaatatcaaacaagcagagttagagaagaagaaagctgagaaagaggctgaaatggagaaggcaaagggcattaacttgacaaagaagggggcaaaagatagttga

SEQ ID NO: 104167 - DNA, 474 bp, Glycine max
  Peptide Sequence Number=SeqID_220945
atggttccaaatgatttggtatttcccccaatcgaccacgaaaacctcaaaattttgtcatcagaataccacgcccctctctcacctcctccacctcaaccctcacccttcgcctggattagtatccccctccacattttgcattccaagctttcatcttttcgcctgagaggcccaatttggtcatttggtcttcccgctgcggcgctcctcatgtcctgctggatcctcatcgccatcaggaagaacaagagaaccctcactcccaatgaagctcgtctcatcaacatcatcaacaacaaagatcggttacttaattacacgatgcttaagttaaagcctaaacaaaataactcaagtgatggagacaacagccctgtgttgaaaattgccaaactcttgcaccagattgcacaaatgaatgaaatacttattgatcggcacaaagctttggctgcaaaagtgatgaaatga

SEQ ID NO: 104168 - DNA, 1356 bp, Glycine max
  Peptide Sequence Number=SeqID_220946
atgtctgtccatccccagttgcaagagctttgcagcattgtcatgagcactgttggtgggctagatgagctggagttgagtctaaataagttcaaagattctttaacttcatctcttgtagctcaggctattgattctagtaagcatgaggcacaaactagaagattgctcaggttcttcttatggtcttgtaagaatttgagtcatcgtttggaagacaaggattataatcatgctcttcgagtttttgctgaaaagaaagactacacggcaatggatattttgatgggagatctcaagaaggagggtcgagccatggatgctgagacttttagtcttgtagcagagaatttggttaaactaggaaaagaagatgaggcattgggtattttcaagaacttagacaagtataagtgttctatagatgaatttacagttactgctatcgttaatgccctttgctccaaagggcatggtaagagggctgaaggggtagtttggcatcacaacgacaagattacaggcacaaaaccttgcatatatagaagtcttctttatgggtggtctgtgcagaggaatgtgaaggaagctaggagaattattaaagagatgaaatcaaatggggttatcccagatttgttatgctacaacacattcctcaggtgcctttgtgaacggaatcttagacataatccttcaggacttgtgcctgaagctttaaatgtcatgatggagatgaagtcacataatgttttcccaacctcaatcagttataacatactgctttcttgtctagggaagaccagaagagttaaggaatcttgtcaaatacttgaaacaatgaaaatttctggttgtgatcctgattgggtcagctattatcttgtggcaaaggtgttgtttctgagtggcaggtttggtaaagggaaagagatggtggatcaaatgattggaaaaggtttggtgccaaaccataagttttactacagtttgattggtattctctgtggggttgaaagggtaaattatgctcttgaactgtttgagaaaatgaagaaaagctcaatgggaggttatggaccagtatatgatgtgctcattccaaagctttgtagaggaggggattttgaaaagggaagagagctttgggatgaagcctcaggtatgggcatcactcttcagtgctcagaggatgttttagatccttcaataacagaagtttacaaacctacaaggccagaaaaaagcagccatgtggacagctcaagagccaagtctccacaaaaacttacaaagttttcagggaaaatgaagatgagaaaaaaaacagctgcaatgaagaagaaaaagaagtaa

SEQ ID NO: 104169 - DNA, 1027 bp, Glycine max
  Peptide Sequence Number=SeqID_220947
gagcttggatgatgttcggatgaatctggaagtcctcaaatactgtgcaacagttctattcttggagtcaagtctcccagatatattcactgcaaatagttgggtttcaccaaattctattacaagaagccgcagtaatgagaagtctctatcgcaggggggcttattaaatattaataaagattctgtattatcatctcctgcaaccgaatccaaggacaaaaatcatccaataatttcttttgcattgagcagcctaaaagggaatgtcccaaatattgcagatcctaatatagatcaatcggatccttttaacttgagcgctcttgaggctgaaataaaaagagaatccattaagtcagatgctgccatggaggaaaaaaccatgcaagagtcacctgatttggcttcctcatcttctgtatctcagccttgcagcagctctattgctgttttagaacctgatggaatatgtatcccttttattgatgcatctcttgttccatctttccttggcagtcaaaggatagaattactgcatgaaggtttcccgtttctgcttcattgtactgatttgaaagtgcggtttggaataaactcaaggttttttgatagggctggccggccacgattgagttttgtggttgatccatcaccaagtctatgtaatgttcttgatgcctgtgaccgtgtagcacagaagttaaacatggattctggtagcagctctgattggaggcctgttgttattaggaaagaaggcttcttcaactatcctactatcagattgcacatacctacagctgttgtggcagatgttgatatttatgctacggaaatataccaaagagaatcatctggaacagtgcaaagacttctcttcagcaagtttgatgctgcagaacttggttcgttgttcatgcctgggacatttgttgatgccttcttatccttagatccatatgattatcagcagaatgcagggattaaattagttagcaaaaaattgatcattcatggcaaatag

SEQ ID NO: 104170 - DNA, 1758 bp, Glycine max
  Peptide Sequence Number=SeqID_220948
atggatgctgaaactgaggctgaggaacttattaatttgaacaatatatcaagtaactgtggtgggaataatagtaagagtggcgatggattcattgacagaagcaaagtgaggattttgttgtgtgataacgattccaagagttctgaagaggtttttactcttcttttgggatgctcttatcaggttatttcggtaaggtcagctaggcaagtgattgatgcactgaatgcggaggggcaatacatagacatgatactagctgaagttgatcttccaataaagaaaggcatgaagttgttgaagtacatagcaagggataaagaattgtgccgaatccctgttataatgatgtctgcacaagatgaggtgtccattgttgtaaagtgcttgaggcttggagcggcagattacctagtaaagcctttacgcacaaatgaactactaaatttgtggacacacatgtggagaaggaggcgcatgctgtttctattctggcagcttggacttgtagagaacaacatcttgaattatgactttgatctggtagcatcagatccaagtgatgccaatacaaacagtaccaccttgttctctgatgacacagatgacaagtccaaaaggggcactaatccagagacaggagtattaatccaacaagaacaagaggctagtattgccaccattgctgctgttgtggtggagcttcccagttatcttgtatcacaatatcagcctgatgtgcctggaataagtgatcgtcgaacaggtactccaaggcagcatccatcaagcagcagaactattgatggacatttttcatctggtccaaagaagagtgaactgaagattggagagtcatcagcctttttcacctatgtcaaagcaacaacattgaagagcaacattgaagagagtgctcatgttgacaatagtaacaatactactactactactactactacagaagttaggatggaagatatgaatcaagcatgtattgaacagggggataatggccttaaaacacacaaaaatggagaaatgtttggaaaccattctcaagatgacttaccgagcagcaatagtatcctcgattctttctctattgagagatcttgtactccacctgcatcgatggaagtttcacagcaaaagcattacaaggaagaacattctcagggagtggtgcatccaagaaatggaagtcacggttctgtgcctgctcaacatgcttatccatattatatttcaggagttgttaatcacgttatgatgccatcatcggcacaattgtatcaaaagaatatccaggacctgcagattcatgctggttcttctatgattgcacagtacaatcatcttccccaatgtcctcctcatgcgaatgggatgacaaatttcccatattatccaatgaacatttgcttacaacctggtcagatttctactaattcttggccatcattaggaagttcaagttcatgtgaagtacaaataagtaaagttgataggagagaggcagcattgatgaagtttagacagaaaaggaaagagcgctgctttgataagaaaattaggtatgtcaacagaaaacggctcgctgaaaggcggcctcgcgtgaggggacagtttgtcagaaagttgaatggtattaatgtggatcttaatggacaacctgcttccactgattatgatgaagatgatgaagaggaagacaatcatagggcaagagattcttctcctgaggttgcttga

SEQ ID NO: 104171 - DNA, 726 bp, Glycine max
  Peptide Sequence Number=SeqID_220949
atgtatggagcaccacctccaccaccacctccgggtggtcaaggaccacctcctcctggtggtcgaggtcctcctcctccacctcctcccgttggtcgaggtcctcctcctccacctccccctggtgttcctggtgctcctagccctcctgggggtggacccccaccacctccgcccttaggtgcaaaaggtgccaatgttggagctgatccaagagggaggggacgtgggtatgcacgccctgcaggaggtggtgcaatggcaccccgacgatcctccttaaagccgttgcattggagcaaggttacgagggcattacaaggaagtttatgggaagaattacaaagacatggagaacctcaaattgcaccagagtttgatgtttcagagctagagaagcttttctctgcaaatgttccaaaacctaccgattctggcaaatctggagggcggcgcaagtctgttggagctaaaactgacagaatcaccttggttgatctaaggagggctaataatactgaaattatgctcaccaaggttaagatgccacttcccgatatgatggctgcagtactagctttggatgagtcagtattggatgttgatcaagtggaaaatctcattaagttttgtcctaccaaagaggagatggatcttttgaagggatacactggtgacaaggagattttggggaagtgtgaacaggtgtgctatgatttatattag

SEQ ID NO: 104172 - DNA, 582 bp, Glycine max
  Peptide Sequence Number=SeqID_220950
atggatgcattaaccttaagctcaagtgtgaacatttccaaaccatttcatttccttacactctcaaagaaacagcaaagagaaagacatcctcgtacgcagtttggtgtttcatgcagaggcagaaaagagcttggaggaggtgtggaggacaacttgtacaaggtactaagtttgagtcccaaaagtgcaaccacggatgacataaagaaagcatacagatcaatggcgcttcggtaccaccctgatgtgtgccaggattgttccaagaaggaggaatcaacgaggatgtttgtgcaactcaacgcagcttaccagaccttatcgaatcctaggcttcgagcagagtatgactgtgaattgggtttgagaagtgaaaagatcggtgttggtgatgagacttggagatatatatggcagaatcaacttgctgagttgaagagaaggtctcacatacccaatgaaatgaagggtaccagtggtaccaaatcagtaaaaagaaatcaagttacagataaaggaaggaccctaagcacaatcctttctgaagataactcgatactggtactggcgtactgctaa

SEQ ID NO: 104173 - DNA, 261 bp, Glycine max
  Peptide Sequence Number=SeqID_220951
atggacaatgtttcatctaatgacatcaggattcaacacttaaaaaagaggttcctgtttcagtacaatgtacttttgaagggggattatatccatatgcggttttgtgcacatatttttatgcttgattgtgaagcatggcctgaaacaatcaagtatatcaaattctcaccatctagattggctcaattcaagggttatgctgaacaggagcaaattctctacaagggtctcatttgcttagatgtgaaaactaggtga

SEQ ID NO: 104174 - DNA, 1581 bp, Glycine max
  Peptide Sequence Number=SeqID_220952
ggtacatatagcagtgttttccgagcaaaggaggttgagaccgggaagatagtagctttgaagaaggtgaggtttgacaattttgagccagagagtgtgaggtttatggctcgagaaataatgattctgaggaggcttgatcatccaaacatcattaaactggagggcttgattacttctagattgtcttgtagcatatacctcgtgtttgagtacatggagcacgacatcacggggctcttggctagaccagaaatcaagtttagtgaatcacagatcaaatgctacatgaaacagttgttatctggtcttgagcattgtcactcgcggggtgtgatgcacagggacatcaaaggatcaaatcttttggtgaacaatgaagggatattgaaggtagcggattttggattggcaaatttctccaattctgggaacaagcagcccctcactagtcgtgttgtcaccttatggtaccgtcctccggaacttttgctcggttcaacagcttatggtccatccgtggatctctggagtgttggctgtgtatttgcagaattactaattgggaagcctatacttcaggggagaactgaggttgagcaattgcacaaaattttcaagctttgtggctccccacctgaagaatactggaaaaagaccagacttcctcatgcaacattgttcaagccacaacaaccatatgatagttccctccgagagacatttaaggattttcatgcatccactgtaaatcttctacaaactcttctttctgtcgaaccaagcaaacgtggaactgcctcttctgctctctcattggaggatttgacaagtcaaactcaaacttcacataagatgaatgatagatctgcccacatcattaaacaagaggacactaacacatgtgaggaggcaccaaagcagtctagtggtaaaccagaagatgcttcttcttatatgaagaatgcatctcaagtagatattccctttcctggaccattgcaagtttcaaaatcaagtggctttgcatgggcaaaaaggcgtagagatgacacttcagttagatcccacagtcggtctatttctagaggatttatctttaattcattagaaacttctacactaaattcaagggataattctgaatccagaaaccatgaaaataaggaatttttcggggcacgcaccaactctaggggcaatcacctacttgaaatttctaagcttgccatgcaaaatcaatggagtaagtttgatcgtccagattcatttgatacttgtgatgagtaccattcacaagaactgtccctggcaatttataacaggcaagattcgctatccaagagaagtaacctggatcaagaagaaaaggtagagttttcagggcctctgctatctcaaatgcacacagttgatgaactcttagaaagacacgagcgtcatatccggcatactgtcagaagatcatggtttcagagagggaactatgctactccaaacattttaacatgtgatccctggattgcagggccatctacattgtcgaagctcacttgctgctgtgactttgagcaacaatga

SEQ ID NO: 104175 - DNA, 390 bp, Glycine max
  Peptide Sequence Number=SeqID_220953
atggctgccgggttgcttcgtattcacttcgatgattgctttgtgcaaggttgcgacgcttctgttctcattgccggtgatgccactgagagaacagcatttgcaaaccttggtttgagaggatacgaggttattgatgatgcaaagacacagctcgaggctgcgtgccccggtgttgtgtcatgtgctgatattcttgctcttgcagctcgtgattccgtttctctgtctgatcaagcgctttggaatgatccttccacaaagtcatttgtacaaaggtacctgcaggacggcttcaaaggtttgcttttcaacgtggaatttgcaaagtctatgttctgccatcaactagctatagtgcatgttaaaataaatttgtacatggcttag

SEQ ID NO: 104176 - DNA, 525 bp, Glycine max
  Peptide Sequence Number=SeqID_220954
atggaagaagctggagcatgggtgagacctaggctcaacacaatgttgtcattgggtgaatactttcttcgccaaggatgccatcacgcacgtgctgttgatagtggtgttgtcgttcagatgctcgggaagaggaggaacgacaactctctttgttctgagcctttcaacaacaacaatgacaatggcacatgcaagccagtatcctcggagtcctcaaagaaaaagaagggttggcccagaaagtacttgcccgatggcaacattgtgttggcaatggcacaagttggtggtttggtcatgttgcaacctgaagtgggaggctctcgtgaaaacttcttctttgctggaatagacaaagtgcggtttcgtaagcctgtgattgctggggacaccttagttatgagaatgacacttactaagctgcaaaagcgatttggaatagcaaagatggaagggaaggcatatgttggaggcgaagttgtgtgtgagggtgaatttttgatggcgatggggagcgaataa

SEQ ID NO: 104177 - DNA, 267 bp, Glycine max
  Peptide Sequence Number=SeqID_220955
atggctcaagaggtgttagcgattcccatttctaatgtagtatcagaatcttcattcggtgttggaggaagaattttttatccttatcgaagttcccttactcctagaatggtggaagtattgatttgcatgcaagattggttgaaaggaacatctttttcaatgtttgctgatgagaactttaaagagctcgagaaatttgagcaagatatgttgtctccacatgaaggaacttcattgaccaccactattaatcttgatgattga

SEQ ID NO: 104178 - DNA, 327 bp, Glycine max
  Peptide Sequence Number=SeqID_220956
atggtgaaaatagttgttggattgggaggctcggtgccccctttccttttatcaccgagaaaaagaaaaagatggtgggggctacacactacaaacttttccctcgctattaggatactgaaaaaacagcatactgaaaataaggcaagcacattaataatgcaggcaaggttttggtcatcaaatcatcatgctatccttctttcactcaagaaattagaaggtttgatgagggcgagccctgatacagcggtaaagttgtgtcttggtgacttgttggtcatgggttcgaatccagaaacagcctctttgcatatgcaagggtaa

SEQ ID NO: 104179 - DNA, 315 bp, Glycine max
  Peptide Sequence Number=SeqID_220957
atgggctacaccgtttttgggttagagacagtttttaactatcttaacaagttagggataaatgttttcatgcttgaactcagggagaagattgacaactatataagagcagaatcaatagaaatacaaagcgggcactacagctacaactgtatcacggaaaaaccgacacgtggcaatgagatgggatatgaaataaggttcgtggatggaaggtggctgcttaagatccgatcagttactgcgtttctattggtccacgacggtttcgccaccaccgcgacacgtgccgggtacccactcagagtggcatag

SEQ ID NO: 104180 - DNA, 231 bp, Glycine max
  Peptide Sequence Number=SeqID_220958
atggtctggttccgcgagttcaacgagttaaagacagacacacgatcttggatattggagaccactttgtacgcaccctccaatttcttcattctcagcaaaacttccttcgtgttccaggcatatacatatggttgcggaacccacgagcattccgacgctgccacaataagtctagcaccgatatccaaacttccgttagaggttatcacatatatatactcagcttag

SEQ ID NO: 104181 - DNA, 813 bp, Glycine max
  Peptide Sequence Number=SeqID_220959
atggcgcagagaaatgttctcctgggaagcaagatattttttagcagcagtcgaatcttctttggtgaagttcatctttgcgaaaatgaaaaggactatattggatttggtcagcacagacagttcaaggaccatctaaatctagcattggcaccaattcccaccacggtccaagaaaaagagagtgatgatgttgagatcagtgttgacaagaagatggaaataggagaggggacaaagatggcaaagtttcaaatgggtgaacttcttagagcttctgcggaggcactgggtcatggaatcttgggaaatagttataaggctatgctgaatgatggatctaccattgtagtaaagaggctaagggacttaaaaccactctctaaggaggaatttgcaaagatactaaacgtgattgctgatatgaagcacccaaatttgttgtcattgcttgcttattatcattctagagacgagaagctcatgctctacagatatgcagagaatggaaatcttttctcccggcttcatgttgcaagaggagtggcacgagcattggtgtacctgcagctcaaccacaacaacatcgtcccacacggcaacttgcggtcttccaacgaagacgacacagttcttgtttcagacttcggcctagcctccttgatagcacaaccgattgcagctcagcacatgggagcagtgagggaagaatggactgctgagatatttgacaaagagatttgtggccaaaagagtgcacttgctgggatgctgatgctgttgcagattgcaatgcgttgcattgagaggtga

SEQ ID NO: 104182 - DNA, 242 bp, Glycine max
  Peptide Sequence Number=SeqID_220960
ccttgccccaacagatggccttcgcgtttgagtcgaaaaatctgggccttttctcgccgtcgccacgagaacgttgtggagaagaggaactcatcccttcccactttacactttacagggagaagaaaaaagatccagtaacattaaggatgcactatgcaccaagagaatttgctatagtaatttctagtatgagttcaatcaaacaaagcttgatacagaagataaaaataaattcataa

SEQ ID NO: 104183 - DNA, 736 bp, Glycine max
  Peptide Sequence Number=SeqID_220961
tgttcaggagttgctgcagtatggcctttctcagcctaataatcctaatgcaagaagtgtgccactttcgaatgctaggactaggatcccccaaggaaatctagatgctattacaagtgaggggagtttcattatacaaggggaaggtttaaattatttaggggttagtaggggttcggatcctctaaggtgtcagcgtgatgtgcagcacaaaagtggctttgctaagcagcagctacacaggtcagagctagacatccgacaccaggttttaggatatgaaaatcctaggagtccaaggaacgcttgctcattccctttgctacccaagtataattccctagcagaagctcgagggttgatatatttaatagccaaagatcagcatggctgtagattcctgcaaagaatatttgacgagggtacaccggaggatgttcaagtgatatttaatgagataattgatcatgttgcggaacttatgatgaatccttttggcaattacctaatgcagaagttgttggatgtctgtgatgaaaaacagagaatgcagatcatactcatggtgaccgaggagccagggcagcttgtcagaatttcgttaaacattcacggcactcgtgtggtacagaagctgattgagactctcaaaactaggcagcaaatttcattagttgtagcagctcttgaaccaggattcttggccctcatcaaagatcttaatggaaatcatgtg

SEQ ID NO: 104184 - DNA, 465 bp, Glycine max
  Peptide Sequence Number=SeqID_220962
atgcttataccgtgcttgcaatttcagtctctctcaaatactgtcgaagagaaggcaaagcttttcatcaacaagctcaaaggtaaaacccagaaagccttgccagatctccttcgagagtacagcattcctccgggtctgttcccccgcaacataacatgctacgaatttgatgcatcaaagggaaagttgatcgtgtacttatcctcaccctgtgaggtgtgcttcaaggactcatccattgtgaggtatgcaaatcgtgtcaaaggaacattatcaaaggggaagctcagtgttacagatggaatgaagaccaaggttcttgtgtgggtcaaggtgactagtgttgttgttgagagttacaagtctgacaaagtatggttcactaccaccggagttaagaaatcaaggcccaaagatgcatatgaaatgcctcgtgatgctattaaggtagaagaattttga

SEQ ID NO: 104185 - DNA, 337 bp, Glycine max
  Peptide Sequence Number=SeqID_220963
atgggttatcatcatgaatgtgatattcccattcctaaactagaagttgaatggacaaatgttgatctagccattatggagctcaacacaaaagtcagataccctttgacatgtgctttatctaaaaatgggtacaacaagatctatagactaaagactaccaaagagatctggaactcattaaccataaattatgaaggcactaaggatctcaaactaagaaaggctcaaataaacttgaaggtgttggaaaactttcccaaggtatgggaaccaaagaccatagctatccaagaagctagcgacctaaggaatcttgcatgggatgagttgcttg

SEQ ID NO: 104186 - DNA, 3276 bp, Glycine max
  Peptide Sequence Number=SeqID_220964
atgtcagagcaggaaacagattcctgtggcttgctcttattctttttcttgatccttctttcaggtaaagttgctgtaggggaatctttggacaaagacaaagaggttctgctgaagctgaaattttacctggacagcaaaattcttgcagacagaggaggttacatatattggaacgccaatagctccaatccttgtgaatggaaaggaatttcatgcagtgctacgaagagggtggttggcatagaactttctaatagtgacatcaccggtgagatattcatgaatttttcgcagctcactgaactcacacaccttgatctctctcagaacacgctctccggcgagattcctgaggacttgaggcactgccacaagcttgtacatctcaacctatcacataatattcttgaaggggagctgaacttgactggattgataggcttgcgcacattagacttgtcaaataacagattttatggggatattgggttgaatttcccttccatttgtgccaatttagtcgttgcgaatgtctcaggtaataaattgactggtgtgattgaaaactgctttgatcaatgtctcaagttgcagtacttggatttgagcaccaacaatctgagtggaagcatatggatgaagttttcgaggctcaaagagttttctgttgcggagaaccatctaaatgggactattcctttggaagcttttcctttgaattgtagccttcaagaactagacctttcacaaaatggatttgctggtgaggcacctaagggggttgctaactgcaagaatttaacaagtctgaatctttctagtaacaaatttactggggctattcccgttgaaatagggtccatctcgggcctcaaagcattgtacttgggaaacaacagcttttcaagagagattcctgaggcccttctgaacttgaccaatttgtccttcttggatttgagcagaaaccaatttggtggggacatacaaaagatatttggcaaatttaagcaagtaagctttcttctgttgcattcaaataattacagtgggggattgatatcctcaggaattctcacattgccaaacatttggcggttagacctaagctacaacaacttttcaggtctattacctgttgagatttctcaaatgactggtctgaagtttctgatgttatcctacaaccaattcaatggatccattccaaccgaatttggaaacatgactcaactgcaggcactcgaccttgccttcaacaatttgagtggatctataccctcaagccttggaaacttgagctccctcttatggttgatgcttgcaaacaattctttaactggagaaatccctcgagagttgggaaactgttcaagcttgttatggctaaaccttgccaacaataagctctctggaaagttgccttctgaactgtccaaaattggaaggaatgccacgaccacatttgaatcgaataggcaaaactatcgaatggttgctggatctggtgaatgcttagcaatgaggagatggatacctgcggattaccctccattcagctttgtgtacagcctcttaaccaggaaaacttgtagagagctttgggacaaattgctcaaaggatatggtgttttccagatttgcacacctggtgaaagaattcgcagaacacagatatccgggtatattcagctaagttcgaaccagctcagtggtgaaatcccttcagaaattgggactatggtgaacttcagcatgatgcacatggggtttaacaacttctctgggaagttccctccagagattgcaagtattcccattgtggtgctaaacatcacaagtaaccagttttcaggtgaaatccccgaagaaattggcaacttgaagtgtttgatgaatcttgacttgtcttgcaacaacttctctgggacgtttccaacaagtttgaacaaattgacagagcttaacaagttcaacatctcatacaaccccttaatatccggtgtggttccatcaacaggacagtttgctacctttgagaaaaattcatatttaggcaacccctttctgatccttcccgagtttattgataacgttaccaacaatcaaaacaacacctttcccaaagcgcataaaaagtccacaagactgtctgtgtttttggtgtgtatagttataacactggttttggcagtattcggacttcttacaatcctagtctgtgtatcggtgaaaagcccttcagaggaaccaagatacctcttgagggatacaaaacagtggcatgattctagcagctccggatcctcatcatggatgtctgacacagttaaggttatccgtttgaacaagacagctttcacacatgctgatattctcaaagcaactagcagcttctcagaggaaagaatcataggaaaaggaggatttggaacagtgtacaagggagtgttttcagatggcagacaagtagcagtgaagaagcttcagagggaaggcctcgaaggagaaaaagaattcaaggctgaaatggaggttctgagtggtcatggatttggctggcctcatccaaacctggtcacgctctacggttggtgcctaaatggttcagagaagatactgatttatgagtacatagaaggtggaagcttggaggatttagtcactgatagaacacgtttgacatggaggaggaggctagaagtggcaattgatgtggcacgtgcactagtctatttgcaccacgagtgctacccttctgttgtgcacagagatgtgaaggctagcaatgtattactagacaaagatgggaaggccaaggtcactgattttgggcttgcaagagtggttgatgttggggacagtcatgtgagtactatggtggctgggacagtgggctatgttgcaccagaatatggacacacatggcaagctactacaaaaggggatgtgtacagttttggggtgttggttatggagttggcaacagcaagaagagcagtggatggaggtgaagagtgtttggtggagtgggctaggcgtgttatgggttatggacgacatcatcgcgggttgggtcgttctgttccagttttgctaatgggttctgggcttgttggtggggctgaggagatgggtgagttgctaaggattggggtgatgtgtactgctgattcaccacaggctagacccaacatgaaggagattcttgctatgctgattaagatatctaatcccaaggggtactcaagttatggacactaccttgtttag

SEQ ID NO: 104187 - DNA, 336 bp, Glycine max
  Peptide Sequence Number=SeqID_220965
atggtgtttcgtggttgtcatttttctttgatttctccttgtgcgttgaagacgaaaggcaactctgtaagacaagggattaatcatgtgttagggtttgttgatgatgctctatttcggtgtaaagattctaagggtagtgtgggtaatatggaagaaggagatgtagtggctgaaaagtttgtaggggtttaccaccctttgtatgatattccacttcattatggtggtcttaatgtagaagaaggagatgtagcaacagaagtgatggatgatttctttggttatgtcaaagatgataaccaagatgctatgttatcaattgagcactactag

SEQ ID NO: 104188 - DNA, 339 bp, Glycine max
  Peptide Sequence Number=SeqID_220966
atggctgcatgcatggacatgctagtaataccaggacaaagaaatgaagcatcaattccttggaagattgccaaaaaattgaaaaaggaaccagatgaaatcaacttcacctattatggcagaggaaattatcaaataagaccttcaagcaaacacaagcaggatcgttggaacatagtaagtaaaatagcattggcatatgagctgtggagggaaggtagatgtgtggagtttgttgacccttcattggatgatacaacctcgccttttaaaatcatgagatgcatggaggtggctctgctgatagaccttccatgttggaagttgattcactgctga

SEQ ID NO: 104189 - DNA, 786 bp, Glycine max
  Peptide Sequence Number=SeqID_220967
atggtgggttacacaccttcaagctttgtggatatagtttttgctggcaaaggaatcaaagtgagtctgaaaagaggcaaatttgatcatcctgctttgacaaataaaaagcctggggcaaatagagaggatgagaagaaggaaggaacccatgttgtgactgccattcctacatggccaaacttcccaccagctcaacaatatcattacttagccaatgtcaccccttctcattatccaacatcctatcagccaagaaccctcaatcaaccacaaaggccatccttaaatcagccacaaagcttgcctaccgcaaatccaatgtcaaacaccacccttaacacaaaccaaaacaccaaccagggaaggaattttttagcaaaaaaggttgtagaattcactccaattttggtgtcctatgctaacttgctcccatatatactcaataattcaatggtagccataaccccaaccaaagttcctcaacctccatttttccaaggatactacttgaacgcaacgtgtgcttatcatgtaggagttctggggcattccattgagcattgtatgaccctgaagcataaggtgcaaggtctaattgatgattttatgacttttcagaaggaaatgtacaaaatactcaaaatgagggcaaaagggtcacttttgggacatttttcagcccctgggcccattagaaagcttagggatgaagtaaccagcgcgcctgggcgagcaagttacttcaggaggaagcaagcagctcgcatgggcgagttgctgtga

SEQ ID NO: 104190 - DNA, 246 bp, Glycine max
  Peptide Sequence Number=SeqID_220968
atgatattgcgagacaaacctgacctgtcacggtggtccttgaagtataaagcatttggtcgtgatattgaattctcttggttggctttccattccaaaatcagaaaaatcactgctgatctatggaaggtcttccaaacagttcaacatcgtgtgatgatatttgagatgtatgacaacaaagaaaagtttagatatcgcattttagagcctgaccagaaacttgtgggcatctatgtaatttaa

SEQ ID NO: 104191 - DNA, 498 bp, Glycine max
  Peptide Sequence Number=SeqID_220969
atgtctatcgagcaagactactttagtcacaccttggttatccagagacaatcgagtccgatagcatgcggagacacgtcatggttatccacacctttcatcaaccagaggcaagcgagcccatttacatgcagagaccaatatgagataatcgagtccgataagatacgaagacacctcacggttatctgcaccttgtcatccaaatacggtgagtccgatgacatgcggagacacctcatggttatccacaccttttgtcaaccagaggcaagcgagcccgttgacacgcagagaccaatatggctatctgcttcctttgtcgaagactcgatgtctatcgaccgagactactctagtctcacttttgctatccacagacaatcgggtctgatagcatgtggagacacctcacggttatccgcaccttgtcatccagagacggtgagtccgatgatattgttcgctttcggcaagtgcaccggatcacgcaagtag

SEQ ID NO: 104192 - DNA, 207 bp, Glycine max
  Peptide Sequence Number=SeqID_220970
atgaatctggggatcccacggtcatctggctccgcatgccaccggtctcttgggacacgcatttcgtttctaaacgaccatttagaggaaacacggcgtccaacaaagataggagaaaatcactcaaagtgtatcaatctcacacagtgcgaggcgagaaagtcgcacaggattttgtcggcaatcaaagggagaggaccactttag

SEQ ID NO: 104193 - DNA, 324 bp, Glycine max
  Peptide Sequence Number=SeqID_220971
atgcatgtgcgtcaagatttgccgattatggttagaactagagggttaggtcatgccttaggtaggattataggcaaagccctggggagagaggatcatcatgatttagatgatgttccccaggggcaaaggcctacagcattcgtacgtaggcaacgggaagttgcccctattgctgaggatgatcctgtgttgcatgaagacgtatatgcacatgctgcagaagctattcatgatgttgagggatttccaagtgggccgcgtgacccatcagtgctaactaactatggtgaccatgttgcagtcatcgtatggaatggagag

SEQ ID NO: 104194 - DNA, 914 bp, Glycine max
  Peptide Sequence Number=SeqID_220972
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctatcctgggcaggctattggtttaataccacataccctagtccaagccctccaggagatacttttcccttgaaggtagaagacgttattcgacttcaaatggaaggagaattagaattcagtgtgggtgactgggtatatcttaaggttcaaccttaccgattgaaacctttagcaagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 104195 - DNA, 146 bp, Glycine max
  Peptide Sequence Number=SeqID_220973
atgaaagcaaacaaaacaagaaatgaattgaaagtcacggatttgaaaactaaccagttgaagaacaaagaacgcacgaagaacggcggaaaatcttcacgaaattgctcacggaaacgtctcagaagagttacggaagcacctcg

SEQ ID NO: 104196 - DNA, 679 bp, Glycine max
  Peptide Sequence Number=SeqID_220974
atggttgctaggacaagattaagtcatttgattgcgtgttcagtagacaccagcgatcggggacttatatccttgtttgtcgagaggtggcaccgggagatttctagtttccatcttcctgtgggagaggttttgatcacgctagacgacatcgcgtctcttcttcatttgctgatcattggcgacctccatgtcttccagcctctgcacatcgacgtggcagtgctgatgttggttgagttattaatggtctcaccagaggtagccatggctgagacaggacattatgccctgcgtgacctcactcagactaggaggtatgcatggagagctgctagcctcgtgcatatgtacgatcaccttaatgatgccagtaacagcaccagccgacatgttactggttacatcacgttgttacagtgttggatatatgagcacttttcgtcagttgcggagtgcaacgctgatccagactacgacgaggtgtcaccacgacagcttcgttggggggccgttgctattagatacagatcggagagggttatgcgccaattcggatacgtccagggtattcctgcacaccctgacgattcatgggtatcatttgatgacgtagacgataggtggacacactactcagaccatcttgcaccaacaggtgacatatgtgttgtgccag

SEQ ID NO: 104197 - DNA, 243 bp, Glycine max
  Peptide Sequence Number=SeqID_220975
atgcatattgttgtggtaagacaggggcaggatcatcttgagctaccttctggggtgaggaccaaatgtggacagcagaaaccaatcaagggacggatgcaagtggggatggggttacgaccgaccgatcgttgccccttctctgcgcgaaacaagcagagaacgtcgctgcaaggcagccccgttagctcgcctgggcgagctgagctcgcctgggcgagccacccctgcaccaaattataa

SEQ ID NO: 104198 - DNA, 318 bp, Glycine max
  Peptide Sequence Number=SeqID_220976
atgtcaggatttacacgcgattctcctcaaatttcagccagcccgcatcaattagaccttgcaccttacgcttcagagccctacaatgctcaatggaacgccccagggcttctccgtgacaagcacacgttgcgttcgagtcgtattctcggagaaatggaggttgatgaacgttggctagggttatggctaccattgaattatcaagtagatatgggagcaaggattgcctttgtggataattgggcggtgggtaaggagaaggaatggcagtcacaacatgggcttgaaggtgaagaccatatcatcaaagcttga

SEQ ID NO: 104199 - DNA, 117 bp, Glycine max
  Peptide Sequence Number=SeqID_220977
atggaaatggctcagagaaagctttccgcaaagaaatctaggagggacgccgtggccgaaggaaccagtgccgctcccgagtttggcagccatcgtttcaggagcgccgaacactag

SEQ ID NO: 104200 - DNA, 1407 bp, Glycine max
  Peptide Sequence Number=SeqID_220978
atggcgcagatcgtgcgtgattatgttgccgacagtgtgaagcgtgccgatggcagccgggttgccatggcgcatcgccgcgccgatgtgcgcaccctcaatgccgccatccgttccgagcttcaaaaccgacaaaggctcgagcgcggccacgggcagaatgccggtgcggaccgtggagaccgtggggatgttgaggaccgtgggaacagtgagaatgttggagaactcaccttccagaccagtaccggcaaacgcgccttcgccgccggcgatcggatcatcttcctcgaaaacaaccgcgacctcggcgtcaaaaacggcatgcttggcaccgtcgagcatgtcgagcagggtcggatcgttgcccggctcgatggtcgaggtggcgacagtgtcagcattgccacggacagctaccaggcgatcgaccacggttatgcgacgacgatccataaaaaccagggagcgacggtcgatcgcgcctttgtaatggcgtccggcaccatggaccggcatctggcctatgtcgccatgaccaggcatcgcgacagcgtgcaactctatgccgacatcacggagttcagtaatgcgggccggctggtcgatcacggcgttgcgcactacgagcataatccgcaatcacgcgacagctattttgtgacgctggagaatgacaagggcgatcagcgcacggtgtggggcgtcgatctcaagcgggccatgcgagaggcctcgccaaaaatcggagacaggattttcctccagcatgaaggcgccacgcctgtctcgcttccggacggtacaaaggcagagcgcaatgcatggcgtgtcgtcaagggtgatgaactggcctaccagcaattagaaaaccgcctgtcgcgttccggcgcgaaggaaaccacgctggattacatcagcgactttgcagagcggcgcgggatcgcaagcgacggatcgatcgggcaagagtttgcggtcaaaagcgagatcgaacttgcttccgcccgatatgcgcgccaagaggtgttgtcccgtgcggcccatctgcaacgggagcagcaggatcggccatcagagcgtcagcaggttgacgaggaacgtgccggcgatctggccggccctgttggcagcgaagatccgcacagaactgaggacaacaaaggtcatcgtcgcattaggtggtcggacctcatgtcgcaagctagcgccgtccctgcccaaacagaagctgcaggcccgcaaaattctctggaacccggtaagccaacgccgcttgtgccagccatcacccgataccaacgcagcatcgaagaggtggcgcagcaaatggctatgtccgttatcgatcggcaattcgatacagtggactctctcgtgcggcacgtgttccgtgatccggccgag

SEQ ID NO: 104201 - DNA, 384 bp, Glycine max
  Peptide Sequence Number=SeqID_220979
atggaatctattccaaacatatatacgatggttccttacctcggacaggatatattatggcgaattcgtcagattccattgtgtcttccacaatggaatctgataagtgagatatggaatctgataagtgagattccgggtaattgtttacataatcttcttctgtccgaagaaattattcatcgaaataatgagttgctattaatatcgacacatctgagatcgctaaatgttcaggagttcttctattcaatccttttccttctccttgttgctggatatctcgttcgtacacatcttctctttgtttctcgagtctatagtgagttacagacagagttcgaaaaggtaaaatcttttgatgattccatcatacatgattga

SEQ ID NO: 104202 - DNA, 105 bp, Glycine max
  Peptide Sequence Number=SeqID_220980
atggcgagacatgatttatgtcgggatatcggtttagcaaatggctcagaaggcctgcaaatgaagccattctcttatcctgggttatggagaattcgtccttaa

SEQ ID NO: 104203 - DNA, 330 bp, Glycine max
  Peptide Sequence Number=SeqID_220981
atggatatctctgaagatactgacatccctataatattgggaaggccattcatgttgaccgcaagctgcatagttgatatggggaagagaaagctggagctaggttttgaagatcagaagattgatattgatttgtttattgaagacaagcctgctccagaacacaatgtctgcttacaggtaatggaaggaggtcaagaggttctgaaaccaaaccgcttagcgacaccttatccttggctaagcgcgactcagtgtcgccaagcgcaattccttacggccataactaaggtccatgaagctaagcgccagtcatggcagctaagctga

SEQ ID NO: 104204 - DNA, 973 bp, Glycine max
  Peptide Sequence Number=SeqID_220982
ctccgtaggaccttcaccaaaacaagtcagggtcagaggccatgtggtgaagattgatgcacacagtctcaacacttttctggagacacttgtggtactagttgagggtgaaaccttactcacatattctagatactacaggttgcctgttgatattagagaaattgaggttgccttatgtatcccaggtcgggggtttgttttgaatgtagaaggccatcctgggaagattctcaggaaagatttaacaactcttgctcaggtgtggagtgttctctcgtactccaacctggctcctacttcccacacctcggacctgacagtagatcaagctaggctgatctttggcctagtctctcagatggacatgaatgtgagagctttcatctctggtcagattacatctatggcccagtctaattcttctagacttgggttccctgctcttatcaccgctttatttactatcagaggggccaagagagcgaggacaaggccagctgaggccccttccacatctacaactcttcttccagcacgtaccctaacagctccttctgcctcagctcctgcagattttcagtgttttgaagccatgcttcaaagcatccatcaggggcagattatcttattacaaagtttacaaatggtggcacctccagacactattccttcaatagagcagtttaatgagtgggaagcctggcccgtaactcagtcttctcttcacaaggaagatgaaggtcccacagcccaagtaccacagcagatggaggatgagtcatccgagactaccattccagagcccttggtcagaaggaagaaggcagatcaaacacaagaagttgcagccactttcgacaaatctcttcaggccacttctgagccttcagtaccagtggcagatacagcttcacttcagcaggcaacatacccttccactcctgtgttggatcaagtggcctcggaataa

SEQ ID NO: 104205 - DNA, 231 bp, Glycine max
  Peptide Sequence Number=SeqID_220983
atgggttttcctttgtcggcagtcacttaccctgccgaaaaatttatctggtcagaagatcttttgttctctttcctgattttaagcattcgttattcgctctcccttgaggagattctgctttcctttgctttgggggaaaggatgaggattcttttcatgggtcaaggttcaaagcagcttaaggttgtgtctcaacatggtcttttcatcgtgcaaacccgattttga

SEQ ID NO: 104206 - DNA, 155 bp, Glycine max
  Peptide Sequence Number=SeqID_220984
atggctccgaagaagctctccataaagaggtccagaaaagacatcgctggggaaggctccaatgccgcccaggattttgatagtcaccgattccggagcgctgagcaccagcagtgtttcgaggccatcaaaggatggtcgttcctcagggagag

SEQ ID NO: 104207 - DNA, 426 bp, Glycine max
  Peptide Sequence Number=SeqID_220985
atgtcgatctccccctgtggaagtatcagttggtctgcgtcgttccgacatagggatcgcgcccgcaagacactcagtggacccgaagaagtccaacagggccctggggcttccagctctgattatgggcctttgtcagtcctacaggggatcacgcctgcaagacaccctgtggacccggagaagtcctacagggtcttggagttgccagctctgattacgggcctttgtcggttctacggggtgcctgttgcccctagcaaggtcatcaggccccctactaatcgagctttcatcaagaagtactgcgcccccaggcaggcgcagggcgaaacaccccagcagcctggggatggcctgcaacgggtaacaaacgcaccgccaccacctctagagttcatctcagctcatccacaaaaaggttag

SEQ ID NO: 104208 - DNA, 311 bp, Glycine max
  Peptide Sequence Number=SeqID_220986
atgaagcatagctccaatctcgaaggtgggggacacatgaacagccgccaggcaatgacattcatggggctccgaaaaaagtggtttgttggcaggaccgaacggtccaccgggggaggaacttctccccctatttatagcaaaataggggaggagcttgccacccagctcgcccaggcgagcaaggttgcttcctccagaagcaacagccttctggaggaagaatctggaaggcccaattacaaaaactcacagattgcgaaaacacctcctttcgatttccgtcacattacggaattttcacggatcgc

SEQ ID NO: 104209 - DNA, 240 bp, Glycine max
  Peptide Sequence Number=SeqID_220987
ttctacggagtgcctgtcgcccccagcaaggtcatcaggccccctactaaccgagctttcatcaagaagtactgcgcccccaggcaggcgcagggcaagacaccacagcagcctggggatcgccggcagcgggcaacagacacaccgtcgccacctccaaagcccctcagctcatctacaaaagctggagtgttccctatgacccgaccagcaagcgaccaagtccaaagccaaaggtaa

SEQ ID NO: 104210 - DNA, 204 bp, Glycine max
  Peptide Sequence Number=SeqID_220988
atgatgctctcctacaacccaagacaaggtagatggagattacattttgcaagcttagggttcaagtcagtcaatcaaattttcagctcaacatgggtgcaagggataattcattcatgcacaagagattcatgcaaaaatcggtactcaatgctagttgttctttcacatttaaagatcacacactcaccgggttgtggctag

SEQ ID NO: 104211 - DNA, 544 bp, Glycine max
  Peptide Sequence Number=SeqID_220989
atgaaggcaaagatattagagaatgttttaattatgtctagattattgcgatccttttcccgtatctcttttcgctcaaattcctcctcttcatcttcttcaagaaacaccaatctcttaaatgatcaagataaccagacccaagaggtcgccccaaaacataatctcttcgatgaggaagtccgattcgaagatattaaccaaaacatggatgactggaacattccagaaatccctcaggatcaactatacgttcctgaaacaattaaagacaaacacaactttgattacataatcaaaacagtagaaaacaatattcctctaagacaagatataggggaagaatttcatctactttcaaaaaattcaatttatgaacatagccgtaagtataaatatctacacatcggttgtgtacaagtagccatcaagcccttaattgatatgggcatagatgcagcagttttaatgtgtctaagagatattaggcataatcaatttgaagactccctaattggaacagtcgaaaccagcctaggacaag

SEQ ID NO: 104212 - DNA, 345 bp, Glycine max
  Peptide Sequence Number=SeqID_220990
atggggtggtggcttatttatctgtttgtgtcactctgttgtccaattctgctggaggattatcatcttgtggagaagcttgcaaattttgatagggaacgtatcccagaacgtgttgtccatgccaggggcgctagtgcaaagggtttctttgaggtcacccatgacatttctcacctgacatgtgcagatttccttcgagcccctggagttcagacgcctgtaattgttcgtttctcaactgtcattcatgagcgtggtagccctgaaaccttgagggaccctcgaggttttgccgtgaagttttacaccagagaggtaaagatttatgagtatatagcataa

SEQ ID NO: 104213 - DNA, 789 bp, Glycine max
  Peptide Sequence Number=SeqID_220991
atgttgtctttaaacacagaggattcagtgaggaagaaaggcttctacaagtcttgtcctccaccaccgccaccaacaatgtttcagaaatcagtgttcatgaagccaaggttcgatggttcatccaacgaagcaccttccttcaataaggagttgaagagaagcttcacaagtgagagaaccacaccagtgggaaagaaaagtcatgaagaaaataaatccatgcaaggcacattgtttagaagtaacaagttcatggggcatgcaagtgtgcgtcttatgtcacagccagctgagaaagaaagccttcttgtggaatctgacgatgatgatgatgacgatgacacagaaaccaaggaccaagacattgaaggaggaagaaccgttgctcagaacaatgacaggggaaagggtccacctgttattggtggagaaagttcaaaaacagatggtgatgaaggaccagatgtggataagaaggctaatgagttcattgctaagtttatagagcaaccaaggcttcagagaatcgagtcaatcaagaggagtgcaagaaactcttcaagaactaggaaactgctgtggagcaaccgagtgagttctaatgttatatactccttacagcacatgcatagtgacacatcaacattagctgttggcggaatagatgagtgggatccttggggtgttccagatgattacagatgtgaggtgattgagaatgatgcaccagttcccaagcatgttcctctccctatagaatttgacaagacgctagaggcactttga

SEQ ID NO: 104214 - DNA, 315 bp, Glycine max
  Peptide Sequence Number=SeqID_220992
atggggtcccattctcctgtccagtgtggtgccttgtctgataaagagtgtggtggtttaagctatgatgatgcttggaatgcatgttacaaccactggaatatcttaacctctatcagcgtcagaaataatgtaagcaatacaaggggtactgaacgaaaggaaatacaaagcacctctggtgttgccctccaaaagaaaacccaaactaacccaacaggaaaggcaaccccacatagattaaccaaaggagtccgatatgttggaagaccagtggttaaaactagtgttgaagcctttctctctaacttttag

SEQ ID NO: 104215 - DNA, 348 bp, Glycine max
  Peptide Sequence Number=SeqID_220993
atggtcattatgcaccctttgtcattcaggaccagcaagttgagttataaacacgcagagacaaattatggtcattttgcgccctttgtcattcaggagcagagcagcaagttgagtgataaacgcgcagagacaaattatggtcattctgcgccctttgtcattcagggacagctcgatcgtgcccgatggcatgcagagacaaattatggtcattttgcgcctcaccatccaggctcgatcgtgtccgagggcacgcagagacaaattatggtcattctgcgctttgtgtcaaccaagaggaacgaattcgacagtatcaggatgatgttggtcgttcggtactga

SEQ ID NO: 104216 - DNA, 363 bp, Glycine max
  Peptide Sequence Number=SeqID_220994
atggctgaggagttcacggaatctgaggttgtctttcccgaccaccgcgccgtccacgactgggtagtagagatggcgccgcagccgcagcggaaggagagggagaattgtcgacggacggcggcgaattcgatgccgggaggggcggcggcggtggggctcccccgaggaggaggcggaggaggaggagatgacgccgccgcacgagatcgtgaagagaagggtggccgcaaaaatggcgttttcggtgtgcacggggaatgggagaacgttgaagggacgcgatttgagtcaggtcaggaattcgatcctcagcttgagatcgtttttggagtctcgttgattgtaaaagggaacatttga

SEQ ID NO: 104217 - DNA, 594 bp, Glycine max
  Peptide Sequence Number=SeqID_220995
atggccatgacatgtgaaagctcaattgtttcccctcttttcctgtcacgaatatgtcaggctaagacagacccaacaagagcctttctgttggagaataaattctcaacaattacagtaaccgcctcgccaagacaagttgtatccgctgcacggttgtgcaatccaaatttggccacaaaggtggtagtcccatggagaagaagtagaaaagggaagaagacaacaggaaagaaagagcaccacttgtggaaaagtagagattctgctcagtctggccaaaaggcacttgctcttgttaggactattatggaggtgcagatgaatgtggagaagctggtttataaactccctaatgagaaagaggctgtttatggggcattagacaaatggacagcttgggaaacagagttcccagtgattgcagtgtctaaggctttaaaaatcttaaggaaaaggggtcactgggttcgtgcaattcaagtagctaagtggatgataagcaaaggccaaggagcaacgatgggaacatatgacacccttcttctggcatttgatatggacaagagggtatttgcagacatggaggagtag

SEQ ID NO: 104218 - DNA, 285 bp, Glycine max
  Peptide Sequence Number=SeqID_220996
atggcgcttcaagctaaacaacttttattacttgtgcagccttacacttcttatttcatccacataagactcattgttcaatctctcatcaacaacacccacaatatatcaatggagggtgccctagccgaaggtcttgcaagggtttacctcgacaccaataacgacaatggcaacaacctggctgcaagtgggagtgagaaagaagagccgtggcgtggagaggaacacctacgcgggcaacaccagagctacgatagagacgaagatgcgctacagatgtga

SEQ ID NO: 104219 - DNA, 864 bp, Glycine max
  Peptide Sequence Number=SeqID_220997
atggagggagtggtctttgtgcataagaaccagccaaagatctactctttgcacaccacaagatcatggaatttcgtggggttagatgggcctttaaatccttgggaagaagaatccgatcacacagatggaaacttgctagccagagcacaatatgggaaagacatcatagtaggaatgattgatagtggtgtgtggccagactcaaagagcttcagtgatgaagggatggagccagttccaacaaaatggaaaggagtgtgccaaaatggaactgctttcgattcgtctcaatgtaatagaaagatcattggagcacgttactacttgcatggttaccaaagtgcatttggccctcttaacgaaaaagaagactacaaatcagcacgtgacaaagatggtcacggaagccacacagcttcaatagttgcagggcgtgtagttccaaatgcctcagccattggaggcttcgccaagggcacagccttaggaggagcccctttggcccgtctcgccatatacaaagcatgttggccaataaagggaaagtcaaaacacgaagggaacatatgcacaaacattgacatgcttaaagcaatagatgatgccattggtgatggagttgatgttctaagcatttccatagggttcagtgcaccaatttcatatgaagaggatgtgattgctaggggtgcgttgcatgctgtgaggaagaacattgtggttgtgtgtagtgctggcaactctggccctttgcctcagactttgtcaaaccctgctccatggatcatcactgttgctgctagcactgtggaccgttcttttcatgctccaattaagctcagcaatggaacaattattgag

SEQ ID NO: 104220 - DNA, 630 bp, Glycine max
  Peptide Sequence Number=SeqID_220998
atggcaaccgttcgatcaaactcgattaccgtcttcttcgtggcattcattatcctcacaacagcaccatctccttcccaatccctctctttctcctctttcttccgttaccgaaacctcttctccctctcgcactccctcctcatcggcgtcgccaacctccgcgccgcacgcggcgacgtcgccggcgccgatcgagccaggtccatcgccgacggcctcgatcagggaaccgtcttcggcttcttgaagctcctctggacattgtcgtggacggatatgtccttcacggacctctacggcgctgtttccgacatgaacgagctgctgcggggcttgactgagttgactcgcttggaatcggtcgcggaaaggtccgcttgggtttcccgaaattaccaaagtgtcctcaccgtctttaagtccctctccagaaagctcctcaaagcgcttggccagtcgggagtgatgagggaaataggggagacgtttcagaaagaggtggtggaaggtggattaatcagggattgccttgaattgggtaacaatgatctaaaggctttgattcagattgtcaaggatttgttgttgcaattctttcctgttcgtgataaagaccatgatctatag

SEQ ID NO: 104221 - DNA, 1785 bp, Glycine max
  Peptide Sequence Number=SeqID_220999
atggaaaaccagttctttctgaattctggggtgtcacaaacacagcaccaccaccctcttcacttagaatcttcaccaccatccaatccttcttcagtgccctcttggcaatcactctcaccaccaaacatggggattcaaccaacagttatgaattgtgcctctgagcaaacacaacaagattgcttttacaactccaattgggacaagtcaacaacaacagatcaaggccttcaccactttgattcctcagcactgagttcaatggtctcatcaccagcagcatcatccaaccccaacaacaacatgtccaatgagaatttcatcatccgggaattgatggggaaattgggagctattgggaactctgatgagatcccacaacactctcctcaccctttggttgtggcatcttcttacatgaatactaaaggcaataacagcaccaacacttcatgctacagcacccctttgagctcccctccaaaggtgaacattgtcaacagcttggtgaatttgaggttggcaaatttgggagggggaaagtcaacaacaacggttttgaattccagtgtggctgaattctcagctgatcctggctttgctgagagggctgcaaagttttcttgctttggcagcaggagtttcaatgataggagtgtccaattgagggtgaacaatgctgaattggctcaaagatctgcaccagcaatggaacatggtgggaagttacctagagtctcaagcagtccattgctcaaaacacttggatctcaaatgggtgcccaagagaacaagaattcagcaattcatcaggagcaggagaaaatggaaggggccaattctcaagaggaatctacaatttctgagcaaaccccaaatggggaaattggggtgaaaacttcccaagatattatgaattccaggaaaagaaaagcttcttccaaaggaaaagccaaagaaacttcaaacactactaatcctaccaagggtgttgaaggcagtgagtattcaaattcaaagcgcagcaagccaaatgagggaaatgaaaatggccaagtgaaggttgaggaagagtccaaagcagaggaagagaaacagagcaaaagtaactcaaaacctcctgagccaccaaaagattacattcacgtgagagcaagaagaggccaagccactgacagccatagtctagcagaacgtgtacggagggagaaaatcagtgagaggatgaagctgctccaagatcttgtaccaggttgcaataaggtcactggcaaagcacttatgctagatgaaattataaattatgttcagtcattgcaacgtcaagttgagtttctgtctatgaaattggcttctgttaacacaaggatggatcttagtattgagagtcttgttacaaaagatgtattccaatcaaacaattctttggcaacacacccaaatgcaataatattcccattaggttcctcagcacaagccttttatgggcaccagcctcagcaaaacaacccagttttccataataacatacctaacagaacggtgacccactgctcagtggacccattagatacttctttgtgccaaaatcttgccatgcagttatctccgctagatgtgtttaatgaaggtggctctcagtttccattagcattcttagaggatgatctccacaccattgttcagatggggtttggccaagctgctaacaggaaaacaccaatacaatcctcgagtttcaacggttcaaataatgtaccacagatgaaagtagagctctga

SEQ ID NO: 104222 - DNA, 522 bp, Glycine max
  Peptide Sequence Number=SeqID_221000
atgaaattctctatactttttggttggttggtcagcccagacgggattgaagcactttgtaaagatgtgcatgtggaccacacagatgttagaatgctcatacttgcttggaaattgaaagctgaaaaacaaggttatttttccaaggatgagtggcgaaaagggctcaaatgtttaggggctgacactcttccaaaattaagaaaggctattaatggactgaagaaagagggaataatactttcagaagaaaagcaaaggagtatagatattgagaccatctgtgagctgttgaatgtcgttcttagatctgaatttcctactcaagtcaatttattaactgagtatctaaagatccagaacgattacagggcactaaacatagatcactggagaaatttttatcggttttttaaggaggtaagccttattgatcttcgaagttatgactccagtcaggcatggccagtgatcctcgacaattttgttgattggttaaaagaaaaagaagagaaaatatag

SEQ ID NO: 104223 - DNA, 297 bp, Glycine max
  Peptide Sequence Number=SeqID_221001
atggaaaaggtcgagggtctgcataatttgaaaatgatggtttatgagtcatttacgcatggggaagtcgacaagggtgtttccctcactcttacgtatcctcggcaaaagaagggtggaggttgcataacagcttgccaaggcaagctcagctcacccaggcgagctatttgcttcctcttgaagtttccttgcttgcccaggcgagctcagctcgcccaggtggatccttctcttggagacttcatggaaagaactaaaataacaaatatcacactagaaaggagggttgaataa

SEQ ID NO: 104224 - DNA, 525 bp, Glycine max
  Peptide Sequence Number=SeqID_221002
atgagtgaagtagaggaggtgcaagaacgtatgaaggccgacatagaggctataaaagagaaaatgaccacaatgatggaggtcatgatgagcatgaagaagataatggaggttaatatggctgcaatagccgctaccagtgccattgctgaggtggacccgactcccccatctggcctcaaccaaatgaatcatccaaccttggatatggtaggtcagggaggcaaagagttgggaagtacaaacaacccccattttgtacgaattcggaacaagcatgccttcccgccatatggcttgcctcccaactatgcaccacccaatgtgacacacatacacattgggagccaacaaacccaatctgatcatgcacatgtctctcaacccatggaggagacacatgaagcaccccgagaccataatcaagccgacttcgagcctcgcctcggatacgccactaaggggcaaccagttagtggtgtacccttgccaaacactttggaaggccatctgtggcgtccctaa

SEQ ID NO: 104225 - DNA, 825 bp, Glycine max
  Peptide Sequence Number=SeqID_221003
atggctgatgctcgtgaaagcagatactctgatagctccttcctttattcactcatgggtatggcccaaacccaaaaggaagcccaagatgctattgctagcgttgcacgggttgttcccggaagtataaccgatgtccggtcttttccttccagtaatgtcaagatgatcgcggcagctaacaacattgggaatctagggttctggaatgtgggacaaagcgagtttcatttatactgtccccatttggctttcatttctgggatattgattcaaccgcattgcttctccaagatatacactagttgctatgatggaattcttcggctaatggatactgagaaggaaatctttgatctggtatttgagagtgacgaaagtatatatgctctctctcaatcaacaaatgagacaaactgcctatatcttggtgagggttctggtgcctgcacctgggatttgagatatactgatggggataaacttgccgccttgagaatatttacccacaaaagaggtgtgcaatctgcttacttctctccttctggatgtagcctggcaactacaagtgcagacgccactattggtatttacagtggagttaacttagaggatggagctgttattcatcttaacaatcagaatagtacatacctctctactttgagttatggtttctcgggaaagcgaaatggggttggaatgactcatatctcttccttggaaatacgaacagaggagttgatgtcctctcagcagttcaaaggaagcagttatgactcttgcgagcccgcacatgtctgtcaatccgtacagattagatag

SEQ ID NO: 104226 - DNA, 131 bp, Glycine max
  Peptide Sequence Number=SeqID_221004
atgcctcgtcccaaaagaaaagctgccccaccaatcacttcctctgatgttgattcttctcttcgcaccgcgatgagttttccattgttgaagtgccccaagttggcgaatttcgatcttgttcgatcgag

SEQ ID NO: 104227 - DNA, 357 bp, Glycine max
  Peptide Sequence Number=SeqID_221005
atggccaaaatacaaggcccaaaagaaggaaaacatattctaatatttacaaagaaaagtggacccaaccttggcccatgggctcagaaatctaccctgaggttcatgagaaccctaggaccttctttagcagggagattgagtgtggttaagtgcaacaccgagatagaaagactgagtgcgactgagtcaggtgacgactttggtggaaaaacactcatcaaggtcaacgatgtcattggaaagacgcttgtccaaggtcgacaatgtctttggaaagacgcttgtccaaggttgacgacgctttctctcttgcattttgttaggtttagctgtagggttcctttttttctttaa

SEQ ID NO: 104228 - DNA, 1440 bp, Glycine max
  Peptide Sequence Number=SeqID_221006
atggcgccgcagaaactcaacgattacgaacggaagcgactcgagaacattcgccgcaacgatgaaatgatggctgccctcaaactccactccaaagccacccaactctccaacttcaagcgtagtcaaagggttggaaccaaatcctacaacatgaaatcggaaaagaaacccaaaaccgaaaccccaattgtgattaggcgctccctccgaacaagaggtattccgccagattccaaaggtcttgtcggagattccgtgggccccaccactcccactaaaactaaaccttccgttgttaatttgggtcctatttccatggctgatgctcgtgaaagcgctcactctgatagctccttcgttgaatcactcatgggtatggcccaattggaagcccaagatgttagggttgaaaaagagaaagtggaggcttcccttgggttggaatctctgtatttggatcccaagaatattgcgcgggttgttcctggaaggataaccagtttgcgattttttccgtccagtagtgtcaaaatggtcgcggtgggtaacaagtttgggaatgtcgggttctggaatgtgggaggaagtgaagttcatttataccgaccccatcgagctcccatttctgggatcctgattcaaccacattgcttctccaagatgcattctgtcattagcagtggatttcaggttaaagtggaagcaaaggaggaaagtatatacacaagttgctatgatggaattctccggctaatggatgttgagaaggaaatctttgatctggtatttgagtgtgatgaaagtatatatgctctctctctaccaacgaatgagacaaactgcctatatcttgctgagggttatggaggtttgactatttgggataacaggattggaaaacgttcatcacactgggttttgcatgaaagtaggattaacaccatagatttcaactgtgaaaaccctcatattgtagctactagttccactgatggaactgcctgcacctgggatttgagatatactgatggggataagctcagagccttgaggacatttacccacaaaagatctgtgcaatctgcttacttctctccttctggatgtagcctggcaactacaagcttggacaacacaattggtatttacagtggagttaacttggaggatgcagctgttattaatcataacaatctgactggcagatggctttctactttcagagcaaaatggggttgggatgactcatatctctttgttggaaacatgaaaagaggagttgatgttgtctcatcagttgaaaggaaaatagttatgactctagagagccagcacatgtctgccattccttgcagatttgatacacactcttacgaggttgggatgctagcaggagctacaagtggaggccaggtttatatttggacgtcgcgctag

SEQ ID NO: 104229 - DNA, 2820 bp, Glycine max
  Peptide Sequence Number=SeqID_221007
atggcctctgacatatcgtttgaggacctaaaaaacgagaatgtggatcttgaacacattcccgttgaggaagttttcaagcagctaaaatgtactagagagggtctcacttcagctgaaggagagaagagactccaaatctttggtcccaacaagctagaggagaaaaaagatagcaagttacttaagttcttgggttttatgtggaatccactttcatgggtcatggaagttgctgctatcatggccattgtaatggccaacggagggggcaagccaccagattggcaagattttgttggtattgtcgtgttgctcatcatcaattcaaccattagtttcattgaggagaacaatgcaggcaatgccgcagcagctttaatggctggtcttgcacccaaaaccaaggtgttgagggatggaaaatggagtgaggaggaggcagcattgttggtgccaggagatttgatcagcatcaagttgggagatattgtcccagctgatgctcgtctattggagggagatcccttgaagattgatcaatctgctctcactggtgagtccttgccagtcaccaagaaccctggtagtgaggtcttctctggctccacctgcaaacaaggtgagatagaagccattgtcattgccactggtgttcacaccttctttggcaaggctgcacatctcgtggatagcaccaacaatgttggtcacttccaaaaggtcttgacatccattggaaacttttgtatttgctcaattgctgttggaatgttgattgagattattgtgatgttccccatccagcaaagggcttatagagatggtattgacaatttgttggttcttctcatcggtggtatcccaattgccatgccaacagtcttgtctgtgaccatggctattggatctcatcgcctatctgagcaaggagccatcaccaagaggatgacagccatcgaagaaatggctggcatggatgttctctgcagtgacaagaccggaactctcacccttaacaagctcaccgtggacaagagcttaattgaggtgttccccactggcatggacagggatacccttgtcttgtatgctgctagggcttctaggattgaaaaccaagatgccattgatgcttcaattgttggaatgttgggtgaccccaaggaggcaagagcaggaatcactgaggtgcatttcttgcccttcaaccccgtggacaagcgcacagctatcacctacattgatggtcaaggcaactggcacagaagcagcaagggtgcccctgagcaaggagaggttttgaaaaaggcccacaaggtcattgatgagtatgctaatcgtggtttacgttcattgggtgtttcacgccagactgtttcagaaaagaacaaggagagtgcaggggaatcatgggaattcttgggactcttgcccctctttgatcctccaaggcacgacagtgctgagactattcgtcgtgctcttgaccttggtgtcaacgttaagatgatcactggtgaccaacttgccatcggaaaagaaaccgggcgtagacttggaatgggcaccaacatgtacccttcatcctctcttcttggtgatagcaaggaccctgccattgcatcaatcccagttgatgaactcattgagaaggctgatggatttgccggagtcttccctgagcacaaatatgagatcgtgaagaggctgcaagaaatgaagcatatttgtggaatgactggagatggtgtgaatgatgccccagcactgaaaaaggcagacattggtattgctgtggctgatgcaaccgacgcagcaaggagtgcctcagacattgttctgaccgagcctggactcagtgtgatagtgagtgctgtcttgaccagccgtgccatcttccagaggatgaagaactacacaatctatgctgtctccatcaccatccgcatcgtgttaggattcatgctcgttgcacttatatggaggttcgacttctctcctttcatggtcctcatcattgccatcttgaacgacggaaccatcatgaccatctccaaggatagggtgaagccttctcctcttcctgactcatggaagctcaaggaaatctttgccaccggagttgttcttggagcttacatggctatcatcactgttgtgttcttctttttggttcatgacactgatttcttcaccagagtctttggtgttgagccaattgtagacagtgaggaacaacttaactcagctttgtaccttcaagtgagtatcattagtcaagcactaatcttcgtgaccaggtcaaggagttggtcttatgttgagcgccctggcattttgcttatcacagccttctttgctgcacaattggtggctactgtgattgctgtgtatgctcactgggactttgccaggatcaatggagttggttggggatgggcaggagcaatctgggtcttcagcattgttacctatattcctcttgacatcctcaagttcctcatccgcatggggttatcaggcaaggcatgggacaacatgcttgacaacaagactgctttcacaacaaagaaggactatggaaggggtgaaagggaagctgaatgggctgtggctcagcgcacacttcacggtctccaagttggagaatccaacaaggccaagcaacatgagcagtctgaaatcgcggagcaggctaagagacgtgctgaggctgccaggttgagggaactccacacactcaagggacatgttgaatctgttgtcaagttgaagggtattgacattgataccatccagcaacactacaccctttaa

SEQ ID NO: 104230 - DNA, 3054 bp, Glycine max
  Peptide Sequence Number=SeqID_221008
gctagtcatattcttctgagtggtgatcgttctgagaggcatgagttagtggaggctgaaggaaattcaagtgatgactctctgtgtgataaatatcttgctcaggctgctgaactgtttacttcacaatgcatgatagcaagatccctgtcatacattctacagaagctcaagcttctaagacaatggaggagtgatttcctagtaggagtccatgctggactgaagagtatgtcacgaaagaccatgaacatcattgttgataagtttcgctctggagagttgaatctactggttgcaaccaaagtgggtgaagaaggacttgacattcagacgtgttgcctcgtcatacgatttgatcttccagaaactgttgccagctttatacagtcaagaggtcgtgcacgtatgcctcagtcagaatatgcatttttggtggacagtggcaataagaaggaacttgacataattgatggctttgagaaagatgaataccgaatgaatatggaaattacttttcgaacatccaaggagacatacataatccctgaggaaagaatattcagagttgattcgtctggtgcttctgttagttctggatatagtatctcattgcttcaccagtattgttcaaagcttccacatgatgagtactttgaccccaagccatgtttttattacttagatgattcaggggggatttcctgccatataacattgccttccaatgcaccaataaaccaaattttaggtacaccacagttgtctatggaggcttccaaaagagatgcttgcctgaaagcaatagaagaactgtataatttaggcactttaagtgattgtctcttgccaaaacaagatgatgcagagccagaggcgcaggtttcaggctcttctgatgaagatgaatgtgaagatgccatatcaagaggagaattacatgagatgctagttccttctgcctttggacagtcatggataaatgaggataacatcgtccgtctcaactcttactacataaaattttgtccctatccagaggatagggtctacaaagagtttggtcttttcatcatggttcggcttccaatggaggctgagaaattggaacttgatctccatcttgctcatggtcgatctgtgatgacaaaatttgtcccatttggagttgtagaatttgacaaagatgagattaagatggcagagaattttcaagaaatgttcctcaaaattattcttgatagattagaattcgtttctgagtttgtagacttgggtatgggtgctgaatctcacacaggcacatcaaccttctaccttttgcttccagttgtattgcaagaatatggaaatgccatgaaagtagactggaagactgtgaagagatgcctttgttcaccaattttcaggcatccagctgatactatggataaaaaagttttccctttagatattcacctgcaacttgccaatggttacagaagtgtaagagatgtcgagaatagtttagtgtatgccccacataagaagaacttttattttgtcacgaatgttaactaccaaaagaatggatatagtcctcataatgattcaggcacttcaagctatgtggattacttcattgaaaattccatatctttgctaccttcaattatgcaccgtcttggaaacttgctggtggctattgaactaaagcacaggctatcttcttcctttccagaggcagctgaaattagtgcccttagagttttagaagctctcactactgagaagtgtcaggagcgcttttcccttgaaagacttgaagtgcttggtgatgcttttcttaaatttgctgttgcacgtcatttttttctcatgcatgacagccttcatgaaggagaccttacaaaaaggcgctccaacgctgtgaataattccaatctgtttaagttggctatcaagcgcaatttgcaggtctatatatgcgatcagacatttgatcccactcagttttatgcattaggccgtccttgcccaagactttgtagcaatgaaaccaaagaaagcatacacttctgtttaaattctgttaaggaacaaggaaaagtaactgaaacccaatgtaacaaaaatcatcattggttacataggaaaacaattgctgatgtggttgaagctctggttggagcatttctagttgacagtggctttaaagctgcaattgcttttctttcatggattggcattcaagttgattttgaagcttcacaagtggttgatatttgcatagcaagtgctagttatttacctctttcttctgaagtagacattccttctcttgaaggtaagctaggacatcacttttttcataagggcctgcttctccaggcatttgtacatccttcttacaataagcttggaggaggctgttatcaggcaagtcgattggagtttcttggagatgctgtcttggattatttgattacttcatatgtattctcagcttatcccaaactaaagcctggtcaattgacagatttgagatcattgtctgttaacaacaaggcatttgcttgtctagcggtagatcgcagttttgataaatttcttttatgtgattcaagtggcctgtctgaggcaataaaaaagtatgttgactacattagaagacctgtatcagataacagcattaaagaagggccaaaatgtcccaaggcactgggtgacttagtggaatcttgtgttggtgccatccttcttgattcagggttcaatttgaacaaagtttggaagattatgacttcgttcttggactcaatcatgaaattctcatcaagcttgcagctcagtcctgttagggatttgcgagaactttgccaatctcataatatggagttggagtttctgccagtgccctcaaaattgactaaaaggttttcagttgaagctaaagtgagtgggaatggtgtatgtgaaacagcttcagcaactggtcaaaataaaaaagaggcttgcagaattgcttcactgctacttttttcaaagttcaaggtgagtatattacttttgtga

SEQ ID NO: 104231 - DNA, 2199 bp, Glycine max
  Peptide Sequence Number=SeqID_221009
atgtcaggctgggacgaaggagccgtctactacagcgaccaggccctcgccggcgacgacggtgccggcgcccgcggtgaagctggcactgattccaaccacactctcatccagaaattcaaggaattcatccgaaacttcgagacaaccaacaatgtcttcccttacagagagagtctcatccacaaccctaagttccttctcgtcgatatgggagatctcgacaccttcgactccgagcttcccgcgaaactccgctctaaccccgccgatgtcttgcccttgttcgaaacagcagcggctcaggttctcgtgaatttaaagacgaaggtggctggggataccggagatatggaggatcagacgcctggtgatgttcagattctgctcacatccaaagaggatccagtgtcgatgagatcgctcggggctcaatatatatcaaagcttgttaaaattgctgggattactattgctgcatccagaactaaggcaaaggccacttatgttaccttgatatgtaaaaattgtaagaaggggaaacaggttccatgtcggccaggacttgggggagcaattgttcctcgatcttgtgatcatgttcctcagcctggtgaagaaccttgtccaattgatccctggctcgtggttcctgacaagagcagatatgttgatcaacaaactttgaagatgcaagaaaatccagaggatgttccaactggagaacttcctagaaacctgcttctctctcttgatcgacatctggttcagacagtggtgcctggctcaagattgacaatcatgggaatttttagtatctaccaggcttctaactctaatacatctaacaaaggagcagttgcaattagacagccttatattagggttgtaggaatagaagaaacaaatgagaccaattctcggggtccagctgcatttacacaagatgagatagaagaattcaaaaaatttgctgctgaacctgatgcgtataaaaatatctgctccatgattgctccctctatatttgggcacgatgatgtcaaaaaggctgttgcctgtcttctgtttggagggtcaagaaagaatttgcctgatggagtccggttaagaggtgatatcaatgtattgcttctgggtgatccatctacagcaaagtcacagtttctgaagtttgttgaaaagactgcccctattgctgtttatacttctggaaaaggctcatcagcagctggcctaaccgcttctgtaatccaagatagcggcactcgtgagttttatcttgaaggaggggctatggtcttggccgatggaggtgttgtctgcattgacgagtttgataagatgaggccagaagacagagttgccattcatgaggccatggaacaacaaactatatctatagccaaagcaggaataacaactgttcttaattcaaggacttcagttcttgctgctgccaaccctccatcaggccgatacgatgatcttaagactgcacaggataacattgacttgcagacaactattctttctaggtttgatttaattttcatcgtgaaagacgtcagaatgtacagtcaagacaagataatagctaatcatatcataaaggtccataaatcagctggtggaaggatgggagagagcagaactttgaaagaagagaattggctgaagaggtatttacaatattgtcgaactcaatgccaccctcgtctatctgaatcagcaacaacattattgcagaatcattatgtgaaaatcagacaggatatgagacaacaagcgaatgaaactggagaagctgcagcaataccaattactgtgaggcagctggaagctattgttaggttgagtgaggcacttgcaaagatgaaactatctcatcttgctactgaggagaatgtgcaagaagcagtaaggcttttcaccgtgtcaacaatggatgcagccaagtcaggaataaaccaacaaataaatcttacacctgatatggcaaatgagataaagcaagctgaaacacagataaagagaagaattggaattggaaaccacatatcggaaagaaggctgattgatgacctcagcagaatggggatgaatgaatctattgtgagaagagctcttataatcatgcaccagagagatgaaatagagtacaagagagaaaggcgtgttgtatttagaaaagcatga

SEQ ID NO: 104232 - DNA, 273 bp, Glycine max
  Peptide Sequence Number=SeqID_221010
atggacactaaccctaaccctaggtcagggaatccaatattttactccagtgagtcagggacacttttgctttacgacaatgcgttagggaatccaatgcttcaaacactaaccttaaccctagttttgctttacgccagtgcatcagagaccgttttactttacaacaatgccttagagacacttttactttttatcagtgcattagagatacttttgctttatgtcatggaattcaattcttcaaaccctaaccctaaccctaggtcataa

SEQ ID NO: 104233 - DNA, 672 bp, Glycine max
  Peptide Sequence Number=SeqID_221011
atggctcgcaccaaaaaatcaggtcaaatgaaatatgaggcggcacgtgaaattgctgataggattgattccctaagagagcagtccgcacaaggtagctttgtagcccatggacatcaggatatactgattgttgccattgggcaactaaagcaccctagttgtgtttgttctgctggaatcggtgtgacaatcgaacaatactttggaccgacttcaggagtcatacctcctgctgagcctaaggtagttccttctactgcccatgtcagcacaaagggaagttgtgtcgatcccttggggcaagacccaaacacggctacatcagacaagcatgggttgtatgttgataacaatcttccctgtctggttgcccttggaagagtttatgaggggtcgacaaccgtgcacaacatccctttgggcaatgatctagtgaagggactggcaaagcctgtcgataggtcagaactagatgacgatcccatataccatatgacattgatgatcccacaacttttcctaaagcctatgcaagtgtcgtgggatgcaactgtgtttgggttgtacaacggtaatgtccccttgtacataaagcatgaagatcttggagaaatagcacacgatggtcaatgtctgaacatcgttgttatacaattgtggattctctaa

SEQ ID NO: 104234 - DNA, 375 bp, Glycine max
  Peptide Sequence Number=SeqID_221012
atgaccaagaatagggtgttgaaagatcataacaagacttttctaaattggtctaaagatacaatctttggtgatgataatgcttctaaaatgctaaggaagcatatggctacaccaccgagctcccttcctcttgagtcaacatcttcatcatctatgtcgaagaggactagaaaaactacacggctcatatcattggatgcaagacccgtcagggtggagagactagtggttcatatggatcctaccactagaaaaagcttatggtccccatataaagaaattaagaacctatttgggggctcatcgcttgagacaaggtggatcttacatatgttaactagaaacaagttcctacaactaagaaggatttga

SEQ ID NO: 104235 - DNA, 474 bp, Glycine max
  Peptide Sequence Number=SeqID_221013
atggcgaaagcacaaagaaaggcccccaaagaaggtgttatgattgctaatagagatgacaaaaaaaaccttacatggcatgcagatgggagaaactacgatggaatgtttttccatctggctaattcctcccaatggaagaagattaatcatttgtatccgaagattgggaaagattcaagaaatgtaaggcttggacttgctattgatggaatgaatcactttggcaatttaagcactaagcacagtccgtggcctattttgctagtaatttacaacttacctcctttgttgttcatgaagcaaaaatacatgttatctatgataatatcgggcccaagacaaccaggaaatgacataaatgtttatcttaatcccttgattgaagacttgagaaagttatgggacgagggggttgacatgtttgatagttatcaaaatgagaaattcaagttgtgtgcaatggtattttga

SEQ ID NO: 104236 - DNA, 201 bp, Glycine max
  Peptide Sequence Number=SeqID_221014
atgacggttgaaggagggttcacgggtgggttcaaaggacaaacaaaggagagtgaaaagagaaaaagaagaataataataacaagagagagagttttgttcaaaacgttgataatggagtcagcgaagaaaagagtgataaagagttaccttagtgaacacgctcgctcactaagactgaccagtagaatgattaaataa

SEQ ID NO: 104237 - DNA, 792 bp, Glycine max
  Peptide Sequence Number=SeqID_221015
atgccggacggagaatcctccgtcgtcgtcgccggcggccaagcttccatggaaccctccttaagcgtctccaatcaactgcagtccctgagtctttcccaagacaaaaaccatgatgactcagtcaagaaagatccccggaaaattgcaagaaagtatcagttggagttatgcaaaaaagctatggaggaaaatataattgtgtatttagggacagggtgtgggaagacccacattgctgtgcttcttatgtatgggatgggtcatttgattcggaaaccgcagaagaacatatgtgtctttcttgcccctactgtggctttagtccatcagcaagcaaaggttatagcagactctactaattttaaggttgggacatactgtggaagttccaagcgcttgaaacgtcatcaagactgggagcaggagattggacaatatgaggttcttgttatgaccccacaaatattacttcataacttatctcattgcttcatcacaatggagatgattgcacttttgatatttgatgaatgccatcatgctcaagtcaaaagcaaccatgcttatgcagttatcatgaaagtcttctacaaaagtaattcctcaaaggttccccgtatatttggcatgactgcttcccctgttgtaggaaaaggtaaaataatgcttatcttcaaaaagttgagtactaacaagagcctagatatttgcctgcctcaattaccttttgatactgtcaagtacacacagggtcaaggtatggaagggaggggaaaaaagagaatatag

SEQ ID NO: 104238 - DNA, 959 bp, Glycine max
  Peptide Sequence Number=SeqID_221016
cggccgagaagtcgacaatcaggggtgttacagatggtattagagcagatatctcttccggtacggactacatagttaaggatgatttaaaagaattaattgatactacctataccatcaagatgcatctacttttccgtagctcatcacttaagaactccacagttaagcttccgaaacagattgtcaaggtctcggaaagagctacctacggagggggccctacatggggtcgcacgcggcgctgttttgagttggttgcgcacgtggacagtgtggcgggagagaagatcaatgtgccgctagccaaagatgcgtcacacgtcgtgtgtgtgaacttcacatgccagggccatgcgaagggtcgctgcggcggtgttttgagttggttgcggatgtggatgactagggcagtctcgaagggaaccaaactggaaaaagaaatatacatgtatgaagaccctatagctctatccttatctaacagcaaaagcctctataagatcccatttgagaatataatgttatttctcatctgccacacagaccattggaaaaacagtggagatgttcacccaggacgtggtttcccaccaaagagggcgaccacaacaccggaagcatggcctaatcagagctccgacgcaccaaaaacagaacttgtttggttgcgcaaagaactggcatgtcggcagggtgtcggttttctaatggaggcacggtgggtggtgttggatagatcgacaatgggcgttccaaatcgtgggttcgccagtcaaaaaggtggccagatggcagcggccgacagctgtgacaggagaagttgccagaaattcaaaaacatatcatcaaagaaggagagaagtttcgtcagagcactggaatgcagaaacaaggtcgctagaagacgggcaaagcagagagatccaccagggatagtggatctctgtcaagaataa

SEQ ID NO: 104239 - DNA, 555 bp, Glycine max
  Peptide Sequence Number=SeqID_221017
atgggcatgaaatttgttatgcaggtagttggaggagatcctcttctcaagcttgtagcagttgattggtttacagttgataaatccgcggatagaattgcccttcaccctaaatgtttggttcaggttcctgctaaaccaaactacagtctggttctatattatgcagctgacagaccgataaataaaaattctctgttagctaagtttgttgatggaagtgatgcatttcgggactcaagattcaaacttattccaagtatagttgagggatattggatggtcaagagagctgtaggaaccaaagcttgcctcttaggaaaagctgtgacttgtaaatactttagacaagataattttttggagattgacgtggacattggatcatcttctgtagcaaggagtgtcattggccttgtcctgggatatgttacaagtttagttgttgaccttgcaattttgatacaggcaaacgaagaggtggagctgccggagtacattcttggaactgttcgattaaaccgtttgaaacttgaatctgctgtaccattggag

SEQ ID NO: 104240 - DNA, 249 bp, Glycine max
  Peptide Sequence Number=SeqID_221018
atgcttaagtttacaatagtacaacttgttaacgacaaagatgtcagagactcacaaacatttgatgctactgaggatcaacctcaaccatacttgcgtactcctgcagtaaagcctacctcatcagcccaaccagataagcttgagcttacagcaaagtctgacttacctaacaaagaacttggtccctttaatgaggataaagacaaagttctacacaatcaaccccaggaagatgatgaggaataa

SEQ ID NO: 104241 - DNA, 291 bp, Glycine max
  Peptide Sequence Number=SeqID_221019
atgtcatcgcatactgagagaaaggaaaaggaaggtgttggggttgagagaggaaagctccgtcagcgtgagatggacgccgcagcaacaggttcggagctgaacaagtccggaagcggaggttcggagcgaagtgaggacagcggaggagggatatttgagtactctggctgggtttatcacttgggagtgaattccattggccatgagtactgtcatctccgattcctcttcattaggggaaagtatgtctccatgtacaagcgtgatcctcacgataaccctggcctc

SEQ ID NO: 104242 - DNA, 2337 bp, Glycine max
  Peptide Sequence Number=SeqID_221020
atggatggtcccaaaagcaagtccttcgtgaatagcggattgggcaacgtacgaggtggtcaggtcactgttacttggccgtatactcaatttatgctccttggtattatcggcatggttttgtttggaggttcacagtacaaggaagcatcatcatatggtggaagtgagattcgtttgacggcagtgggggaatatcctattggatcgggtcagacccgggtacacatcggtgggtgggtgggtcctgcaattccttccttctccttctgctttgctgcatctaaacacagtacgattcgcaatttgttgttgatcactcgaaagcaaacaatcatgggaggtgggaacagaagatcaaaaggtggtggaaacagaaaatccaacaacagcagtggctgcggcaaccctaaatctcgaaaaagaggttcggatgttaagagcgctttgttcgtcgaaggcggtttcttgtctgattggcatctcccttcccctacccaaaatccagagagaagttctgggtccaataacaaatccgggagccagcgtagagcagcagaaggatctgcatctaaaagtgggtttgcgaaatctttgggtgctactattcgatacagttatccttcacttgatgttcagaatgacttatatttaatggcatattaccaggaggtcgcatgtgctgggattggaaacaatggtgaagatagtaatttaaatcagctgcaacctttggttttggcagactccaagcagggtcaaattattgctcatatagatcaaacacctccttcaaaacccagcaatgtaaaatatgcgtacacttatgatgcagattttattttgggtgacagctctcatagaggattatgtctccctgctgaacaagagaaaaccccaagtggcattggcactttgtctgaacagatgccccaatcaactccagttttagattcaccatcatttgagaaggaggctggttctgatgagggtatggattgtgagttaagcaatcagatcacagaagacttgccctcaaatgtgtctgctgagagaaattcagggtttctgtcaattggaggccttaaattatacactcaggacatctcggatgatgaaagtgatgaatataatgatgaagactcatcagatgaggacagctctgcgtcttctgagccagaagagttacttggatcatctgaaagcaatgactctgaatactcatctgatagtgattcagacattgatgaagaggtagcagaagattatttggaaggagttggtggtagtgataacattatggaagcaaaatggttgctaaaacctgttttggatgagtcagatgatgatagttcttccagcagttgctatgatgaggcattggagaagttgagtggctttgtccttcaagaagcctccagggaatatgacacgaagaaagctcaatcatggaagaaacgctctgtaggttctggacctttagctttggaagacctaatgctggcaaaggatccaagaagcatctctgctagaaagaagcatgttcctcggttccctcaatcttggccttcacatgctcagaacattgatgatgatgaggatgccgatttttctgttgctgactatgtgaataagaaatctgtgagtggagacagaagattgggaaagaaaaatgctaaaaggaatgattttagattacaagaacctcaatctgcccagaacaagtactcaggaagccgtaaattgaaagacaagaaagggaatggacaaaagggttcatatgctaatcagccagtgtcatttgtatcaagtggcttaatcaattcagaaactttacaagttacagttgttgatgctgaagagacaaataggaagggtgtcaccagctctgctaatataggttcgtttgaagaacacactactggttttggttcaaaaatgatggctaaaatgggatacacggaaggagcaggattggggaaaaatggtcaaggtatggcacagcctattgaggttattcaaaggcctaaatcacttggtttaggtgtagaattctacaacaattcagctgagccagctaggaacaaatcttcaagagttggtgctaaatcacttggtttgggtgtagaattttccaacagcccggctgagccagctaggaacaaatcttccaaggttggttcttttgaaaaacataccaaaggctttggatcaaagatgatggcaaagatgggctttgtggaaggtaatggattaggtagagaatcacaaggcattaccactccgttgagtgctgttaggctaccaaagtcgcgaggactaggtgccaaaagttaa

SEQ ID NO: 104243 - DNA, 660 bp, Glycine max
  Peptide Sequence Number=SeqID_221021
atgggaacaacaattcttcgttcccacgattgcctccaaggccggttcctccacagcgaagccttcgccatcgccgcatcacgtgtcgcatcgcgaagaaactctaatcctaacaataatagcttcgcctcctccgccaaaccaaaccgctgccggaagcggagtccggtcaccaatcgaaaccgccgtcgatctccggcgaaggccaccttgccggcgaatctcgtcatgggacacgttaagatcctgaagcgaggcgagaaattgagcctccagaataataccaaccaaagactcgcggagaacgtttcgatgaagaacgatatgggcctggatttgttattgggctcgacggatcggttgggcccggatccattaaccatgcagaagcatattagggtttcagatgctaacaacaacggcgtgtatgcgggatcggcgttcgtctcgtcgccgcatccaagttccgttccggtgccgggatttctagggcggaacggcgcagccaccagcgatttgcgacggatagccgcagggtgcgggcacgtgaagaagaaacggagaaagcaatgcttgaaggtttttagggagtggagatttggtgttcggtttctgaaagggggtgttagtttgttagatagtgatgccgttagtttttaa

SEQ ID NO: 104244 - DNA, 513 bp, Glycine max
  Peptide Sequence Number=SeqID_221022
atgttgcaacaacttaacaaggaaggacctaaggcaggaccattaaggaaaccacaacctcgtgtacgtgaccccactacagggaagaatactcaaaaaactaccaataggaaggttcagaaaacctttatgtcaaataatagcaaatggaaggataaggctcaagagagtctgattaagggcatgaataataaggaagtaggcaacaacaggatgacgggcaacagtaatgatgaagaaaataaaaagaaggatgatagcatgaaaacaacgattccaacaaactatgatccaaaaggaagcacggacgaggcgttattagcggtgatgagaaacatggaagctctcatctctatgtttgcaactcgtttccattatgataaaatggatatagtttttaatgcaaataagcctgcgaatttggtggataaggaatccttgtgtaataatacttttaatactcctagagaagaagctatgagtggtgttatacaggaggttgtgagtccttag

SEQ ID NO: 104245 - DNA, 1119 bp, Glycine max
  Peptide Sequence Number=SeqID_221023
atggctcactcgttgataagaaaatgcataaaacctgcaaccctcaacttcctgacaccactcgcagtccctgagattcggcggcggctagcgtcggtggcggcagcggcggacgaggaccctccgcaatcgccgtcgtcgttcactttctcgtcggagggggagaaggtgtacgtgaagccgccggcggggaagtggaagccgtcgccgtcgtcgacggtgacgatgccgatgtcgttcatgacggggtccatcgtggggaagcgcttctacaaggaggtgaagactcgcgaagccgatgacgggaacggctggacggttatgctcgattaccgaaccctaaagactccttccaagagacccctcaagcttccctctcttcctcttgctaaagccattgctgctgaatgggaataccagcaaacggatggcataaggcccttcacaatgcctcttatgagacttgcttgcactgccttggaaagagttccactcacaaggagcaaagttattgagaatttgatgaagaaatttaatcaagatttagtattttgccgtgcacctgatgacgatgagctgacaagctatgtacatgctcgtcaggtggagaacattgatccattgcttcgttgggtggagtcagaatttggctttaagccagttctttacaccagcttttttggtggaaagcaggaagatggtcttgtaatggctattgagaaccttctaaagaaaacagatgattgcgaattggcagcaattgatgctattgcagcatcagcacattcgttaattatagctattggaatggttcaggggaaattgcaaattgaggaagcaattgaacttattagacttgaagaagattctcaggtggacaggtggggcctcgtagaaggtggccatgatgtggatattgctgatctaagggtgcagagctggtattgttctaagagaatcaaagtcactggagatcctctgaatactttggatgagattcatgagaataactactttgacggatgcagtccttttgattatgtgaatatatcacgccatatacctgtggcttttaaggatcttcctgacagcatagaacacaaagtggaggctgtttag

SEQ ID NO: 104246 - DNA, 552 bp, Glycine max
  Peptide Sequence Number=SeqID_221024
atgtattgtatgagcatctatatattacctgatactcttatagatgagattcatgggatgctcaattcaatttggtggggaagtaaaaaggagagcagaatgggcgtgaattggctccgttgggacaagctaaccttgaggaaggatcaaggaggaatggtttttcaagatctaaagggttttaatttggcccttcttggaaatcaggcatggagtttttgtgagttttggtcctctagacatttgttgaaagagtggatgaaatggcgtgtggggaagggttatagtattaatgtgtggaaggatagttggcttcgagggaggaacattgccttgcatgatcatgctggggctcgagtagcacttgatttgatagtgcatgatcttatagaccaggaaaagggagtatggaatgctaggggccccttttgtttagaaaacctggaaaattcgtggcatgcattggtgggttgtgagcatgagggaagcaagtatatgggcacaataggagagcttgatcttaagcactttcctgaaaaaattcgtccctaa

SEQ ID NO: 104247 - DNA, 195 bp, Glycine max
  Peptide Sequence Number=SeqID_221025
atgggggtgaaaaggacattgggctacgatgcaaatgaatacaataatggagtgctgaactgggatgaattctcttcagcggtgaaggaagcccatgccaatcgcatgggtagccaaaccaagaggtttgtaatccctgacaagccaaaagaagagaattatttctatgccaacccacaggagtgtttgggatga

SEQ ID NO: 104248 - DNA, 262 bp, Glycine max
  Peptide Sequence Number=SeqID_221026
atggccactggagcatgtcaaatgatgtttcagtgtgtctttgagggaagtatttcattgcatgacatggagattgagcgaaggccataccacaaaaattgtggctgtgcattgcacaacttgaatgatggtgcctctatggctctggcgagtgaaccatacagttctcttagaatgcttaatgtggttacaagaaaatcgttagaaagtgagaagttattttgtttacttctgtttttcaaggccattgacactcttcgtg

SEQ ID NO: 104249 - DNA, 143 bp, Glycine max
  Peptide Sequence Number=SeqID_221027
gcacgagcacagttcaatatggtgtggcagcgatagagcttgaattcatcattaatggcatccaatctctccttagtgtactcatcacggctgtcgcttatccacctgcaaataccatcacaaacaatatctcaaagctttga

SEQ ID NO: 104250 - DNA, 333 bp, Glycine max
  Peptide Sequence Number=SeqID_221028
atggaaatctacaacagaccttcaggttacgtgcaatgctattttacaccatcaatgactttccagccaatgaaagcatttaatggaagccaagagtttcaaacagcgccaaaaccattagctggacaccaagtttttgatcgggtgaaggacatcataactatctttgggaagacacaaaagaaagatgcgtttgagaagaacatttggaagaaaaggtatatgacaacggttgcatccgatattagaaggtctacaaacgtattttccctcagcatgtcagacaatgtcggtaaaagaaaaaaagtttttgttattgtctacggagtctaa

SEQ ID NO: 104251 - DNA, 888 bp, Glycine max
  Peptide Sequence Number=SeqID_221029
atgttcctgcacgatatcgaagaatttgatgtgctgcgcggtgatactttggctgagccaaagtttattgaaaatgatcggctcaagcagtttgatgtgatttttgccaacccgccatactctataaaaaaatggaatcgtgacaagtttgctgccgatccatatggtcgtaatctgtatggtgtaccaccgcagggctgcgctgattatgctttttataatcatataatcaaaagcttaaaaccagatactggtcgcgccgccatgctctggccacatggagtcctattccgagattccgagcaagccatccgcaaacaggtgatagaatcagacatcattgaagcggtgattgctttcgaagttaaacgaaaacttccgacattcatggaaagtcatattcaatggtgtataagaggggaggattttgatagtgaatccctaagatttattcggaagggtagcctgatggatgcaggcccaacattctttcgacattttttaccaggggattttttgtacatgacaaggaatccaaggctaaaaaaaggtgctattgcagattttgaaggggttgctgcaaataccacattaatattaaatcaaaaaatttcaaaggaattttatgatggccttcttcctcatataatgcagtcagaattatttcatgcctatgcagaatctgttgcggttggctcaacaaatctttttactaaatggattgatttaaaacgcttcgagtttagcttgccttctgtgcgagagcaggagcgtttaataaaaatattagaaaaagttgtggaatgcattcatttaacggaagatcttgtagagcattactcaaatcttaaagctgcattaataaattctgttattacagaagatcag

SEQ ID NO: 104252 - DNA, 3723 bp, Glycine max
  Peptide Sequence Number=SeqID_221030
atggcgtttgatcaaaattccattccgttgaacgcggcctcggcggtggccgaggagccgctgatttctccggccaccgtcacgccgcccactccgaattccgtcggggagcttttctacccgccctcggactccgcaacgtggtgcgtccaccccattgcgcatcatgccgacgtcagccccgcggcggcgccgtttgggtctaactacggcggttccagtttcggaaaccaccgcgttgtggctgctgggaatgctttgaatttgggaaagttgtcagcgtgtaatggattagacaacaaggcatgcaatgatgtgaatggttttggtggtgttaggggaagcagagtggttgcaaatgtcggtgatcacggcggcggtagccaccacgagggaggtggcagcaacggcggcgatgattcggcctcctcggggaggaaggtaaagtttctgtgcagttttggcgggaagatattgcctaggcctagtgatggaatgttgagatatgttggggggcaaacaaggatcattagtgtcaggagagatgtgagtttcaatgatttggtgcaaaaaatggttgagtcttatggtcaggctgtggtcatcaagtatcagcttcctgaggaggatcttgatacattggtttccgtgtcgtgccacgatgatgtggacaacatgatggaggagtacgagaaattggttgagaggtctcatgatggttctgccaagttgagggtttttctgttttctgcttccgagagtagtgaatgttcttcttcttctggtggggtgcactttggggacttgcaggatacaggacagaagtattttgatgctgtgaatgggattggtaatagtacagaggggatcaataggaaggagagtgttacaagtgctgcttcaacccagaattccgattttagtggtgctgaaactcttgatagttcaattgtcagtggtggggtgcccttgtcatcacctaaggagaatgtgtcagcagcttcttcttccgacacaactgcaacaaatttggtggttttggaggtccccggtgcaccggtttactcgggtggtgcttccgcggtttcattggccatgcctgtggctaagactaagactagtccaaccgcaacccacaatctttattttcagaatgaggtagagtcagagaagtctgtgactgttactttatcccagaacccatttggattgcagccttttgttgatgctactagccaggaggttatgaatcatgcagcagattatgtccagctgccttcacagatgggcttcacaaaccctcagcttttaggaaagaccggcgggcatgtcttcgcgcaacagcagtttcatgatagtactcaccgtttagcattgcatcatcaggtcatccctgctggggtacaaatgacagtggctcaacaaccatcttctcatgttggtgtaagaccaaatgttgttcaaccgcagcagcaacatcttttggatcaataccatgatgaaaatacttcaggaggggtaaggattatccagcttcctgctgaacgtagctacaacacattccaggttccaatgaatcaagtccaacccgtcatagttggaggcaattatggctgggttcaggttcctccacaagagcgtgttgttatctctgatggattgttacctcaacaacaggtaatgatccctgagaaaatccgaagagctgaggactgttctatgtgtcagaaaaaactacctcatgcacattcagatccagtagttcaggatcagcacgatagtcgtggtgcaggttctactcctgattcaaccccaagtcataatagtttcccaatagaggacaatgtaaaagctcaagcaacgaataggattatgccaatggtgacttcacccttgaaggaaggcattgctgaacagggggctaggaccagacccagggtccttggcaaattggaacctcctgatggagtacatcatactgagaccagtgggtttcctcataatattgagccacacactgaaggtgggaggaattttatacaaaagctagaagaattggatcatcccaggaactcgtttttccaggaaaagattggaatgaaaggcagagaacaatctccaaacgacgagcccctgggaacaacaccattgtcttatctagatgatgttggcaaccaccacatggtatcagttgagaactgggttaaacaggatgtgcttaatcatatacctttaggtgaaggaaaatctataaaaacttcagagggtatgcttcaaggatctcaaaaggaatatactaatgagctttccagggttgtttctaaatcagatgcgatagataattggattagacaagaccatctaaaacctgttgatgcaaggatggacaccttaaagatacccaattctgaagtttatgtaagtaatgattactcttttctgccagttgataaacccagtgggaatgataacttagattacagcactcaccactctgtagaggaagaggtgattctggataacaactttggcaggtctaaactgagagttgatgtaaatcaaaataagatgacaggtgtgctgccttgttcttctatggaaatttcatacaggaacaattccaggccaggggaatgcaatgaggccgcacaacctccattttggggcattcctggctcaagtcctcaatcgaatattggcaacccccacaagggtgatgcatcaccatcttcaccatccttgtctgttaggtttggagatgtgcaggatactaggaactcacttttcagcaatcaggatccctggaatatacagcatggtaccttctttccaccttctatacctagcaaaactgcttatagtaaagaaacctattcttgtaacgattcctttgatgggaattcaggcaactttggggaacaaagtttagaagcacagttggatggtagcctctaccagtcattcaaacaaaatttaactatagaacatgttaggtctgccaaagggtcagcagaagaccaacaacttcaagctgttgcggaaaatgtagcagcttctgttttgcactcaagaactccttcaaattctgacttgcattccggagatgtttcctgttgcgaaaccattaagtatgacagtgttcaaaacaatctaatagatgtcaagtgtggacataaagctcaggatgtcaagagcaagcaactggaaaaggcaaattttggctttccagcatcaggtgttggaaaactacaggttataaagaattgtgatctagaagaactgatagaactaggttctggtacctttgggaccgtatatcatggaaaatggaggggcaccgatgttgcaatcaagcggattactgataggtgttttgccggaaagccttcagagcaagagcgcatgagaagtgacttctggaatgaggcaatcaaacttgctgacttgcaccacccgaatgtggtagctttctacggtgttgtgcttgatggcccaggaggttctgtggcaacagtaactgagtatatggttaatggttctttaagaaatgccttgcagaagactgagaggaatcttgacaagcgcaaatgtcttttgattgcaatggacgtggcctttggcatggagtacctgcatggaaaaaacattgtacactttgacttgaaaagtgataacttgcttgtgaatatccgagatcctcaccgcccaatatgcaaggtttaa

SEQ ID NO: 104253 - DNA, 576 bp, Glycine max
  Peptide Sequence Number=SeqID_221031
atgagtctgctttccttggaattgcacccttctcttggcagattgttgtttgctctggttcagttatgggaactgagacagtgtactgaatgctgggttttcattagtgtatctcctggtgaaggaacgggtgcaacaatgtcagacgatgaagatgaccaggcagagagcaatgccaacttatacgaaggaagccttgatggcggcgaaactcttggatttggtcctcttgtccccactgaaagtgaaagatctttgatggaaagagtcaggcatgagttgaagcatgaactaaaacagggttacaaggagaagattgtggacataagagaagaaattctaagaaagagacgagcggggaagcttccaggggacaccacatcccttttgaaagcttggtggcaatcacattctaaatggccttaccccactgaggaagacaaggctagattggtgcaggaaacagggttgcaattaaagcagataaataattggttcataaatcaaaggaaaaggaactggcatacaaataacccctcatcctctagcaactccaaaagcaagcgcaagaggtag

SEQ ID NO: 104254 - DNA, 843 bp, Glycine max
  Peptide Sequence Number=SeqID_221032
atggctccagaactgctgaacggaagcagtagccttgtttcagagaaggttgatgttttttcatttggtattgtgatgtgggaactcttgactggagaggagccatatgctgacttgcactatggtgctatcataggtggtattgttagcaacactttgcgccctcctgttccctcatcttgcgatccagaatggagattgttgatggagaggtgctggtcatcagagccatcagagagacctaccttcactgagattgccaatgaattacgttctttagcgaccaaggtgtatttactgttgcaaataattgagcactgcatgacgccgcgtgggtgttgggtgggggtatgtacgtgtatcactgctcttactcaaatcatcaaagccgccactaacctcatacacacaatcgaaaacatggcatcttacgagggaaggccattggtgatggaaatggaaggagaagaaggtttcgaagaagccggtagcagcggttgcggatgcttccggtgtttcagcctgaagaaatggtggcaaggctatgaggaagaaggtaaagggctacttgatcaaaagggtgagggagagtcatgggttgtgaacaaattaaggaaggcaaaggaggtttcagaagtaattgctggccccaagtggaagactttcattagaaagataagtgggtatgggaagaaggtgaagtaccaaagaaacaggttccagtatgatgaacatagctatgctctcaacttcaacagcgaagctcagagagaagatgaaggcatgcctcacagcttctcatcaaggtttgctgctcctggtcgtcgccagaatgaatcatga

SEQ ID NO: 104255 - DNA, 204 bp, Glycine max
  Peptide Sequence Number=SeqID_221033
atggccagcttgaacgccggcgaggaggggacacgctgcgccgccctcttcagtaaccccgtcgccatggaagagaggtccctcgggagtgttgtgcgttctgcgttttatcttttttatatgaggggagggtgggttggtgaatttggagggggagtgggggtagattgggaagttctcgttgattacggaaagtacttgtga

SEQ ID NO: 104256 - DNA, 1473 bp, Glycine max
  Peptide Sequence Number=SeqID_221034
atggtgtactcctactacacccccacgtactactcaaccctccatgactcactcacctctctgtgcaagaccattcttcctttcagcttcaagaaacgaccgttacctgcggcggaacacaaattgtcgaaactgcaatccgacaaccttaaatggcagcaagactctttccaccaggtgctgaacttgatgggtctccacaaagaaggcatcgtcgctgaatctgaagtttcggccttcagaacccacttgctagacaccctcattgcttctcctccagaacaagaacaccccgttatattaagagataagcttctgtttctccaggaacttctctatgccaagtgcatttctgaagaagagtaccattcttctaagaggccattactccagagactggcagcacagggggctcagattgaagctagggatgtgatcgtggcaaggcctaaggactcaaaagagaattcagaggaagagtggtcagtgattgatttgaaggatgagaagtgctgggtgaacaaagagaatttgggtagtaagagcaagtccaatcagggatcagccatgaagcagattaaaggagcagccttggtatttggctttggcaaaggtgggaaaaatggggaagaaaagagcatgtttgactcaccttctttgtctgccaacaatgaatcaagggaaaaccccttctgggatgctcagacaaaggaaaaacaaagtgaaggaaagtcaattcttatggaggaaagtgtgcctccagaaccagtgaaggagagtggcggtttggacaagttgaagaggaaaccatttagaactttgtttcataaggagcaaagtggtggtcctgaacaagatcaaagatcggggaaatcaggtaaaaagcaatggggatttgaagggttcaagaaatggaggagaaatgaatcagaagaagagacagctcctttgcctcttaatgagagtgaggaggcctattcgggttccttagcaaagacacttggggagggaccagacactaagttaataaagaagaagttgcattctgatggttccccatctgatttttttattgataaggttttgggagacaagataaagaaggagttgtcaagaatccagacagaactgagcagcacaaacccaaatcttaaattttcgaatgatcagattgaagcaatttctacaagaattccagtggacaaggctgagttgaaaaattactttcccaaatcatggtgtgaccgatacggtgatgttgtgctggatgtggtgaagaaagagttcaaggaccatgttgcggaaatggagaacaggcgcaacattgctagagaaaaacaaagcaactctaggcgttggacaacaacaacatttgacggtgacgaaaacattcatccaaatctttttggtcatcgtgataataattcagttcgtagcagtaacattaatccattttctcatggttacgcttag

SEQ ID NO: 104257 - DNA, 501 bp, Glycine max
  Peptide Sequence Number=SeqID_221035
atgcagctggcacgacaggtttcccgactggaaagcgggcaatttaatcagtgcaacatacatagaaatgacctccctttatttcttattctaataagatacacaccagaaaaagcacaaggggcaccagacggtgatacacggatcgttattcataagctccatatgcattacatcagcaacggtggtgttggtggtgtggaggccctggagggggaggtcccggtggcccaggaggcggaggagttggatgagcatacggtggcccgggtgggccatggtgttgatgaaagcctggttcgggtgggccgggatggtggtgtggaggcccaggaggcggaggagttggataagcatgcggtgggccgggtgggccgtggtggtggtgtggaggcccaggaggcggaggagatggatgagcatgtagtggcggagccggtgggccggggtggtggtgagggcctggaccgcctggcgggggaggattgtgcatgttgctga

SEQ ID NO: 104258 - DNA, 1900 bp, Glycine max
  Peptide Sequence Number=SeqID_221036
acccaaattgggtatcattttgaagccacacaagagtcatgttggagacttagctccacccttagggtgggcattggaggaggatggtgttgggagtgaattggttgatgagcagattgattctaatgatgcatcggtaaaccgtgagtcagagggtgtaaagtctttgaatttggatcaagttcaggacagtgactttgaaggacaaattcgtggttatgatgacgatagcaaggaaagtggtggcaatgaattggttgaggagcagactgattctaatgatgcattggttaacggtgacttggagggtgtaaagtctttgaatttggaccaagttaaggacagtgattgtgaaggaaaaatgtgtggtgatgacaatagcaaggaaggtggtgaagaagaaagtgatggtaaggttgatgtgagagcacttgccttgtcattgcagaccgtgaagacagtggaggacgtggggggtattcttaaggacaagggggacttgcccctccaggtgttttcgacaataatcagtggttttggtaaagagaagaggatggattctgctttgattcttttcaactggatgaagaagaggaagatagaaactaatggctcttttggccctaaccttttcatttataacggtctattaggtgttgtcaaacaatctggacaatttgcagagatggaagtcattttgaatgaaatggctgaagatggaattgcctacaatgtggtgacatataacaccttgatggcaatttacattgagaaaggagaatgtgacaaagctctcaatatgcttgaggagattcgtaggaatggccttaccccatctccagtatcctattcacaagccttgttggcatatcggaggatggaagatggctacggagctctaaatttctttgttgagtttagggaaaaataccgtcaaggtgaaataggaaaagatgatgatggagaagattgggagaaagaatgcttgaagctagagaagttcacaatccgtgtttgctatcaagtaatgcgttgttggcttgtcagtcgtgataacttgagcaaaaatgtgttgaagtttcttgttgatatggataatgttgggattccactaccgcgggctgatcttgagcggcttgcgtgggcttgtacccgtgaagatcactacattgttgtgaaagagctgtacaaccggataagagaaaggtatgataagatcagcttgtctgtctgcaaccatgcaatttggttgatgggaaaagcaaagaaatggtgggcagctttggagatatatgaagatttattggacaaagggccaaaaccaaataacttgtcatatgaactgattgtctctcacttcaattttcttctcagtgcagccaagaggaaaggaatttggagatggggtgttaagttgttgaacaagatggaggataaaggcctaaaacctggatgtagggaatggaatgcagttcttgtggcctgttctaaggcttcagaaactactgcagctgtgcaaatattcaagagaatggtggaaaatggtgaaaaacccactataatatcatatggggctttgttgagtgctcttgaaaagggaaaactctacgatgatgctcttcgtgtgtggaaccatatgatcaaggttggggttgaaccaaatgcatatgcctacacaattatggcttcgattcatactgcccaaggaaattttaatagggttgacgccatcattcaggagatggtaacattaggaatcgagcccttgcaaatgatggaaagccaaggctggcatatcagttatatacgagagctaaaaacgaaggccttaccctctcttcgaaagcttacgacgcagttgtccaatcctctcaggctaataatgcaaccattgaattag

SEQ ID NO: 104259 - DNA, 1590 bp, Glycine max
  Peptide Sequence Number=SeqID_221037
atgggttcttcctctagtcgacttgggtctcgcccttcttcgtcttctagtcacagtcacagggtcaaccgcttcagattatcgtctcttctatgtggcacctccacctctcgctccgttcatcagcttttcataggggaccaagcaattgagcttgacttatggttagttatcttgtcaaagtataggcttttaggtaagatggaagaactttcagctgaacttcgggttgattcagcaagggattttgatggtgaaattcagaaagacactgaggaatcgtctttatcatatacagaagctagaattagctccagtcgccctgctgaaactgcaaccctatctgatatgagaactgagttccatgggaatactagtgttgaaggttcttctagaaacgttgcaacaaatagtcagaggaactgcttgtctgaacatgaggagcttgtccctccttatcaggtaagtgctggtcatactggtcatgaatcatatagtgatagtagcaacacagctagtacttcatttgtagaacagcagtcttcagatccagtctctgtaaatgtttctgctaacaaggatttagtcaatgatgttaataatccagtggttagtgatgtctctcaagtttctcatgagacaatgcgtccaagaagttcaacccctcaagagcatgggaattttggttctggtgaaatttctgttgagaatcacactagtgcattcatatctattcagaattcttccagccctgttgctcaagtttccaacttagcagcaacctctcaattgccagaagatgaacctcgtcgtgagacaataccttcgggtttaggtattcttgtgtccaatcgggaaagagggccgggaaatgatagtgtgcttcaagttgatgtggtcactatatcttccaacattttgtctggtagcagtgctgatgccaatgataatgatgccagaaggaatggtagaagattattttgggatgctttttcacgacgtagttctagaaggcttggtgattctcctaccattgtcttctctgctgggggtgctgatgattctggatctcaagatcgatggctagttgattttggtggtgatttgtcaaatgatggggttggaggtgcttccggatatacgggtagtagaattcacagattgaatgaacgaagaatgcaacactcaagatctgagatctgggaaaggcttcgtggtggctttgatgagattggtcggtggaattcatgtccactaggactccatgcagatggcatgtgctcatgtgagtcttccccaatggctgaggaatctagcactcaagcaagtatttcaagaatcatcatgctggctgaggctttgtttgaggttttagatgaaattcatcgacaacctggatcactgtctctatccatggtatctctccctgcacctgaatcagttgttgattcactccctctgaaatctcacaaaaaggttgatgtagctcatggaggcaatgatgctgaacatgtatgtcctctgtgtcgcggcaatgtctgtggagggttcacagagtcttctgccaactcagaagtgcagtctcattga

SEQ ID NO: 104260 - DNA, 2256 bp, Glycine max
  Peptide Sequence Number=SeqID_221038
atggtaaacacggagagggcgatacgtcacgcaattcaggagcggttgccgattgttgttgtaattaataaggttgacaggcttataactgagcttaagttgccgccaaaggatgcttatcataaactaaggcatactttggaagttattaatactcatatatctgctgcctcctcgattgctggtggtgttcaagttgtggatccagttgctggaaatgtttgttttgctagtgctactgctggatggtcctttacattgcagtcgtttgctaagttgtatgggaagctgcatggaattcctttggaggctaataaatttgcttctcggctttggggagattattattttcatccggataccagaaccttcaaaaagaaaccccctgccagtggaggggaacgatcttttgtggagtttgtgctggagccactttacaagatatatagccaggtgatcggggaacataaaaagagtgtagagacaacacttgctgaacttggagtcactctaagtaatgcagcctacagattaaatgttaggcctttgctaaggttggcttgtagctcagtttttggtccagcttcgggtttcaccgatatgcttgttcagcatataccttctccgagggatgctgcaattaagaaagttgatcatatatatactggtcctaaagactcttctatttacaaagccatggcacagtgtgattcttatggccccctaatggttaatgtgaccaaattgtatcccaaatccgattgcagtgtgtttgatgcctttggtagagtttatagtggtaagatacagacaggacaggctgtacgtgttctaggagaaggatactcgccggatgatgaggaggacatgactgtaaaagaagtaactaagttgtgggtgtatcaagctcgtgataggatgccagtagctgaggctcctcccggttcttgggttctaattgaaggtgtggatgcttcaatcatgaaaacttctactctttgtaatgtggattatgatgaagatgtatatatattccgccctcttcagttcaatacactgtcagtggtaaaaacagctactgagccattaaatccaagtgagttgccaaaaatggtggagggcctgaggaaaataagcaagagttatcctcttgcagttactaaagtcgaggaatctggggagcacactattttagggactggtgagctgtacttggattcaattatgaaggacctgagagagctctattccgaagtagaagtcaaggtagcagatcctgttgtatcattttgtgaaactgttgttgaatcttcctcaatgaaatgttttgccgaaacaccaaacaagaagaataaaataactatgattgccgagccgctagaaagaggtcttgcagaggacatagagaatggtgttgttagcactgactggagtaaaaagaaactaggtgaatttttccagactaaatatgactgggatcttcttgctgcacggtcaatctgggcatttggccctgataagcagggtcccaatattctgttagatgacacccttccaactgaagttaacaaggatctgatgaatgccgtgaaggattccattgttcagggatttcagtggggtgcacgagaagggcctctctgtgatgagcccatcagaaatgttaaattcaagattgttgatgcaaagattgctaatgagtcactccatcgggggtctggccagatcattccaacagcacgacgagtggcctattcagctttcctcatggctactcctcggctcatggaaccagtatattatgtggaggtatatgcattaccaactataatgatggctattcaaacaccaatagattgtgtgtctgcaatttacactgtattatctcgaaggcgtgggcatgttactgctgatgttcctcagcccggcaccccagcttatattgttaaggcatttttgcccgtgatagaatcttttggatttgaaacagacttgagatatcatacgcaaggtcaagcattttgcatgtcagtttttgatcattgggctattgttcccggagatcctctggataaaagcattgttttgcgcccacttgaaccagcacctatacagcatcttgcccgtgagtttatggtgaagacaagacgtagaaagggaatgagtgaggatgtgagcataaataagttcttcgatgaggctatgatggttgaactggcacagcaggcagcagaccttcatcaacaaatgatgtga

SEQ ID NO: 104261 - DNA, 1068 bp, Glycine max
  Peptide Sequence Number=SeqID_221039
atgctttactgtactagagaagaattaagggtagggttttatgtgaggagtatgattttaaaccttacttaccattgctcaaactgtgaaatgccaatcaattcagtgatttccctaacggacagagctaaacaatttgggcctattctgaagcttgttattggcctatgtgtactaccagtgctgttggttgtgtatccgattgttggtattcttggaagtattgttggtggagcagcctatggatttctttcacccatatttgctactttggaagctgtagaggaaggaaaagatgacaaattttaccactgtttcattgatggtacatggagcactgttgaaaagagctgcatggttgtcagggatgtaaatgatgtttgttttcattcatacttctcggttatggatgacctgcgacaaaaaggacctccaaatgcaaaatactatgagatcagtgcgggcaagcattggtgcaaaacttgtgacctgggaggtcactggttcaaaacttggaaacagtctctacagactacactttctgggggtcaggctgcatacacttaccctcccttgaccctactcagttggagccttgtgttggacactcttatgtctttaaagcatttctctgattatttttgtatttatatccagatccaaagtttcatgttgtgcaggctgctttatattcctggtgctttaatagctgcagttattggaatcattgttgatctgccaattatatcatttgttgccctatgcaaaggtccatacatgctatttaaggggtggcatcgattgtttcatgaccttgttggccgtgaaggccctttcctggagaccatatgtgtacctttcgcgggtcttgctatccttctgtggccattggcggttgctggggcaattctggcatccatgttaacaagtttctttcttggtgcctatgcaggcattgttgcttatcaggctttctattacttgactgcccaatgcttttctagactggttgctattaacaagaaggccaatgctaaattgtggaagcaacactggggatttggatga

SEQ ID NO: 104262 - DNA, 1767 bp, Glycine max
  Peptide Sequence Number=SeqID_221040
atgaaggagcatgattcccaaggctctggaagaactttgggttctagtggaatattagattcatctcatcctcgacccgaacaagctggtttgcggattttgtctgatagattgcgtaatacctttggaaccccagcgccagtatctctaggatctttgcagcctcctgtcattcctgattctttgacaactttgtcccaatacttaaggcatataagccttgaatttgatgcaattgtcagagaagggagggataatgccgaagcagctgaggctcaaaggaatgaagaaactagatctgtttcttcacatttgggttcaactccagaagggctttcatcacccgcatccttggcagaagttttacgttctaccagacaaatgattgatcaacaagccggcgaatgcctacttcaactatcagggcagctggagaatcaagcaaatgtaacggatcccttgttgcggtcaagcattcagtctagggctttgagaactggagttttgttttataaccttggtgcctttttgcttgagcttggtcgcacaaccatgacactgcgtttgggtcaaacatcgtctgaagctgtagttaatggtgggcctgcagtttttatatccccaaatggtcctaaccatatcatggttcagccccttccttttcaacctggggcaagctttggtgctgtccctgtgggagctgcacagtctaactcaagtttaggtagtggacttggttcaagctttttcccaaggcgtatagatatacagatacgtcgaggtacctcaacaacctcatccaataccaatcaagaagaacgcaatgagacacaatctgcctcagtacaaagaaattcaggtgaaagttctgttaatcaggcaacctctaggcgtccagatgcatccattgctggggagccaggagtaaggttagtgccaattagaaccatggttgcagcagcagtgccaggcaccttagggcgtctgccttcagaatcatctggtaattctatagggctttactatccaattcttgggagatttcaacatgtttcttctggacattcaaatagtgaacaaggatctcaacaatcaagtcagcatcacactgtgttaccgtcgactcctgaatccatattgcaaaggcaaaacacagaagattctgccaggaatggatccttatcaactccaagcacaaggcaagagccttcaagttctcgtgttgtaaatatcaatattctggctgctagtggaccccaaaacaaccaagaatctgagagacaaataccaagcagtgtacttcagtttttaaggacattctttcctggtggagaaattcacgtggaagattcaagtgtacaaggaacaactgcaggttctgccttagatcatgctgcaacatcaaggggtgctgccccagttcctgaagcacaacctaatgtcagtgaagaaggaatatttttgtctaatatactccgtgaaatcatgccagtgatatctcaacaagtagggtctgagggaaatccttcagaagatcatatggctcaagattcttcaacccaggttgaaactgatgtcgggacatcacgcagacagagtgattctgatccaagccccccaaatgcaaaacgccaaaagcgtgagttccattctccttgctcccaaactccaatgggcacaaggggtgaatacttacaaaggtgtcctgaccctcgagtgagtgagcttcagcatgggagtttgtataatgggaacgtgagtgcatag

SEQ ID NO: 104263 - DNA, 723 bp, Glycine max
  Peptide Sequence Number=SeqID_221041
atgggaagtactgaaaagatcccaatcagcgctgaaagttcagaaaccaccatcgagataaaaattaaaacattggattctcaaacttacaccctcagagtggataaacagatgccagtccctgctctgaaagaacagattgcttctgtaactggagtgttatctgaacgacaacgcttaatttgccaaggaaaagttctaaaggatgatcagctcctgtctgcctatctagatgttgaagatggtcacaccttgcatctggttgtgaggcaacctgatctaccaccaccaggaagtgtgtccaatcattcagcctcactcggtcttacttgcaaagaagatattcttagcttgaagctctttagtgtgtttccattttcttataaaagcatgcctggggtgaaaatggattttctagttggtcttgtcttgttgtggtttacctccatgcctcatccaaatgaaaattttcccttagtacaaagagacaaggtatttactgacctccatgcttacctccattttgcagtgactgaactgaattcaagcacaggccttggtcacgcaagtcaagtagcccctggtgtttttattgaaactttcaatgtgcctgttcagggtgatggagttgctcctgaaatcaataggattgtttctgctattctaggatctattggacttccaaattttgcgagtggcagtgaaggagggattgatgtcagg

SEQ ID NO: 104264 - DNA, 330 bp, Glycine max
  Peptide Sequence Number=SeqID_221042
atgaaggtgaaagacaagggtgatagtacattaatattgatgcatcatggcaatggctacgtaggattttgtcgcgtagttgccttgcgaagggaaggaaaagaacaatccacgtggaagtcgacatctcgggatgaagtggcacagcaatcaccacgtgggcaccgaaacttcacgcacgttgttgcacctctgggatgcaagaaacacattggtggcgacgtttgcctgaatttgtcatgtgggactatggacttgccttcattttattcaattcactctacttcctcattcaaatattcaagcaatccatcattaggagtagattga

SEQ ID NO: 104265 - DNA, 435 bp, Glycine max
  misc_feature (388)..(388): n is a, c, g, or t
  Peptide Sequence Number=SeqID_221043
atgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtanatcccgcgtggggcgtggaaggttttgatccttttgttccggggggg

SEQ ID NO: 104266 - DNA, 750 bp, Glycine max
  Peptide Sequence Number=SeqID_221044
atggtaatgcccgtgacggcgccgtcgacgccacctctcccctgcgggacccagaatttagacagccacagtgataggttttctgataacctatttaggccttggctgtgtggcattgatgctgtaacgagtacatcttctggcctcagtgatggttatgtggctttgttcgttcgtatgttaggcattgatcgtgatcctctggatagagaacaagctatagttgctctctggaaatattcgcttggtggaaagaagtgtatagacactttaatgcagtttcctggttgtattaatcttgttgtgaacctcctacgatcagagtctaattcagcatgtgaggcagctgcgggtcttctgcgatcactatcttcagtcaatctatatagaaattctgtagctgatagtggagcaatagaagagttaaacagattgctgaggcaatcttccttggcatctgaggtatgggaattggtaaaggagcagagtttgagtacactgtggaatttatctgttgatgagaagctctgcattaaaatttcaaagactgagattctgccattagctattaggtaccttgacgatgaggatataaaagtaaaggaggcttcagggggcattttggcaaatttagcatcgagccgtgttaaccacaacatcatggttgaagcaggtgttataccaaaattggtgaggcttcctttgagtatagtaattggaaggtggttttactttttcaatagaaaataa

SEQ ID NO: 104267 - DNA, 1794 bp, Glycine max
  Peptide Sequence Number=SeqID_221045
atgttacctgatggtacagaaattgaaaggacttctagacagccatccagatatggtgcttcggaattacttcttggattaaatattgatgacaagaatgctaacttagaggaagcaaaagtcaatgcaattgttggacgaacacaacagcaattccttgctcgtgttggggctttagaaatggaacaaaagactatgcctcattctgaatgctcaaatgatcagaggtttacacttttaccttggatggatggtgttgctcgtttagtactgatactagaacttgaagataggtttgcaataattaaggctgcagagtcaattgctactgcatgtatcaatgaacatatgcgtatagcattcagggaagctggagcaataaagcatttagtaaggcttttaaattgtgatgataattcagtccagttggcagccacacaagccttggaaaggctgtccgttagcaatattgtttgccgggttattgaagctgagggggttttaggtcctttagttagtattttgaaatgctcagagatagctggaactattttggaaaagtctttgaacatacttgctcggatattagaccccagtaaagtgatgcaattaaagttttatgatggaccagttaatggatctgaaaaggcatttggtggaacaaaaggtgactgtgtttcaaccgggtttagtagcactgaacaagctgtatcaaaaacgtacacaaggaatgatatactggattctgttttcattgcacacctggttgagattatgaagtcctctcctcccagtttacaagaaaaagctgctactgtgcttgagtttgtggcattgactgacccaactctggccccaattatatttctggatattgaatctggtctgaattcagcttttcagcaaaaaattttgaaaatttcaggacctactgtccctggtggacctttctgttctgctgcccttctacgtgccaaacaattttggttcctttatcactgcagcatctcttcgttctcacgtgaacagtaccacgagctgctgcaagccttcattggcggttgtcgtgccctcctatctccaaagcgaccacaccccctgagtctccacctcccggcgaagcaactagtctcctacagtgatatggtaaatcaagcggacatggaatctgacgtagaagatcagttttctgaagcatatgcaattgaatttgaagaagctggtcttgcaatagctgcagcatcccggttattaacaagactactcgatcatgagcagttccgccacaaaataaactcctcgcaattcattgatttgcttcggggaatcctcaggtcctgcattcccctccacaataaaaagtgggtagctacttgcctagttaaactaagttctctctctggctccatcacgagcctctatccaatcaatgtggaagttactctctacgagacaatcccaagacttctggaacagatcaaaacatcattctccccagaagcacaggaaacagctgttgttgaacttaatagaataatatctgaaggagtggtagattacacagaagctattatttctgatgaagcaatatattcattggtgaatttgatagaagaaggcagtgatagggctgtggaagcaagcttggcaatactgtataatctgagtatggacagtgagaaccattcagcacttgtggctgctggagcagtgcaggtcttaaaaagaagtgttctagcaaacagaccacactgggaacgggcacttcttttactcaggattttgcaaccgtga

SEQ ID NO: 104268 - DNA, 288 bp, Glycine max
  Peptide Sequence Number=SeqID_221046
atggttacggcgcttacctcgacggtggacggtgacgaagctccctcgacggtggacgatggcgttgctcttcacggaaacctcctcaatgcacctcacaacctcttcacggcaagctcctcttcacgacaacaatggtggctgaagaagaagaaccttttcaccggtgaggtgagcaagaacaatacgaaaatggctaaagtgaggaagaagaagaaggaaacgggatattatgggcttttcacttcaagtgctgggtgtaccaacaaaaatgctaggtgcacctag

SEQ ID NO: 104269 - DNA, 384 bp, Glycine max
  Peptide Sequence Number=SeqID_221047
atggatgaaatagagaaggtgcaagagcaaatgaaggccgacccggaggccttgaaagagaaaatggccacaatggtagaggccatgatgagcataaaggagatagtggaggtcagtgcggcttaccaaacccgtgctagagctaaaataatgggtgaagtagagaaggtgcaagagcagataagagcaaatggtaggcaaagatttgggaagtacgggcggccccccattatgcgcaaactcaaaacaagcatgccttcccaccatatggctggcctcccaactatacaccacccaacgtggcatgcattcccaatgaggatttcaataactccgctcccatactcattgaaatgtctctcaacccatgggggagacacatga

SEQ ID NO: 104270 - DNA, 681 bp, Glycine max
  Peptide Sequence Number=SeqID_221048
atggctaaaagctaccataggagctatatagagctgaaatttcaagataagttaaatcaggaatcaacttgttttactagtcttcttggtgaaattgtttttccaaaagcgacaccacgcactgtcaggtatcacgccaaggctaaggatcacgtgaaatgggaattaggaaaaccgcatagcaagggtaaaggtttaggcgttgttgctgccatctctggaatgccatatgcacagcacatagcaccaggaaccaatttttgcactgagtggctgaataattcagtttggaaaggataccaaaagcctgcatggttggaagctctttacacacaaaagttcttcgtggggtgctcttaccatgagaacgctaaaaagaatgagaagaatgtctgctgcttagattgctgcaccagtatttgtcctcactgcttgccatctcatcgcttccacaggcttcttcaggttcgccgttacgtttatcatgatgttgttaggttggaagatcttcagaaactcatagattgctccaacgttcaggcctataccatcaatagtgccaaggtggtgttcatcaagaagagacctcaaaaccggcaattcaaaggatcaggaaactactgcacctcctgtgatagaagcctccaagagccttttatccattgctcccttggatgcaag

SEQ ID NO: 104271 - DNA, 1002 bp, Glycine max
  Peptide Sequence Number=SeqID_221049
atggcggaaggtgcacgtgcgaagaacacgacgacgactctcgtgcttgcaaaggaaagaactcgccggaaagatttgcttaacggttttcaacgttacaccgatggttggaatatcagcaatgtctattatctcacgtcagttatgtctactgcggttccttttctttccgtggctgtagcctgtgatgatggctattctaaagcactccatcatttgtccttgactttgcttatcttctgcaccattgcggcaataggtggatgcgctgtcctgtactctggtcaggggaagtttcgtgaaagcacttcgaacacacttgattacgttgtgaatcaggctcaattagtagccgaaaacctccggaacgtgacaagttattttgattcagctaagcagcttgtgaatgggattcctctgccacttgatcttggatccaacattgatgatgccgccaaagtgagagtcatcactgctactgattctctctccaaaaaggctaaagaaaattcgaggatgatacataaagtcatagatggagtgagactggctcttgttattgttgctgctgttatgatctttgttgcattgctcggattgcgtcccctcgtccctcttctctgcaatccatataatgccgacttcacctctcgccagtgtgcgccaggggaagtcacattcaaaaacgccatcgaggtgtggaagaattatacgtgccaggcttcatcatctgaacaatgtacgaatgaaggtcgtttgacaccgaagatatacaacaaacttgcatctgcagtgaatgtgacggatggtttatttcattatgggccatttttcgttgatttagtagattgcacttttgcacgtaaagcattctcagagattagcaacaactattgtccttctctgcggagatatactgaaagagtttatttgggaacggttgtgagagcagtggcggcgtcttcgcaactgaggtgcttagccagacaaaggccatcctag

SEQ ID NO: 104272 - DNA, 357 bp, Glycine max
  Peptide Sequence Number=SeqID_221050
atggaagaaattggtgaaagaaagaaagggagaaaatggtggaagaggagagaattccctaaggaagacttctcaggctttggtggacataggcctttgtgtgctcacttagcgctggtgcctgttttcgcgcttagggcgcgcttagcgcttgtgcttgtttgtgcgcttagcgcgtgttgtgtgcttagcgatagtgctttccttcatgctcggcgcatgcaacgcgctgagcgagcctttgggctgggcctgatgctgagttctctttttcttcgtcattcctacagttttttgcttttagtccctccagttttcatatctacagccaagatttggaaaaacatcaattcttaa

SEQ ID NO: 104273 - DNA, 333 bp, Glycine max
  Peptide Sequence Number=SeqID_221051
atgctcaaagaaagatgtcttgagtctgttgactttcctggaaccaagacagtcaagaatatgccagcctttggagctactgaagaagacttgagtggaaagcaaagttcaactagcagttatgataatgaggagaagatatcaaatactacctcaaattccttaaatgagccggttgaaattataagaagcagtcatgaggaggctccaaccaatgaaatagtcaatgatgttccagaagatttgctatccagtgtgaatacagaaaatccagatatcaaatctgagtcacttggagctctattgaagtcacgcaacacgggtctttcatga

SEQ ID NO: 104274 - DNA, 957 bp, Glycine max
  Peptide Sequence Number=SeqID_221052
atgaccacttcaaaccttagcatatcctaccatattggcacaaccccatcatcatcatcatcatccatggactggttctcttggctatccagaaccactcttgaaccttccttaatctacgactatggcctcacctttgcccgcaacgagctccaattggaagatgcttgctacttcaaccacgagtttcttcagagcatgggaatctcaattgccaagcacaggctagagattctcaagcttgtgaagaaacaagaaggaggaggagcagcacggcccaataagaagctctctggggtcatcaaaaagtgcctaaggaagtgcatgaacaagtttgttgtttctcatgatcatcatgcagtcaaacacatgccatgctccatggtgaatgtgtcagtgccgccaccactaccaccaccaccacatgagattagttggtaccatcaagggaaattaaaagggtcacttgtgaggaagcaacaacaagggagtgaggaacttaaggaagaaaaaaaagagaagcctttccctgtgcctcctatatatagaagcagaaccatagcactttcaggacctttggaatatggtggtagaatgcatcatgagaaaatggtccacagcagggccttgaagctatctggaccacttgatggaagaatgcatgagagaatgatgatgatgaatagtactaatagtagaacccctttaatgcctgggcctttggatgcaagatttgtggccacaactaagagtccaagagtgtctgggcctctggatccaagagtgttggttgagaatagaagcccgagactgccacggccttcggatgcagcaagggctgaaactgagagcccaatgggttacagtccttataacaagcccaaagctgattttgattttgatgatgatgatcacaccctctggccttcactgttccaagatctcaaaccaacttga

SEQ ID NO: 104275 - DNA, 372 bp, Glycine max
  Peptide Sequence Number=SeqID_221053
atggatgatgatgaagtgatgagtagagaaacaaataaagtggaattcatgggtttaggtgctagtgctactatagacttagaagaaaatacaaaaggaaaaagacaaggttcaacttcttttgacacgcaatctcacaagagaaggatgggagaaaaagaaggaataacagcttctttggataaaatgaccaactcttttgatcgaatgatagaaaaaatggatggtaaagtcgatgatgaagatattcaagaagtgttacgtgagacagctttaataccagatcttaatagacaacaatgggataaagctattaagtggtcaggtgacaatccaaagcaattagctatcgtgaaagcccttccaatttaa

SEQ ID NO: 104276 - DNA, 1716 bp, Glycine max
  Peptide Sequence Number=SeqID_221054
atgttgcgagtgaagggagggaagagaccaccttgggtgggacttggagctgcagtgtgggttcagattgcttcaggaaatggttactgtttccctctctattcccattccttgaaatccgttttgggtttcaaccagagccagattacccttcttggtgttgccaatgatattggtgagaatgttggcattcttcccggactcgcctgcaacaagtttcctccttggctcattctcttcatcggtgctctcttttctttccttggttttggtgttctctggcttgctatcaccaaaacacttgattctcttcctttcatcttgctatggtttgcacttgctgttgctaccaacagttgtgcatggttatctactgctattcttgtcaccaacatgagaaatttccctgtcagtagaggcacagttgcaggaatcctgaaaggttattcgggactcagtgctgcagtttttactcaaatttacagcgtggtttttcacaattcttcatccaagttccttttgtttcttgccattggtattcctgctttatgcttcagtaccatgtttcttgttcggccttgtactcctgcttctggtgatgattctgctgaaaaggggcattttttgtttatccaaggtgctagtgtggccatgggtttatatattcttgctacaactctacttgacaactttatccacataagggacagtgtttcatatgctttgttggctgtgatgattcttcttctcttggctccacttgttatccctataaagatgacactgtgtcccagaaaagcctctagcacagaaattcctgaggaacatgttggatctacagactatttggttcaagatggcaaagacaacgtagagccattgctatcatcttcatcagctagtggtcttggaagttttaatgatgtggtggatggttcagctgaggtggctatgcttcttgctgagggtgagggagcagtgaggaagaagagaaggcccaaaagaggggaagattttaagtttactgaggctctagttaaggcagattactggttactattttttgtttactttgttggtgttggaactggggttactgtacttaataatttggctcaaataggcattgcacaaggtatggaagataccacaatcttgctgtcacttttcagttttttcaattttgtgggtcggcttggtggaggagttgtttcagaatattttgtcaggacaaaaacgattccaaggacaatttggatgacatgcacgcagataattatgatcttcttgtaccttgtgtttgcctatgctatcaaaggaaccctttatcctgcaattgcagttcttggtatctgctacggcgtgcaattttccatagtgattcccactgtttcggagctttttggtttgaaagacttcggtctattgagcaacttcatggctttggggaacccacttggtgcatttcttttctctgctcttctagcaggacatatatacgacaatgaggcagcaaaacaacacggtgtaggcctcattgcttcaagtgttgcatgcatgggtccaaattgtttcaagctaactttttttactctggctggtgtctgtattgcgggaaccatctccagcattatcttgactattagaattaagcccgtgtaccaaatgctttatgctgggggttcttttaagctacctcaaacttcaggccactaa

SEQ ID NO: 104277 - DNA, 645 bp, Glycine max
  Peptide Sequence Number=SeqID_221055
atggcggcagcttctagaaaaccaagaagcgcagtaattggatccctttcttcaacccctaggttctgcaactctcactctacatcatcatcttcttcttcctcagctttcgcttcttccacctccagcttcacctctcgctcctcctccttctttcaccgctcttgctctccaacacgtgtcaacctctacggttccaccgctccctccgtccggttctccctcgaccgttcggtctctccgaaccgctccatctcggtggcgccgcgaaccggcgcttcaaggcaaagcagtagcccgcaccaccagcagaagcggacctgcatgtgctcgcctacgacgcaccctggctccttccgttgcagcctccacaagaagagccacgctccggcgccgtactcgccgcaccgcctcaacgcgcgcagatccgcgatgacgaactcgctcgtgagaattcgcggcgtcgaaggagatctcgtgaagcgagctctcgccgcgttgattcgaccttcctcgcaccagcagagaaggcgaggagacttttacccgaggcctagcaggctctccgttatgtccatggcagagagagggaatatatctttggtggcaactggcaagtgggggggccaacacgggacacgataa

SEQ ID NO: 104278 - DNA, 249 bp, Glycine max
  Peptide Sequence Number=SeqID_221056
atggtggaacctcaacaacaaaaggttttaaagattcttcataaagagaatgagattcaaactcgaaaaggaggggagtatcaggaaagagccgtgttggggttgatcaaggaagctcggtcgatgttgttttccgaaaagcatttattaggatgccaatatccattccatagtacgcttgttgggtttagcggtgattgtgtagtagtttgggggtttgtcaaacttcaaacaaagtttggaagataa

SEQ ID NO: 104279 - DNA, 162 bp, Glycine max
  Peptide Sequence Number=SeqID_221057
atgtggtcgcaaaaccaatggcgtccaattatttcagaagccaaagaacacggcaagttacctgcagagtatgcagtttacatcctctggtttggttcaaatcaatgttgtgctgcacatgccacagtccttaacaaaaatgagaaagatttccgctcttga

SEQ ID NO: 104280 - DNA, 1198 bp, Glycine max
  Peptide Sequence Number=SeqID_221058
atggccaaaaagcgcaagcccaagaagaaaccccagaatcacaatgtaaaccaaagccaaaacgtggccgctttgatttggcgagtaacacactcagcagagtccttcctctcccaaaacgaccttgttctcctcccttcccaatccctccgtctcgaatccctaatctcatccatcatctcccactctccctctccgcctctctctccgccgcaccgtgactcctggttcagccgcttccgctccgtctccgattcccaatggctccacgccttccgcatgttgaagcccaccttctcccatctcctccacctcctctccccctccctcgccccctccttcccccacatcgcccccgactgcgtcctcgccgccgccctcttccgcctcgcccacgccgccccctaccccgccgtctcccgccgcttcgccatctccccggcggacgcctgccgcgccttcttcgccgtctgtaaggccctcgctgacaacctcggccacctcttcgagctccgcaccgactcccagagggtcgtggtggggttcgggttcagctccctccccaactgtttcggggttttaggattcgctaggttcaaaatcgacgattcattattgggtgaaaatggagctttaatggttcaagccttggtggattccgaaggaaggttcctggacgtctcagcagggtggccaagtaccatgaaacccgaaacaattttgcgtgagactaagctttatcgtgaggttgaagaatccaaggaattgttgaatgggccgtcttataatctcagcgagggttgtttgattccgcagtatattctgggcgattcttgttttccccttttgccttggcttttgacgccttataatagagtgaacgaggaagatagttttggttccgctgagagggccttcaatactgcgcatgacaatgcgatggggttgcttggggatgcgtttgcgaggcttcgtgccagctggcggcttctcgcggcttccaggaagtggaagcgggactgtgttgagcatttgccctttgtgcttgttgctggttgcttattgcataattttgttctcaagttcaatgaggcaatgccggatgaaggggtggaaaaggaagaggggcttccttcgtttgatggagtggaggatgagagtgctgttagggtgagagatgcacttgctttgcatttga

SEQ ID NO: 104281 - DNA, 1626 bp, Glycine max
  Peptide Sequence Number=SeqID_221059
atggtgaaattgaagattgggggaatgtggatcgggattctagaggtggaacttgagacatggtcgatccgtatgttaagggaagaggttgccaaacgatcaaattgcaaccctaactctgtcaatttgatatgcgctggcaagattctcaaggatggtgatggtcaacacaatttgacccaattaggtatcaagaataacgccaagattcttgccactcgtatctgtgtcgaacaaggcaaagctatcaaacaagagatcatggccgaggaagaacactctcacaaacttgctagggtcaaggcagctgccattgcagtggccaaaaggcatgtagatgatctattacctatcgaaaacttcaccacagaagttgaaggtcaaatggggaagaaaataaaattagcctccgagactgatcatcagagggccataatgacgggattggtgttagaggcaaatggaaagcgtctaattcgacagggaaagtataaagatgcattagaagttctaagcatggcagaggaaacattctctctttgtgatgattctgacacccttgagcttattgacatcattccgataatgcaaataaacatggtgtggtgctactttatgatgcaagacatcagttcgttatcagaggcaggaaaacttcttgcaaaggctagggaaggacttgaagatgcttatgggaagcatgctctacgcgccagacttttaaaaagtggttgctttctagaacttgcatggcatttgagactggagctgctcgaaggagtggtggcctattatagtggtcaattggatacagcaagagaagcactgctttctgcacaagcaaaatttgaaaagttgcaagtatctgatgaagatctgtcgctcgtaatgagcatgggcttcaccaaatgtgatgccaagagggcattgaaaatgaatctacaaaacattcaagctgcagtcaatttcctgattgaggaaaatgcagaaaaagatcaaaagcagaaggaaagagaaagtgaaatccggaagcagaaacctgtagatctacaaagattgaacgagctggaatctgttggggacattgcagctgaagctctccgaagaaacggaaatgtttttcagaaagcgctgaatgatttgacacatccagaaactttttctgctttacaggcttatatcgagtcagagaaagggaagatagttgaagagataagaacttctgcagctcttgctgctactgaggctgaccccaacataatacaatttgaaacaatgggaggaagaatgacgacagcacgtgtgagtcgtgtgacagacgccaacatgcaacgtgaagtaaatccaagtggcggtgcaagttcatcatcctcttctttaccacctcagattaatgcttttgtttgtgatcttcaagatccatctaataagagtgaagcacaaaagagagatgtagagatggaagatgaactttctgcagatatagctgaatcatcagatgctttggctgactatgacatcgaagtggacatagaaggggcagctataactgagtacttgtctttggtggagacagcagcaggtggcagaaggaaagaggaagaagaaaactattctgttgagtga

SEQ ID NO: 104282 - DNA, 780 bp, Glycine max
  Peptide Sequence Number=SeqID_221060
atgaagacagacaaatgtttttggacttctgaatattttaaaaaagagtttgtcaacagggaaatagtaaagcaagaattcaagaaaatgatggccttgatgagatcacaaaacagacaaggggctaatcacagagatggacgacgccttggcgttacagcttctatagaaaatgggggaaataaatgcttacagcatgaaagatttgttcaattcttaagacagctacatgatgagaaatgttttaatggtgtcctaagtgttggagtgatcttgaggttagagttttcccattatgactacaataaaaaaggaaccatttcagccaaagattttgccctgtccttggttgcatccgcagacatcaatcacataaacaaactattggatagggtcgaagaattaaacagtgtccagaacctaagagacaaaagaattacattcaaggagtttcaagattttgcagaattacgcaagaagttgcactccttctctctggccatattcagttatggaaaagttaatggggtcttgacaaaatctgattttcagagagcagcatcacaggtgtgtggcgtctgtatttcagatgaagtggttgacataatctttcatgtgtttgatgcaaaccgtgatggaagcttaagtgcaagcgagtttgtgagagttgtacaaagaagggaaaacaacaattcatcacgtcatggtggcttcgggggtttaatatcctgctggtggaactgtgtaaaaaactgttcatcagctaagcttcaattttga

SEQ ID NO: 104283 - DNA, 1488 bp, Glycine max
  Peptide Sequence Number=SeqID_221061
atgccgggttttagggggaaaattaggattggaattttgattattgttgtcgtagggatttgtctcgctgctttgtatggtttgttgaagcctatttcgaatggatgtattatgacctacatgtacccgacttacattcctatttcatcgtcggagagcatttcgccggtgaagtatggcttgtacttgtaccatgaggggtggaaaaagatagattttaaggagcatcttaagaagcttagtggtgtgcccgtgcttttcatcccgggcaatggtggcagcttcaaacaggcaagacataaatctgcatatctagcttgcttttttcaaagtttgaggtatgctcactttctggccaaggtgcggtcattggcagcagaatctgatagggcatatcagaatggcccccttgagcgtacattttaccaagaagcttccctaagacctgaagaaggaggtgtagatataaatttatctggtttccaattacccagccagtatacaagcaggctggactggtttgctgttgatcttgaaggtgaacattctgccatggatggggcgattcttgaagagcacactgaatatgttgtatatgctatacacaagattttggaccaatataaagtgtcttatgacgctcgaacaagagaaggtgctgcagtttctgggagtttaccaaaaagtgtgatattagttggtcattcaatgggaggttttgttgctagggctgctgttatccaccctcatcttaggaaatcagcagttgaaactgttcttacactttcatccccacatcaatcacctcctgtggcattgcagccttcattgggtcgttactttgcgcgtgtaaattcagaatggatagaaggatataaggttcaaaccacgaacacggggcattatgtgtctgatccagtactctctcatgttgtagttgtatctatttctggtgcatacaatgattaccaggtacggtcaaaattaacatcacttgataatattgtgcccccaacccatggcttcatgatcggtagtacagccatgaaaaatgtgtggttgtcaatggaacatcaggctattttatggtgtaatcaattggttgtccaagtatcacacacacttcttagtttgatagattccagaactggccaaccatttccagatactcaaaagagacttgcagtttttgcaagaatgttgcgtagtggaatatcacataattttgactggatgatgcagttaccctcttataaacggtcactaaacattcctgcccagaatacaaaagatgtcactggatctcttgtgcatagaccggttgcttgtcctgccaatattcattggaatgatgggggccttgatagagacctatacattcagataaatgagctgactgtattagcaatggatgctgtgacttatgttagcaacggacagcagtcacatgaggaggtcttgaaggtttatatgagaaggaaagggtag

SEQ ID NO: 104284 - DNA, 1302 bp, Glycine max
  Peptide Sequence Number=SeqID_221062
atgccatactaccaaatttctgactacctagcattctgttactggcaatggcaggttgacccacattgttcttataagagtagcatttcaatttctgttagtgctgctgcaagtaggtttctactattgtatagtccaaagatagttggtttctctattgctgttgttttctttgctctaatgcggcaagcatgttcatgggatcttgatctgcggataccatcaatgctgactgctgtggaatccaatttgacactaatatcacatttctttcccctagccattctacccattttcttttccttgttccttttgttgttgatgtctcagccacttcctccatttgctagcttcatcagcatctctctaatttgttatatctttgcaaacggattcatagctattctaattttgatttcccacttggtattctttgtggctgctgttacacatattttcatcaagacaaggtggcaaatgtgggaacggaatgttagcttttttttccttcgttggtttgttaatcattcgtctagcttcttttctctaaaggtggttagggttctaagagcaaatccagtaattgttatggcagttactgcaatggtcttggctagcctggttcatccatcctttggtctccttatacttctcttctctcattttctctgttgtcacaatgcattatgcagcagtttcctgacagcatcttgtcgcaaccacgaacagaataatgaaaattttgattgtaacagtgaagactatatggggtctgaaaggctgaagttcaaatttgatggtagtttcaagcggactttcccttcagaagacaattactccaacagtccagattcatcaaaaagttttggtgacacacaattagatttatttcaccatcgccatggcttgttgatattgcatcttgttgcaactatgatgtttgccccatccgttgcagcttggttccagagattggcgttgggtgagagcctcccatggctcctggattcagtgctttgcatcggcgtcattcttcatggcatctgcaactcgaagcctgaattcaattccttcttcttgtcctatactgggatccccatctgcaatgttaggctatattttatctatctcatagctggatactggtcttatttttctggtctcactttggctccgtacagtgcgttttatgttatgggtgctgtggggggcatttccttcgccttaaggatgtcgcgtagacggaatggggaagagaaagaggttacttatagcagccggaagcattctcacaggcactga

SEQ ID NO: 104285 - DNA, 257 bp, Glycine max
  Peptide Sequence Number=SeqID_221063
atggctggagaaccaccagaaacagcaaacatggaccagatggaagaagaagtggaagatgaagctcaacaagagcctgtgcaccaatggagtcattttgagccttttacgattcataagatggatgccatgcttcacctccatcaagagcactcaatcgatgttcacagcaccttagaaaacatcaccactaggctagagaacatagaaactaagctaacccttagtaaccttcttaaccctgatgaggatgaagc

SEQ ID NO: 104286 - DNA, 476 bp, Glycine max
  Peptide Sequence Number=SeqID_221064
atgccttatttctatgtgtttagtcctacaatgcttgacaggctagcatctggctcgcctgggccatcaaataacttcatggttaagaaattagcttgcctgggtgagctagttgcttcagggctaaggggttccaaggttcagaagtggagagaattgagagaagagagaaagaagaagaagaagaaagaagagggaacgaagccgaggtgctatcgaatcgcaatcgtgggagtggaggtagatctgttgtcatgctggatctccgactcgcttgataacagtgaagtctcatctagagttttcctctcatggggtgtcgcaacctacccttcgaagggagggcgatgcgagactcatgggtgcgtcttccaaggaaggaaaatgcgtggagtcgccaccaacatttatttgaagaaaacggaaggtattagcacccttcgcgtccgtcacaagggacgacagcctttaatcaa

SEQ ID NO: 104287 - DNA, 237 bp, Glycine max
  Peptide Sequence Number=SeqID_221065
atgggaggagggcctcctgctatggtggaaagggagaaatttgatcatatagaggaaaggatgagggtcattgaaggaggcagaaattatgcctttgctgacatggcagagttgtgcctagtgcccgacatggttattcctccgaagttcaaggtgtcggatttcgataaagaaagtcttattggggcagccatcacctggtatacttgtttggaaccttcacgggtccgttcctag

SEQ ID NO: 104288 - DNA, 574 bp, Glycine max
  Peptide Sequence Number=SeqID_221066
atgaagtccggttattatcaagccctgaaaaaggacaatcacgaggaagctttctctagtgtgatactagagaatttttggaagaagctttggcaaattaaatccatcccgaagtgcacccattttgcgtggagggcttgcatggacattctccctgaagaaaatactggtcaggctcttttatattgtgaagaggttagacgcacgtggtttgcctcaagcttaggggggaatcagtgggtcttccacaacaaaaagttccagcaggtgcaagagaccttatctaaggcatcttccatccagttaccttcagaaagtgtgctacatcggcctggtttcaagcccaagagctggattcatcttcctaaaggctttattaaagctaattttgatgcttctactggtcttggtgtgctttttcgtgatcaaagtggagaaatcctagcagctgcctctcttctgctcccccattgtcatgatcctctcactgtagagactattgctttcagttcgggcaactatttggatgacattctcaaggattgctctagactaggaggatctcaccttactg

SEQ ID NO: 104289 - DNA, 303 bp, Glycine max
  misc_feature (43)..(43): n is a, c, g, or t
  Peptide Sequence Number=SeqID_221067
gtatttccgacatgcgttgatgaaatcctgttgaaaacttggnctgtcagatttaagtttcgttcacaattacgccaatcatctgtgttggatgtgagtgaagaactccatcatattcaatcattgatagccatccttgggttgaagccaccgttgccacagtcttctgattacgatcctggaaactctacctgtttaactccaaccaaaaggattagttgtcagcaatccagttctgattttgattctgatgagcatgcacagtatcagttatcaactaacaaacatatcaaggctgagtaa

SEQ ID NO: 104290 - DNA, 1158 bp, Glycine max
  Peptide Sequence Number=SeqID_221068
atggagaacaaaagaatggtgacgaatgaagaacagaggcgcagtcccagaaaccagaagatcctcccattagcagattacaatggccaaaacttggcaacccttttcagcccaaggttcaaatctgcggctgctatggctggttgggatgaagaggcactgttgttggccagcctcttcgttgaagacacgccggatagagatcccaagcacaagaagcgctacgtttggcactccaaaaccccaccaaactcatcaaggaaacgtagagctctgaggagtccacaagcaccaatccctgtagttcttgatcttgatgcagaagaaactcccagaaaagatagtgggagaaagaataaagaaatgaaagtttgtgttgataatgagggaaagaaagcttgtgttgagaatgagggaagcagagtgggaggagatgggaatgaatcaaaagagaagaactcggctgacgcttcttctagttctgttcttccctgcattgataaactaagggatgagctttcctgtgctatttgtttggagatatgctttgagccaagtaccactccttgtggtcacagcttctgtagaaaatgtctaagatctgctgcagacaagtgtggcaaaaagtgcccaaaatgcaggcagctaataagcaatggccgaccatgcactgtgaacacagttctctggaacacaatccagcttctgtttccacaagaagttgaagcaagaaaagaagccagtgccttgaatagtctccaacaagctcaaaatctgagtccagaatcagcattttttgctaatctaaggaatgacagacgacagccttttaggggggcatcaacaacaacatcatcaacacagcaggatgaggatgctgcattggctagaatgttgcagagacaaattgatgaacaaagaagcccgggaacaactcgaactcggtttgcaagattgagggcaagaagaggaggggtttctactagccaacatgaggatgcagctttggctctaaggatgaggagagaagagttcatgcaaacttatagagggagcagccagtctagcaggctaccctcatcattattagctagagaaaaattgagggctatggtatctagagccatgaacagaagagaagatcttagacaagggtga

SEQ ID NO: 104291 - DNA, 276 bp, Glycine max
  Peptide Sequence Number=SeqID_221069
atggctccacctaaagaaattgtgaccatcatttaccacaatggtcacattgtagacaatccagttcaaggatcgatgtacacgtctgcgaacccaatattttttttacctcaactattcgaaaatgatgatatcagaggcgcgatggaaacaattctccagaatccacaattgaattctgtcgaattctatgctgttactgaccttattcttcaatcacaaccattgtctccacaaccctcatgtcaacaactacaactaccgcctccacaatag

SEQ ID NO: 104292 - DNA, 1333 bp, Glycine max
  Peptide Sequence Number=SeqID_221070
atggagccacatttgccacaagaattggtatccaacatcctctcaaggttgcctgcgatagacttggttaaatgcaaaagcgtttgcaagtcctggttcgatctcataaccgattctcactttgtttccaattactatgttgcctacaacaatctcaagcattaccaaagccaagaggagaaactcttggtcattggtagaccctttgtttctgccctaaaaactcacatttctcttctttcttgcaacaccaataatcccaaaaaaaaccatgtttcctcttctctttcaaaccttccttgtgaatataacaactctgagcacaagtactggtctgaaatctcgggtccttgcaatggcatatacttcctagagggcaaccctaatgtcttgatgaacccttcattggggcagttcaaggctttgcctaaatcccatttgagtgcttcacaaggcacttattctctcactgaatattctgggtttggctttgacctcaaaaataatgattacaaagttgttgtcattagggacatttggttgaaggaaacagatgagagaaaacaagggcattggacagctgagttgtatagccttaattcaaattcttggagaaaacttgatgatgcttctctcccacatccaattgaaatatggggttcttctcgggtttatacttatgccaacaattgttatcactggtggggccatgatgttgatgagtctggtgtgaaagaagatgctgttcttgcatttgacatggttaatgattccttcaggaagataaaggtgccaataattcgtggttcctcaaaagaagaatttgcaacacttgcacccttgaaggaatctgctacaattggtgtggttgtttaccctttaaggggacaagagaagtcctttgacgtgtggataatgaaaaattattgggatgaagggtcttgggttaagcaatacaccgttgaaccaatagaagcaatttacaagtttgtgggattttatgggagcaatcaatttccttggagcagctgcaatgagggattagggtggtacgattatgaacctgcgacggaaaaaataaaggatcttcaagtttggggaaacaatggctctttaagagctgctagatacatggaaatgcctcctcctctcctatggcatccaccccattgtcgtctccaactccctccacaaggtcaccatgaagactgtcgatgtcctcaccgtcatggtcgtcctattgagctctctaacctcaactcccttgttaaatctgctagcacctcccttaacaacaaggtcatcactattagaaaatacactttcaacatcg

SEQ ID NO: 104293 - DNA, 225 bp, Glycine max
  Peptide Sequence Number=SeqID_221071
atggtgctttcatcgttgtcgtcttgtcatcaccatcttgccactgtcaatttgtcaaagaaggtggtggatatgagcgagttgtggagcctcgtgtgtcaaggtgtacctgatgctactgggatatgttctacactgtggaagcttttgcttggatatcttctaccaaattgcgggctttggtcaactgaattagccaagaaactagcaatcacagtacaatga

SEQ ID NO: 104294 - DNA, 768 bp, Glycine max
  Peptide Sequence Number=SeqID_221072
atgagacaacctattgaggatgaggcccggtttttggatcacaaaaaagattaccctagtgacaatgaaaaagggactgggcatggaaatcttccagatccacaggaaagcagtctagcgaaacatgaggaggaggatcaatgttttgctgaggaggattcttacttgtctggtaaggaacatatccaacaaaaaaatgttgagccagtcactgcttcatatgatcatattggccaaacgatggaacctgtcaggaagagctctaccactcacaaaaatgatgccatcaggctaggagatgggaaggttatggatcatagtgggaggtcacgaattaaggacatggaagatgaccaacatggttcagtcagatcaattcgggtgggcatcaacaacgacgttgctgatattggcaatgaagtgcatggaagtttggttggtggtagtagagttgtggagagtatgaaccacaaaggtcacagccacagtcatggaaaagaatggagagttgtggagccatggagagcaatggagagggacgaaaatgacaaacccttcggttacccaagcgcaccggccaaatggaatgctaagaagccgagaggaacacaaaggtcacagccacaatcatggaaaagaatggagagctgtggagagtgtgaaccatggagaggaatggagagggacgaaaatgacaaacccttcggttacccaagcgcaccgggttggaaaaccgtgcacgtgtgccacatgtcgccaatccagtaa

SEQ ID NO: 104295 - DNA, 435 bp, Glycine max
  Peptide Sequence Number=SeqID_221073
atgtggctgaaaggggtgaagacccctgtgtttctgttggaaatcgcaatgaacgcgctaagcgcacctgctgcgcatagcctgttcatcacaactgttaaatttttggatttgcagatgatcgcgctaacctggcctgtcaggctaagcgccactatgcttctgttagtcaatcctttgaataaggctaggcgcgcccagtgcgctaagcctgagtgtcattctagtgaggctgagctaagcacgccatgctgcgctaagcccagaccctcttctgttttgaaaaattgtagacttaggctaagcccaacatgttgcgctaagcctaatctacaaaaaaatattttttgtgtcttcaggctaagcgcgagtctgctgcgcttagcccatgagcaaaattttatacgacacactaagcccagccttctacgctaa

SEQ ID NO: 104296 - DNA, 1026 bp, Glycine max
  Peptide Sequence Number=SeqID_221074
atggatgggagaaagggttatgcagaccttcaaagaggccgtggtacctgcaggagcactggtttggcggtgatggcgacgaaagtgatggcagaacacaaggatcctggttatatcaggatgaatatgcatgacaatcaggatacaaaagatgacgagcctctcttgaagattgagataaataatcctgctttgctagctggaaattggtcccagctttgtgcaacatgcaagattgtcaggcctcttcgagcaaaacactgttccacctgtgatcgttgtgtggaacaatttgatcaccattgtccttgggtatccaattgcatcggcaagaagaacaaatgggatttctttgtttttcttgttcttgaagttctggcaatgttggttactggtggagtttgtcttacaagagtgttaactgatccacttgcacctcattcatttggggcatggattcagtatgttgctaacaatcacattggtgcaatatcatttctaatagccgattttttcctcttctttggtgtgtttactttgacagttgtgcaggctagtcagatatcacgcaatattacaacaaatgaaatggcaaatgcaatgcggtatagttacctcagaggtccaggtggtagatttagaaacccatatgatcatggtatcaagaagaactgttctgatttcttgatcaatggttacaacgaagacgttgagtgcattgaagaattaggtaactcagaggagggtataggaatgatgcatatggcaagaagctcgaacttggcaaatggagactcgcacacccatactgaatatgcaagaggcaatggaaatggccatcatgctattaatgtggattccaattccaacagtaccaactccaaaatacatcatggtcatattaatggtcatgttcattcttcgcattgtagccataataaccatggcaaaaccagaaatgacaacgttcccttgggcttgggtcttggccttggacggaacagatctgttacagcctcatcatga

SEQ ID NO: 104297 - DNA, 291 bp, Glycine max
  Peptide Sequence Number=SeqID_221075
atgaaacccagagaggggcatcggaaatggacaacccaactgggattcaaaggtgaaaacaaaaccccagaatttgggaagagaaacaaacttatctgggtgacaaattatgggaaaaagcttcaaactttgcaaggaaaacgcaaacacgacgaagcagcaaggaagtttggaatggaagaaaaccaagtggtgttgttcttctgtaacgtggaagaatgctttttcatatccttgacgttaacgccacaaaaagcatttgagaaaaatcacataacgcgagtttcttaa

SEQ ID NO: 104298 - DNA, 1149 bp, Glycine max
  Peptide Sequence Number=SeqID_221076
atggaggatgaaaatgacttaccaatgaagggctaccaacaggaattgatccctggacctttgagtcaaggctgtttgaaaaagcttgagtatcttaatattggatgctgtaaatgtgttatggattcagacatgaagtctatctcagagcttataaatttgaaggagttacaaatttccaacagcagtattactgatattggaattacctatttaagaggtttgaagatgcttaccacattaaatgttgaaggatgcaatattactgctgcatgtttagagtttattcatgccttagcttccctggcatgcttaaatctcaacagatgtggtctctctgacgatggatttgagaaaatttctgcatgcactccctttcctgcaggacttaaaaacttgaagaggttgagcctggcttttaacaggatcacagacgcatgtttagttcatctgaaaggcttaacgaatttggagtatttgaatctggattattgcaggataggtgatgacgggcttgctaatttgacaggtctcactctcttgaaaagtctagtgttgtctgacactgacattgggaacagcgggctgcgtcatatatcaggtttaaaaaagctggaggatttaaatttgtcattcaccacagtaactgatcatggcctgaaaaggctgtcaggattgacacaacttaaatcacttaatctggatgcccgacagattaccgatgctggacttgcaaatcttactagtctgagtggattgatagcattggatctctttggagcacgcatttcagacaatggaactacatttttacgatcgttcaagatcttgcaatcccttgaaatatgtggcggaggattaactgatgccggtgtaaaaaatatcagagagattgtctccctgacacagctaaacctgtcccagaattgcaacttaacggataaaactttggaattgatatctggaatgacagcactgaggtcgctaaatgtttcaaattctcgtataaccaatgaaggactacggtatttgaagcctttgaagaatttacgcactcttaccttggagtcttgcaaggttactgcttctgaaattaagaagcttcagtcaactgatcttccaaatttgataagctttcggccagaataa

SEQ ID NO: 104299 - DNA, 2178 bp, Glycine max
  Peptide Sequence Number=SeqID_221077
atgggaaagaaaaagaagcaagtaggagaaatagaggaggatggtaaagttggagatagcagccccagagcatacgataatgatactatggtgtttatatccatgtctcaagaattgaagaatgaggggaacaagctgttccaaaagagggatcttgaaggagctatactgaaatatgaaaatgccctcaagttgcttcccaaaaatcatattgatgtgtcctatctgcggagcaacatggctgcatgttacatgcagatgggactcagtgagttcccaagggcaattcatgaatgtgatttggctcttcaagtgacaccgaaatatagtaaagctctgttgaagagggcaaggtgctatgaggctttaaataggccagatttagctctgagggatgccagcactgttgtgaagatggagccaaataatgtcatggcattggagatctcagaaaaggtgaaaagtgcacttgaggagaaaggattgagggtaaacgatacaataattgagttgcctccagattatgttgaacctcctgatgctttgcctccagaaaaggtatcgaaagagaagaggcggaagaagaagaagagcaataaagaggaagagaaggctcctgatgacaaaattctagaaaagcaaaccgaggagaaatttgaggagaagaaggctgagggcagtattgtagtcgtagagaagaagatcaacacgtccaagaagaagaaggccaagggaaaaactaatgagaagaagactgatattaaggaagttatagaggaaagaagtaatggtagaaggaatcatgttcctaagaaatccgctaaatttatttttggtgatgatataagatgtgctgaactgccaattaattgtagccttttccagttaagagaagttattcaggaccgattccctagcctgggagctgttcttgtcaaatacagggaccaagaaggcgatttggtcacaattacttctgatgatgaattaagatgggctgaagcaggatctaatggttctatccgactgtacatagtagaagctactcctgagcaggatccactttttgagaaatttaaagtgaaggaggtggaagtggttggcgttaacatcgcacctgagaatggttgtgtaggaaaggcaaaggaaattattagctcttcttgcattgaggattggataattcagttttccaaactgttcaagaaccatgttgggtttgaatctgacagatatttggatttccatgaacttgggatgaagctctattctgaggctttggaggagacggttacaagcgaagaagcacaaggcctatttgacattgcaggagataagttccaagagatgactgctcttgcattgttcaactggggaaatgtgcatatgtctagggtaaggaagaaagtatatgtcacggaagattcttctaaagaacatctttgtgaacaaatcaaaagttcatatgaatgcgcactggaagaatatgcaaaagcgggagaaaaatatgcagcagccattaaaattaagtcagattttcatgaaggcttcctggcactagggctgcagcagtttgagcaagcaaaactttcttggtatcatgcacttagtagtaatgcagatttacttacatggccttccactgaggttcttcatctttacaacaatgctgaagaaaatatggaaaaaggaatgcagatatggaaagaatcagaaaagcagaacttgagtaagacatctaattcaaatgatgttagattgcatttgcagaacatggggttggatgggctttttaaaaatatatccttagatgaacttgcagcacaggaggcacatatggggtctcaaataaatctcctatggggtaccatgctatatgaacgctcatttgtggagttcaaattagggctaccgatatggcatgaatctctagaagttgcagttgagaagtttgaacttgcaggagcttctcaaacagatatagctgtaattttgaagaaccactgttcaaataatactgcggtagatggtcttgccttcaaaattgatgaaatagtacaggcatggaatgagatgtacaaagctaaaaagtggcagagtgcagttccatcatttcgtttggaacccttatttagaaggcgagtttcaaaaacttatcatgcctttgagcttgcatga

SEQ ID NO: 104300 - DNA, 1578 bp, Glycine max
  Peptide Sequence Number=SeqID_221078
atgggttctcagataaggcttctgggcctgtgtctttggatgtacttggcatgcttaagcttcattggtgtgggtgctgtgtatggaagagaaggtgaagttttggaagggattgttttagttcatgggaaaactgctattggaaggattgatgatgattctatctgtgcaaccctggattggtggccttctcagaaatgtgactatggaaaatgcagttggggtcatgcttctctgctcaatctggacctcaacaacaaaattttgttaaatgcagtaaaagccttttcacccttgaaaattagattaggtggcactttgcaagacaaggtcatatatggaactgaagattgtcgtcaaccctgtactccttttgttttgaatgcgaatgaaatgtttggtttcactcaagggtgcttaccgatgtataggtgggatgagctaaacagctttttccaaaaagcaggggttaaggttgtctttggattaaatgctcttgctggaaaatctataaagtctggttctgcagttggaccttggaactacaccaatgctgaatcgttaatacgatacacagtcagaaagaagtacaccattcatggttgggaacttggtaatgaattgtgtggaaatggaataggagcaagtgttgcagcagatcaatatgcttttgatgtaggtgctttaagaaacatagttgaaaatgcatatagagggtttgaacataataagccactagtcattgcacctggaggcttctttgactcggattggttcaaggaatttataagcaaatctggtaaatctgtagatgtggtcacccaccacatttataaccttgggccaggagttgatgaccacataactgaaaaaattcttgacccttcctatctggatggagaggctaacacattcagcagcctgaaaagtatagttcaaagttcagcaacctcagtaaaatcatgggttggtgaagcaggaggggcttacaatagtggccatcaccttgtgtctgatgcatttgtctacagcttctggtatttagaccaacttggcatgtcagctgtttatgacaccagaacatactgcagacaaagtttgataggaggaaactatggtttgctgaatactagtactttcatgccaaatccagactattatagtgcacttctatggcaccgactcatgggaggacgtgtcctctcaactaccttctatgggacaaagaagataagaacttatgcacattgtgcaaagcaatccaaagggatcacaatactagtactcaacttggacaacagcaccactgttgaagtcaatgtggccttaaaatttaacaagttaccataccgaagagttggtgaaccagcaagaagagagtaccatttaacagcaccagacaggaatttacatagccaaaccatgttgctaaatggaaaaattttaagtgtaaactcagctggtgaaattcctcctttggatcctctatatgtaaactcaagaaagccaataatagttggtcctctatctattgtatttgctcatataccaaatgttcttctttcggcatgcagctaa

SEQ ID NO: 104301 - DNA, 285 bp, Glycine max
  Peptide Sequence Number=SeqID_221079
atggaaacacaaacgacatcgagggagaagattgcatacctcaacaatgtcaatgctctgaagaagaagaagaagaacaaagcaacgggccaaggagcgaaggagaagacgacgctgcagaacggagctgggtggaagaagaaaaccaagaagcgctggattgctaggtgcacaggccacagggttgcagaagaaggaagaaggtcgcggaacaagaagatgaagcgcggaagaagaaaaaccgtgtgggtggtattaaatagtttaagttctgatggtatttaa

SEQ ID NO: 104302 - DNA, 708 bp, Glycine max
  Peptide Sequence Number=SeqID_221080
atgacacaatcatggaaaacttctctgagagaactgaatggctctttgaaggaagtaccatggaaggcctttttccaaaatcgtgctgtgtgggctatgatatatgctcatttctgtgaaaatttagttctagtatttcttacagttttgaccaatggagaatctaattcgcccatctgtatgctatgtagtgaggagctgaatctaaatctgactgaagctgcatgggtgtctattcttccgcctctggcttcaatatttgtgactggtcttgcagcacaattagctgacaacttgatttcaagaggagttgaagccactgtggttcgaaagatctgccaatcaattgcatttttgtcccctgcaatctgcatgactctttcctcgctggatctagggctaccgccttgggagattgtggggattctcacaagtggtttagccctctcaagctttgccttatcaggactctattgtacccatcaagacatgtcgccagaatatgcaagtatacttctgggtataactaatactgttggggctgttcctggaatagtgggtgtagccctcactggttatcttcttgattcaactcattcatggagtatatcactatttgcgccatcgatcttcttctatgtgactggtaccatcgtatggttggcgttcgccagcagtaagcctcaaagtttttctgagctaaactga

SEQ ID NO: 104303 - DNA, 1020 bp, Glycine max
  Peptide Sequence Number=SeqID_221081
atgaagagaatgatagcgttgggatttgagggttcagcaaacaagattggtgttggggtagtgaccttagatggcacaattctgtcaaacccacgccacacatacatcacccctcctggtcaaggctttcttcccagagagacagcacagcaccacctacaacacgttcttcccctcgtcaaatccgctttggaagtcgcacaaatcgctccgcaggacattgactgcctctgctacaccaagggtcccggcatgggagctcctttgcaagtctccgccattgttgtccgtgttctctcacagctttggaagaagccgattgttgctgtcaatcactgcgtggcacacatcgagatgggaaggattgtaaccggtgctgatgaccctgttgtcttcgaggggcgttatagaatctttggagaaactattgacattgctgtggggaattgcttggatcgctttgcaagggtcttgacgctttccaatgatccaagccccggatataacattgagcagcttgcaaaaaaaggagagaagtttatagacctgccttatactgttaaagggatggatgtatcttttagtggaatattgagctatattgaagcaaccgctgctgaaaagctaaagaataatgagtgcactcctgcggacttgtgctactctctgcaggagacactgtttgccatgcttgtggagataacggagcgggctatggctcattgtgacacgaaagatgtgcttatagttggtggtgtaggttgcaatgagcggttgcaagagatgatgagaatcatgtgctctgaacgcggcggaagattgtttgccaccgatgatagatattgcattgataatggagcaatgatagcttatactggcctccttgaatttgctcatggtgcatcaactccactagaggattctacgttcacccagcggttccggacagatgaagtgaaagcaatatggagagaagcaaatttggaaaatttgaatgggcttgcagagaagagtatttga

SEQ ID NO: 104304 - DNA, 624 bp, Glycine max
  Peptide Sequence Number=SeqID_221082
atggccaggctcacgctgagaccagacaattcctgcttcttttcacacattcaaagagcttactcacacaccccttttaccagaactacctcgtttcaacgttttcactttcatctctcaccatccaaccacaccctcaggctcagaatagtttctagctctcagcaaaatgccaaagaaacccagagagtgtccatggccaaggcaaaggccaaggttctcacggaccttcaagtggaagagatggagaagcagcatgagaccttgtcttggaactggccaccttggaagaatcttccccaaagatacaagctcatcggcaccacttcattggcctttgttatttgtaacatggataaggtgaacttgagtattgccataattccaatgtctcatcaatttgggtggaactcaacaacggcaggattggttcagtcctccttcttctggggctatgcattgagtcaattgcctgggggttggctagccaaaatatttggtggcggaaaacaggaatataactatgggctgatggggagtggacctgagggttcaaatgacttattaagctgcaaacaaggtgcgggtggcgatgctgacattgcaaagtttgcctgggactag

SEQ ID NO: 104305 - DNA, 297 bp, Glycine max
  Peptide Sequence Number=SeqID_221083
atgaataggattctttttagtgatggtaataaatctggttcacagttgaaaaggggaattcctcccttggcagagaaaatcttaagaggtaacattgaagatctattgaatgattatattattgaatttgactcctctaaaatcagctcccactttggaaggaaaagagccaaattcagaattattagcattgacaaaaacaacagcaaaccaggccacaagctgatgcaacaactaccattttgcagcagcgttgatgaagatgaaaggaaaagtgacaactctactgagacctag

SEQ ID NO: 104306 - DNA, 210 bp, Glycine max
  Peptide Sequence Number=SeqID_221084
atgggtggtggagggaccaaagcacaggttgctatcgaagcccccatatgtttgttagctatggttggcagcatttgtaattggtttggttggaggaggtttccatgggattgggatcggatcaagacttgttattgtttacaaacagcatcgttcgcatgtgctgttgtgcgaatctacttccaaggactcgggtcggagcattattaa

SEQ ID NO: 104307 - DNA, 1023 bp, Glycine max
  Peptide Sequence Number=SeqID_221085
cccgactgtgaagggctgcctgtctgtgctcctgtgctagggctgacatggttatttaagtgccatgtcacttaccacatcatttttgtggaccctagacaatacataagcccccaagctttgagttcaacttgttggcgaaagagattgtctggtgttaagggattgtacgatgtcgaaggtggtagccttgatgggaaggagagtgtgttatataaaatgttttatgatgactttgccctgtctgaccgttatggagtgcatttaaagagggacatttcttctccctttttgcggaactcgatgatagacaatcttctcgggtttgatttcaacatggttgaaggtcttgctgatcaatctggaataagcttaccaagggcgtaccttgggtttttgaagaagtgtttaccaagggcggaccttgggtttcctgggacaaaccttgggtttttcgagcctttggagaagcgagactcaccaagggcagaccttgagtttgatgagcctttggagaagcaagactcaccaagggcagaccttgggtttgacaagcctttggagaaaatcgaccagggaattgtccaccctgaattttttagagactcactaaaggcggaccttgggtttcacaagcctttggagaagcgagactcaccaaggacggaccttaggtttgaggagcttgtagagaggcaaccagggattgtccatcctgggttttggagagaatcactaagaaaacattcttcttgtcaatggttccccaatttcgatggggattatgacatttgtgtcgtatgtgagccggggtttaaggataaccctgttagctacctctgcttgaccattggtctggggatgttcgataaaagtcacaaggatgttcatcccccacatggcaaagggtcatggggagctcagggtgtcaactcaaagtgtcacccaatagtagccgacatgtacaatcatggttgccagggaacacccccctgtctggaggccacagattccttcatgtag

SEQ ID NO: 104308 - DNA, 354 bp, Glycine max
  Peptide Sequence Number=SeqID_221086
atggtgcatccaatgtctaaggaagcagggcatgcatcattatcaaaggccctaacaacattactttggagcaagccctcaagttcaacttcaaagcttctaacaattaggcctagtacgaagcactacttgaagctagcaaaagaagttagagccaaaaagctaaggtgctacactgactcccagcttatgtaccatatacggggggagaacatcaccagagcagacttgctctccaagttggctagcactaagaaagctggacatcttaagaccattatccaagagacactccaagcacctaccatagacactaaggaggtgatggccagagaagaggcagaaccagactag

SEQ ID NO: 104309 - DNA, 135 bp, Glycine max
  Peptide Sequence Number=SeqID_221087
atggagttaaggctgatgatggttgaaatcaacgaatcaaatgaagtttctacaagccgcagtaccacaatatacatgccattgcttcataacatcttgttagaaaaacaaaacataaaggtattggatggttaa

SEQ ID NO: 104310 - DNA, 471 bp, Glycine max
  Peptide Sequence Number=SeqID_221088
atgctcaagcaattcctcagaaaactccctcgcaaggcatctaaactcaactcggacgagtcatgtcgagccgactcatcgcgctcggacgattccccacgtgtcgctggcaaaaacagccaccatcccggcgacggaggcccctcctccacgaagaaaacatcctcgtcgacggtttttccgacaaaatgcaatggtagtgaaactgtgcgtatggctcaatcactcattgttacttgtcatgctggcactggttgggctgtggaggatgccgaggacaagatcatgaaacgggggcaggaggcagagagaaggaaggagaaagaaacgggggcaggaggcggagagagaaacaggtgcggggacgttgacatgcggcagtcaacgtctgagcttaacggtcaacgtctaattgaggtgtccgggaccaacattgcaggattttataaaacagggagatcaaattcgtga

SEQ ID NO: 104311 - DNA, 381 bp, Glycine max
  Peptide Sequence Number=SeqID_221089
atgtatttctatgctacatctgatcacaccttctcttttatggtgttatttcctttctctcaattcttcttcacacattatgtggatcccatcactgaagaagttgaatctgatactaacactacttttggctccctggttgttcaagtagaggcacttgctcaagccttgaaggaccgcacccatgctaagaaggaggctcgtagatggtctttgatcagtgacttcttctacaagaaagccattgggtggaaacgtcctcattctccaatggccccaggaagtcctgttactctttcctttgactctgaggactttggtgatgagttccttatgaagcttgatgaagaagctgccaggaaaaggggagagaaaatgtaa

SEQ ID NO: 104312 - DNA, 251 bp, Glycine max
  Peptide Sequence Number=SeqID_221090
gtaagggtggtggtgctaaagccttcacaacacgtgagaacaaggtcatggaaggaggggtagaagagggagaggagggtgaggtagtggtcggcgagggacatgctcttgagtgtggtggctcaaggggtgaagtgagccccctaattcaagggcatgaggtcaaagttggtgaagcggggcttacccttgatggtcaaggatcgaatacggggaagcgggtggtggcacgccaagggaacacaacgtag

SEQ ID NO: 104313 - DNA, 1212 bp, Glycine max
  Peptide Sequence Number=SeqID_221091
atggagcatttgccacgagaattggtgtccaacgtgctctccaggttgccagcgaaggtgttgctgctatgcaagtgtgtgtgcaactcctggttcgatctcataaccgatcctcattttgtttccaattactatgttgtctacaacagtctccagagccaagaggagcatctcttggtgatccggagaccctttttctctggcctcaaaacttacatttctgttctttcttggaacaccaatgaccccaaaaagcacgtttcttctgatgttttaaaccctccctatgaatacaactctgaccacaaatactggaccgaaatcttgggtccttgcaatggcatatactttcttgaaggcaatcccaatgtcttgatgaacccttcattgagggagttcaaggttttgcctgaatcccattttactagcccacatgggacttacacattcactgattatgctggctttggctttgaccccaaaaccaatgactacaaagttgtagtgctcaaagacctttggtttaaggaaacagatgaaagacaacttgggtattggagtgctgagttgtatagcctcaattcaaactcttggagaaaacttgatccctctcttctccctcttccaattgaaatctggggttcttctcgggttttcacttacgcaaacaattgttgccactggtggggctttgttgaagagtctgatgcaacacaagatgttgttctagcatttgatatggtcaaagaatcgtttaggaagataagggtgccaaaaattcgcgattcttcagatgaaaagtttggaactttggtaccctttgaagaatctgcttcaattgggttccttgtttaccctgtgaggggaacagagaagcgctttgacgtgtgggtgatgaaggattattgggacgaagggtcttgggtgaagcaatacagcgttggacccgtgcaagtgatttacaagcttgtggggttttatgggactaatcgatttttctggaaggacagcaacgaaagattggttctttatgattcggagaacacaagggatcttcaggtttatggaaagcatgattctataagggctgctaagtacacagaaagtcttgtttcgcttcataggggaaatgagtttagtcacaagtgtttttcgtgtagtttggttccagaccctctgctacatgatactgaatatcttgtttcattttaa

SEQ ID NO: 104314 - DNA, 312 bp, Glycine max
  Peptide Sequence Number=SeqID_221092
attttcaggaagaagatagatctcctccagcatcaagaacttgcagcccagaatcgtacacggctatataatcatggaggctgcacgagttctgtaccaagtccgggattgaagagttatttttgctctcaagctgttctcaacaagcttgatacaaggtttatggatgatagtaagaagaatgactttaggattatatatgttgtgaagaatgtgagaatacccaagtatctagacttggagtggttctctcagcaagggtttaacttccccaatctgctcgaagcacaggctctatccaagcttgtgtag

SEQ ID NO: 104315 - DNA, 267 bp, Glycine max
  Peptide Sequence Number=SeqID_221093
atgcaccaagagctcgatcaattccacaagaatcatatatggaagttggcggagtttcccaaggacaagaaagttcttggagctaaatgggtctctcataacaaactagacaagaacggtaaggttgtgaggaataaggcaagtaatatggaactatatcaaatggacgtaaagagcacattcctcaatgggctcatccaagaggaagtgtatgtggaacattcccctgggtttgagagtgattgtcaccatgtgtttcaaacttaa

SEQ ID NO: 104316 - DNA, 195 bp, Glycine max
  Peptide Sequence Number=SeqID_221094
atggcattcagggatttgtggtcatttgctaagttaagccttgcatcatctgttataagttgcttagagcaatggtatggaacatgcattatactacttgctggtctactagacaatcctgtgattgatgttgattcctattctatttgcttcaatttgttcagggttggcactcgatgctgctccttggaataa

SEQ ID NO: 104317 - DNA, 462 bp, Glycine max
  Peptide Sequence Number=SeqID_221095
atggctcctgacagaacccagctgcaaaatataagcaagagagagcatgagtcctttaaggagtatgcccaatggtggagggacttggcagcacaagtggcaccccctatggtggaaagagaaatgataactatgatagtggacacgttgccagtgttctactatgaaaagttggtgggttacatggcctctagcttcacagatttgatatttgcgggcaagaggattgaagtaggcctgaacaagggaaagtttgattatgtcgctcctgccagcatgagcaataagagatttgaggaaagtggggcaaagaagaaggaaggagatgccaacactgtgacttcagcttctacttggccgaaaccccaacaaacccctcacaacacttaccaatatgcccaacaccaaccaagctttttggcttgcatcagaaacccttccaatctggtgcctgtccagtga

SEQ ID NO: 104318 - DNA, 177 bp, Glycine max
  Peptide Sequence Number=SeqID_221096
atggctaagtttgaccctgatatagtcctggagttttatgctaatgcttggcccgtagaagagggagtgcgagacatgcggtcatgggtgaggggtatgccactcaccaggcacccagtatacccggataagtctaatagggccctggggtttccggcattgatcatgggcctctga

SEQ ID NO: 104319 - DNA, 750 bp, Glycine max
  Peptide Sequence Number=SeqID_221097
atgacgcgtaaagacggactgctggcgttgctggtggtcgtagtatgggggctcaattttgtcgtcattaagctgggattgcacaatatgcccccgcttatgctggccggtttgcgtttcatgttagtggcgttcccggcgatcttttttgttgcgcgtccaaaaatcccgttcaaattactgctgggctacggcctgaccatcagttttggccagtttgcgtatctgttctgcgccattaaatgtggtatgcccgccgggcatgcttcgttggtgttacaggcgcaggcgttcttaaccatcattcagggggcgtttgtgtttggcgagcgtctgcagggtaaacagctggcgggtatcacgctggcggtgtttggcgtgctggtgctgattgagtccagcctgaatggtcagcacgtggcgctgcttggctttatgctgacgctggccgcgggcctgagctgggcctgcgggaatattttcaacaaactgatcatgcaacatgaggcgcgtccgcaggtgatgtctctggtcgtgtggagcgcactgatcccggtggtaccgtttatggtcgcgtccctgatattcgacggcccggcagtgatgctgacgagcctggttgaaatcgacctcaccaccattttgtcgctggtctatctggcgtttgtcgccacgattatcgggtacggtatctggggatcgctgctcgggcgatacgaaacctggcgcgtggcgccgttgtcgctgctg

SEQ ID NO: 104320 - DNA, 202 bp, Glycine max
  Peptide Sequence Number=SeqID_221098
atgtctggtgtgtgggtttttgacaagaaaggagtggcgaggctcataacaaacccaacaagggaatccttcgagcagaaagagccaagacaacctggtacagcaaccgcaccaggtgcaagaccgagagtgttggtgtatctcccaagcaaccaggtcattcgttcctacaccgaactcgaacagcgactcaccgaactcg

SEQ ID NO: 104321 - DNA, 273 bp, Glycine max
  Peptide Sequence Number=SeqID_221099
atgactcctgctttaccctcctatgacgatagcgttctcatcctccacactgtgccaccttcttcaccctcctacgacggtagcgacctcgtcctccactacactagcccgtcctcacgacatcgcatcaccaccttccccctccttcttttgcgtgccaggtttctggtgcaaggagggacatctattgtggaacaacaattccataatgcccattctagaacaaccattccaaaagtgatttttttgacttacggaaaggttattccataa

SEQ ID NO: 104322 - DNA, 1878 bp, Glycine max
  Peptide Sequence Number=SeqID_221100
atgcatctcactacctccgtcgccgtcctcgtcggctgcgtcgttgtcttcatctggcggagatcctcctcccccaaggccaagaaggtcacctcgaattccgcttctgcaattgcaatggcttctaatgcgaccatccctacatatgatgtgtttgtcagcttccgcggtgaagacacgcgcaacagcttcactgcttttctctttgatgctctctctcaaaatggcatccatgccttcaaagatgatacacatcttcagaaaggcgaatccatagcacccgagctgctactggccattcaagggtctggccttttcgttgtggtcttctcaaagaactatgcttcctcaacttggtgcttgcgtgaacttgcacacatctgcaactgcactattcaagcatccccgagtcgtgttcttccaattttctatgatgttgatccatcagagctgcggaaacagagtggttattatgggattgcctttgcagaacacgaacgaagattcagaggagataaagagaagatggaggaactgcagagatggagagaagctctgaaacaagtggccaatatctctggctggaatatccaaaatgagtcacaacctgcagtgattgaaaaaattgttctagaaataaaatgtagattgggttccaaatttcaaaatcttccaaagggtaatctagttgggatggaatcctgtgttgaagaattagaaaagtgtttagaattggagttggttagtgacgttcgagttgttggaatttgtggaatggggggaataggaaaaaccactcttgcacgtgctttatacgaaaagatttcttatcaatatgattttcattgttttgttgatgatgtaaaagaaatttataaaaaaattggttcactaggtgtacaaaaacaattgctttctcaatgtgtaaatgataaaaatatagagatttgcaatgcttccaagggaacatatttgataggaactaggttacgcaataaacgaggacttatagttcttgataatgttagccgggttgaacaactacacatgtttacagggagtagagagactctattacgtgaatgtgtaggtggagggagtagaatcatcgtaatttctagggatgaacacatattaaggacacatggagtaaatcatgtttaccaagtcaagccattgaatcaagacaatgctgttcagttattttgcaaaaatgctttcaaatgtgactatattttgagtggttacaaaatgttgacacatgatgtattatcacatgctcaaggccatcccttggcaattcaagtaataggcaactttttgcaaggtcgaaatgtttcgcagtggaaaagtacattggttaggttaaatgaaattaaaagtgaggatattatgaaggtgttgcgaataagttatgatgatctggaagaaaaagacaaagaaatatttttagatattgcttgtttcttcagtcgtgattatagttataaatattctgagcgttatgtgaaagaaatcctggattttcgtggatttaatcctgaaattggcctcccaattcttgttgataaatcactcataaccattagtcacgggaagatttatatgcataggttgctgagagatttaggcaagtgtattgttcgagaaaaatcacctaaagagccaagaaattggagtagattgtgggattggaaagatctctacgaagttttgtcgaacaatatgaaagcaaaaaatctggaagccatagttgttgaagataaaacatggatgttttttgaaacaacaatgagagttgatgctctatcaaaaatgaaaaaccttaagttgcttatgtttcccgagtatacagcagtggaaggttaccacaaatga

SEQ ID NO: 104323 - DNA, 462 bp, Glycine max
  Peptide Sequence Number=SeqID_221101
atgaaaattcatcatgaaatgagagactcatttccgataacccaaccaaatagattagccacacgtcaatcagaatcacaacgaataccaactcccttcttcaacaggtttatagaaaccttggattactacttggcaatgctcgagtccattgatctgtctcttccaagaaagagcaagcagcgggttaatgtggagcaacattgtttggctcggaatattgtcaacattattgcttgcgaagggaaagaaagggtagagagacatgagctgttaggaaagtggaagtcgagattaacaattgctggctttcgtcaatatcctttgggttcttatgtgaattttgtcataaaaagcctgctgaggtggtatccagaacattataatcttgtggagaaagatggggccatgctagtgggatggaaggacagaaatttgatttcagcttcagcttggcattaa

SEQ ID NO: 104324 - DNA, 183 bp, Glycine max
  Peptide Sequence Number=SeqID_221102
atggtttatggatacaaagaaagcatcgatagtgaaaatgaggagtttttcttggcagattcttcacatagcttcctaataattgcgcttaacgaccataaattcagattcatgacttccgctttgcttcctgtgcggtctagtcgatcgggttcacttttcctctttggttccatgatgtaa

SEQ ID NO: 104325 - DNA, 309 bp, Glycine max
  Peptide Sequence Number=SeqID_221103
atgtccaaaatatcaagcacgggtcaaagttgtacgttgttctattctggcagagtatcaaatgaaggaagtgtttctcaatcacaatatatccaatattcccaacgaaactcggttgaaaagttcttgcataatgctcaaatggttaggttaggtgaaataagcagactgagacaggactgttactatttgatcgttggtacggtggatgaagtcatcattgatacaccatggagttatgataattatccctattgtactatgacatttgatccattgaaaattggtgtcaatttttgttcgtgctag

SEQ ID NO: 104326 - DNA, 252 bp, Glycine max
  Peptide Sequence Number=SeqID_221104
atgtcgccaagagtagattgcagtatgttttctgaattagaatcatccatagtggcgatgagatcaaggttttccctccctattttgatgaattattgggaaagacttgggctgtcagattttagtaccatgcacgatgctcaaaaaggcctacaatgtgttgctgaaccttggtaccaatatttgagagacaatgccttcagtgttggagatgagatatgtttctactttaggccttataaaaaagtatga

SEQ ID NO: 104327 - DNA, 4539 bp, Glycine max
  Peptide Sequence Number=SeqID_221105
atgggggagattattcattttgctttcgcccttgtggttaggcagttagagagtttgttctctgctgaggagcttggctctgccccaaagatggctgatcgtgtcacagcagtggaagatcgtttggaacgcgtggaagccagtattgtatcgttacgcgagttcatcggcgccgagattcagcgtgcgatggcgagtcgtccttctcctccaccgggtggtgactcagttacctcacccctggatgaatttcgtttatctgccaagaaagttgagttgccgtcgttcaacggcgacgatcccgtggcgtggattacccaagctgagacgtattttgaagtgcagcgaatttctgaggaggtgagtattcaattgaccaaactcagcatggaaggccctactattcactggttcaatctctggcgtgattcaacagaggagttgacatgggagaatctgacggaggcgatgatgattcgatttggcggtggacgtttggagaacccgtttgaagaactcaaggagttgaaacaaaacggttcggtggaggaatacgtcgcggaattcgaactgtactcctcccagtgtggacggttgccggaacaacagtttctggggtatttcatcggagggttgcgtcatgatattcgttcccgtgtgcgtaccttcaaaccacgaaatcgttatttggcgatgcagttggcacgtgatgttgaacgtgagttcgctgacgtgtcgggtcagggagtcgggtctcgccacaagccgggtcaagcgagttgggctcgcccacagaaacaggtttggacccaacgtgaaggggatggaaacgggtcatctaatccggcccaatctggcggtggtttggggaaatccaattcaatttcccgatctgtttctgggtccactctatcgacaggatcgactcgttcatccgcaccatcctccggttctcgcctgaacgccggtgaaggtggtcgtcgcaatccccgtggtgtccgtcatcttccggcagcagagatgaatgagcgtcgttcaaagggtttatgctttcgatgcaatgaacgttgggatccgctccatcaatgcgctacgaagcagttgcgagtgattattctgggtgatgatgaggccatcaacgatgagggtgaaattgtggtgttggaaacagcggcagaggaggacacagagtctgacgaaatggaatgtaaaggacttggggtgtttggtgtgtcttctacctcttcacaagttcgtaccatgaagctggagggtgttttgcaaggggcaaacatcttggttctaattgatagtggtgcaacacataacttcatatctcccaaagtggtggaagctttgggtttacagctggtcccttccaagcccttgggagtcaagttaggtgatgatcatcgtgttttgactatgggtaagtgtgcggcaatttccttggtattgggggaaatggagactaccattgatgcttatattttggagttaggaggtgtggatttaattttgggagtagtttggcttgaaaatcttggcaaggtcactatggattggaaggagatgtctatggtgttcaattacaacgggaatttggtgaagttgattggtcagcccttggaggagaaaatggccacattccagagtgccgtgaccacttccagtgtgtttgctaatgaagggtctcctactttgatggaagtaaagggcaaggctgaagctgggcttagtgaggtgcaaaacagagcgcttcaagcgttgctgactaagttctccagtgttttttgtgaagtaatgggtctgcctccagcaaggaacaatagccattcaattgtgttgttacctggtgctgggcctgtgagtgttcgaccttataggtatcctcatcatcataaagatgagattgaaaaacatattcagattttgttacaacaaggagtaattcgaaatagcactagtgctttttcgagtccggtcattttggtcaagaagaaagatcattcatggaggatgtgtgttgattaccgcgcattgaacaaggtcaccatacaagataagtatccaattcctgtggttgatgaattacttgatgaattgcatggttctgcatacttttcgaagttagacttgaaatcgggttatcatcaaattcgaatgaaggaggaggatattcataagactgcttttcgaacccatgaaggtcattatgagtttatggtgatgccattcggtctgactaacgctccagctaccttccaatctgtgatgaatgagatctttaaaccttatttgagaagatttgtcctcgtattctttgacgacatcttagtatacagcggtgattggaacactcatttgcaacatttagctgtggtgctgcaagtcctccaacagcatcagtttgtggcgaataagaacaaatgtgcttttggccaagaaaagatcgaatacttaggccatgtcatttctaaggcaggggtgatggttgatccggccaaggtgcagagtgttttgcagtggccagttcctactagtgtaaaaggggtgcgtggatttttgggtttgaccggatactatcggaaattcattgccaattatgggaaaatagctaaacccttgatagagttgacaaagaaggaagggtttaagtggaatgaagaggcggaaaaagcatttcagacattaaaaactgctgttacttcatcgcctgtgcttaccttacccaatttcgaactgccctttgaaattgaatgtgatgcctccggtaaaggtgttggggctgtgttgatgcagatgaagcaccctattgcttacttcagtaaagcatttactgcctctaaactatccaaatcagcttatgacaaggagttgatgacattagttttagctattcaacactggcgacactatttgttgggtaggcgcttcgtggtatactctgaccaaaagagcctcaaacacttactacaacaacgtatcacgacggctaaccagcaagaatggatggctaaattgctgggctttgactttgaagtggtttataaggtaggagtggagaataaggtggcggatgcgttatcaatgcaacacgaagaggcaacaatacagaccatgttgtcatttccgatctggactcaagggaaacagctgcagcaagaagttatgcaagatccagtcctcaaaggaatcattaaagctattcaatcggaccctacatcgaagccaggtttcgttttaaaaggtggggtgttgttctacaaaaataggttggtcattccagctaagtctccaataattgatgatttactgcgcgattttcattcatctcctagtggaggacattcagggtacctcagaacatatagacgaatggctggaacgttgtactggcagggcatgatgaagagagttcaggagtttgtgaaggcttgtgatacttgtcaaaggcaaaaatatgctgccaccacacctagtggtttgctgcagcccttgcctattcctgtgttggtatggagtgaaatttctatggattttatcactaacttacctaagagcaacgactatgaagctattttggtggtagttgatcgcctctcgaaatacagtcatttcattcccctcaagcaccctttcacagcccgttccattgcttctatttttgtgaaagaggcggtgaggcttcatggcgttccggagtctatactcagtgatcgtgaccctttatttgtgagcattttttggaaggaattgttcaagctgatcgggactgtgctcaaaatgtcttcagcataccatcctcaaacggatggtcaaacggaagtagtcaaccggtgccttgaggcttatcttcgttgcttcatatctgaccaaccaaaaaaaccaccggtgttggtgcacttcttagagggtgaaactagagttgaagcggtggctcaagaattgagggatagagatgaggcattgagacaactgaaattcaatttacagaaggcacaagagcaaatgaagatgcaagctgataaaagaaggaaggaagtgcagtttgacgtgggagattgggtctttctcaaattatggcctcatagacaacaatctgtggtgcaaagaattcatcagaaactcgctcccaggttctttggcccttaccagatcattcagaaggcagtgggtaactacacagtgtctaatgacttgcctgccagcctggaattggagaaaaaggatgtggttcctgccaagctgttgtcgtggagagacaaatttgatgctggaaaacatactagggaatggctggtgcagtgggaaggcatggatattggagatgccacatgggaagaggaattattgttaaagagtcaattcccagatttcagccttgaggacaaggctgttgttgcaggagggggtgatgatagaagtgggtctgttagtagtgaaggtgaagtattggttaacaaaaagaatgttgagcccaaagtttggcgcgtgtatgaaagaaggattaagaaaggagtcacaaagaaagtgtga

SEQ ID NO: 104328 - DNA, 341 bp, Glycine max
  Peptide Sequence Number=SeqID_221106
atggcactgcacttgtccactgcattgactttggttgtgtgtcgcgcgaggagcaggatatggttttggaattgcaaggggtgcgttgagcacaagaaggctgagagtctctatatatgcgggtgtcctgggaaatcattatctatggagaaagtgaaagataaattactcaattgggctaaggagattgtggattcggtgattgctctgtttcgagtggacttctcaagatggagagcttgcaaatcaccagcgagccctggtgcagcggtaaagttgtgccttggtgacttgttggtcatgggttcgaatccggaaacagcctctttgcatatgcaagg

SEQ ID NO: 104329 - DNA, 1056 bp, Glycine max
  Peptide Sequence Number=SeqID_221107
atggtgaagagaaatgggattaggattttgaagaagaaaagaggtaacatactagggattttgaacatgaaagtaacattgtcactattgtcgtcggccttgatggttatgatgtcatcattaccaacccatggagatgttgcagtcacagcgatagtgctcaaagcactcaaatcaaaggaggagccagacgagggtgatatgactggagtccatggcctggagggagaacccggtggaggagcagtcaaagcaaactggcttcgagggccaggacctccaaggaagaagaagaagaatagaggaaagtgcttctgtttcattgttctgcctattttttatgatgttgatccatcagaggtgcgaaaacagattggatgttttgggaaagcctttgggaaagccagatggagagaagctctcacacgtgtggctaatcgatctggttgggttattggaaatgagtcaaaacacttgtccctgcttccttcaacttctggaattgcattggcttctagcaccatcatgcatgcaataaggacatatgatgtgtttgtgagcttccacggtttagacacacgcaacaattttgctgctcttcttcttcaagctctccataggaatggcattgatgccttcaacgataatgtacatgtcatgaaaggtgaattcattgaatccgagctgtatatggccattgatgggtctcgcaatttcattgtggtcttcacaaagaactatgcttcctcaacttggtgcttgcacgaactagcacggatctgcatgaacattgaaacatcaacaagacgaattctgcccattttttatgttgttgatccattaaaagtgcaaaagcagagtggatgttatgagaaagcctttatggattacgaagaaagattcagaggagctaaagagagggagcaacctgagtatggactagatccaatgcttcatttcgctttggttggatctgagcggcaagtcagaattcaaggtagagctagcaattggcaggacaaacttgtggtgacctcaacacgttctgtggaatag

SEQ ID NO: 104330 - DNA, 291 bp, Glycine max
  Peptide Sequence Number=SeqID_221108
atgaagaagctcaaacaattttcagattggctacttgacataggagatggaaaaattggacaacataatgacggattttcagaaatcactattctagatgagtttcttatcaaggattatgatgattatatccatgctattgttgaagtcacctatcccagcttgatagataactatagtgacacagattatttgcaaaaaagagttgttcttgcctctaaaaaggaaattgttgacaaaataaatgattatgtcctatcacttatacccaataacgaaaaggagtattag

SEQ ID NO: 104331 - DNA, 312 bp, Glycine max
  Peptide Sequence Number=SeqID_221109
atggggacaagaaaacatattccaaatttaccttggaaattgagttctaatttattggtggatgaaataccttttggacttggtcaaaaatccttgatacacctttgtgagaaatacgacattagcaaggagaaatgggtccagttttgtcaaaaccgcaaagacccctcgtgggagctcatggctgagaagacaaagaaaagactggaggaagctacccaatccggaagcactgagggcatcattgaccctccatctcccatcagacgctacatgaagtggaagatggcccgcatcaagaaaactgggtag

SEQ ID NO: 104332 - DNA, 228 bp, Glycine max
  Peptide Sequence Number=SeqID_221110
atgggaagggtgttacaaacagaaacttatacgggaagggtctttggtcagcagaagaagatgaaaaacttcttaggcatattactaagtacggtcatggacgttggagctgagttcctaagcaagaaggtttgcaaaggtgtggaaaatctacaggctgatgtggatcatttaattaaggtgctacagcttaaatccaaggtagttccagttaagttggattattga

SEQ ID NO: 104333 - DNA, 477 bp, Glycine max
  Peptide Sequence Number=SeqID_221111
atgttcctcgtattcaacaatgctttgaaaggacttgatgatactccacaacctaaatccaaggctggtgctaggtggattattgttaagtgtaatagacaaaaaagaagcactgagtgtggctattacgtcatgcactggatgtccacgataatcttaggaactttcaacaataattgggaaacgtattttaatgatgttagatcattggaagcaaagagattcaaggcgtttcgcatccagtgggcacaatattatctaaaaaaagcaaaaaatccggaagccatagttgttgatgataaatcatggatgttttttgaaacaacaatgagagttgatgctctatcaaaaatgagaaaccttaagttgcttatgtttcctaggtatgaggaggagctttccacagatgaggagaaggaggagaaattttcaggaaacctcaattatctttccaatgaattaggatatcttatttga

SEQ ID NO: 104334 - DNA, 219 bp, Glycine max
  Peptide Sequence Number=SeqID_221112
atgcatccattcgaaaagcaaccaacaaaaggaagagatgctataccttatatcgataaattcaagcatgagaccgacatggacatagtaggtagtaggaaaggagttccacttctagtctctaaacagaacacaatagaatatgtttgccaatggcttatagttgccactagagagtgtgatgaggaagtagtgcctcaaattgaaaggatgggatag

SEQ ID NO: 104335 - DNA, 642 bp, Glycine max
  Peptide Sequence Number=SeqID_221113
atgactttggatgttcaacatggatattcaacttcaggcaccaaagcagatacctctagacaaaggtatagagcttcaaacccagattataaattggcaagctcaagttgccaaaaaccatgggccttgaccatggggaatgaagcatacaacttacttgagaggcaaaagagaaagggatgtatacctaatgtaattgcatataattgcatcctgacttgccttagaagaaagggaaaagttgaggaagcattgagaatccttgaagcaatgaaaatggatgcagctcccaatcttacatcctacaatattttaattgacaggctttgtaaggcaggagaacttgaagttgctctgaaagttcgggactccacgaaagaggctggcttattctctaatatcataaccgtaaatattatgatcgatcgactgtgtaaagctaaaagacttgatgaagcttgctccatatattttggattggatcataaagtttgcacccctgaatcaataacattttgttcactcattgatggcttggccagacatggcaaggtgaatgatgcctatatgctttatgaaaaaatgttagattatggtcagactccaaatgcagtgttgtatacatcccttattagctggtga

SEQ ID NO: 104336 - DNA, 228 bp, Glycine max
  Peptide Sequence Number=SeqID_221114
atgttttgcaaaactcttacagcctcagataccagcactcatgggtggttctctgtccctcgcagagctgctaagactgttttcctcgtttggtgtgacacctcacatgattataagcagcaaagaccttctcaagagcttgttgccaaagatttgcatggtgtggagtggaaatttcgacatatttacagaggtcagccaaggtggcatctgctcactactggctag

SEQ ID NO: 104337 - DNA, 195 bp, Glycine max
  Peptide Sequence Number=SeqID_221115
atggtgctaatacgatgcttacatcagcacgtcttagaaggtcagcattctaagacggtgcttacatcaacaccgtctttgaaaggaagatcgttgaaaactgcgacttctaagatggtcattgttgcaccgtcgttgaaggtttcgacattccacgatgttgaaatctacgacggtcatccaccgtcattgtag

SEQ ID NO: 104338 - DNA, 324 bp, Glycine max
  Peptide Sequence Number=SeqID_221116
atggtgggttacacaccttcaagttttacagatttggtcttcgccagcaaaaagatcgaagtggatctgaaaagaggcaaatttaatcatcctgcttggacgaatgagaaaactggggcaaatgaagaggatgaaaatgagggagaaacccatgctgtggctgccattcctatatggccaagtttcccaccaacccaacaatgtcattactcagccaataacaaaccttctccttacccaccacaccagttatccataaaggccatccctaaatcaaccacaaagtctgtctaccgcacttccaatgacgaacaccacctttag

SEQ ID NO: 104339 - DNA, 339 bp, Glycine max
  Peptide Sequence Number=SeqID_221117
atgaaaaacgtctttttcttttcctgtccacaaatcataattattagctacacattcaacaaattgaccgttagagaattgctaataaagtggagtttgccattgtccaacaatgagtttgtcaagcttggtggagaccagcttgttccatattatgctgacattcttggagccattttgccttgtatagcagataaagaagagaaaattagagttgttgctcgtgaaaccaatgaagagctacgtgccctcaaggcagatccagctgaagcgtttgatgtaggagcaatcctgtccattgccaggaggcaattatctagtgaactggaggctacttga

SEQ ID NO: 104340 - DNA, 2724 bp, Glycine max
  Peptide Sequence Number=SeqID_221118
atggtctcaaaactgttgattttgtttgaagccttagaggttgattatgtgctatttgaagatcctcccgctgatgtcaacgcttctgaatcatctactcctgaaactcctgctacccctgtcgtcacaccgcttcttgcagaaaccaagaaagctgacgaagaagcaaagaagaaatatgaaaaggacaacaaaactgctagaggtcatctactaactcatatggcagataatctgtttgatctattcattaatcaaaagtctgcgaaaacaatatggtacactctgctgaaacattacggcgatgacgatgctggaagaaagaaatatgtggtaggaaattggctgcgtttccaaatgatggatgacaaaccaatcatggagcagattcatgagtatgagaatctagttggtgatatactaaatgaaggaatgaagatgtgtgagatattgcaggctaatgtgcttctagaaaaatttccaccttcgtggagtgactaccgcaaccaactgaaacacaagaagagggacttgtcacttcaagaattaataaatcatatgaagacagaggaggccagccgacttaaagataagcatggacaacaatctaacaactcgaaacctgctgcaccacatgctcctcaagcacatctagcagaaaatgaagaagtgatagctgttgtggtagtggaggcaaacatggtcgacaacaaggtggactggattctagataccggtgcttctaaacacttatgcgccaacaaagagctttttcaccagattgaggatgctgatgacggagaatgtgttttcatgggaaattcagctacagctggagtgcttggtaaaggaaagattctctttaaacttacttctggaaaaacattatctttgagtgatgttttgtatgttccctctctgcgtaggaacctaatttctgtatggggatgtcttgctaaggtagctctaccagatttcaagaggactaatgtaggtaccaaaacttttgattgtgtgtttattggatatgctcaaaatagtgctgcttataggttcttgcgtttgaatgataattctatttgtgaatctagaaatgcagaattttttgaacaagaatttcctttaacaaaacatgttaatgaattgatttcttcttgtaatactactttagtgcctttacatttgcgtacttcttcctctgtaacaaatgaacaagttaatgaacctagaagaagtaaaaggaagagaatagaaagtagttttggaccagattttgttactgctttcgtggttgaaaacaatgatgtcgataaaataaatgatgtttttgtatctacttttctcattgaggaagatcctaaaacttataatgaggctgtaacttccattgatgccaatttttggaaagaggcaattaatagtgaattagattctatcatgtataatcatacttgggatttagttgacttacctaagggaagtaaaccaattagatgcaaatggatttttagaaagaaattaagaactgatggaaccattgataaatttaaggctagattagtagttgttggttacacacaaaagaaagaaattgactattttgatacatattctcctgttactaaaatttccacaattcgttctcttgttgctttggctgctattcatggacttatagtgcatcaaatggatgttaagacagcttttcttaatggtgatttgagagaggaaatttatgtggaacaacctgagggctatgtgattcaaggtcaagagaacaaagtgtgtaagttgagaaaatcattatatagccttaaacaggctcccaaacaatggtatgaaaaatttgaccaaactttggtaagtgatggttatattgtgaattcatctgacacttgtgtttactctaaattgtttggacaagaatgtgtgataatatgtttatatgttgatgacatgttaattttcggtactaatgtgactgtagtggaaaagaccaaattattcttatcttctcattttgatatgaaagatctaggagaagctaatgtgattcttggagttaaaatgagaaaaagtgataatgaactccctatgatcctagcatacatcttaaggaaaaacaatggttctagtgtttcacaaactgaatatgctaaaatcatagggagtgttatgtttctcatgcattgtactagacctgacatagcatatgctgtgagtagactaagcagatatactcacaatccagaaggattttgtgatgcaaattgggttactgataatgatgaagtaagttccactagtggatatgtttttactttaggtggaggtgccatatcatggaagtcttccaagcaaacttgtatagcacgttcaactatggaatcaaaatttattgctcttgatttagcaggtcaagaagctgaatggttgagaaacttgttggcagatgtgccattgtgggggaaacggtctataccagtttctcttcattgtgactctgaagcagctattggaattgctaagaacagtgtttacaatggaaaaaggagacacatacgcattagacacagttcagtcagagaattgtttaaaaatggtgtgatctcattacagtttgttagatcagagaacaacttggcagatccgttcactaaaggtctaacaaagaaagttgtacttgaatcatcgagggggatggggcttaagcctttgtgttga

SEQ ID NO: 104341 - DNA, 546 bp, Glycine max
  Peptide Sequence Number=SeqID_221119
gttattgctatattagataaattaaagaatcacaagagccaaaacaaggagctgttggattcatcaccaaatgaggatgacgatgattgggatggtgaagatcctgaagaaggcatcatttatagtgttgaaaaggaagagtcattgaggaaaagggcatgggaagaaagcaagaagatgtgggtggtagcaggccctgccatattcacaaggttttcaacgtttagaatcatggtggttagtcaatccttcattgggcatattgggtcaactgaactagtagcctatgccattgttatgactgtcctagtcaggtttgtaaatggtgcattgttcaagtttgggctcaacggtgcaatgacatcaacacttttagcatattggattccaaacattggccaacttctgtttataatgactaagtgccctgacataaactatggttccttttacaatcttgagatctggtacaacactgttttgattcttgttacaggcaacatgaaaaatgctgaagtgtcaattaatgctcttgccatatggtaa

SEQ ID NO: 104342 - DNA, 183 bp, Glycine max
  Peptide Sequence Number=SeqID_221120
atggaaaattatacaccatcagaatttattctaaaggatgcaattccaaaacccctcccatctgccccactccctgatgctgagttcatggatgcagcaacatatacacctttcctaccataccaagttacccaaaaatgcagaaaacttcctccaaacccagaaaaagaatctctgacctaa

SEQ ID NO: 104343 - DNA, 369 bp, Glycine max
  Peptide Sequence Number=SeqID_221121
atgtcagaaacacaagtacatggaagaaaaagaaggaacttcaatgctatcatagaaacttgtgattcgtgcttcgtcgcctcgacttctgcgactggtcactctctctctctttcttctcacactcagacgctccttcactcttcacacaatttcaaaatccctaatccatcctttgcactgcattcttctcagatgtgtgtgtttggcgttctgcatttggctgtgttgaggcatttggtttcctcaaatgcctcatgtgagatgaggaagaaaatcatagatcccttctctgagaagaagttccgcggcgtccgacaacggctgtgggggaaatgggtggcggaggttcggaatctggcaagatga

SEQ ID NO: 104344 - DNA, 1707 bp, Glycine max
  Peptide Sequence Number=SeqID_221122
atggacttgaatcagttttcaagtttcaacgtaattagttcagcaggattcccttgcgcatcatcttgtactcctatttcaccaatatccaaccggttgcttggatccttgaaacttgatataggaaactcacctaattcggccctttctactcattttgattctgatactgtttcttctgcattaagtgacagccaggagcagcacaactgcggggaaattcactctggtgtcaactcctgtaactctttgcaggaaagcaatcattatttgcataggccggtctcatctgtagaccatctcgaagacggattgcatctatctactaggagcttttttccacaggatgcaagttatgaccatgaaaccagacatgcattgctggaattagaaacttctttgatggcacctgatgatgaagatcaagtcaccacatcaagcacttctttgggtgatagcagtaggccaacagcatctgaccaaagaaataggtcttggagccatgagggccaatcaagtgatgttgcatatgtagagaagcgtcacaaatcaatggaggaagcgttgctacagggattcccatcaagcaatttgaaacaattgctgattgtatgtgccaaagccttgtctgaaaacaacatgaaaggttttgatcagttaatagagaaggctagaagtgctgtgtctataactggggagccaatccagcgcctgggtgcttatttggtagaagggcttgttgcaaggaaggaggcatcaggaaataacatctaccatgccctaagatgcagagagcctgagggaaaagacttactctcttacatgcagctactgtatgaaatctgtccctacttaaaatttggttacatggctgccaacggcgctattgctgaagcatgtaggaatgaggacctaattcatatcatagactttcagattggtcagggaactcaatggatgacacttcttcaagcacttgcagcaagacctggtggagctccccatgtgcggatcacagggattgacgatcaactttctaaatatgttcggggtgatggattggaagccgttgggaaaaggttggctgcaatctctcagacatttaacatcccagttgagttccatggcgtgcctgttttagctccagatgtgacaaaagacatgcttgatgttaggcctggtgaggctttggctgtgaacttccctttgcaactccatcatacagctgatgaaagtgttgatatgagtaatccaagggatggacttttgagattggtgaaatcactttctcccaaggtaactactttggtagagcaagaatcgaacacaaataccactcccttcttcaacaggtttatagaaaccttggattactacttggcaattttcgagtccattgatgtgtctcttccgagaaagagcaaggagcgggttaatgtggagcaacattgtttggctcgggatattgtcaacattatagcttgcgaagggaaagaaagggtagagagacatgagctgttaggaaagtggaagtcgagattaacaatggctggctttcgtcaatatcctttgagttcttatgtgaattctgtcataagaagcctgctgaggtgctattcagaacattataatcttgtggagaaggatggggccatgctactgggatggaaggacagaaatttgatttcagcttcagcttggcattga

SEQ ID NO: 104345 - DNA, 231 bp, Glycine max
  Peptide Sequence Number=SeqID_221123
atggagaattggcgaacagcgctacgcaattacttcgcggggctccagactcgaaggtggaggacacatgaacagtgtggagaatggagaatcggcgaacagcgctacgcaacaacttcgtgggactccagacttgttggtggaggatgcatgaacaaggctaggcaaaaaattcatggggctccgaaaaaagtggagaatggagagatggcgaacagcgctacgcaataa

SEQ ID NO: 104346 - DNA, 699 bp, Glycine max
  Peptide Sequence Number=SeqID_221124
atgcctaccaacattgcatgttttagcattgctgtgaatttttatcaaacatttcttctcccccaaggttctagattgttgagaatctcacatcgggtggttggaggaggccatttcccacctatccctccaccacacttagctcgacagcaaggtcgattccatcctcgaccgcctcaacatcctaccaacaccaattctgtttctgtttctagctttcataccatccaacgcatcctggtccgagttcttgtaggaattaagtctcattttgcacccacgttctatgatgaccacaaaggtgccctcactactacaaaagtatatgctgttttggcttgttattttgagtgcaaaatttgcgtttgcttactttctttagataaggccttggtggacccaacaagggctattataaaagaggataatataaattactcttggcatgattttgtctctaaaaataatcaaaatgctttgacaattgttaacgtgtgggctcctgtggttgctatttatcttctagatatttatgtgttttacacacttgtattggctgtctatggattcttacagggggcaagagatcgactgggagagattaggtcatttgaagcactgcatagacttttgagtagtttcctagagcttttatggacacacttcatgttcctctacccaataggtgctgcttgttaa

SEQ ID NO: 104347 - DNA, 276 bp, Glycine max
  Peptide Sequence Number=SeqID_221125
atgaagaagtcgagcctcctctacgacctcgtgtgcaagctgaacgagattcacatgctgaagacaacgccatatgatgagcgcatggggaatcacgagaaccatgcattgcacggctccgttctgcttcagagatatgaggcactaggtgttggagatattggaggtggaggtggatccgaagggaggaccgatgattcaagagacaacaatgaagctctatatttcaaagaacgcgttcgagaaggttcacttgttggaggcaatgcattttag

SEQ ID NO: 104348 - DNA, 519 bp, Glycine max
  Peptide Sequence Number=SeqID_221126
atgagagaggagtcacttggactaattattggggtttccataggtgtggttattggactagttttggcaatttttgcattcttctgccaccgataccatcggaagcgatcacagataggcaatagcagttctagaagggctgctaccatacctattcgcacaaatggtgctgattcgtgcaccattctttcagactcaaccttaggtccagaatcacccataaagtcagatagacatggcatgcccttttggcttgatgggtttaagaagagtagtagtagcatgatcccagcatctggactacctgaatatgcatacaaggatttgcagaaggcaacacataacttcaccacagtcattggagaaggcgcatttggtcctgtttataaagctcagatgtctaccggtgagactgttgcagttaaagttcttgcaactaattctaagcaaggggagaaagaatttaacacagaggtaggttgccaatgtcattttccgttactttggccactccactga

SEQ ID NO: 104349 - DNA, 1092 bp, Glycine max
  Peptide Sequence Number=SeqID_221127
atgagggctgagaatgggttcgggatgagggacgaggtgtgtgagccgcacagggtgaaaaggtatttttggaataactattctgaaaaacttcacatttctgcaatggtcattccacaagatttcgtctcttttgttgcggatttcaaattgaatgtgaaattgattggttatttgtggtgtttgggtgtggtggtggttgcggtgattatggagggtggtgaccaattgagatttttccaagcggatttgcatgaagaaggaagcttcgatgaggctgtaaaaggatgcattggtgtgttccatgttgctgcttcaatggaattcaatgttagggacaaagaaaacaatgaggcttttgttcaagcaaatataactgaccctgcaatcaaaggaaccataaaccttctaaagtcttgcttgaaatccaattctgtgaaaagggttgtcttcacatcttccattagtaccattactgccaaagacatcaacggaaagtggaaatctattgttgatgaatcttgccaaatccaccctgacactgtatggaacacacaagcaagtggatgggtttatgcactttcaaagcttctcacagaagaagcagcatttcaatttgctaaagagaacggcattgatcttgtgtcagtcatatcaagcactgttgcaggcccattcttcactgctaatgtaccaacaagtgttaaagttctagtgtcaccattaacaggtgaaactgagtacttcaggatattatctgctgtaaatgcacgaatgggatcaattgctttagttcacattgaagatatatgcagtgctcacatattcctaatggagcatgctaaagcagaaggccgatacatatgcagcagccaaagttgtgcattgtctgacttggctacccttatttccaaagtgtattcaaattcaaatatctaccagaagaccgagaaaatttatgacaaagttccctctgagatttcatcaaagaagttacaagatttgggctttagttacaagcatgaccttgaagatataatttatcaaacacttatgtgttgcctagactatggttatttacctcctgtttag

SEQ ID NO: 104350 - DNA, 1308 bp, Glycine max
  Peptide Sequence Number=SeqID_221128
atggagaaagaagagaaaaagaagataaagggaaacgttaaggataacatgccaacagtgtggttctctctgaagaagtctttacactgcaaatcggagccatctgatgtacatgaccccaaaacaaggaagcagttgagcacaatcttgaccaagagagcagggaggtcagggtgttcaaggtccatagcaaatctcaaagatgtaatccatggaagcaagaggcatcttgataagccaccaagttgcagtccaagatccatagggagcagtgagttcctcaaccctataactcatgaagtgattctgagcaattcaaggtgtgagctgaagataactggctatggaggattccaagaaggaggggttggaagtggtggtggtggtagcaatgctggtggaggttcaacttttgtggggactttgaggcctggtacccctggccctggagggcaccctacaatgcactactttaacccttcttttaggacttcttccactcctccaaggaaatctcctttcctttcatcagataaagaagggtctggtcctcatggtgctggacttcattctagcaataggttgtctcttgagacagattctaatggctcttcaactgtgacttgccacaaatgtggagagcaattcaacaaatgggatgctgctgaagctcatcatttatccaagcatgctgtgactgaacttgtggaaggagattcatcaaggaaaatagtggagatcatatgcaggactagctggttaaagtcagaaaaccagtgtggtagaattgagagagttttgaaggttcacaacatgcaaaagactcttgcaagatttgaggagtacagggaaatggtgaagatcaaagccagcaaactccagaagaagcatccaagatgtcttgccgatgggaatgaacttctgaggttctatggcaccactgtttcatgctctcttggcctcaatggctcttctagtctctgcctatcagaaaagtgttgtgtttgcagaatcataaggaatggtttttcagccaagaaggagctcaagggtggaattggagtcttcacaacatccacaagtggaagggcttttgagtccatagatatcacttgtgaggaaccatcattgagaaaagcacttatagtgtgcagagtaattgctggcagggttcataggccacttgagaacattcaagaaatggcagcacaaacaggatttgactcattggctgggaaagttggtctctattcaaacattgaggagctttatttgctcaatcctagagctcttcttccttgctttgtg

SEQ ID NO: 104351 - DNA, 108 bp, Glycine max
  Peptide Sequence Number=SeqID_221129
atgccaaagtggcttctagttgcaagaaaactacagatgtcattggagaggacaaaagctaagccatggagtgaaacatggggcagtgtcatacagagtgtacactga

SEQ ID NO: 104352 - DNA, 351 bp, Glycine max
  Peptide Sequence Number=SeqID_221130
atggaaaaatccgacaagatgaatttcaaagagaagaaagaaaagaaaggatatatcacttgggaagataatgtcttaaattattcaagtgattcagagaagaaaatcataagtttgggtatcatgatgaaagactatgaaaatggagaagagcaaagtcgatacattgatagcaatttctccaaacacatggcatgcatcaaagtttattcatatttctccccaagaaaattggaagttggaagtagttattggaagttgaaagttaaaaatggaagttggaagttggaagtggaagttactggaagttggaagttggaaatgaagttattgaagttgaagttgaaatga

SEQ ID NO: 104353 - DNA, 258 bp, Glycine max
  Peptide Sequence Number=SeqID_221131
atgaggatcaaaaggtcttttaaagttgtaatggggccaaggacaaggcttgtagtgagcttcaaaacaaggaaagggaaacaaggctcaaaagggctatcaaaggaattaagtcaaggtaagtccatttggctagaagcttataagtacaaaattgcctcaatcatttccaaatatgcatgtgaattaggaagcatcaacaagaatcaagccaaggctattgtgcaagcaatcaatggggcaaaacacaccaaatga

SEQ ID NO: 104354 - DNA, 153 bp, Glycine max
  Peptide Sequence Number=SeqID_221132
atgtgcacgtatgcaatttttggtagccaaaatgctttgagtatgcatgaaatggccccgaggaagcttgcctcaaagaggtccaggaaggataaagcggccgaaggaccagttccgctcccgagtatgacagccaccgctttagagtgctga

SEQ ID NO: 104355 - DNA, 267 bp, Glycine max
  Peptide Sequence Number=SeqID_221133
atgagcgagatagaggaagttcgggaacagatgaaggccgacatggaggccatgaaagaccaaatgactaccatgatggaggccatgataagcatgaggaaaatgatggaagtcaacgcggctacactcacccatctagtccagagcaagcatctattcccaccgtatgacctgcctctcaactatacaccacccaatgctatacatgtgcccgatgagaacaatgaccactcctctcctataccccttgagagccaacaaccttag

SEQ ID NO: 104356 - DNA, 276 bp, Glycine max
  Peptide Sequence Number=SeqID_221134
atgctctcgggaatggaagcttcgagcacactccagacattttctcaaagatcccaacggtcagatcgtgtacatgtgacttgtaaagctgcagaccaaatttcgatatatatatcagggtgttacattccccgacaacggcgcccaaaacttgttcgcacaagtagtataaaatggtatttaaattatctaggcaaaaagaaagaaaatcacgcaagagaaatactgtgtaaaaacaagttgagaaaagcgttggtcttcctcactggttcctga

SEQ ID NO: 104357 - DNA, 393 bp, Glycine max
  Peptide Sequence Number=SeqID_221135
atgatggggtacgcaccttcaagctttgcggatttggtcttcgccggcgaaaggatcgaagtgggtctgaaaagaggcaaatttgatcatccttctttgatgaatgcaaaaaatcgggcaaatgaagaggatgagaatgagggagaaacccttgttgtgactgtcattcctacacgaccaaatttcccatcatcccaacaatgtcattactcagccaataacaacccctctcattacccaccacccaatcatccacaaaggccatccccaaatcagccgcaagacttacttgctgcacgaccaatgccaaacaccacctttagcacaaaccaaaaccccaaccaagaaatgaattttacaatgaaaaagcttgtagaattcaccccaattctg

SEQ ID NO: 104358 - DNA, 243 bp, Glycine max
  Peptide Sequence Number=SeqID_221136
atggcagctaagctgaattccttgcgacaatatttcggaaacttcgtctctgcattctctctctccaaaaatttgcacattttgcatctgtgctttctttttgcattatcaacttcgaagcaacaaccatacaccatccaagtgttctctgaagaactagctaagcacgcttaccgtgctaagcgaggtcatcctttgaggatgaatactcatcctcttgctgaactacctgtggctaagtga

SEQ ID NO: 104359 - DNA, 513 bp, Glycine max
  Peptide Sequence Number=SeqID_221137
atgagtcttcattcttcatctagtgttaaggaccccttgtataagatattagatgagttaagatcccttaagttgtggaaagaaaaacaagagagaaaagaaaaagtagagtattggaatgatcttaagagtgcccttaggaagaggcaaattctctcctactatgaaagggagcttatggacaagctccaaaggcttagacaagggagtatgagtgttgaagaatatagacaacaaatggaactactccttttaagtgctggacttagggaggaggaaagaacaagcatagctaggttccttagtgggcttaatatggaagtgagggataaggttgaactccttccatatagggaaatagatgagctagtgcaactttgtataagagtggagcaacaaattaaaagaaagtcttcttcaaaatcttatggctttcactcttatccaaggaaggaccaagcccaaggaattttgggggctgcaccttcaaaacccaaggaagataaggggtaa

SEQ ID NO: 104360 - DNA, 255 bp, Glycine max
  Peptide Sequence Number=SeqID_221138
atgagaaaaagtgatagggcacgcgattggaaaaaacaaggaaaagctttggagaccgaagcagttagaactcccaaggatcgaagaaggaaccctagcgtttgtagagagcaaagatccactccgttggtggccaagccactgggcagcacccaaagacggaaggaacctaggttaccggaaacttctgctcctgatgattttgacagttattgtcaacaaaagttcatgattgctagttatatcatgacttga

SEQ ID NO: 104361 - DNA, 315 bp, Glycine max
  Peptide Sequence Number=SeqID_221139
atggaatacgcacccgtgagcctcgcctcgctcgcccgcaaaagggtaggttgcgacagaagacacactcgtgagcctcgcgtctccctcccgccgaaagattgcacatcatgcttcatgctaggtgtcgcaacctacccttcggcgggagggcgacgcgtgactcgtgggatgcgtgttccaccaaaggaatacgcgcggagtcgccaccaacgtttatttgaggaaaacgtcggaaaaactggaaaagacgtgatctacaaacttttaagtgaaaggttcgggagttgtatttacgcacggggaaggtattag

SEQ ID NO: 104362 - DNA, 672 bp, Glycine max
  Peptide Sequence Number=SeqID_221140
gtaattcaatggcaggagatgacccataaagagttaccttggaggactactcaagcttctcaactccactgtacttcacaattgatacagggcaacctattccaaggattttcaaatgaagatccttacgtccatctagccacttacatagagatatataatacaatcaagattgttggtgttctggaaggtgctattcgcctcaacctattcgctttttcccttgtcagtgaagctaagagatggcttcactcgtttaagggaaatatcctaagaacttgggaaaaggttgtggagaaattcttgaacaaatactttccagaatcaaagacagcacaaggaaaggtagacatatcttcatttcatcaatttctagacgaatcactttgtgaagctctagatcgcttccatggtttactctgtcggactccaacgcatggattcagtaagccaatacaactgaatatctttattgatggcttacgtcctcactcgaagcaacttctagatgcttccgctggagtcaatgaccatgcaattcttcgggatagagcttacattactacaaagaaaagtctacttgagctcacttcccaagatgaattaatggctcaaaacaagcttcatgaccaagcgagcatcatgcgcttagcgggtgaccacttcatctag

SEQ ID NO: 104363 - DNA, 231 bp, Glycine max
  Peptide Sequence Number=SeqID_221141
atgaggtcctccactgtcacgcccaagcttctccagatcgagaacaccattttctccattggcaagagtggaacaatagcttgcagaagctcgcattgttcgcttcttcttgactctgaatcagagtctcctgattctgatgatcgaggagatgttacaaattgtatcagagcaaacctctttcttagtacggtgtggttcaaggatgaactagatggagtgggcatgtaa

SEQ ID NO: 104364 - DNA, 222 bp, Glycine max
  Peptide Sequence Number=SeqID_221142
atggaaaaggtttacaagtcaaggtccttaggaagatccttgaaacttactaaattcaccagctaccctgagctacgcaataagctaggtcatatgtttggccatgaagaagtttgcaaacataaaaggatgtcaaggaatgattgccttgaatatggaggatggaacactacatcgtttcaaagctgcttcgacaattttggccataagggtaactgttag

SEQ ID NO: 104365 - DNA, 867 bp, Glycine max
  Peptide Sequence Number=SeqID_221143
atggttgttgtaccctttgtgcctttggcctttcttgatgacggttcttctcctcctccttcaccctcatcacctcctcaaaaatcttttgcaaaagttctctcaaatgcatgtgatataccattgagacaacttctggtcccttgcttgaaaggcgatgccttatccgttaagataccagaggatgaatacaaagcaagattggagggatgtaaaaacaatcttcatggaaggttgagtctttccaaaggggacactctactcaattatcaatatttgcacatcaaacttgagaagggttttggccatgggttcttggcctttaaaccttggatcactcaaactattctgtcatggttgtttcaccctttgtgccttcaacctttcttgatgacggcgatgccttatccgttaagataccagaggatgaatacaaagcatgattggagggatgtaaaaacaatcttcatggaaggcaaaaaggtctttgtggagaaacaaaaagagccaattattcaagatgatggagtaatcccaccgggtctaagctttgcacaaaagaatgatttagggggatccttgaagtataatcagggtgatgatgcacatatatcaaatcttgatgataattgtaaatcttcagttgagggaggtactcaatcttatgatgagtctttgcatctagacttgcctttagttgatagatttggagcagaaactccagagttgaaggataatcccattgtgcatcaatattttgggatcataacaagtaggaggcttatctctagatggtttcacaatggttcattcaaaatcccaacgcaagaagcttcatggcaacaaaaagaagatggtagtggatag

SEQ ID NO: 104366 - DNA, 474 bp, Glycine max
  Peptide Sequence Number=SeqID_221144
atggtaaaaagcaaacaaaccaacccaatggggttgaaaaacttgttcaccacaccggatctaaccgcagtgagaacctcgacgttgagcacgatgacaaaaatgacccttttggccatgaacctgaagaaactaatgagcaagccaaagaagcaagatagggaggcagtcgaggcttatgaccatgtgcttgacgtggaccatctcggtggtgatggtgatgaggtaggtgaagttccaggagtaggcagtgatggtgaaggcgaggtcgattgtgatgtagccgaaggcgtcaacgaggatgacaaggagggagagggaggtgaggttgtaaaggcagggttggctgtgaaaggtggtgtcggcgagggcaacaagaagagtggtgagggatcagaagacgatgaaggtgtcgacgttggcgtggcagaggagattggtgttggtgaagatggcgaggtagaagatgagtga

SEQ ID NO: 104367 - DNA, 759 bp, Glycine max
  Peptide Sequence Number=SeqID_221145
atgagagaaataattgctattgtcgtgatggttcatgagctatctttcagcattgtcgaggatgaagtatggatgtgggcattccaatatgcaaattctaaatttcaaaaaataagtcgaaaaaacagttggaatcttaaaaaaaaagtcttgagttttgtgaaggtgtctgctccacggcgaggaattgatgtggctgatgccattttgaagtgcttaaaggcatgggggattgaagacaaagtgttttctgtgtctgtcaataacatttcttacaatgactcatgtttgaagaatcttaaagaaaacttatcattgagcagaaagatggttttgaatggtgatctgtttcatgtcagatgttgcacacacatattaaacttattggtgcaagatggcctcggtaagattaaggataccattcagaatgttcatgaaagtgtgaagtatattaaccataatgattcaagactaaaggcattttgtgatgttgctgaacaaaaacatctaaaagaaagaaagctcatcattgattgtcccattaggtggaattccacatttcaaatgttgtcaacaacgttgaagttcaaaactgcattttcaacctatagtgaaagagatccacactatacttatgcaccttcacatgaggattggggaaaaaatgcaaaaggtttgtacacttttgaagtttttaatgtggctacacatataatctcaggcaatgagtatcttactactaatttatatcttgcataa

SEQ ID NO: 104368 - DNA, 1122 bp, Glycine max
  Peptide Sequence Number=SeqID_221146
atggaggaagaaacacatataaagaccatttctcatggagatgaatctcaaaatatattgagtccctactacctccatcctggagaaagtccaggaatggtccttgcttctcctcccctaaatgccaacaattatcacacatggagcaaaggtatgtttagtgctttatggtcgaaaaacaaactaaaattcattgatggtacactaccaatgccaaaaaaggaagatgcaaattataaagcatggcagagatgcaacattatggtagtcacctggatcactcagtccctttcccctcaaattgcacaaagtacaatttatatagataatgccaagaagctatgggatgagctcaaagaaagatttacaaaagggaattatttcataatttctgatttgcttcaagaaatacacttcatcaagcagagagagagaagtgtcactgatttctttacagaattaaagattttgtgggatgagttggatatggtgagtcctactcaggattgttcatgtacagtcaaatatacctctgatttgattaaatcaatccaaaagaaacaggaaattgaaccggtgatatgcttcttgaaaggtttaggagaagtttatggtactgtgaaatcaaatattttgatgatggatcctttcccatccatcaacaaggcttatgccttagtcttgcaacaagaaggacaactgcaaggaaatggaactagtgattcaaaggttttttttttacctcttcaaatcaacagaataatcaagggaattggaggccacaaggaagaaggggtaacaactttggtagaggaaaaggtaatggaatcttgggcagaggagatggaaatgttggaagaggaagaggacacaactatacaagcaaacagtgcatatattgcaataaatttggccacacagttgaccaatgctactcaaagcatggttttccttcgggtttcaaaccaagaaaaaactctgccattaacaattttgtggcatccgagggagaacaaagtcagtctgaaattgataattctctttaaggttcacaaggtggaaccgtcacctctccgagagtgcagttcaaacctgatcaactatagcagttgctcactatga

SEQ ID NO: 104369 - DNA, 2370 bp, Glycine max
  Peptide Sequence Number=SeqID_221147
atggcaacgtactttcatggcagcacttcagaaaccccttcctccgctgaagggttgcagacactttaccttatgaatccaaactacgtagtaccgtactctgacgcggcacaacacccaacgcaaaacatgctcctcgtcaatcccaacaataacactagtaacactagttccacttccaccaacgcgctcaaccttggtaacttctcccacgcgccgccacctccttctcccaacaacaaccgtgaacaccatcatcatcacctgactggggttaccattccctcttcaaacttcctcctatccaacgccgccgccgaccctgctcgatcgtcgttcctcgggcaacatgaattctccggtttccacagtagtgctgccgccaccacaagcacggcggcggcatctcgtggtaacaactataacctatggggttccatatttgatcagtctgcgtcgaatatcatgacatcaactacacacaccccatctagtaacatggggtgtgtcatcggtcattcgacgcagattggtttccacaggcctaatcatttgtcattgagcctttcttcacaacaaacaccatatagttctctctcgggggagactcatgctatttctctggcgaaccgaggcggcggcggcgatgatatgaggggtatgcacaatggagtttctagcatgcatagtgtttctttgggttctaagtatttgaaagcaacacaggagcttcttgatgaagttgtgaatgtgggcaagggaatcttcaaaggggaggaatctatggaaggggataagaaagagaagatgaaagggaatattgaatcctcttcttgggttggtgatggttcgagctgtggaggaggggagaataataataataatgatggaggcaaacaaggagttgaactcagcacagcacagagacaagagcttcagatgaagaagtcaaaacttgtgaccatgctagatgagctctacaaatgcattggttttgatcttgtggaaagtactagggtacttgagtatgttatggctttcttccttgcggtggagcaaaggtaccgacagtatcaccaccaaatgcaagttgtgataacatcatttgagcaagcagcgggtgttggagctgcaaagtcttacacagcccttgcgttaaagacaatctcaaagcaatttcggtgtctcaaagatgcaatctcttcacaaataaagaccacgagcaaaaccttaggtgaagatgattgcttgggagttaaggtagaaggttcgaggcttaggtatgttgatcatcaactgagacaacaacgtgcattacaacagcttggaatgatccaacacaatgcttggaggccccaaagaggcttgcctgaacgtgctgtttctgttcttcgagcttggctttttgaacatttcttgcacccttatcctaaggactccgataaggttatgcttgcaaaacaaactggacttactcggagccaggtgtctaactggtttataaatgcccgagttcggctatggaagccaatggtagaagaaatgtacttggaagaggtaaaacaagaaccaaacaatagctctcaggataacaccacaaaaagatcaaaagaatcaagcaaggagttatggtcagaagctaatgctactgcacaggaatctggtgcaatgagacttgatcacatcaacattctccaatcaaaagcagaaagcttcaacaacaacaacaacaaccaaaccacttccccaacagagatctctaataattcccataattcactccaatcagctggtttccatcttgctgacatgcaaagcccaaacaagccaattagaagcacttctgaaatgcagaactctccaggtagcattctttcagtggacatggaaatgaagcctcgtcatcatggagagacaaataataatactattattactagagaaggcaacaacaacacaacaaagtttggcattgaaagccatggtggtggtggtggtggttttggagcatttcccaatatggaagacattggaaggttccatcatcatcatcatcatgtcactgatcagcaatcactggctcctaggtttcatggaaatggtgtttctctcactcttggacttccacacagcactgagaataataataacctttccctctcaggaactactcatcaacatggattcctctcacagaacatgcacttgggaatgagatcaacaaccaataatgcgaataatgagttttgtggtgccatcaacactactccaccttctaattctcactcaggcaccagttatgagagcattgacattattcaaaacagaaagagatttgctgcgcagttgttgcgggatttcgtggcctaa

SEQ ID NO: 104370 - DNA, 564 bp, Glycine max
  Peptide Sequence Number=SeqID_221148
atgcttgcttctaaaccatgctctactcctatgatcaaacggaacaaacttctatatgatgatactgctcctccctatgaccaaactgcctacagaagaagacttattggacatttattgtatttgaccacgaccagacttgatatttcatttactgttcaacatcttagccagttcatgcaatcgcctaggcaacctcattttgatgtcgctgctcgtgtccttcgatatattaaaggttgtcccgctcaaggtcttttcttcctagcagattctgacttacaattgaaggcttttagtgacttggattgggcaacctgccctactactcgtcgccaatccgcaaggcatattgcttctaatcctaattttcatgagcgcaccaagcacatcaacattgactgtcacattgtccgcaagaagttgcaagccaaattattccatcttctgcctatgccttcttctcatcaaattgttgacttcttcactaagcctttggaaacaaccacttttctgaacttaatgtccaagttgggagtgttatccatccattctccagcttga

SEQ ID NO: 104371 - DNA, 135 bp, Glycine max
  Peptide Sequence Number=SeqID_221149
atgggcaatgccatggttgcacatgctaggatccctcttgaggtatatatggagcaaggtgccttatcacagaaggatcttgtggtgaaggtggaattcttaggaatagtaagggtgttacttcctaagaactag

SEQ ID NO: 104372 - DNA, 228 bp, Glycine max
  Peptide Sequence Number=SeqID_221150
atgtctatgaaacaaagtcatttcaaggatagtcccaatagaccaggcactatagaaattatgatggatatccatgcccatgtacgttgcacttgcacactctatattgtgggattgccttgtttgaagcttttcattggttgcggcactgctcatagacgtgttaaagtaggatacgtcttcgtggttccaatgaagcaaccatttatatatcaaggggttaattaa

SEQ ID NO: 104373 - DNA, 510 bp, Glycine max
  Peptide Sequence Number=SeqID_221151
atggtggtgtgtgccggcgacaaggtaggtgtgaggtcgcgtggagcagatctggtggcagcatatggtgctacgacggtggtggtcgcagatctgatctatgagaagatcgtgcgcgaagatcatagcagtggtgctagcgaagggatagtgcgatggtggggcgattggattctgaatggacgtaagcttgatgcatatgcgaatcgagtccatggcaaggttcacattgtgcgtctcgatgaaggtgtcaagcaacgagaggagcgggcatgtgacatgctagagcagacacgcgatgtgctgcaaatccatcaaaaccatatccatcgttgttggttgccaaacaacttccttgttcttgacccttccttgcttctagcttttgtcgatgcatcagaaatctcaaggaagaagattgctctcattgttgatgtggagtatgagacgcagaaggagaacacaaatgtggtttcgagttttgaagagcaaaagtcttgtcgttgttga

SEQ ID NO: 104374 - DNA, 1254 bp, Glycine max
  Peptide Sequence Number=SeqID_221152
atggcagaagttgagatccctcaatattttgtttgtcccatttcgtttcagatcatggaggaccctgtgaccactgtgacaggcataacatatgatagagaaagcatagagaagtggttgcttaaggccaaagattgtgtgtgtcctgtttccaaacaacccttgccgagaagctctcaatacttaacacctaaccacactcttcggaggttgattcaagcttggtgttcagcaaacacttccaacggtgttgatcgaattccgaccccgaaaacgcctttgagcatggtccaagttcagaagcttctcaagggtcttgaggttccttgttcttatcaaaaatcattggagaagttgcatggcttggctacaactgagaggaacagaatctgcatggctgaggctggtgtggctaaggccatgatcaaattgattaacaagagtttcaaagaaggaaacacaaatttaaacaacaccacttgcatagaaaaggttttgagaattgttcatgttctttggagcaatgatcaaagtagcatgaaaagtactctagttggggagaacaacttggacttcatcaactccttgacttggattttgaaggttcatttggatgacaacaacatcaagatggtgaacgaagcaatgccccttttgaagttgacaattgaagttgctgctgactcaacccttttggggagtttaggccttgaattcttcaaggaaattgtgagagttttgagaaagagagcactactctctcaacaagccattaaatcagctttgtgtgtgcttacagaaactagcacttcaggtagaaacagaacaaggattgttgaagcaggtgcagtcacagaactcatagagcttgagctagagaagccagagaagaacatgacagaactcatattcaaccttctggcactcctgtgttcttgtgctgatggaagagaacagtttctgcgacacgccgcggccattgcagtggtttcaaagagggttttgagggtttctgctgccactgatgacagagcaattcatgtgttttcagttatagccaagttttcagcatcaaatgaggttgttctagagatgttgagggttggagctgtgtcaaagctttgcatgcttatgcaagctgattgtgcttcttatttgaaagagaaagcaagagacatccttaggttgcactccaaagtttggaacaattctccttgcatacaattgtatttgttcactaggcaccaaaggtga

SEQ ID NO: 104375 - DNA, 540 bp, Glycine max
  Peptide Sequence Number=SeqID_221153
atggttgtcaagtctcaaagcataccccaacacgtggtggaccaagaagaattctttggagaactccgcaaatatgacatgcgcctcaaccctgagaaatgtactttcaaggtacaaggaggcaagttcctcagcttcatgatcacacaccgagggattgaagccaacccctacaaatgcactaccatactaaagatgcgtagcccaaccaacatccaagaagtggagaagctaaacggtaaactagcatccctatccaggttgctcctaaagctcatcgaaaaggtgaagccattctacaaactactcaagaaaattgagcccttcctatgggacaagactttagctgacgaagccgttagcttagtgtcgcaacgtgcccttcgcgggcgagcgagggcgaggctcacgggtgcgcttcccaaaggaggaaagatgcgtggagtcgccaccaacatttatttgtggaaaacgtcgggaaaaccgaaggaaaccggtcaaaaagaaaattctaagttcgggagttgtatttacgcttga

SEQ ID NO: 104376 - DNA, 419 bp, Glycine max
  Peptide Sequence Number=SeqID_221154
atggttagaacacgaggtttaggtcatgctttagctagggttataggcagaggtagacaagatgagcatgatgcagtcgatgtgactaaggatgttcctcatatggcggaggatgttcctcaggtgactgaggatttccctcatatggctaacgatgttgctcagaggagtgaagatgtgcctcagatgaccacggacgtagatgcgaatgttgcaaaggacttaggtcgtgatggtgctgaggggtcacatgctgatgagggattccctggtgggccccgtgacccatcagttttgacttcatttgcggagcatgtcgcacatgccatttggactggacatgagcgtcctgagctgaagttggtgtcgcacggaaggaaggtggcgttaattgggaggccagtgcctgcgattgaagg

SEQ ID NO: 104377 - DNA, 360 bp, Glycine max
  Peptide Sequence Number=SeqID_221155
atgaaaatccggaggaccgagtgcctcccacgcccagtcgtactcataaccgcatcaggtctccaaggattggatctgagggctgggcacgggagtcccagtcccgaacccgtcggctgtcagtggattgctagagctgcttccgcggcgagagcgggtcgtcgcgtgccggtcgggggacggattgggaacgggcccttcggggcctcttccccgggcgtcgaacagtcaactcagaactggtcgagagagtctgatcttgagctttggcccgattgtcctaaaaggagctatcagctgcttgctcctccaaattggcaagttcttgctccattagctgtagaccagaagattctttaa

SEQ ID NO: 104378 - DNA, 216 bp, Glycine max
  Peptide Sequence Number=SeqID_221156
atgggaaatcagattcaagtccttatcaccaagatccaacaagttgctatttcctttgattcacaaactgatagtcaacaagctgaataccagaatgaaatagaataccagagtgcagagaaacagaattatgcagctaacccaaattatgcagagaacagacccaagaggaaaagctcagcacctacatatttgaaggactacaacttaggctga

SEQ ID NO: 104379 - DNA, 216 bp, Glycine max
  Peptide Sequence Number=SeqID_221157
atggctgccatgcctgaggataattctcctgacttaagagaaatagcaagaatccttaatgacatatttgagggcatgattgccaattggtggatgatattccagttgaaaagctgtaaatccatgatgtacccgtggatcatgtcatttttacaaatacatctatccaaaagcctcaaggttgcttatgtttggaattttaagggatccttataa

SEQ ID NO: 104380 - DNA, 213 bp, Glycine max
  Peptide Sequence Number=SeqID_221158
atgggtttaatcagcggaaagttgctaaatgaattatggattagttggtataaagtagcacataacttggtatttgcagatttttattccctgaggaaggatgttgaaattatgtcacagcgtgttgaagagattaaagaatcttctggtctacagctaatggagcaagaacttgccaatttggaggagcaagcagctgatagctccttttag

SEQ ID NO: 104381 - DNA, 3783 bp, Glycine max
  Peptide Sequence Number=SeqID_221159
atggcggaatccacaagatcgaaggccaactctgaccgtttagaggaagcaatctctaaactcaccctctcactcaacgataccctgcatcacctcacccataagattgacgagctcattgttaacctgcagaaaccagaaacacccagcaactcaccttcatcttcttcgaccacttccccacctgttacttcttcgtctccacaccgcatgaagcttgaagttcctcgattcgacggagctgaccccctcggttggatcttcaagatcaacccgttcttcgagtatcacgcgactccggagcatgaacggttgaccatagcgtcgttcttcatggacggccgtgccctggcttggttccagtggatgacgagcaatggacaattcacgtcctggcccgttttcctacaagccctgcaatccagatttgcaccatcaccatatgaagaccccacaggtgccttgttcaaattaactcagaagggaacagtcagcgcttacctatccgaattcgaggacctggcaaatagagttgtggggttaccctcccacttcctcctgagttgtttcgtctcgggactgtcttcggagatccgaagagaagttcaggcacatcagccattgacgatggctcaggcagcgggattggcccgtttgcaggaagagaaactcttcgtcgcgcgtcgccagggacgtaatagggataagggtctgtgtttcacctgcgatgagaagtatcatcgtggtcacagatgcccttctagagcattcctgctaattggggacgacgacgatccctcttatgaagacactctgcccccagacctaatacttgacccacccgaagacccgagtccgaccccggcccaaatcagcatccattcactctcgggtcacccggaccctgagacattaaggctcctgggctatatcaatgcacaccctgtggtgatattagttgatgggggaagtacccacaactttatacaagctccgttagccaagctattgggcctatcttcacgcaccaccaatccgctaagtgtcatggtgggaaatgaccagcatttgagttgtgatcagctctgcgaggacgtcccggtgtggattcaaaacaagcaattcacggtggacctgcaccttcttcccctgagtggtgtcaacctggtgcttggagtgcaatggctcaaggccttgggacccatactcacagactacaacaccctctccatgaagttctttcacgatggcaatttggttgaattaaaaggagatgatgcttccactttgagtctcctctcccatccccagcgagaccttatacgcccaagtatcagtcccttctcatccccagttctattggtaagaaagcatgatgggtcgtggcgcctttgtgtagattaccgggcccttaatgcgataaccatcaaagaccgatatcccattcccaccattgacgaactattagatgagttgggaggtgctaactggttctcgaaacttgaccttttgcaaggatattatcagataaggatgcatgaatccgatgtggccaagactgcgtttcgcactcaccacgaccactatgaattcgaagtgatgccgtttggtttgtgcaacgcaccttcgtcgttccaagccaccatgaatggcattttccggccttaccttcggcgattcatcatcgttttctttgacgacattttaatttatagtcgtacattgcctgagcatctcattcatcttgagcaagcattcgagaccctccttcacaaccaattcgtgctcaagttctctaaatgctcatttgcccaaccacaagttgagtacttgggtcatgtggttttgggtcacggagttgcacccgttgcttccaaaattcaggcaattgatcaatggcccatccctaccactaccaaagctttacgaagcttccttgggctcgcagggttctaccggagattcatacgggggtatgcttccattgctgctcccctgataaaagtcactaccaaggacccctttgagtggaccaccgaggctgatgaagctttcaaagccctcaagactgcattaatatcagccccagtcctcgtgttgccaaacttcactcttccattcaccttagaaacagatgcttcaggagtgggcatgggagctgtgttatctcaaaaggggcatccaattgcgttctttagtaagccattcacacccaggatgcttcaagcttcaacatatgtgagggaattatgcgcaattacaaccgcggtcattcaaatccctgagcagcaaatgtatttagctagactcatggggtatgactattgcattcaatatcgttctggtaacactaatttagtagcagatgctttatctcgaagaatggaagcaacagagagcactctgttattgttatcagtcccttgcctaacatttttagaagaactgaagaagcaattgaatcaggaactctcttttgtggacttcatagacaacatcaagactaatcccaccaaatttcctgattattcagtttctaatgatttagttttgcagggaaatcgcatttggcttccacagggcattccctttctgcaagtgcttctcacagagtatcactcaactccgacagggggtcatatgggagtcgcgaaaacgttagccaggctcactgagaatttttattggccaggggtacgccacgacgtgaagcaattcgtggccgcttgcgtggactgccagcagactaagtacgagaccaagagagctgctggtctcttatgtccgttaccggtgccgtgccggccttgggaggacctctccctcgatttcatcacgggccttccttcatttcatggccatacaaccattttagtcgtggtggacaggttctctaaaggggtgcacctgggtatgttaccaacccaacattctgcttacgccgtcgccacattattcatgaatactatcggaaaactccatggcatgccacgaagcttggtctcagaccgagacccactctttatcagccaattctggaaggagttgtttcggttaagtggcacacagctgaggatgagctcagcttatcacccccaaacaaacggccaaacggaggtgctgaaccgggtgcttgagcagtaccttcgcgcttttgtccacaagaaaccttcttcgtggggtaagttcctcccctgggccgaatggtcctacaatacgtcccgccattcaggaactggtgtttcccccttcgaggtcacctttggccggaggccaccagattggccatcatacgttacaagtacctcaaaagtggaagctgttgacgagtttctgactgatagggagtccatttttcaagacttaaagaaaaagcttcagaaggcccaggtgcttgatcgaattggaccagttgcttataagctggaattgcccgacagtagtcgtatccaccctgtgtttcatgtttccatgttgaaacaattccatcaagtaaacacgactcccactcacaccacccttgctttaccaccagtagctggcttacttcccgaagatgctacttgggaagactgggaagcattgcaagcagaataccaccttgaggacaaggtgactttcgaaggccctgggaatgatagtcaacaagctgaataccagaatgaaatagaataccagagtgcagagaaacagaattatgcagctaacccaaattatgcagagaacagacccaagaggaaaagctcaacacctgcatatttgaaggactacaacttaggctga

SEQ ID NO: 104382 - DNA, 414 bp, Glycine max
  Peptide Sequence Number=SeqID_221160
atgggatgcacactcacatatcaatttgtagttgcattccatacggacagaaacttgattgagataccatcaatctaccaaaagcaatgggttcctcactatccatcgaaagtgttattcgcatataatggaagcagctacattataaaagttataaaaattgacgacaaatacttctttgctgatggtttgaaggaattcaggaaagcgttgaacattcaagaaggtatcatcatcatttatgctgcttcagagagagattggatattcaatcttcacttcatgccaccactagataatcaaacatgtggaaggcctccagcaactcgaataacacatgtttggactatagaacttactgaagctatgatctcagctcctcgtccattggtaggactccattcatataattaa

SEQ ID NO: 104383 - DNA, 684 bp, Glycine max
  Peptide Sequence Number=SeqID_221161
atgtggggttgccttcccggacatgaccatgtcatctttgttcttttggaggatcctctcatgagtcagagaacaatccaaagaaggatcctctcatgctttggctcactggtggccctgagcgacgcaagtagtagaatggaaggctggttgtaccttatacgcttcaaccgtattggacttcagttctctcggaagcgttacttcgttctcgatggtaaccttctccgcagcttcaaatcagttcctgtttcaaataatcagtttggagcaagccgtcctgaagaagcggcgaggtggattcaatcctttcatgaagcatcgttaaggggtgcgtctgatggaggagatgatgttgtaggttgttctaagaggggatggcaatcctttagactcagtggatcttctagtggtataaagtcacccaaattttgtagacctggactctttcttctgctgatgtcattgccctttcaccatggacaatctttggctgccaaaatggtttacgactattcaaggaagcaaaagacagggattctaatgggaagaagccatcttctagactcttatgtcgcttggtccttcaagataagagtaagttcatcaattgcacgtcacctttcagcagtggcattgttacatacttattttagcatgacatatcttaataatgttgagtag

SEQ ID NO: 104384 - DNA, 321 bp, Glycine max
  Peptide Sequence Number=SeqID_221162
atggctgatggaagagtagctggggagaaaaagagatgtgtgataagatatggaagatacaccataatactatggactgagataaggtatggaaggtacaccataatactatggaatgataaggtcttgtctattgtcattgtcattattattccaatcacttgcactatgcttgcctcatcgataactgagattcaaaagtatgatttgtttccgtctcccgtgacattgtcacatcgtgccctccgtcaaccccaggctgctccatcgtctcatgtgccgctccgccatcgtcttggtttgactacggaggtcaactag

SEQ ID NO: 104385 - DNA, 339 bp, Glycine max
  Peptide Sequence Number=SeqID_221163
gggggatttaaggaagtgaaatcgctgctggggttgctactctgcgcgctgcaacttagtctgcaacctccctcggaaacggcttttgcgtctcctgcacccccgaaactcgccagtcagagctgcgatttcagcagtagtggcgaagtcgccagttgcactggcgagatgccctttcacatgaagtcgccagcaccgctgacggtttggccttccacgtgtcgtatggtagcgaagtcgcctttgcaagttgcggtttgcttggaaattgcatgcagctcccgtaaaaaagaacaccatgccggaaattgttccaaaaggaccccatttgaggaataa

SEQ ID NO: 104386 - DNA, 174 bp, Glycine max
  Peptide Sequence Number=SeqID_221164
atggcgtgggccattcaacaacagagagaatcttctgcgcatttacattgtcacagtcataagagatacacgggcctcaggattggattaggctcagacaaaagaaatgtaacatgtgtctatacctataagaaaggtaatacaaagaaaccaccaaaggtttcgtccagttaa

SEQ ID NO: 104387 - DNA, 682 bp, Glycine max
  Peptide Sequence Number=SeqID_221165
atggccatcggtctgccgacgccgcgcccggcgctgcggctggtcaaacagagcgacgatcagatccacctgtgtttcagtaaagacggcggggaagagctgaccgacgaaatggcccgctggtctgcggagcgcgtcaaatcgctgcaccacctgtgcggctacatcctgtgtgccaaatcgccgagctgcggactggagcgcgtgcgcgtctacgagcctgacactaacaacaatcgcaaagctggcaccggtgtgttcacctcgttcctgcaaaaagagctgccgtggctgccgctggaagaggatggacgcctgcacgatgatgcgatccgcgaaaactttatgggacgcgtctatgcgctgcatgagttcaacgaaatgtggcgtagcgggctgacgcgccacaagctgattgccttccacagtcgctacaaattactgctgctgtcgcatgcgcaggatgagtaccgcgagatggggaggtttgtcgcggcaatggaacagtgggagtcactggatgcgtacgcctttgaataccgtaaccgtcttatgcacctgatgtcgcaccaggcgtcgcgtcgtaatcacaccaatgtgctgatgcatgtacagggctatttccggccgaagctgagttcaccgcagcgtcaggagctggcgcagctgatcgaccgctacc

SEQ ID NO: 104388 - DNA, 513 bp, Glycine max
  Peptide Sequence Number=SeqID_221166
cgccacggtttgaaagagcgtgcgcagacgtggatcgcccggatcaaaactgccaccgccggccgtttactgatcgtctatctgtttgtgcgtgaactgactgcggcgctgggactgaccagcctgggcgggcatccgcagatggtgcgtccgctgctggcgccgatggccgaaggtgccactgaaaaccgttacggcagcgtatcaccggagattcgtcagcggctgcgcgccatgtcggcggccaccgataacgtcgggctgttcttcggtgaagacattttcgtggccttcggcgcgatcatttttatgcacaactttatgcaggagtcagcgggcatcagcaccgaaccgttgcacatcgcgctgtggggcattccgaccgcgctgtgtgcgttcctgattcatgctgcgcgactggtgcggctcgaccgtcagctgtcgccaacagtatctgatgtggctggccggggcgatcctgctgattgtcgcgctgctgtcatggcgcgatag

SEQ ID NO: 104389 - DNA, 322 bp, Glycine max
  Peptide Sequence Number=SeqID_221167
atgccgccgcacaaatggtctcataaccactacatgcaattaaaaaggagtatcttaaggcttttcatctctgattaccagaggccacaatccacatattacacaaaattcacagctggccagccaccacaagcctccttgctttgtggtcttgttttccttttatctgttgactgccaggagctcgcctgcttaggtacatcacaggttctcactgaccgactatgcccgggttgggtcgggattggtcaagcttggttttgggcaatagcaccccacctgacgtccccaaggtctcctgacccccgggacatatctccag

SEQ ID NO: 104390 - DNA, 189 bp, Glycine max
  Peptide Sequence Number=SeqID_221168
atgaccaaacctggtctctgcttgtcatcgggcccgccgcctctggatgacaaaagggtgcgaataaccataagaatgaccaaacttggtctctgcttgtcatcgggcccgccgcctctggatgacaaaaggggtgcgaataaccataaggtatctccgcgtatcatcgggcccgccgcctctggatga

SEQ ID NO: 104391 - DNA, 471 bp, Glycine max
  Peptide Sequence Number=SeqID_221169
atgacaagcagagaccaagtttggtcattctgcacccttgtatcatccagaggcggcgggcccgatgatacgcggagataccttatggttattcgcacccttttgtcatccagaggcggcgggcccgatgacaagcagagatcaagtttgggtcattctgcacccttgtatcatccagaggcggcgggcccgatgatacgcggagataccttatggttattcgcacccttttgtcatccagaggcggcgggcccgatgataagcgagagaccttacgtttcattctgcacccttgtatcatccagaggcggcgggcccgatgatacgcggagataccttatggttatccgcacccttgtgtcatccagaggcggcgggcccgatgatacgcggaaatacccgagtggttatccgtataaaaattcttttgctatctgtaagacagaacgcttgatagcatgcagaggctga

SEQ ID NO: 104392 - DNA, 390 bp, Glycine max
  Peptide Sequence Number=SeqID_221170
atgaaggcgagcgcgttcagccctctgaaggtgaggacgtgtagtcctctaaaggtgagggcgtgcaaccctctgaaggtgaggacgtgtagtcctctaaacgcgaggacttatagtcctctgaaggtgaggacgtgtagttctctgaaggtgagggcgtccagcccactgatggcgaggacgtgtagtcctctgaaagtgagagcgtgcatccctctgatggcgaggacgtgtaatcctttgaaggtgagggcgtgcagccctctgatggcgaggacgtgtagtcctttgaaggcgagggcgagcagccctctgaagacgaggacgtgcagtcctcttaaggtgaggacgtgcagtcctctgaaggcgaggacgtgtagtcctctgatg

SEQ ID NO: 104393 - DNA, 189 bp, Glycine max
  Peptide Sequence Number=SeqID_221171
atggcctccttcacaagatccagggctgatctaaagctgatgagacttaaacaaagtgttttcatgacagttgtggctagtggtaaaggcaatattggaaaagtttctgacatgagccggagatggcagcggttgtgcgttggtggtggaggcagtggaagtgagggagtttcagtctttcttgattag

SEQ ID NO: 104394 - DNA, 2799 bp, Glycine max
  Peptide Sequence Number=SeqID_221172
atggttaacataaaggttacttttggggttctttcggttcttcttcttgtggcagcagtcagttctatagaaaagaaggaagcagagaatgattttgttagggagttacttgatccagcatctggattgttagatgagcacacggttggtgtggatgctgtgtttcactgtttccttgatgtctggattgtcttagcctgtcatttctttcatttgacaatcccagttccaataatgcttgatcctgaaagaaaatttggtcgtattttgctccaacacatatcagaaccacctagtccaggtcctgcagttggatcacctacacacagtttagcgccatctcctgaatccagtctagcaccatcatctgaacccagtctggccccatcatctgaacccagtctggccccatcaccttttgctccagcacctctagttcataaaccttcgcatcctttaccaccaacatcatttttcccaaaattgactccaccagaagaagcttcagaaatttcttctccatcttctgacattaacaaactggaagagaggcatagtaataaaaaaacagttgttcttgctgtagttataactgcattggtgacatttatagctgcagcattgctctttttatgctgtactcggcatcgtaagactggccatttcagactcaatgatgataggcctcttcttagcttgagcatgagtgactactctgttggtccttccagttattcgttcggaaattcaataaaaggggagaaagttgagtttcagtcatcaagtaatggtttggtggacaataagaagtattcagtgcaggaaagccaatcaataggagctcttaatgctgctgctggatcaccatttgaactgaaacctcctcccgggagggtgggagccacaatcctttctggactgcctcctttaaaacctcctccaggcaggctaaaccctcttcctcctgagccaccttcatttagaccttctggtgatgcagctccagctgctgttgctgctgttgctacagctcctcctcctgcccctcaacagcctggtttgagtagcactctaccaccccgaccaccagctggtgccagacctggcccacctctaccactaccgccagcactagctggtgcgagacctggtcctcctccaccacctccagcatcagttggtgtgaaacctggtcctcctccaccaccacccacagcaccagctggtgccaaacctggtcctcctcctccaccacccccagctggtgccaaacctggtcctcgtccaccaccacctcctatgagtggtgtggctcctcctcgacctccaccctcgtttggctcaaaggtgccgcggccgttagctagtggatcaaaagatacagttgtagctggagtagaaggtgaagctgatgctcccaaagccaagctaaagcccttcttctgggataaggttcaagctaacccggatcagtcaatggtttggaatcaaatcaaatcaggatctttccagtttaatgaagagatgatagagacgctttttggctataatgctgtggataagaacaatggtaaaaaacagaaacagtcttcctcccaagacccttcaccactgtttatccagatcattgacaaaaagaaagcacagaatttattgattctgttgcgtgcattgaatgtgacaatggaagaagtttgtgatgcactttatgaaggacatgagctgcccccggaattccttcaaaccttgctgaagatggcaccaacatcggatgaagaacttaagcttagactttttagtggtgatctatctcaacttgggcctgctgatcgtttcctgaaagccatggttgacattccatttgcatttaagcgaatggaagttctccttttcatgggctcacttaaagaggatcttgcaactactatggaatcttttgccattttagaggttgcttgtaaggaactaagaaacaaccggctgttcctcaagcttcttgaagccgttctcaaaactggcaaccgaatgaatgatggaactttccgtggtggtgcacaagcatttaaacttgatacacttctgaaattatctgatgtaaaaggaacagatggcaagactacactcttacattttgttgttctagagattatccgctccgagggcataaaagccatcagaaaggcaaaagagagccagaaatcgtctagtattaaattggatgaccttcacgatagtacccgagaaacagaagatcgctaccatgaaatcggtcttcaggtggtttcacgattgagcagtgaacttgagaatgtaaaaaaagcagcaattatagatgctgacagcttaacaggaactactgccaaacttggccatggtctcataaaaacacgagacttggtaaacaaaagcatgaagaatgtggaggaagatagggggttttgtgagacagtgaaaagttttgtgcagaatgctgaggctgatgttatgaaactgctggaagaggagaagaaaatcgtggctttggtgaagagcactggtgattacttccatgggaattctgggaaggatgaaggcaccaggttgttcatagtagtacgagacttcctaataatggtggataaagtatgcaacgaggtgagagatacaaagaagaagtcggttaaaactcaaaaacaagagactcctcgagaagcatcttcatctgaaccacgtccaccacctgattttcgtcagcgactttttccagcgattgctgaaaggaggatggatgacattagttcagacgatgagagtccatag

SEQ ID NO: 104395 - DNA, 849 bp, Glycine max
  Peptide Sequence Number=SeqID_221173
atgagatattgcaaaagtaaatttgctactggtggaactgggtcaagtactacccatttgcattccaaaagttgcattcaaaagaaggctaaaacaactgctgaaagtagacaacccaccattccattccagccttcaaattcaaataacccttttatgattcgcggtgttagatactctaacaaaaagatgagggaaattattgcaactactatcatggttcatgaatatccttttagtgttgttgaggattctatttggatgtgggccttccaatatgcaaaccctgattttcataaggttactcataaaactgcaagaaatgattgtttggcactgattgagatggagaagaaaatattgaagaaattgttagaaagtgtgagcaagatcagtttaactatagatatatggaaatcttgccatcaagtagttgaatatatgactgcatttgcttcttacaatgaaagagagcctcactataattatgcaccttcacttgaggagtggaatcaagttgagaaagtttgtaagctgctggaagtttttaatcttgctcctcatgtcatctcaggtagtgagtatccgactgcaaatttgtatttggcagaagtttggaaggttaaacaaatacttgataaggaaattaaagatgaagatctcttcatgagggaaatggtaggtccaatgaagaaaaagtttgacaaatattggggggaatgtaatatgttgatggctattgcaagtgttttggatcctaggtgcaaatttcatatggtctatgtttacaagagtctacgtctagtgttgctaatttggatgataatatttcatcatcctcccaattga

SEQ ID NO: 104396 - DNA, 294 bp, Glycine max
  Peptide Sequence Number=SeqID_221174
atgtgtatgtactttgatgttaaagccaaaccaatgagccacagagttaacaaggaggcagaatttgcatatggtgctggtcaggtgaaccttacaagaactgtgaaccctggattagtttatgacatggatgactttgcatatatccagttcatatgccatgagggctatgatgttgatcctctctatcaatggcttggccatgatgctataaactatcccaccatgcaactaagtgttaaacaacacaggcacaacagtagtagggtttttaggagaagatttaggatttga

SEQ ID NO: 104397 - DNA, 312 bp, Glycine max
  Peptide Sequence Number=SeqID_221175
atgacttcagtcaagattactcttgcagcgctggttcttgctttaatagcttgcaatgggcttggattcatgggtataccaagaatgctgggcaatggtgaatgtcatctagatgttgaatgcatctcaattttaccttactgtaaagaaaaaactatttgcaataacggcatttgcatatgtgaccagactaaagcaagcctaaaatctggatgtaaaaccaatgctgattgcgcaatctttatttgtgatccaccttacgttataccgtattgtgacataaaacatggtgtatgcaaatgttcgcgttag

SEQ ID NO: 104398 - DNA, 260 bp, Glycine max
  Peptide Sequence Number=SeqID_221176
cggttggattcactagtacaccaaagacgtcgggtcctaatcaatgtcatgataatgctgattgctcaataaagttaccttactgtaagggaatagccttttgtcgtaatggagtttgcgcgtgttacgaagagaaagcaagcataacacaacaatgtcaaaatgataaagattgcattcatttaatttgtgctccgccatgtgaagtttcctattgtgacacaaaaacttccaaatgcaaatgcaagtgtaagaactag

SEQ ID NO: 104399 - DNA, 714 bp, Glycine max
  Peptide Sequence Number=SeqID_221177
atgaaaacccactctgctattatcttctcatacattaatatatctacacagtctgtttttgttcgcttgctgatgatttggcattctggaacttctttaattaaattttcaggaatcaatgcacagagattgaaaatattgtacgagaggcatgtggtatactgcgtatcaaattttcaagtcatccaaatgatgaactatttcggttctctcaaatgttcagtcagctcttcttcatctgacgccataaagaaatatgatgtgtttgtgagcttccgcggtgaagacacaggcaacaactttactgcttttcttttacaagctctccgtagaaaaggcattaatgccttcaaagatgatgaaaatctcaagaaaggtgaattcatagaacccgagctgcgggaagctattgaagggtctcgaattttcattgtggtcttctcaaagaactatgcttcctctaattggtgtttgggtgaacttgcacacatctgctactgtattgaaacatcacgaagaccagttctgcctattttttatgatgttgatccattggaggtgcgtaaacagagtggatgttatgagaaagcatttgtggaacatgaagaaagattcgtagaagatagcaagaagatgaaagaagttcatagatggagagaagctctgaaacaagtggctaatttcaaaagtggttgggatatcagaaataagtaa

SEQ ID NO: 104400 - DNA, 294 bp, Glycine max
  Peptide Sequence Number=SeqID_221178
atggtgatatacgacgtgtttgtgagcttctgcagtgaagacactggcaacaacttcactggttttctttttcaagctctccatctacatggcattcagaccaacaacgatgatgcagatctcaggaaagccgaatccatacccatagaagagtctcgccttttcatcgtggtcttctctaagaactatgcttcctcaactttgtgcttgcaggaactggcaaagatctgcaattgcattgaagcatcatcaagacgtgttctgcctattttttatgatgttgatccttcacat

SEQ ID NO: 104401 - DNA, 243 bp, Glycine max
  Peptide Sequence Number=SeqID_221179
atgaattatctaacaggaaaggttttggaagaccccatgactttgactgcatccaaattgactaatggatccaaactcatgcttgtggcttcccaatgtttatatcaaggggttgcaactttaaaggatgatggttgccccaaagtctgggtagtcacttctgatcactgtcatcagcaagcagcacatggagcttgcaaaagttttatgagcctttatttggagttgcaaggcattggttaa

SEQ ID NO: 104402 - DNA, 444 bp, Glycine max
  Peptide Sequence Number=SeqID_221180
atggtgcacgaaactccatcaggacaaactgcagtgattggaatattgtataaggctggaagaagaccagatcctttcttgtcattgttaacgaaccacttaatggtcatttctaatagtacgggagcagaaagagaagtggatgtaatggatccaaggctggttaaaataggcacaagcacaacactgtattacagatatattggttcgctcactactcctccatgcactgaggatattgcttggaccatgcttaaagaggtgaaatccgtttcaaaagagcaaatcagattacttcgggatgccgttcatgattatcaagaagaggttgctagcaaatccaagaaaaagtccaacaatcttgcttgcattcaagctaaagatcgtacaacaggaagaacagagattgcttcttgtgtcaaggttgctgaggtatggaattga

SEQ ID NO: 104403 - DNA, 2034 bp, Glycine max
  Peptide Sequence Number=SeqID_221181
atgccgccttccccggcattgagatactctcctggtagagagccaagagctgatggtcacaagcgggggcgcagtcttgaaagtggattgcttttccgggagaaggacgatgatcttgctttgttcaatgaaatgcaaatcagagagaaagatagctttttgcttcagtcgtcggatgacttggaagactcattcactacaaagttgagacatatttctgatgtcaaccttggaatctccattcctggtcgaggggaatccagtgagttgcttaatgatggtgacaagaatgattacgactggttattaacacccccagacacaccactatttccttcgttagatgatgagccaccgctgagcagttttggaagcagaggaaggcctcagagtaaacccatttccatatcgagatcttctacgatggataaaagttaccaaagccgtaggggcagtgcaagtccaaatcgtttaagtccatcccctcgatcaggaactaacacattgcaatcaaggggaaggccttcgtcattgccaaattccagcccaaccccaagtgtgaggtatgccactccatccagaagaccatctccacctccaagtaagtccatggcacctgcttctaagtcaacctatactccccggaggatgagcactggctccagtggttctgtagtctcatctggagttaggggaagttccccagtcaagacaaatcgtggaaactctgcgtcaccgaagataagggcatggcaaactaatattcccggcttctcttctgaagctcctcccaatctccgtacttcattggctgatcgaccagcatcctatgtgaggggttcatctccggcatccagaaatagtagggagtctacctccaaattcagtaggcaatcaatgtctccaactgcttctaggagtagtagtcatgatcgagaccaatttagctcacgcagcaaaggttccattgcatcctctggtgatgatgatctagagtctctgcaatcaatcacagtgggtagcttggacagattgagttcaagaaggggtgggtcattttcaaccaacagaactcctgccatttccaagaaaccagccaggattgcgtccccaagttctgctcctaaaaggtcattcgattcggctatccggcaaatggatagaaaaattcctcagaacatgttcagaccacttttatctagtgttccaagtacaaccttttatgctggaaaagcaaattctgcacatcgttcccttgtatctaggaattcatctgttacaacaagcagcaatgcgagctctgatcaaggtacaacttttgcactggatactgaagggagtgaccataatcaagatgatatggcaaacgaagttgataagatattatatcctgatatacatgaagaaatgtttgcctttgataagattgatgcattaaatgcaaacattaagcaagagatgaatagggaatcagtagatatcttgcaaagtgaaaccagaaatcccaagactgtttttggtccgattgaatctgaggattctatttcccacattcgtattgacactagagttaatgaaagttcagaaatttcacatgccaaaggtgacatttctgaaactggtagttttgaaaatacagcactctgttctcattgtggttgttgttatgaggtcactaatcaacctgagaagaatattgggctttgtccagaatgtaagatcacattgttgagagtcatcatccctgagacaactttggcagtatctgaaaactcttcattgattacaacaaacatgccaaaagaagaaaaatcattacctgaaacaaatcaactaatggttgcatctgaattgcctcaagagactaatatgggtaacttgaggtttccccatggtgaacaaaatgctgaggaaaatcaaacttcttgccgtgaactaaaccaggatcactcacaaaacagtcctcttccaaattcattgacggatggaggtaggcagacatctggcaaccagcttgagatgaaccaatcagga

SEQ ID NO: 104404 - DNA, 324 bp, Glycine max
  Peptide Sequence Number=SeqID_221182
atgttgggagttatcggagctggaacgtggttgcgatattcaaaggcccttcttcaaccatggaaggtagggttctcctctttgtccgctgtcgacggccggaaacaccaccttctggatttgcaggagatcgagacggttctcaccgacgttaaagctgacaacgttaaggttataccagttcccaagcactgcgattgggctgatttcatggctaagcagaaacagagaggagttgaacgaatgatgctaccaagtgtggaaggtcaagcaggaggaaagtggatcgtcattgactctggttgttatctcatgcttttttaa

SEQ ID NO: 104405 - DNA, 1246 bp, Glycine max
  Peptide Sequence Number=SeqID_221183
gcaaacagagtttcgtgtgcaaaggcagttgagtggaaggaaattggatgtggactgtggatatgactcaaggatcaagcctccaagcactgcttcatctttctctggagcttcaatccattctcgccaagagttaggtcttgcaactcgagagacttctggcagtacagaatgtggctctgtagaggaggttccccgagttttgcaagaaatgcaagcttcggaaaatacagtggcggacgtaattgatgcttcttcaactgatttagttgtggaggaagataaatttgaacatgatgatagtagtagagtaaataatgcttgcaactcagaacttttgagtcaggctgatgacaatttagtcacttcatttcaaaatcatgaggattgtatttcacctgaaaatgttgatgataatccaaataatgccagggatgtctcagacacagaaacttcagctaaggctccggaattatccagtcatgacaaacaagatgtgcagaattccaatgttaatgaactggatgctttggttacaactaactgctccacaattactgaatcagaaatagaaggggaaaacaattgtgagaataatattggcatggcgaatgatgatctgtcaaagagcatccttgatgactttcgggaaccttccaatgattgtcatgctgtttctgtttcagaggtcaatgtctccgagtcccatcgcattgagggatcaacagttacagttgagtgtcaaggtgcaggcaacactagaagcctgacacttgaagaggcaaccgatacaatccttttttgcagctccattgtccatgatcttgcatataaggctgcaacaatagcaacggaaaaggaatgctccaacccatttgaaggttctgaaccaactgtgaccttgttgggcaaagccaattctgatagaaaggatagtcgcaaccgacctaccagcaagcgcacgttgaaatcccagaagaccaagaccaagcagaggagggtggaaactgatgtcaaaatcccttctggcaagactgagaatgatgaaaatattgatgagtctttcacgcacaatgttgggcttcctaacaagcatttctgcacttccctttggccctacatgggagccaagtcaagtgcttgcgcatttatggttctaggccataagttaagaggcattttggaggactgtgatgtgccccctccacttgctgcattcttgtttgttattttccatctcaattaa

SEQ ID NO: 104406 - DNA, 516 bp, Glycine max
  Peptide Sequence Number=SeqID_221184
atgagtgaggctgcagctacgacgacttcgtcttccatgatgcgcaattaccctctcatttccgccatcgttgctttcgccatcgcacaattcatcaagtttttcaccgcctggtttaaggaaaaaagatgggatcccaagcaacttgttggatctggtggaatgccttcatcccattcggctactgtcactgctcttgccgcggcaatcgggttccatgaaggctttggaggacctctttttgctactgctttggttctagcttgtattcttatgggttatatggttgggcgagtttctgatatgggacattgctggcaggtgatgtatgatgctactggtgtaagattgcaagcaggacgccaagcagagcttttgaatcaaattgtatacgaacttcctgctgaacatcctctggctgaaagcagaccactccgggaacttcttgggcatactcctcctcaggttctccattttgtatttgattgcttcctagtattacttgatgcatcgtag

SEQ ID NO: 104407 - DNA, 3501 bp, Glycine max
  Peptide Sequence Number=SeqID_221185
atgaaactgagtccaagggagatcgagaaactagacctgcataatgcaggctaccttgcacagaaacgccttgctcgtggtttaaggctcaattatgttgaaactgtggctctcatagcaacacagattttggaatttgttcgtgatggtgaaaagactgttgcacagctaatgtgcattgggagagaacttctgggaaggaaacaagttcttccagctgttcctcatcttgttgaaagtgttcaggttgaagccacctttcgagatggtactaagttagtcaccattcatgacctatttgcttgcgagaatggaaaccttgaactagcattatttggttcttttcttccagtagatttgcagaaacacaaactgcaaattgaagcccctactcacattattagtatctctctcttatgggtggaaactgggtctacagtaccttcacttgacaagtttacagagaacgaagaagatcatagaactccaggggaatgtaaaagcgttgtgcttgtaagcattggaggtaacaaagtcatcagaggaggtaataacattgccgatggtccagttaatgattctaattgcagagcagccatgaaagctgtggtcacaaggggatttggacatgtggaagaggaaaatgctagggaaggtgttactggagaagactattcattaactacagtaatttctcgagaggaatatgctcacaagtatggccctacaactggtgacaaaatccgtcttggtgatactgacttgtttgctgaaattgaaaaagattttgctgtctatggtgatgaatgtgtttttggaggtgggaaagtcataagagacggaatgggtcaatcaagtggccatccacctgagggctccttggatactgttataacaaatgctgtgatcattgattatactggaattatcaaagcagatatcggtattaaagatggactgatcatctcaacaggaaaagcaggaaatccagacattatgaatgatgtatttcctaatatgataattggggctaataccgaagttattgctggagagggcttgattgtgacagctggggctatagattgtcatgtgcattttatatgtcctcaattagtatatgatgccgtaacaagtggtatcacaacattagtgggaggaggaacaggaccagctgatggaacacgtgctacaacttgtacaccagcaccaaatcagatgaaattgatgctacaatcaacagatgacatgcctttaaactttggtttcactggaaaagggaatagtgccaaacctgatgaactgcatgaaataatcagggctggagctatgggactgaagctgcatgaggactggggaactacaccggctgcaatagacagttgtttgacagttaacatacatactgacaccttaaacgaatctggatttgttgaacatacaattgctgcatttaaaggaagaactattcatacttaccacagtgaaggagctggtggtggccatgctccagatatcataaaagtatgtggtgagaagaatgtcctaccctcatcaacaaatcccacacgtccttatacacataataccatagatgagcatctcgacatgttgatggtctgccatcatcttaataagaatattccagaagatgtagcttttgctgaatcaagaataagagctgaaacaattgctgctgaagatattttacatgacaagggggcaattagcattatatcatctgattcacaggctatgggtcgaattggagaggtgataagcagaacctggcaaactgctgataagatgaagtcacaaagaggaccactgcagcctggtgaagacaatgacaactttcggatcaagcgttatgttgcaaagtataccataaatccagctatagcgaatggtttgtcgcaatatgttggttcagttgaggcgggtaagttggctgatcttgtattatggaagccgtcattttttggagcaaaaccagaaatggtgatcaaaggtggtgaggttgcatatgctaacatgggtgacccaaatgcaagcatcccaacacctgaaccggtgattatgaggcctatgttcggagcatttggcaaggctggtagttcacactccattgcttttgtgagcaaggcatggctccaatccatctctttcacagacacgcacttgaatagcccttgtgcagaaattattacatggtccaagattactatggcagctttggacgaaggggtgaaagcttcatatggacttaacaagagggtggaagctgtgaagaatgtgaggaagctcaccaaacgagacatgaaactgaatgacactcttccacaaatcactgtggacccagaaacatacacagttacagcagatggagaggtttgtgagtacccattagccatttgcactgggcaagtgtacttgtcagatttcataaagaaaatcatgtccatacaaacagagcaacctcttcctactcacactcccttcctaaattcaaactcaaaccaaagccaccaacaccaaccacaagaaaacaacaacgattatgaaacacaaacacctcttgatgatgtccttgcaagtttagaagtgcttctcacgctacttagcttcaaccagtcttcattgttgagcttcactgtgtcttggacaacgtttgcggtggttggtgtggttgcgccactcctggctcttcaggtgtatgacaccgacaaaaatcagataaaaggttttgaaattggcattgttgcatttcagacttgtctagctgccgtgtccttgatttgcctctctcacaatcttcaaaaatatggcctcaacaggttcctcttggttgaccatcacgctgctcacatgccatgctttcaccatgatttcgcccgagaaatcactcaccttgccttcgtagaacacgggtccctttggccctccattgctgttttgttggctctgatagtatcatggacttatgtgagtgcaatctctttatcagcctgtgttctatttcacttggtctgcagtttgcaactcgttcactttgatgattataggaaactcttgcaaagggaatatgatgccttgttcttggtggtcacagctagccaatttgtgactctattaccggtctctggatttggtggagcactgactttcataagtggtggagattttgctgttttcacacttgttaaggtggttgggattattattgttctgcatgcagcaacaaagatttcacttagagcacagggcattgtttcccttgcaagcaggtggcatgcgcttgtaacatgcacttctgatccatctaaactgagatattgtgctagtacagggagcttggaagctgcaaaacatttaaactcaatatttttggattactcagaaagtgatctagactcatcagattacattgttgtgccttcaaatacccagttagcttcttatatgtcctcacatcacaagagacaagcctttggtacgtaa

SEQ ID NO: 104408 - DNA, 1137 bp, Glycine max
  Peptide Sequence Number=SeqID_221186
atggggtttctaaggtttataagaaggtatagtttccccttcaaggacaaaactcgaaatagagcatatgcacttcagcatatgcaaagcagaggcttctcaaaggatggagttcttaatggtaatgatgtggtgcatccagttctgatcattggcgcaggacctgtgggtcttgttctttctattcttctcacaaaattaggtattaattgcacagttttggagagaaacaaggcattttcaaaacatccacaagcacacttcatcaacaatcgatccatggagatattccgcaaaattgatggccttgttgaagagatccaaaggtctcaaccaccagtagatttatggaggaaatttatatattgtacttccctctctggttcaattcttggatcggttgatcacatacaacctcaagatcttgagcattttgtcagcccggtctctgttgcacacttctcgcagtacaagctaactatgttactactcaagcgacttgaaaacctaggcttccaaatatgtgcgcctgaaagtttggaaggaaatgaacagtcttgtgagaaaaaaataatgatgggccatgagtgtgtttccattgatgccagcaatgactttgtaacagtaactgcatcttctatcattaaagggaagcgtgtagaacagaacattcactgtaacatccttattggtacagatggtgcaggaagtactgtaagaaagcttgtaggaatagaaatgagaggtgaaaaggacttgcaaaaacttgttagtgtccatttctttagcaaagaccttggacagtttttgcttaaggagaatcctggtatgcttttttttatcttcaatgctgaagctattggggtccttgttgctcatgatctcaggcaaggggaatttgtattgcagatacccttttatccacctcagcaaacaattgaggatttcaatccaaaggcatgtgagaaattaatcagcaaacttgttggtcgggagtttggagatgtagatgtaattgatataaagccatgggttatgcatgctgaagttgctgagaggtttatatgtagtggcaaccgaatattacttgctggtgatgctgctcatcgatttcctcctgctggtggatttggttag

SEQ ID NO: 104409 - DNA, 474 bp, Glycine max
  Peptide Sequence Number=SeqID_221187
atggaggaagtgcctaacaagtccaagctccaagctcaaaagacaagagcaatatactgtattccaggagacggtagatgtttgtttagatctgtggtttatggtgcatgtctaagatcaggggaaccatctccaagtcttagcaggcaaaaagaactcgcagatgaactcagagccaaggttgtggatgaattcatcaagaggagggtagacactgagtggtttctagaaggtgactttgatacctatacagtacagatgcgaaagcctcacatatggggaggagaacctgaacttctcatgtcctcacatgtcttacagatgcctataacggtgctcatgcaggataagagttcgagtaaccttaaagttattgcagaatacggtcaggagtatgggaaggataaccctattcgagtgatctatcatggttatggccactacgatgcattattgaagagttccttccactag

SEQ ID NO: 104410 - DNA, 2364 bp, Glycine max
  Peptide Sequence Number=SeqID_221188
atggcggctagtagacatggaggttatcgtgacaacgagtttagggaccgtgagtccaattttgatgtttcaaggcggggtttcaataataattctaaacaagagtatgataagattacgaatggtggccgcgatgttgtgagggttgggagcaaggatgcaagagataggcttagtctgaaacaaaaagatattagggacagggaagctccaaatggtagttaccggtcatcttcgagtaagagcgactctggcagtagtggcgggtgtagtagtgggcttggtcccagaagatgtgagttttctgttaagactatggatagagagcctggtgagctttctagtgaaagtgggtctgatgatgatggtattgaatcaggatcacaggaaaaatactgtgaggttgcaacaggtgaaggaaaccgtgcacgatctccactagagaggaaaagaaaattttctccaatagtatggaatcaggatgacagcgaagtcaataatttatcaaaacttagggttgtcacagcagtgactactctgcctccacttccaatagtccgtctgtcacctaatgttcccgatagaggagttgaaactcatcctgtcaaaaacacagaagctgagattcttgagttaccaactgtaactaaccctcctttgctgtctgagtctcctgtaggtttgcattcattgttgccagagcagagatggggtaatgagcaggaagccaagcaacctgaaggtgaagattttattccaactcataatatatcatcttcaagatgggcatctggtgataactctcctggtgatgaaggtgaaatcaatgatgacaaggaaatccttaagaggaggaagctatctcctgagctgggtatgagagtaagaaacaagatgttgagactagaggaatctaacatagaagattttgtagaagctagagccaaatcatctgaatctgaagaaagaagtagccgtgggagatcatccagtggagattatcatcctggtaatttgtcagggaaggatgattatatggagattgatggtcaaggtagcagaagtgaaactagtggttatcattcggatacagatttggaagatgattgcagagaaacttctgaacctccggttccaccacaaagagttgtcaacatgcttcagggttgtagaagtgttgatgagtttgagagactgaacaagatagatgaaggaacatatggtgttgtatttagggcaaaagataagaagactggtgaaattgtggcattgaaaaaggtgaagatggagaaggaaaaagaaggttttccattgacttctctcagggaaataaacattcttctttcctttcaccacccatccatagttgatgttaaagaagttgtggtagggagtaaccttgatagtattttcatggttatggaatacatggaacatgatcttaaaggactaatggagggaatgaagcagccctttagccagagtgaagtaaaatgcttaatgctccagcttttagaaggtgtgaagtatcttcatgacaactgggtgcttcatagggatttgaagacttctaacctgcttctgaataataggggcgagttaaaaatttgtgattttggattggctcgtcagtatgggagcccattgaaaccatatacccaccttgtggttactctttggtacagggctcctgaacttcttctggggacaaaacaatattcaacagccattgacatgtggtctctgggttgtataatggctgagctattgtccaaggaacctctatttaatgggaagactgaatttgaacaacttgacaagattttcagaattcttggcacaccaaatgaaacaatttggcctgggttctcagaattaccccaagtcaaggtcaattttgtcaagaataagtgtaatctcctgcgtaaaaaatttcctgcaacatcattcactggatcaccagttctttctgattctggatttgatttgttgaacaagcttctaacttatgaccctgaaaagcggatcacagctgaagaagctctaaaccatgagtggtttcgtgaagttccccttccgaagtctaaagaatttatgcctacattccctgctcaacatgctcaagacaggcgaatgaggagaatattaaagagtccagatccattagctgagcagcattggaaggagatgcagcagggtgaatcagggactggtggcgcttcttgttggtttgtgtcgagatatgtattctttacttccttggagccagatctatttcaggttaacctctttatgctttatcattatattgaaatgcacatggggcgcagcttgcgcataaagtctggcatatttgccttctga

SEQ ID NO: 104411 - DNA, 2328 bp, Glycine max
  misc_feature (2159)..(2159): n is a, c, g, or t
  Peptide Sequence Number=SeqID_221189
atggatgttgttgaggctgaagaaagtttttttgcagcaagcgatgccaagttacatggagaaatgtgcaagtgtctttttgcaatatattgcaagatattgtcattatttccttctttagaagctgctaggcctaggagcaaatctggaattcaggcattatgttcattgcatgtagccttagaaaaggcaaagaatgttcttcagcactgctcagagtgtagtaaactttacttgagtatcttacatataacttcacttataacgcaggctataactggggattctgttctgctaaaatttgagaaggctaaatgtgctctcgaggacagtcttaaacgggtggaagatattgttcctcaatctattggttgtcagattgaggaaattgtgaaagaacttgcaagtacggtatttgcacttgacccatcagagaagcaagttggggatgatttaattgcattgcttcagcagggaagaaagtttagtgactctaatgatagtaatgaacttgaatgttttcatctggctgctactagacttggaatcacttcttcaagaacagctcttacagaaagaagagctctaaaaaaactcatagaaagggctcgtgctgaggaagacaagcggaaagaatcaattattgcttttcttttacaccttatgaggaaatattccaagttatttagaagtgagttctctgatgataatgattctcagggttctcaaccttgttctcccactgttcagagatctcttgaggatggcattcccggtggtcattgtcatgcctttgacagacagctttcaaaacttagttcctttaattttaagccaaataataggaaatcagggcagatgctccttccgccagaagagttaaggtgcccaatatctctgcaacttatgagtgatcctgttataattgcttctgggcaaacatatgaaaggatttgtatagagaaatggttcagagatgggcacaacacctgcccaaagactcaacagaaactttcacatctttgtttgactcctaattactgtgttaagggtcttgtggctagttggtgtgaacagaatggagttcctattcctgaaggccctcctgaatctcttgattttaactactggaggttggcattatcagacactgaatccacaaattcaagatccgtaaacagtgtcagctcttgcaagttgaagggtgtcaaagttgttcctgtagaagagagtggtatctcagagcaaacagggggaaatgcaactgaaagtttttctgcacaagaggaagataatgaacggtatcttagttttcttaaagtcttgacagaaggaaacaattggaagaggaagtgtagagtggttgaacagttgaggctgttgctgcgggatgatgaggaagccaggatttttatgggcaccaatggatttgttgaagcacttatgcagtttctgcaatcagctgtgcttgaagcgaatgtgatggctcttgaaaatggagctatggctctgttcaacttggctgtgaataacaatagaaataaggaaattatgatagcaacaggaatcttgtcgttgttggaggaaatgatttcaaaaactagttcctatggttgtgcagttgccctgtatctgaatctttcttgcctcgatgaagccaagcatgtgattggcacaagtcaggctgtccagttcctaatccagattcttcaagacaagacagaagtgcagtgcaagatagattccctccatgcactctataacctttctactgtgccctccaatattccaaacctcctttcatctggcatcatttgtagcctacaatcccttcttgtaggccagggtgattgcatgtggacagaaaaatgcatagctgttttgataaatttggcggtttctcatgtgggaagagagaaattgatgttggctcctggacttataagtgccttggcttccactctagacactggtgagcccatagagcaggagcaagctgcttcttgtctcctaattttgtgtaacaggagtgaggaatgttgtgagatggtcctgcaagaaggggttatacctgcattggtgtcaatatcggtgaatgggacctcgagaggaagagagaaggctcagaagctcttgatggtcttccgagagcagcgacnacaagaccagtcacctgttaagactgatcaacgtgaatccgaaagtagtgatttgtctatgcctcctcctgaaaccaaactgctatctaaatcaagatctagaagaaaggtggggaaagctttcagctttctctggaaaagcaagagctattctgtttaccagtgttaa

SEQ ID NO: 104412 - DNA, 156 bp, Glycine max
  Peptide Sequence Number=SeqID_221190
atgatggttgggaagaagatctgtaaggtttggttgagagagacaggtattgaggtccgaaccgaagagcgaattgcagggaggaagcgcacgaggacagaggggacaaagggaaagaaagagcaatgccaaattgcaattcttagtaagttctaa

SEQ ID NO: 104413 - DNA, 723 bp, Glycine max
  Peptide Sequence Number=SeqID_221191
atgcttgaatatgcacttaaaaagggagggaatgtttcaattgaggtgaatcctctccatcgtgcagcttgctgtagggacatgatcattgctcacaaaaaactactaaaagaagggtatgatgtcaatgcttttgatggtcaaggacatacccctttgatgttagcagcaagaggatgccacggcgaaatgtgtgagcttttgatctcatatggtgctaaatgtgatattcagaatgagagacatgagacagcacttttacttgcaagagaaaatggtgcaggaaatgatgcagaacgtgtgatattggatgaggtagctcgaagactagtcttgtgtggtggtcgtgttaaaaaacatacaaagtgtggtaaaggttcacctcatggtaagttactagagatggttggagctgctggaatgttacgttgggggaaatctagtaagagaaacgtgatttgtaaagaagctgaggttggacctagtgcgaaatttcgatggaatcgaaggaggaagtttgatgttgatgagccaggaatgttccatgtggtcactacaaaaaataaacagattagagatgacaaagtgaacttggagctatggggatctgcaaaaatatactcaagtgaaacagggaaattacttgtaatattggggatggatacaagacatgtatattcccacaaatttatgcggaaatggatgtgggcaccagtattataa

SEQ ID NO: 104414 - DNA, 114 bp, Glycine max
  Peptide Sequence Number=SeqID_221192
atggtggcattagagttgccaccaatcttgtcaatcagaaaattgtggcttgaagatgaaagagctttgggtgcactgttggggaagggtcaaactaaatgtgaaattccttga

SEQ ID NO: 104415 - DNA, 378 bp, Glycine max
  Peptide Sequence Number=SeqID_221193
atgttcctcaccaacgagatttgggcttcgatcagaattgaatgtagtgaaactagatctggaagttcggtcactgacgtcaacatcatcgaagaggatggcccgacattgaacatctcagtgtggttcccacaacagcgttgcctcactctctgcaaacccaccaaacaaaccctttccaccaaaacatttgtgttttatctgaacaggttggagctcctactcgtggtggttttggctgaggcgaatccaacccaactacgagcaatcaattgttggtgtgaaaaggagggttatgtgaacaaccatagatgtgggggcaccaaggtgtttataacttggaaaataaggtattatgattccaactctctgtcttga

SEQ ID NO: 104416 - DNA, 2118 bp, Glycine max
  Peptide Sequence Number=SeqID_221194
ttacaggtggctaagtcttggcaacgtctatggcctactctgggaggatacaacttaggcagtttaagaaacagtttgcagaaaacaagcaagaagaatcactgtgggagcagaacaactgttatggaatttgaatcagactggacaaagcatagaaaatcatctgctcatactgctcaagcactgaataaagattatagccccattctacctgggctgcctgatgatgtggctgagtattgtcttgcactcgtgcctcgttccaacttccctgctatgggtggtgtttgtaagatatggaggtcgtttattcaaagcaaagaatttgctactgtgcgaaaattggctgggatgcttgaggaatggctgtatttcttaacaacggactgtgaaggaaaggaaagttattgggaggttatggattgtcttggtcataaatgccgatcgcttccaccaatgcctggtccaggaaaggctgggttccaagtggtggttcttaatggaaagcttcttgtcatggctggttattcagttattgaaggaactgcctttgcctcagcagaggtttaccaatatgattcttgcctcaacagctggagcagattgtcagacatgaatgtgtctcgttatgacttcgcttgtgctgaagtcaatggtttggtttatgctgtgggaggctatggggtgaatggtgacagtctctccagtgctgaggtgtatgatccagataccgacaagtgggcactgatagagagccttcgccgcccaagatggggttgttttgcttgtggatttgagggtaagctctatgtgatgggtggaaggtcaagctttactattggaaactccaagtttgttgatatatataaccccgagagacatagctggtgtgagattaagaatggttgtgttatggtcactgctcatgcagtattaggaaagaagttgttctgcatagagtggaagaaccaacggaagctagctatattcagtccagaggacaattcatggaaaatggtaccagttccattgacaggaagctcaagtattggttttcgatttgggatactagatggtaagttgttgctattccctctggaagctgaaactgcttttcagacattgttgtatgatccaaatgcatctctggggtcagagtggcagacttgtgacataaggccatctgagttggtagtggagggagcagagaacccgaacgccatgtttggctccgctcaaccttcttcttctcccttcggcacccctgcattcggtaccccttcttctacccctgccttcggttcttccctcttttccacacccttctcttctcaacaaccacaaccacaacaacagcagcaacaacaaacacctctgtttcaacagcaacaacaacaacaaacttcttctgctttcggctttcagaattcactcgcattcgcagcaccgcaatcctcgcccttcccaaatgctcaattaaccactcagatggctaacgttgcacctgttcctttctccctcgccgatcgcgatgttcagactattgttgatgcatataaggatgatcctgggaaccccaagtacgcctttaagcatttgttgttcagtgtaacagaaccgcagtttagagtgaagcctgctggtgtatcagatatcatgtgggcagaggcaatagggaagcttcagggtatggaaagtcctgatagagaacgcctgtggccacagcttgttcagggttttaaggatctttcacaacgccttaaggtaatgagaatagtggaggcattggaggaaaaaggctgtcgtatacccttaacaaaaggggaagctgaacttgctgagaaattagccacaataactagaaagctgaaaggatctggagcggaactgtctagaagagtacaaaatctactaattgtatctcgtgttaaagctaatagcaatggatttggtagctccgtttatcttccagggtcaaccaaaattcatgaacagagtcttggtgatctacaagaggttttacagcagcagctggaggccattgcaagactaggcaatgttctgaagcgagatatacgggatatggagattatgatgaccgaggacacgaagaactga

SEQ ID NO: 104417 - DNA, 123 bp, Glycine max
  Peptide Sequence Number=SeqID_221195
atgaatcataatgcacgtcccaatgagaagcttgatgagcattgtaagctaatggggaaagttgaaggtgattcattgaaaattgttggtgttggaactgcgtttgagatcaaaccctcctaa

SEQ ID NO: 104418 - DNA, 621 bp, Glycine max
  Peptide Sequence Number=SeqID_221196
atggaggtacattctcctgtcggggccaagagattatggaatgtgttgagggtaaccttcttcatgataaggaagggtttgatctcaaagagaaagatgatcatggacatgaatttgatgatgaagaaaggaaaggtggtgagaaaatcacttagcaatctcatgtcatcacatcaccaccaccacaaccctaagagcgtcacacgtggcggcgccgccttaggggtgcattatgaattctcttgtaacagtagtccaaatccaatttttttcaacatgccaaagcgcaagcaccacttcaacttcccctgcatccatgcccctgaggttctcgaagaggaagaagaaactgatttttcattagaagtggaaagtgatgtgcctaaggctgtggtcaccgtgcccaaaacccaagaatacgtgtacaacttttttgttgagaaaaagagtcctcttctctcaccgttctctgtgagggtctccaattactctgcattggatgaaaatgaagacattggaaatgaccatgttgatgatcaagctgaggatttcatcagaaggttctatgaacagcttaggacgcaaagcccagtgcaattcctgcgttaccaagagatgtaa

SEQ ID NO: 104419 - DNA, 351 bp, Glycine max
  Peptide Sequence Number=SeqID_221197
atggactggcaagggcaaaagataacagagcagctaatgcagctaataattgttgcatttgctgtgattgcatttgcaacaggatatcttatggcttctttccaaatgatgatcctcatatatgctggtggtgtggttctcaccacattggtgactgtccctaattggcccttcttcaaccaccatcctctcaagtggttggatccaagtgagttagagaagcatccaaagcctcaaccatctccgaataattttgtatatcttactcttcttccctccctttccccttcattggatattacaatgtactttacttctttggactgcaaaggttatatctgttcgctttga

SEQ ID NO: 104420 - DNA, 219 bp, Glycine max
  Peptide Sequence Number=SeqID_221198
atgatgatccatcagttgattcgacattttgaaaacatgaaaattgccgtcaaagatatagtattacgggttgcgttatgtagcccaattgctctccaatgtccagaagcacgcatcttctcaactacgcccttccatttttctcacgcaaaatcaaaaataacaagagtctacttccgtaaatgcccagcagcagggatccacccacacagtaattga

SEQ ID NO: 104421 - DNA, 1428 bp, Glycine max
  Peptide Sequence Number=SeqID_221199
atgtcgttcgcatcatcattctcgatgctccgccaccgcgcggtggcggcatacgcgcccactctcctcctccgccgcttccgctgtctcccaacgatcgccgccagacaccaacaacaacaacaaaaccctaacaaacaagctgctgccccgagccgcaacctcctgaaggcgaaacaaacactgaaagagtattcctgtcttgcccctgtcctctccctcgaagacagccctcctctgacggaatcccaggccatcggcgtggtggcggcgtcgcaggccaacttcatgcgcgtcatcgtccccgaaaatgacgaaccttctggaagcttccgcggggtggagattctctgcgtggtgagggcgctgctgaagaagattaagcggagggtgatggtcggggacaaggttcttgtggggtccatcgattgggttgaccgcaggggcatgatcgagaatgtcttccagcgaacctccgagattctcgaccctcccgttgctaacgtcgaccaacttctcgtgcttttctcgctcgaacaccccaagcctgaacccttcaccctcacgcgctttcttgtcgaagctgaatccaccggaatccctctcatgctcgcactcaacaagacggagcttgtggataatgagatcattagttcatggaaggctaggttgcgcagctgggggtatgagccggttttttgcagtgttgaatctggacatggacttgatcttcttggttacaagttgagggatcaaacgacagtgattgtggggcctagtggagttgggaagtctagtttgatcaatgcccttagaagcaatccttccgatgctgcggaaggggataattggtttgagcctattttgggaagcaagtggcttgaggatcagcgagttggggaggtttcgaccagaagtggtagagggaagcatactactcgtcatgtctctctacttccattgtctgaagggggttttcttgctgatactcctggatttaaccagcctagtttattgaaagtgacaaagcagtctcttgcacagacttttcctgaaatcaggaaaatgcttagtgccaatgagactgagaaatgttcatttaacaattgcttgcatctgggtgaacctgggtgcattgtgaagggagattgggaaagatattcctactattttcaacttcttgatgaaatcagaatcagggaggagttccagctcaggacatttggaactaaaagagaaggggatgtaaggttgaaaatgggagacatgggtgttcagcaagcagaaccacgcttggaacctaagaagcataggagacaatctcggaaaagcattaaccagtcaattttagatgaattggatgatgatgacgacgacaatttgcttgatgaggagaatgatcctattttaagggcgctatttcgttaa

SEQ ID NO: 104422 - DNA, 1083 bp, Glycine max
  Peptide Sequence Number=SeqID_221200
atgagcggtaaacgttatcccgaagagtttaaaattgaagcagtcaaacaggttattggtcgcggtcattctgtttccagcgttgcaacacgtctcgatatcaccacccacagcctttacgcctggataaagaagtacggtccggactcatccactaataaagaacagtcagatgctcaggccgagatccgccgactccagaaggagttgaagcgggttactgacgaacgggacatattaaaaaaagccgcggcgtacttcgcaaagctggtgctgaatgttcatcccagtggcttttacgcctggtttaagcaaccgtattctcagcgccaccaggtagatctgagactgacgggacagatcaaacagttctggctggagtccggttgcgtttatggttatcgcaagatccatctggacttgcgggatagcgggcaacagtgcggagtgaacagagtctggcgactgatgaatcgtgccgggataaaggctcaggtcgggtaccggagcccgcgggcacacaaaggcgaggccagtatcgtatcgcccaacaggctccagcgacagttcaatccggatgctccggataagcgttgggtaacggacataacctacatcaggacccacgaaggctggctgtatcttgctgtggttgttgatctgttctcacgcaaaattatcggctggtcaatgcaatcccggatgacaaaggacattgtcctgaatgcactgctgatggctttatggcggcgtaatcctcaaaaacaggtgctggttcactcggaccagggcagtcagtacaccagccatgagtggcagtcgttcctgaaatcacacggcctggaggggagcatgagccgtcgcgtaagcgtcggcatggttcgagcaatcagatgtcaccgacagaatatgaaaaccagtattatcaacggctcggaagtgtctagattatccgtggcgattcaagcagctgatgctggtgacctgctccctgttgctggaacccacgctctacctttacgcctgcaatttgaggtgcttccacttcaatgtcggcatcgtcggaaaagtaataagatctga

SEQ ID NO: 104423 - DNA, 933 bp, Glycine max
  Peptide Sequence Number=SeqID_221201
gacaaggtcattggcgacaaggtacagctctcatttgtagagtttgccaagctctgcggcatcccctcaagccgctcctcaaagcagctcagagagcgtatcagcccgtctctgaagcgtattgccagcactaccatctctttctcttcaaaaagcggcgacgacgcaaaagaatacatcacgcatctggtccagtctgctttttacgataccaaaaaggacattgtcatcctgcaggctgacccgaagcttttcgagctctacgagtttgatcacaaggtgttactgcagctcaaggcgatcaacgcgcttaaacgccgtgagtccgctcaggcgctctatacctacattgaaagccttcccaagaacccggcccctatctccttggcacgcctccgcgaaaggcttaatctgcgctctcctgtgttttcgcagaaccagacagtgcgccgtgcgatggagcagctcaaagagatcggttatctggactatagcgaagtccagaagggacgcagtgtctacttccagttagaactcattgaaccagaagatgagatccacacctacattactattgatcgtgtaggtgctgctgacgatgatcatgcccgcatcaccaaagccatagtaaagttgaccgcacaagatgcttctgacgaagacgttatcaagcacctgtttgattctggctatctggatgaaaccagaaacgttgttgccggcagaattgcactcagatcttattacttttccgacgatgccgacattgaagtggaagcacctcaaattgcaggcgtaaaggtagagcgtgggttccagcaacagggagcaggtcaccagcatcagctgcttgcttacgaggagatgtttcagggaactgtttcaagcatcgaggttcatccccgggttttggtaatcacccctcatttttga

SEQ ID NO: 104424 - DNA, 2103 bp, Glycine max
  Peptide Sequence Number=SeqID_221202
atgactttgatcgtaaaaacccagcattattgccgcatcaagcggatgaacgtttctgcgaagggcggcatacccgtatgccgggtattcaatcacaacgttgagcctctgttcgtcattgccatgcagaaatgccggggtctccagcagttcgccgcacagcaacatcaactcttgctcttcatttgccccttcaccttcgcgcgcggaagccgcaaaccggtacagcgcattaaacagtcgcctattttcaataatgccttcgcgcagaacgggcacatggctgtcgctgcgtatattgtcctcatctgccagcagtttcatgacgctctggggcatgtgcacgctgataaaatcaacggactgactccagatttcctccacacctgtcaggttggcgctaatgacgtattcatcatgaagatgttttgggaagccagcattacaggcactgacgcgggagcattccacgccattgcggctgaaccactctgcaaactggcagggcaaagcccagcttttagcgatgaatttggcaagcgaatagccaatccgatcacaggtgctgcaatacagtcagcgacctctatgccggggcgatcgtctttgcaaaactccgtgtctggacctgatcagctatccacttcttttagggattcaacaagtctggggctgaatgcagtatctgttgacggtaaatcagcgccaagctacttttcactgcccgtaatgcttgctcatcgtggccttataaatgcgggtgtccatccacctgactatcaggttaaaatcctgttcaaaccacccagatacgcgagatgcatggcagggaaagggcagggggcttgcggcatttcacgcgcagccagttaccagatccccgtggagcggatgatgaaaagtaactatggtggagtggatgaaactgcgcgcagagcgaatgctatgttgcgcagcatgagtgatgacattatcgataagcgccaggaattcggtctcgatcagttctatcagacgttcacacgtaatgccgtggccaacctgcctaagctcagccgccgtgctgttgaacaggccattgaagaaatggaatccaaagggcatgtgtttggcaaaaaggatgccgggaattcgaaacattacgcgctgaccgttcaggacgttgttgatatctacgctcaccggaaggtgccaaaataccgcgacattcataagggcgaaggcccgtttgtgatcttcgtcgtcaatctcaagggtggggtgtccaaaacggtcagtaccgtgacgcttgctcatggattacgcgttcaccctgacttactgcagtatgatttgcgtaatctggttatcgatctggatccgcaggcatccagcaccatgttcctgaatcaggcaaacagcatagggtcgattgtcgaaaccgccgctcaggccatgctgaatgatcttgatgcgcaacagctgagagaacaaatcatcaagccaaccatcattccgggtgtggatattattccggcttccattgatgatggatttgtggccagccagtgggatcgcctggttcaggaacacctgcccggcgtgttgccttctgaagtcctgcgccgaaacattatcgacagggtgggaagcgactatgatttcatcttcgtcgacaccgggcctcatcttgacgcattcatgcttaatgccattgcggcaagcgatctgcttctcacaccaacaccgcctgcgcaggtggacttccactcaaccctgaaatatctcacccgcttacccgatatgctggagcagctggaagaggaggggattacaccgcgtataaaaggaaatatcggcttcatgtccaagatgacgtccaaacgtgatcatgagatgacgcatgggctggcccgggacgtgtttacgtcttacatcctggacgccacgcttccccgactggatgggtttgagcgctgcggggaaacgttcgacaccatcgtcagtgccgatccacagtcatatccgggcagttcagaagcgctcaaaaatgccaaacgtgaagccgaacgctttactcaggccgtgtttaaacggattgagttcgtcagagggatgcaataa

SEQ ID NO: 104425 - DNA, 330 bp, Glycine max
  Peptide Sequence Number=SeqID_221203
atgccccaaatcgtgacctctgaaccacgcaatcaggtgacggacacagatgctgctttccggaataacgttctgttgccagccgagcagagaggcctgggttcgggcgaagcgttcgaacaggttaagatacgtatttgcaaacacgatggtgcgcttttgaggcgcgtacttgacgccttcgtcttcaggaaagaagtaagcaaagtgtttgggatagctgttggcttcgccggcaattgcaaacagatcaacgattttgtaacggcagccgggcagggcaatcagccgctcatcaatatggcgttgcagccaggccaggttatctga

SEQ ID NO: 104426 - DNA, 480 bp, Glycine max
  Peptide Sequence Number=SeqID_221204
atggcatacggcagtaaagtgcgtttagcaagtaccagtgatagtagcgtcaatgtcgttattcctttcgttgcagctaatcgttcagtgattgttaaccgaaactgtgatttcagctcacaaagtgcctcagtgaccttacctgaatattctgtggcaggaacatccgcattctcggtgcctctgagtctctcctgtacagcggggggcaacatatatgggacaatgagccttacgggaaccacggcatccggcgataatacagtgttcacatctgacggttcagcgcagggggttggcgtgcgtttttattataattctcagccagtcgctgccaaccagggtctacagtttggtcccatatccggaaacaacataccaacccccctcggtctctccgtcgcttatgctcgtaccggtggacgtcttacagcgggaactgttcagtcccgtgtaaatctcaactttacttactattga

SEQ ID NO: 104427 - DNA, 1077 bp, Glycine max
  Peptide Sequence Number=SeqID_221205
atggctgatctgacacctgatgaactcactcaggttcatgaaaaagtcgcggcaatgcgacttgattctcagctgtataaactgcgtgaggcgctgtcgaaaacacagaagcagcaggctgaagccatgggtattgcacagccttccgttgctgcaattgaagggcgcggtgaagatctgaaaattgccacgctcaaacgttatgttgaagcgcttggcggtcaactgacaataggcgtcaatatgcctggcgaaatgcgcctgacgcattttttcgacaagtgccggccccctgagaagaaaacaggcgatattacgtttacctgcccggctatatacacgtgcaaccggaatgtcagaccagcgtgtggtccaggccgggctgagcatctcccgcttcatgttccattcggtattcactccctgtcctgcaaaccacatgctacccactccggactgattaatgccggccatcaccttcatcagctgcactctgttttttcgtggctgcctgtgatcaaggagattaagctgactgactccatccggggtaaagtcatcgagcatgatgcccgctttcatgtatcggcgaccttcaagccagatgcgatcaacgctgtctccatggagcaccccgttgactgcatgcggcgaggtgcgaataaatacgctgataagtcgctagaactgccgctcgcctcggagattttcggccgctcttttcctcaacagaatataggattcgccgttcagtttacggacggttctctccagaactacattaacgtttttccggatgagggcaggatttttcagaagagtagcggtgcgctttggattgtctggagtaagcgtgagcacgcccctgaaactgccggtggtattcatcacatgtgttctgaggcagcagaaatgttcagaatcttcgcagccgttaatacccgtcagctccagaaacatttcatcaatgctgtaatgctcaacgcggggcgtcatctcctccagggctgtcattacgcgctggctgagattatggtttatgtggaatgcaaatctacagaattagttggggtttga

SEQ ID NO: 104428 - DNA, 810 bp, Glycine max
  Peptide Sequence Number=SeqID_221206
atggcactatcctttgcggcctcaacgccgctggcattagaagaggagcctttacctcacaccgatgatgattgcgacgttaacaacgacgacgacgctttttttggcattgtttcactggatgacaaggataaggggaagaagatgaagcaggtcaatctgttccagatttgggggttcaaaagaaacgacgtcgttggttcggttgaatctagttccggacatagtggttattgtgaggaaggaggtggttcttctgagaggaagattgtaaaacctgaaaattgtggttcaattttgcaccacactgggaaagagttcgagaacacgaaatcttctcgtaagagaaagggttctggtgataaaggatacttgaagacctacaaggggcaattcacagcaattttggcatttcgtccaacaggttggactttcagtgagaggataagcaacgatctggaactaattaaacctgtttccaaaagaaatattacgatatatgggtatagtgttcatagtaacgatctgctttctgatgctaaaatgcatccaggttgtgacataagaattaagaaatacagtttatctagcagagcagtacagtatacaagtcctttttcttccttcttccaggggttccctacagtgagcactccagcttcacagaactgcgagattttgttcagtgaacttatctctatcctcatacagtttttgaagcctgacaagataattccaactgtgaatgtctggaatgctgctaatagagaaaagatgcaatcctactcccgagattggttgaagggctaa

SEQ ID NO: 104429 - DNA, 252 bp, Glycine max
  Peptide Sequence Number=SeqID_221207
atgatggtaaaggtagtggaggaagagggcgaagggttagtgttccatgtggataaggagaaggaggcacacatggactttgggttgtgtctagttggaaggtttcttatgtccaggaccatatataaggtctcaagccatgaaggagagtatggcagtagtgtggcaaccagggcagggggtgacaataaaggaaacgaaatcaggattattcttgttctagttcaatcatccagtgtccttcaaatatga

SEQ ID NO: 104430 - DNA, 792 bp, Glycine max
  Peptide Sequence Number=SeqID_221208
atggcaattgatagggagtgcttatacaaaggacaaagctctaacggtcttgccaactcaggggagacaagctacaacagaattggaaatgcagggcataagcacgattggaaaagattctccttggtctgggtttgctgctatcattccctgcatcatcgagaaacaccttgtcctcaaggtgatagatgtcttagagttgggaccaatcttcccaagtggagtcttctggttgcaatcctgtccattgtaccagaactgataggcggggtggtgtttggttgtctcacttatggtccagaatggtcaaagggccaatcgataagcaaccttccctacagtctccgtaatttggtacgggccatagtagcgcttaccaagcttctgaaatttatttgcgatggatgtttggcgtttccgacaaagagcgtcaaacatgtcctgcttggaagaaagaaggaaatcaacggcatctacagtaaaagcacctggggtataatcaggaatttctggcggtggtttgccataggtgacctcatacggcaacaagtttgtggaggaatggcacttggtgttgtagaaccactctgcgaggctgaggaatttgccccactgggatggtttgtgatgaacgaagctgagcaaatattgctccaaagtgcggttgagcacctccgtctggccgtcgctctgaggatggtaggcagtgctcatccgcagcttggtcccactaagccgaaagagttcacgccagaacttgctgatgaagatggggtccctattggaaattaa

SEQ ID NO: 104431 - DNA, 987 bp, Glycine max
  Peptide Sequence Number=SeqID_221209
atgagttttcaagacatccaaattggccccaacccttcctctcgccggaaccaatccccttcgcaggccgtcgccaccggaattttccagatcaaaaccgccatcgctgctttccgacgactcgtcgatggtgttggaaccgttagacactcccgaacaccgtcagaagctgtaccaacaagctctggctctggtgaagaatcggttgggatagatgtggaaagccaaccttttatcagagagcagaagaggcaagagatacttctattggataatgaaatatccttcaacgaggccatgattgaagaaagagaacagggaattagagaggtagaggagcaaattgaacaagcaaatgaaatattcaaggacctagctgttctggttcattatcagggtgttgttattgatgacattcattcaaatattgatgcttctgctggtgcaacaacccaagctagggtacagctagccaaggcttccaaaagtgtgaaatccaaaacctcatggcccctcaaggcaaatcccctcatgtctggagggcaatttgcaagtttcacacctagaattggagatggtgcttccaatatttggtttcacaactggtctggatcaggatgcttgagcacaaaagttctatatgtagatattcaggatgtggacttaactctttctgatgtgattcaagatgggaaatataacctgcaacggttggctactcccctaaatgaagtcagaaacacctttaattttctcccacccctcattcatcataatgtaacagattcatttgtatgggttggcaatacaaatggcatctatactactcagtcggcttatgggtgggtgactaaggttgaagcctctagccctatgcagaatttggatttcaaatggatttggagctgtaacatccctctgagtataaagatctttctatggcaaatttggcataattccttgccagtcttcctcgttttaaattaa

SEQ ID NO: 104432 - DNA, 366 bp, Glycine max
  Peptide Sequence Number=SeqID_221210
atggctacggcctataaatctcgctactaccctcttggatgggtaccaagcctacccggtgcccaaattccacactttgaagctagccatgtaattgtaaaggcctgtaatcaaatgattggtgaagatcataaagctaatgacagtgaccccacacatccaactgtttggaaatgtcctggtgtaagcataattaaaataaactttgatgattcggtgatgagtcagaacaacattggcatggacatggtagcacgagatcacaacgacctgatgctggcaggtgcaacttggactgtgcctactgtttttgaaccaaggattgctaaggtcctttgctataggtgggcaatacatctctcataa

SEQ ID NO: 104433 - DNA, 942 bp, Glycine max
  Peptide Sequence Number=SeqID_221211
atggagaagtttgctctgggtgaaataaaaatccttatctgcacaaatatagttgaaagtgggcttgatattcaaaatgcaaataccataatcattcaggatgttcaacaatttggccttgcacagttgtaccaggagaggcttgctgctattgaagaatgtcgtgaacttggtcaaggcttccaactagctgagaaagacatgggtataagaggttttggtgcaatttttggtgaacaacaatcaggagatgttggaaatgttggcattgatcttttttttgagatgctcttcgagagcttgtccaaggttgaagatcaccatgttgtttcggttccttatcactcagtgcaggttgacataaacatcaatcctcatctcccctctgactacattaattatctggacaaccctatgaaaataataaatgacgctgagagagttgctgagaaagacatctggagtctgatgcaatttacagagaatttgcgccgccaatatggcaaagagcctcgctccatggagattttactgaagaagctttacttgaggagaatggctgctgatttagggataaccagaatttactcttcagggaagatgatctatatgaaaacaaacatgagtaaaaaggtattcaagatgatgacagagtccatggcatcagatttacatagaaattcattggttcttgagggggaccaaattaaggctgaacttcttttagagctaccaaaagaacagcttctcaattggatctttcaatgcttggctgaacttcatgcttcactaccctccttcataaatacaggacgtcagaacaaattgggactatcggttgatactagtgaacatgtgcttcctttcaagatgtatataatcagagctacatcaatggggttagttactacttacaagcacgttggagttggggttatctaa

SEQ ID NO: 104434 - DNA, 1936 bp, Glycine max
  Peptide Sequence Number=SeqID_221212
atgccggagctcgacacattggtctcaacagtaaaaggtatgttgaagttcggcaaggcgagtactggggttgtggtcatgtcgagcttcagaacctcaaaatctttttgggcctcggaggaccaatggaattggtctttctttaataattgggtcaaggagcggcaatctgcgcgggtcgggttcgacgccccggatagagacaaagtgtccaaagtattcaattcggcgttgaccgaaaatacatttaaaggctttcaggcggaaatcgccctattgcaatgtccgcaggacacaatcaaggtgatcaagggcattcatggtcgcctgaaatgtggaaggagcattacagagtccgaaaggcatcaccacatactcgtagtggccttgatgagtacggaaagttgtcttaagtatgtcatgctcgaccatgtggatttggtggaagccctatgccaggtccattttagaaaaccaagaggaatgccccagatcatcgagaagttcatcaatggttcggaggggaaatcggtctttgatggtgacggtgttcagggccctatagtcgacgctacggcttggccggatgagctgacgacgaagcatatcgtccacttgtcgttcaatttcctgcttctgaaagtaaggataatggtagggacggacgttcacaggtttggcattgggttcgagatgaatggcatggtgagggtatttggtgaggagacaactgatgggaggtggaatagtggggtggccggaagtaatgggttcagtcgcctgaagttggaggtggaagaggcccactacctgatgggtagatatcaggcccttaacctgtccatgggtgatctcagatgggctgggagtggtgtcaccttggatggtgatgggctgaccttggtaaacaaagcttatggtgaggtcaaggataaatgtatggccctgaatcaaaatggtcatgttgcagcaaaccctatcgcacactatgtcggtaccgtcacccaccatgacggccagacgaggaatgggttcgggtgcgaggtgcaggaagtgagcgaggcggaggtggataaaattatgggtgctccctccatcgacgaggataacaacctcgtggccattgatggtgcctcagacacgcagcgtggtgggtactgggtggccggacagctcatgaaggctcaattgtgctggtgggtgggtgaggggattcgaaggcaaaggctcttcatcctcggaggccacaaggaggaaaaacttggcacggcagcggtggttcgggccataacgctcttcacagttgtagcaaaggccgcgttcgcagcgaaaggccatttccgcctgggtaaggcatttataggtagtacatggtggtgccaacagaagaggaggcagagtgggagcaaggagttggttgttggcggtggtaggtgggggcgtgacagagccactgcttggactagggataggggttgcatggcaagcacttcacggcaaatgtccggcaaaagccccgatatgaagcagctgaggagaaacggggtagggagacctactatccagttcgccaaagcctcaaacatcgcaaggaatgaattgactgacccggaaagaggaccaggacgtcaactgatcgttgcggtaaagccactgaaaccaactcagggcttcaccgtcaaggggcattggtatcgtcgaagcgaggaacgtcgaggttcatgcgagggggaggtggtcgcagggaaagggttggtgaaggggtttccagggcttggaggcgagaggcgatttcgtcgagccgagagtgaaggatcagtgaaagcaccaattgatagtgcttacacaaaggacaaagctctaatggtcttgccagctcaagggagacatgctataacagaattggaaatgcagggtataagcacgattggaaaag

SEQ ID NO: 104435 - DNA, 495 bp, Glycine max
  Peptide Sequence Number=SeqID_221213
atggctgccaccgtcagcaaccaaatccctgcgtggatttttgggtttgaccagtttttacaggcgtttcgtcaggaattacgcgcagattgccgctccttgacccaattattaaagaaagaccaattccattggtcctccgaggcccaaaaagattttgaggttctgaagctcgacatgaccacaaccccagtactcgccttgccgaacttcaacataccttttactgttgagaccaatgtgtcgagctccggcatgggtgtcgtgctaatgcaatgtggccaccctattgcctttttcaaaatggaggcaatacctcctgggtcatgtcttcgtcatcttgatggaccacaagagcttgcgggaactgatgacgcaaccatacaaggccggccaccacaacgtggtcgcagacgctctgtcacgtgcacaggatgcaactccggcagcggaagctttcttcatcctgaccgcgccacacttcaaattccttga

SEQ ID NO: 104436 - DNA, 1737 bp, Glycine max
  Peptide Sequence Number=SeqID_221214
ggtacgttcaaatcaaatgggttcattccagacacccattggaatgagaagttcaacattgctagagacttcatgtggattcctgttgcaggaactgcaggcaagaggcttatttatttcatactttatataatatgggatgaagttggagaagataagtttgaaagggagaaagttctgttagatttggagcaagagtgccttgaggtttacagaagaaaagttgacagagcaaatatatctagagctcatctgcatcaggaattggccgaggctgaggctgaatttacccaccttcttttgtcccttggtgaacgatctctaccagtccggccagagaaaagggcaggttcactaaaagagcagctagattcaatcactccagcacttcgggaaatgcgtctgaggaaagaagagaggttaaaccaattccgaactgtgcaaggtcaaattcaaaaaatttctgctgaaattgcaggtaactcagacaatgaaccctcatccattgttgtaaatgagaatgatctttcactaaaaaggcttgaggagtatcagaatgagttgcagagacttcacaatgagaagaatgaaagactccagcaagtggagaaatacatagacataatacacagcttgtccacgatcttgggaaaggattcttcggcaatcatcatggaagttcatccaagcttaaatgatttgtgtggaataacaaaaaatataagcgacacaatcttagataaactcaatatcacggtggagtccctttttgaagaaaagcaaaatcggctggaaaagcttcaccatttaggcaaagcactgtctaatctatggaatcttatggacacaccatacagtgagcgacaatctttttcccatgtaatcaatttgttgtcgctctcatctgcagaagtaacagatccgggaagtcttactctggaaatagtccagcagactgaagctgaagtaaagagactggatcaactaaaagcaagcaagatgaaggagctattccagaagaaacaggaggaactggagttgatatgcaagaaatcacatgtggagattccttcaagggaagagatgaataatataattaacctcataaactcaggggagattgatcattctgatctcctcctgagcatggatgaacagatatctagagcaaaagaagaggcttctagcaggaaggctatcatggagaaagtggagaagtggatgttagcatgtgatgaggagcgctggctagaagaatatagcagggatgagaatcgatactcagtcagtagaggagctcacaaaaacttgagacgtgctgaacgtgcccgtataatgccgtgggagaaaaagaggattcaaagccaagtagttgagcgagataatacttatgtgtcaagacccggcaccagcagccggcgtcttccaagtagaagcatgaatggagctctagacagttctgcggtcctgaacagaagactttctatgggaatacaacagctgggatccaacagcataaattcgggaaatcacggcttgtccttcattaaggatggaaggaatgccctaagaaaaaagatttatggcgaacccaccttcacttctcctacaagagatggggcatcttctgcgatttccaagaaaactgttgtgcaattgcaaaagaataagcatggagctttttatgtacttatgttcctaatcttaagttgcccaaacggacgagctcatacttga

SEQ ID NO: 104437 - DNA, 507 bp, Glycine max
  Peptide Sequence Number=SeqID_221215
atggctgacgaagaagaaaacggagtatcgatccaactggaattcccgaagggtcgagtgaagaagattatggcgctggacaaagacgtgaagagagtgagctcagaagcgttgttcctggtgtcgcgctccaccgaattattcctccaatttctggctgaaaaatcggctcaggttgcaattgagaagaaacggaagaccgtgaatctcgaacacataagagtggcggtgaagaggcaccagccaaccagggattttctcctcgatgagcttccgccgccgtctcaggccgccaagcccgataagcccactcagcctgcgggtcggcccaaattggatcctgctccccgtggtactcgctgcatcgatcaattcttccggaaaccagaacctgaaaacacagcccaagccccaggccaaccacctgaaaatccagctcaagctcaatcgcctgaaaatccagaccaagaccaagcccaatcaccggtacctgtagatgagtcttag

SEQ ID NO: 104438 - DNA, 405 bp, Glycine max
  Peptide Sequence Number=SeqID_221216
atggagttttctcaagatgattttgatcggttactgttattcgaacacacgcgaaagactgctgaagcaaactacgcagagaatcctcaagacgctgatgtacgtatcgttcttcattataccctaattaacctttcttcattctatgacttactttgctcacaccgcacgtgttttgtttccgaatttgtgaggtttctgttggaagttattctttgtcacattacaacatttaaaattggaaggacaaaacttagatacaacgcaattatcatcgaattggagttttatcgggtattgcgcataacaaagaatctgaccaggtgggggggagctttgatcgagttgtcgtcattccaagctcctagggatgccaaggcgatgattgatggtatatcacgttaa

SEQ ID NO: 104439 - DNA, 450 bp, Glycine max
  Peptide Sequence Number=SeqID_221217
actgaggcaaagggttattttgacaaggcacttgagtatttccagaaagctgcggaggaggatcccgagaatgacctctatagaaagtccttgcaagttgccgtgaaggccccagaactacacatggagatccataaaaatgggcttggtctgatgagtaatgcgggatcctctgctacttcaaaagaaaagccttgtttagggtcatcatgcctcaaattttgtgggtacaaagcttctcatgttagcatgtcattagaaattgcatcttcaacaaatttttcatggtgtctatcaaagtactgccacactattgttttccatgaatctaaaaagcagaagagcaatgactttaagtatgacatatttggatggattattcttgcagtgggtatagtagcatgggtgggaatggccaaatctaacattcccccgccacctccaagataa

SEQ ID NO: 104440 - DNA, 2284 bp, Glycine max
  Peptide Sequence Number=SeqID_221218
atgggccctctagcccacaggaaacttgctgccatggccacttcaccaaaagcaaaaaagctcatgacattgagtctaggaacaaatccagttgttatcagcagtcacccagaaaccgcaagagaaattctttgtgggtcgaacttcgctgaccgacccgttaaagaatcggcccgaatgctcatgtttgagcgtgccattggatttgctccatatgggacttattggcgccacctacgtaaagtggcaatcacccacatgttctctccaaggaggatttctgacttggagagtctccgacaacatgtggttggtgaaatggtgatgaggatatggaaggagatgggggacaaaggggtggtagaggttcgaggcatattgtatgaagggtctttgagccacatgttggagtgtgtgtttggtattaataattctctaggatcacaaacaaaggaggcgttgggtgatatggttgaggaagggtatgacttgattgccaagtttaattgggcagactattttcctttcgggtttttggactttcacggggtcaagagaaggtgtcacaaattggcaactaaggtcaatagtgtggtgggtaaaattgtggaagaaagaaaaaattcagggaagtacgttggacaaaatgattttcttagtgccttgttattgttgcctaaagaggaaagcataggtgattcagatgtagtggctatcttatgggaaatgatatttcggggaacagacacaattgctatacttttagaatggatcatggccatgatggttttacaccaagacgtacaaatgaaagctcgtcaagagatcgactcatgcatcaagcaaaacggttacatgcgagactcagacattccaaacctcccttacctccaggccatagtgaaggaggttctccgattgcacccaccaggcccattactttcctgggctcgcctcgcaatccatgatgtccacgtggacaaggtcatcgtgccagctggcacaactgcaatggttaacatgtgggctatatcacatgactcatccatttgggaggacccgtgggcctttaagcccgaaagattcatgaaagaagatgtgtcgatcatggggtcggacatgagacttgcaccatttggtgcaggacgtagggtgtgcccaggaaaaacattaggcttagccacagttcatctatggcttgcacaacttcttcaccatttcatatggattccagtgcaacccgtggatctttcagaatgcctaaagctctcgctcgaaatgaaaaagcctttacgatgccaagtgattcgcagggttttatgcgatttcaatgtgaaggttcggttttatccgttccttgttctgtttgattctcagattttggatactgatatcgcaattgatgctggggtatctgtttccgattggctgggatctttgaaaagcggttcctggatgcactgtgttaggcgaaatgccagtcaagagcgtggcagtcctaaagtttcaagagcacagaggaaggtctctcaaaatggtcaagctgctgaaaagaaagtcacagacttaattacatcatctgctagaaagaataaatctcttagcacccttgagaataaaactagagagcctatccctccaacagatttgaataatggatatgagtttatggacagtgggacttctgatgcttgtttggaaaatgatgcagttgacggtgtttcattagattttatgggttgtaacaatcaagctgttcatctggagtctggaactatattttctcctgggtttcacttgtccaaaaattctggtggagttgacagagttgattttatcaaaatttttcagaatgaagaccacaagagagtttctccgtgccaagaaatagagtcaccacaggaagatgcagtagatggtcatgttagtcgagactctgacactgcaatggaggtagacataaacaattcatctttaagcacaaaaaatgtgaatggttgcaattctgattatgatggaaatggtctttccatggaagtttctgccatatatcttgccatgaaaaactcaaagcttgaatgtgttgatgagcacagtcaggatcccatgtcttctgaaatgtgcatagaggaggatgaatttgaggattttgatgactttgacccgtacttattcataaagaccttgccagacttgtcaacagtggttccaacttttagacgattgttgttaccgaagcagacacgtagttgcccttctactactcttgtcctggacttggatg

SEQ ID NO: 104441 - DNA, 180 bp, Glycine max
  Peptide Sequence Number=SeqID_221219
atggttaagcacttcacttgcacgctccacggctataggtctaaggattatgactttaaatattttaataataacacatcaggaatagggaaccaagacagctggtacatggtcgacaatgagcataagtcatacagtctctctgctgcctctgctagttgctttagaggcagagaatga

SEQ ID NO: 104442 - DNA, 633 bp, Glycine max
  Peptide Sequence Number=SeqID_221220
atggaggccataatccaaggtacccttgaggcaacatcaggtcgagttattgtagtgaacgaacaagttgacgatattcatgagcatcataagaagaatgtcacggatataatgatgttgggtgaggaagacaccattctgtgtagggaccaactcaagcccaagaaagtgactaggtgctccaagtatagttcatcatccctggacgttgatgaaacccttgtaacaagcaatggagccatctgtgttgaagcgattgttgtgaattcatccaacatggcagctttccatttaggaattttgagagccttggtgaggcatgagggctcaactggttctgaattagatgaggagattaatgcatgggaattaagattagggaagggtgacgtggctgttgtggtggacttgttggtggtacacggtgctagccatgggaaacaaagacaaccaaagacacgttacttggaggaagactatggacatggtgaatttttggaggggacaaagaagattgcaacttatacacctgatcttcagtctttccttgcagaagaaccgctcccgttgtcaggctctttacctcaaaatgcaagggaaaaattcaacagacaccgagttagtttgacgtaa

SEQ ID NO: 104443 - DNA, 1038 bp, Glycine max
  Peptide Sequence Number=SeqID_221221
atggcaaataaaccgcaagaacaggaagattatggcattattgaagaagacaatacccaggacccggtggatgatgagcaacaactggtccgggtcaaggagtggatcaactgttgtcaccgtgacactatcgagtttaatgatgttctatcgaattttccagacatctccgtggttctatccgaagagatcacagacaagcttgttgaggaaggtgtgctatcaaagatagggaaggaaacctacgccattaacaaggacaagaaccttgaatatgagttcgccattgtgaaggaagaaattgacggtcaaattcctcaagtctttgacagagctttgcaggttgaagatcgcatatacatgaaagctctctatcatgttcttccgatgacacacgtttcagtcactaagcttcaaagcttgcttgagggagaagtaaaccagatagcagcacgaaagatcctagataaaatggtgcgggatggaattattgaacccaaaggcagcaaaagattagggaaacgtgttatccattctgacttaactgaaaggaaattcattgaagtccagaaagctctaagtgctactactgaagcaatggatgttgatcactgtgaaccaaatagcaagtccaaaaaaactggtttccgtttaaatggaagcaactatgacgtgtctacatatggggttctccactctattggatcagatttaacacgaatgaaagtgacatctgagacaaactatagtgactccgggaatggacagaaagcatcaaaggcaaaagagcccgggaacacccccataagcaggccagttatttcaagagagagttttgcgcaaggcaaagagaacggaagaacaaatggaatagcaaatcaaggggacgaagctgacacaatcatatgcagcaagtcttcccaagacaaacgaccaaggaaaactagcgcgttgataaaagttgtcccaaggcctcagcttcattcagtcgttgttacctcattccatttcattacaatggcccacgatttgtcatag

SEQ ID NO: 104444 - DNA, 789 bp, Glycine max
  Peptide Sequence Number=SeqID_221222
atggtcgttgcacagaaagttaaggaagctgaaatcaccgagcaggattcacttcttctcacgaggatcctgctccgaattgccatattcaacatcagttatatcagaggactatttcctgagaagtatttcaatgataagtctgttcccgcgttaggtgtatacgacgccttacagaagaaatacctgaagacgcttctgttctgtgtgtgcgaagcagtggacggaccgatgcttgaggaatatgcattttcatttagctattcagattctgataatcaagaggtgtcgatgaatatcaaccgcactggaaacaaaaagaaccgggggaccttcaagtgtaattcgactacagaagttactccccatcagatgaggagttctgcgtgtaagatgatccgaactctcgttcagttgatgagaactctggagaaaatgccagaagagcaaatctcagttccttttatcctttctatgaatttctacattgtcgagactcgaagtgcatactttgctaggcaactggtgccagctgattatgagcctcctttcttcaagggatgcactgatgaagaaacttatcatccatgggagaagaatccattgaaaatggaggttgggaatgtaaacagcaagcactttgtgttagctctgaaggtgaagagtgtgctcgacccttgtgaggatgataatgagggagtccaagacgatttcagcgctggagatgattccatgcaacagaatgaatattatgatactgacagtgaggtaaacgaagatgttgcttga

SEQ ID NO: 104445 - DNA, 435 bp, Glycine max
  Peptide Sequence Number=SeqID_221223
atgggtattgatactagtttggatattgaaatcatgatgttgatgtttgatttcatcaatcttgttgtgcaccacaagggtagattcaaaagggatgatcatggcacattggaatatgtggatgatatcttgaacatgtgccgcatatgtattgctcaccttgccaaagatgtgcatgcctactttgagcatacaatggatgatttcttgaatctggtaggtggtgtgcttgatgaggttgtggtgaatcaaattaaggatagagctgaagaacaaccaacaatagtgtcaatggttaacactagaggtcaacttaagcttgtgacagtgcaaaaaggtcttctaccgcaagcagaagaagaagataacaagggcatggacgttggaggagaagaagatataaaccttggttgggagagaagaagaagaggatga

SEQ ID NO: 104446 - DNA, 657 bp, Glycine max
  Peptide Sequence Number=SeqID_221224
atggatccaagtcaaataacgatgattccttgtatccaaagaggaagtcagacttttggatcttcattgtatttttttggagatcgctttttgcataatgcacatgtcaaatgttttgataaagttagccaagtgaaaaaggagtgtatgtgtgtgattgtggctactataacgaatttgttggtagccaatggttggatttatgaagcctgtctcaaatgtaacaaaaaggtttatgaagaggctttgtcttttatttgtgttggttgtggtaatgaaagtgcaagtacaataccaaagtttcgtgtagaggttagagtagctcaatctcttgaatatgccatttttacactctgggatcgtgaatgttatgctctgataaatgagactgcaactgacattaagcagataattatttatgaggaaggagtttttgatccaatagatatacctgaagcacttaatcgtgtattgggaaaaagattggcctttagattcaaggatgaagatgagccatctatatcattggtgcacgagaataatgatgttattgatagtaggtgcaaaagcttccagtgcacaagatggaaacacaaaaatttgctgaggttgggattgtatgttgacatgaacaaacttcctagctcggcggcgtga

SEQ ID NO: 104447 - DNA, 525 bp, Glycine max
  Peptide Sequence Number=SeqID_221225
atggaagttactactgaaaaggacatgtcgttgagaaagtgcagaacagtttctgcttctgtgttacttagaaagttgcgatggagcacccttggcctacaatttgattggtccaagctagtagaaattctctttgctctgttacaaagatgtcaaactaaacctttttgtgctaagcggaattatgatgtatctctcccacataacaaaatccctgaagcattatgtgagctttccaaacaattggcaaaacctgctttgcctggtggtgttgagttcagacctgatgctgcaatagtgaattacttcggcctaggggacacattgggtggccaccttgatgacatggaagcagattggagcaagcctattgttagtctaagatgccaacaggaaaatccagagaggatactcccttggcaatgttccttcgaagcggtgatgctgtacttatggctggagatgcaagggaatgctttcatggggttcctcggatcttcacagataaagaaaatgctgaaatag

SEQ ID NO: 104448 - DNA, 147 bp, Glycine max
  Peptide Sequence Number=SeqID_221226
atggggcagaatcgtcttaggcagtggtcagatgccggaatgaaactgaaggcagaaaccaatcaagaggctagggtcatgactgatagatcgtcgtcccttgcccaactctggacaaacggaaagcgccgctgcaaggcagcctag

SEQ ID NO: 104449 - DNA, 207 bp, Glycine max
  Peptide Sequence Number=SeqID_221227
atgaatattgctcaaaataggcagaagagttatcaagacaataggaggaaagacctggaattcaaggcgaacaaagcacttagagggaacgagattttgttggtcaaggtaatctggggaggtgcatcaggaaaagatgcaacgtgggaattagagagtcaaatgcgagaagtctatccagccttgtttcagtcaggagaattataa

SEQ ID NO: 104450 - DNA, 186 bp, Glycine max
  Peptide Sequence Number=SeqID_221228
atgcataggtctgaaaagtatcttgctcctctctcttacatgtgtggacgtgtgaagcagaagttatcagcaaggggcaaatatgtatccgtaaacattggccctgtccaagttgtttccagtgaacaggtccaagctgtatataatgccatgaggagggatgacaggatgaaatattttttgtag

SEQ ID NO: 104451 - DNA, 444 bp, Glycine max
  Peptide Sequence Number=SeqID_221229
atgacattttggcatgacattatgatttccctcattcaagaacctaaatttagaacctcgcctacaattttctctcgtggccacgtcatattacaacaaggagaccagacacataacaagataacacatcatacggcaatgcagaaaccagaactagatgctcaaacattccaaatggaacaaagggaaatactttatggcgtcatgggatttagattccggatatttcttataaaacttcttcacataaacatcctcaggaagagtgatggtcggaattttccctgcagatcgaggaaactttgcagatggtgccctgataaacagagtaaaaaacaaaacattacacaattttccaaaaaaaaatcgaagtttcatcaccatgatcaagtaaacattcagaataaaaattcagtgaatcccgaaaattcccaaaatcattaa

SEQ ID NO: 104452 - DNA, 654 bp, Glycine max
  Peptide Sequence Number=SeqID_221230
atgtgctgttctgagaaatataaaaaatacactctcttaacatattcctttaacttgtggcgtgtatttgttggtttatatggcaccctgaatgcattcgcttttgacggcggcacgtggacactgcaggatacaaccaaccagatcactgttcttcatgggatcatcacaacagattcaccagcagcaacaacaacctcctctccaagagaggtttcatggtttgcaccaccggacaacgctttcaaactcaatgttgccggagctcacttggccagtaacccaggaccttcaggcttttggggtcttctcaggaataattctgctgaatggataacaggtttctcaggatactgtggacatgctacaaacctgtatgcagaactcatgaccattctccagggattgctgctagtttgggagaaagatcacggggacaacaggtaccacccttatgctgctgtgatcaacaagacccgtgattgggtgattagcttcagccatacgcttcgtcaaggaaacatgtgtgcggattctctaccaaaaatgggatcttcaacaatggacactctcacaatttgggatgaatgtcctcaacaactttcttccttgttgttgggtgattctttaggtgttacttatgttaggcagtag

SEQ ID NO: 104453 - DNA, 1545 bp, Glycine max
  Peptide Sequence Number=SeqID_221231
atgggtcacattaagtgcaacattaatgttgggtttttccacgaaataggggcaagcaagagagcaccaatcatggacaacaatgaagggaaagtttgggcattgataacggctatgaagtttgtcatctctcttggcctgcaacatgtgaagttcgaagttgattgcaaaattgtggtggataaaattatcaagcgcactagtgatgcttatgagtttgtggtgaaggagccaaagtggatggtggcagcgatgacagcgacattggagaagcataacgcgaatctaagcgtgaatttaagcagcgagggggaggatcgtgttcatgttgtggtgtttgaggaacatagttgggttttcgtggggatctatgatggttttagtggaactgatgcacttaattaccttctctccaatctctacatcccaatgcataaggagcttaaagggttgctatgggatgacaggtctacaccagaaaatttgatgataaaggaggacatgttgcgagatgttacgatcattgatgaagatgatgtttgttctcaatgtcaaaccaactcatctgtcgtgccaagctttcaagccaccatgaaaggctttgtagtcactgcgttagcgaacaacaaggcaccatctgcaaagtttcctcgatctgcagggaaaattccgaccatcactcttcctgaggatgtttatgtgaagaagttttataagaaatatccggaatctaaatcccatgacgccataaagtatttccctttgttccatttggaatattgcatttctgggaaggacacacttgctgatttggacgatgaggcatgctggaactggatggaggaaaagaaatggggtgcaaagaaggggcggagggttgataacagaaattcctcagccaccaagcgtgctaggactgatggtagtcgtagggaagatgattggacatgccccagctgtggcaatgtcaatttctctttcaggacaacttgtaacatgcgtaattgcactcaaccaaggccggctgatcataattcgaaatctgctgccaagcctctacaagctccgcagggttattcatcctcagctccttatttaggttctaataccccctcttcaatatatcttggtgttccaccatatggatcttctctgttcaatggatcatctgttcctccctatgatgttccattttctggaggatcagcatatcactacaattatggtagtcgcctttctgctggcagtccttatagaccattgcatttatctggaccaacaccctacacaggtggaccagtgattggaaatggtgggatatatggaatgccccaactgttggatcggtatggcctgggcatccctatcggacctgggacaatgggtgctaggcctggattttttcacgatgacaagtcacagaaaaaaggtacagatgcaactcgtgacaatgactggacatgtccaaaatgtggcaatgtcaatttttcattcagaactgtctgcaacatgagaaagtgcaacacacccaaacctggatcacag

SEQ ID NO: 104454 - DNA, 855 bp, Glycine max
  Peptide Sequence Number=SeqID_221232
atgaagaaccgttatttggtgccggagagacggtggttcgtaggtctggccgtcgtggggttgatcggcgcggtgctattcctcagcaacgcgatccgaacctcggaaacctcgtacgtgtgtccgggggcgctcgggatccgaagcaagacccgaaccgaattcagttacgacgcgtcaccgatccagctccgcgcgattatgcactacgcgacctcgcgcgtggttccgcaacaatcggtgtcggagatcaagatcagtctggacgtcattaaatcactgggccggcccatcaacttcctcgtcttcgggctgggccacgactccctcatgtgggcctcgttcaacccgggcggcaccacggtgttcctcgaagaagatccaaagtgggtccactcgatccttaaagacgcgcctggcctgcgggcccacacggtgcgttaccgcacgcagctacgcgacgccaaggggcttatcacctcgtaccgctccgaaccttcgtgttctcccacgaaggcgtacctgcgaggcaacgaagcgtgcaagctggcgctggagaatttgcccgacgaggtttacgagaccgagtgggacatgatcatgatcgacgcgccgaaggggtatttcgcggaggcgccggggaggatggcggcggtgttctccgccgcggtgatggcgaggaacaggaaggaatccggtgtgacgcacgtgtttttgcatgacgtggatcggaaggtggagaaggtgtacgccgaagagtttctctgtaaaaagaacttggtcaagggtgttggaaggctttggcacttcgagatacctccttctaacgacacacgtgcttctcgtttctgctag

SEQ ID NO: 104455 - DNA, 414 bp, Glycine max
  Peptide Sequence Number=SeqID_221233
atggctttcactctcaatctttttattctttcttctttgatagctataacttcattgatgtcatcagcatctatggttgaatcaaggtcactctctagcccctcttcttcaagcctcgcggttcggttgaaggcagagggcgaatcctcctactgctgggattcactatggcaactccaagcatgcactggagaaattgttacattttttctcaatggtaagacttaccttggacatggttgctgccaagcaattagggtgattggacatgattgctggcccaacattgttgcctctctaggattcaccaatgaagagactgatgtgttggagggttattgtgatgaggatgttgttcattcacctccaccaccaccacaatctattattgacccaaaatatattgttccataa

SEQ ID NO: 104456 - DNA, 294 bp, Glycine max
  Peptide Sequence Number=SeqID_221234
atgacgagaatgggttttggagatagaggtgccgatgtaactcgagaagatgcaacactagagaacgacgaatgtgaagagcaacgtaacagaacatggtgttcttacgattttcaattaatttttacgctcttggaggcctttgagaaggtgccttcgattcaatttttgttttcattccgttggtggccttatgatggcggaggtagcacattgcaaaactcagaacgtgcatcggacgtgataccagtgttgtgtttaccttttatatttattcaaataaaacactactaa

SEQ ID NO: 104457 - DNA, 1380 bp, Glycine max
  Peptide Sequence Number=SeqID_221235
atggagtgtaatgcaaaatctctcgggcaatgggactgggagcacttattcttcttcaatacaaaagcagctgaaaatccaaggttacaaccaactgattgtagcagtgaagcagatcgggaaatcaacgttggaatgttgcatccatcaggtggtagtgcttgttctggctctgaactaatacatgcttcttcatcaaggagctcaaaatcagcttccaacaattcatcatcaaatggggatagcaaggcatctatattgactctggaaggttctcatgatgattccactgggaagaaagaattgtgcaatggagagccaattgaaacttctcctgcagcagtgccctctcctgtctctggtgaaccgttgctcactctaaagcttggtaaacgattgtactttgaggatgtctgtaccggaagtgattccaagaaaccatcttcctttgacattcccatttcatcaggaaagaaacataaaaccagtagtcagactttacagcatccaagctgccaggtggaaggctgtggccttgacctctcatctgctaaagattaccatcgcaaacaccgagtttgtgaagctcattccaaatcccctaaggtggttataactggtttggaacgccgattttgccagcaatgtagcaggttccatgctctgtcagagtttgatgacaaaaaaagaagctgtaggcgacgtctttcagatcacaatgcaaggcgccgcaaacctcagcctgactcaatccaattaaatccatcagctttgtcttcatcaccctatggtataacaggatcattcccctcccttggaaaatctattgcctatttcttgctcaccgatgggaggcaaatagtgagtccatttgcattttcaaggactgccacaaatttagcttggcaagatatgcacccccagacaaaagaatttctcccgaagcctgcaaaagccttcaataagataccgagtattgtctccatgctttctgatgattccagtggccttctaacatctagaggcatagcaacgaagagtactgttccaggtatggaagatcccattaggttgtctgatccaaacggtacacaagatgttaaccgtgctctctctcttctgtcaacgaattcttcatcttcatggggtgcatatgagactaagtccctttctttggaacactccactcgggcaacacactcaatcactcagcatcacttaccacttccttcctcggcagagtattggcacactgatcatcaacaacattcaagcatgtgtatctcattcacggattgcgatagcagcaatcgctttcaagactttcagctgttgagctcaccctatgaatcaccttttccttgcaaccaactggattaa

SEQ ID NO: 104458 - DNA, 672 bp, Glycine max
  Peptide Sequence Number=SeqID_221236
atggacaaggtagaggcaactgaggctctgataccaaatgcatatgttggtgcattctggcatagtgctttgaaactttgtagacagtttcagctctccaacgccactaggaagacgtcgccgaccagaagcgccgccaggaacggctcttctcccacaaccactcatccaatcccaaaccctcctctgaccgcgacagagaccattgagactgggacagtcatcgtgaccgagaccgggacagagacagagaatgtgcgcgagtgtgagagggcacacgatcgggaccgcgaagccaaacaccacaatagagagagggagtgcgacatgaactctctttaccagatcccccatgaggcccacctcctctttggcttttgcaccggtatggaccgccatgagcagaagaagctcgttgccaagaacgagaaggatatgcacgaccaaatccacaagaaagacggcatcaaggagaaacccgaggaggtcgacacccagtgccgcaaggaggcctccgccaaactatgtgacaccttcgacatatgcatcaaacggcattggagcgagaagaagctcgaggagatgatggaaagggattgccctaagggtcgtgcttgggttatggctacttctcgttgcgcatatagggctttttttttacagcggaattaa

SEQ ID NO: 104459 - DNA, 228 bp, Glycine max
  Peptide Sequence Number=SeqID_221237
atgactaataaaaacgatggctttgtcctagcccccaatagtttcaattgggtagattatgatattgcaaggcacaataggagggtccatgtaatcgcagggacagttacgggcgtttcggttgcgggtgcatttggaattggagctgctgtttggtacttgaagaaagtgagagctaaagcaccagtcacgtgtggagttcaaagcaacgaaaataggctattctga

SEQ ID NO: 104460 - DNA, 363 bp, Glycine max
  Peptide Sequence Number=SeqID_221238
atggagaggtcctacgaaaaaggaagaagaacaaaaaataagtcaaaagaagaacgaagaagaagacaaaggacgaagaagacggaggaagaagacaaaggacgaagaagacatagggaaaagaaggtaaacctggagaaggaaggagaagcgaaatgttgtaagcacaatgactcgtacggacgagtcactgtgctgattttatatgaaaagggtgaaggatatttttgccctttcacccgaattactggtgccccaaacaactgccaaagcagaactacatatgagactcaaaatgagaatataacccgtgggaatgacttgtcacatacaatgtatatgtgcaatgatattgaaacttga

SEQ ID NO: 104461 - DNA, 1122 bp, Glycine max
  Peptide Sequence Number=SeqID_221239
atggccacctctcccacactactcttgctttcatgcttcatactacaccttgcatattcaacagaaagtgcagttctaaacaagatagactcttgctggcgtgccaaatcaaattgggcatcaaatcgccaagccttggctaattgtggaattggctttggcaaagattcaattggtggcaagtatggatcaatatataaagtcacagatccctctgatgaccccataagcccaaaaccaggcacacttcgttatggtgttatccaaacacagcccctttggatcatttttgccaaagatatggttattaggctcgataatgagcttatcatgaatagctacaagaccattgatggaagaggtgctaaagtggagattgcaaatgggccttgcattacaatacaaggtgttagccatgttatcatacatggcattagcattcatgattgcaaaccaagcaaggctggccttgtaaggagtaccccatctcatcttggccatcgtcgaggctctgatggggatggcattagcatatttgcctcctcaaatatttggattgatcattgctttttggctcgttgtgctgatggcttgattgatgttattcatgcctcaacttccattaccatttctaacaattactttacccaacatgacaaagttatgctactaggacacagcgacgaatacacagcagataaaaaaatgaaagtaacaatagccttcaaccgatttgctagtggtctgattgaaaggatgccaagggtaagatttggttatgcacatgtggtgaacaacaaatatgatgggtggaagatgtatgccataggtggcagttctaacccaaccattttaagtgaaggaaactactatgtcgctccgaataaccctgccacaaaacaggttaccaagagggaaatgaagggaaaattgaaaaattggaaatggaggtcttctaaggatgcattcttaaacggtgcttattttgttccatctgggtatggtagttgtgacccaaattattctcctactcaatattttactgctgtacctgcttccttggtgcccgcaataactcttaatgcaggtcccttgacttgtgttgttggtaaagcatgttaa

SEQ ID NO: 104462 - DNA, 684 bp, Glycine max
  Peptide Sequence Number=SeqID_221240
atgagtagtggagtttccatccttacagagacaaatgaaactctgattctgtgtgtcaaatccacaagtcccacctcctttcaatggatcctgacactgaaggcagcgcgtggtaaccgggatatcaaaatcaactctgatcccatattcgggaacttgatcataaggcataggagcaccaacgttcttccaataaacgctagcataactagcacaatacttaagcatcaacctcagagactcagtggctttgggatagtaagagcaacaagtactccgagggagtgcaaaggagcaacccggcaagtgcctgcagagatagctagcactgtcacacgaggaatcacagtgttcggggaaatgctcgcagaacataggctttggttgaatgatgacgctgtcttggctgcagttgaagaacatgtactcgttctgcggcgagagcttgaagtgtgtggcggtgtccaagctgaatggcctcgtggggcgaaacttctcgccgtcctcgcagctccacatgaatggatcagtgaccacgacatgtggatcggagtagctcagtatggacttccgcatccatcgtcgatgccaaatggatatttgatgggaatgtcgccgcatgatgttctgcagaggctggattgtgatgttgtgagagtgagaaatgatgagagaattagttga

SEQ ID NO: 104463 - DNA, 2232 bp, Glycine max
  Peptide Sequence Number=SeqID_221241
gttgagtttgacattactgtttactctcacattttgcaggggaaatccaattctgagcatgtcacacaattgccatcaggttcctctcctgcttttagtcagagtcatagctcgtatactgctcacaacccaggaacagcatccatgattggtgattcatgtgaacctaatcagaatttttcttttcctgggtctttagaagttacgttcgaagcacaagccttgcgccaattggaagaacagctgagtttgaatgatgatggcttcaatgaaattgcacttgatttagtgtcaggtcaagatcaaagggtggtttataagcaagataaatctgcagctttgtctggaccaaatgatctaggacaaccttgtgatggatataatggaagacaagatggtggggtcaaatttccaccatattctctagcagaaactccaggagctaactctgactactatgaaacattttttgaccaattccaaaatcaaggacctctgggtgtagattcaagcttgactgttgtgcagaaacagaaatttaccattagggcagtatccccagaatactgttattctaccgagactacaaaggtgatcattattgggtcatttctctgccatgactcggattctacctgggcctgtatgtttggtgatgttgaagttcctgcagagataattcaggacggcataatctgttgtgaagctccatccaatcatcttggaaaggttaatttgtgcattacttcaggaaatagggtgccatgcagcgaaatgagggagtttgagtttcgaaataagactactagttgcactcgctgtaattcattggaaacagaaggaagcaaaagtcctgaagatctgttattacttgttcgatttgcagagatgctcctttcttcttcaactacaaaggatgacagaatagaatctggaagtcatctttcaacagaacagaaagatgatgatgattcgtggagccatattatagacactcttctagatagcactagaacaccatctgatgctgttaaatggcttcttgaagagctgctgaaggataagttgcagctctggctttctaaccgaagagatgaagggacgggctgttctttgtccaagaaagagcaggggataatacacatggtttctgggttgggttttgagtgggccttgaaccccattctcagttgtggtgtgaatataaatttccgtgacatcaatggatggaccgctcttcattgggctgcacggtttgggaggtcactgaatattttgtttcatgatagggaaaaaatggttgcttcacttatagcttctggtgcatctgctggagcagtgacagatccaagttcacaagatccaaccggtaaaactgctgcatctattgcagccagccatgaccataagggtctggcaggttatctttcagaggtagacctaacaagccatctgtcgtccctcacattggaagagagtgagctttctagagaatcttctgagcttgaagctgagttaactgtcagtagtgtctctgaagaaaatcttgtggccagtgaggatcaggtttcactaaaagcttccttggatgctgttagaaatgcagctcaggcagctgcacggatacaagctgcttttcgtgcacattcttttagaaaacggaaagaaagagatgctgccgccacagttctagatggatattgtattgatgcaggtagcattgataataacatttcagtgctttctgccatgtcaaaacttagttctcagagctggcgtgattacaaagctgctttgtcgattcagaagaaatatcgaaattggaaaggtcgtatagaattcttagcattgcgccagaaaatagttaagatacaggcttgtgtgaggggttaccaggttcggaagcaatacaagctaatattatgggcagttggaatcttggacaaggttgtgttacgatggcggagaaaacgaattggtatacaaagtgtccggcaagaaatggagtcaaatgaagaagaaagtgatgatgcagattttctcaatgtgttccggaaagagaaagtaaatgcagcaattgaaaaggccttgaagcgggtgctttccatggtccactccactggtgctcgtcagcaatatagacgcttgctttcgttgtatcgtcaagccaagattgatcaaataataagtgattgttacgagtatagctttcatagtccatttctttactga

SEQ ID NO: 104464 - DNA, 2505 bp, Glycine max
  Peptide Sequence Number=SeqID_221242
atgttttcatacaaaccaaagccgaatttgctgctgagtcgaagtggcctaaaacgttacgtggtctcactaccacacccatcttcagcttcagcaaccatcaattcattcaatgccattatcaaccaccattcatcacaaggtgcccaccgtcaagttcttgccacctatgcctccatgctcaaaacccatgtcccttctgacgcctacactttccccagtcttctcaaagcgtgctcttctctcaacctcttttccctcggtctttccctccatcaacgcatcctcgttagtgggttgtcccttgatgcctacattgcctcttctttgatcaatttctatgccaaatttgggttcgccgatgttgctcgcaaagtgtttgactttatgcctgagaggaatgttgtaccttggacttccattattgggtgctactcgcggactggtcgtgttcccgaagccttttctttgtttgatgaaatgcgtcggcagggaattcaacccagtagcgttaccatgttgagtttgctgtttggagtttctgagcttgctcacgtgcagtgtttgcatggtagtgcaattttgtatggttttatgtctgacataaacttgtcaaattccatgctgagtatgtatgggaagtgtcggaacattgagtattctaggaaattgtttgattacatggatcaaagggatctggtttcatggaattcgttggtttcagcctatgcccagattgggtatatatgtgaagttttgttgcttctcaagacaatgaggatacaaggttttgagcctgacccacagacttttgggtctgtcttgtcagtggctgcatcaaggggtgagttgaaattgggaaggtgcttgcatgggcagattttaagaacatgttttgacttggatgcacatgttgaaacatcattgatcgtgatgtacttaaaaggtgggaacattgacattgcatttagaatgtttgaaaggagtttagacaaggatgtcgttttgtggacagcaatgatctcagggcttgtgcagaatggttctgcagacaaagcactagctgttttccgtcagatgttaaaatttggagtgaagtcatctactgctaccatggccagtgtgatcacagcttgtgcacaacttgggtcttataatttggggacttcggttcatggttatatgtttaggcatgaattacctatggatattgctactcagaactctcttgttaccatgcatgcaaagtgtggtcacttggatcagagttccattgtatttgataagatgaacaaaaggaatttggtttcatggaatgctatgattactggatatgctcaaaatggttatgtttgtaaggccttgttcctttttaatgaaatgaggtctgatcatcaaacacctgattcaataaccattgtctccctcctccaagggtgtgcatctactggacaactacacttgggaaaatggatccacagctttgtgataagaaatggccttagaccttgcatcttggttgacacttctttggtagacatgtactgcaaatgtggtgatttggatattgcccaaaggtgtttcaaccagatgccaagtcatgatttggtctcatggagtgccataattgtgggatatggttatcatggcaaaggggagactgcattgaggttttattcaaagttcctggaaagtgggatgaaaccgaaccatgtgattttcctctcagttctatcttcttgtagtcataatggacttgtagagcagggcttgaacatatacgaatcaatgaccagagattttgggattgcaccaaatcttgaacaccatgcttgtgtagtggatctcctcagtcgtgctgggagggtagaggaggcatataacttgtacaagaaaaagttctcagatcctgtacttgatgttttaggcataatccttgatgcttgtcgagcaaatggtaacaatgaacttggtgatacaattgccaatgatatcctcatgctgaagcctatggatgctggaaattttgtacaactagcacactgctatgcttcaataaacaagtgggaagaagacgacccttgtattggcatctcaatgagaccctcaatgccacctcttatccttgtcctccttgtcactgtgattgctctcttcaaccccttcttactctccccgaaggacccagaggtgagtgaagaggtggggaagagttttacagatcttttagccgaagaagtaaagcaaaaggaagctgaagctgaggaaaaacaaagaagtgtggacacaaaacttttagaggctaagaaattagcatcacagtatcaaaaggaggctgacaagtgcaattcagggatggagacatgtgagcaggccagggaaagagctgaggcagcacttgaaaatcagatgaaagaaactgctttgtgggagcttagggctcgccaaagaggatggaacaaagatgcttcaaagaaagctcgagcacgtttttcagtaggatag

SEQ ID NO: 104465 - DNA, 361 bp, Glycine max
  Peptide Sequence Number=SeqID_221243
atgaagtccttgaagaccctcttccttgtggccttgttaattatggctttggccattactctgtcagcaacatcttcccaaactgaagaaccaaagtctctaagaggaacaagccggttcctttcccagaaaagggtagcgttgacatgtgacaaaaacccaaaaatttgccttgttaaaggcagcgcaggccctaattgctgcagcaacaaatgtgtaaacttttccacagacagacttaactgtgggaggtgtggaaagaaatgcagcttcggaaagatatgttgcgaaggcaagtgcgtgaaccctaagaccaacgagaagcattgcggcaaatgtggcaacaagtgcaacgccaaag

SEQ ID NO: 104466 - DNA, 489 bp, Glycine max
  Peptide Sequence Number=SeqID_221244
atggcaggtttggagtacagcatcgatgatctgtttcaagaagctaagaggagatggctcaagcctgtggaagctctttacattctacggaatcacgaccagtgcaagttcacccaccagccccctcatcagccagctgaatcatgcgttccttccgtaaagatggtcataactggcggaagaaaaaagatggcaaaactgtgggagaagcgcatgaacggcttaaggtttcacatgagggtgaggcatggtgcaactgcatgtaggtctcaggttcaaatcctagaagtagcctcttcacatgcggtgataaggctacatgcatctaccctcccaaaacctctccaagtggaagccttgtctactatgctgtcctttttcttttttttgacatctatttgtcttgctgcagctcatgtcagccattaccatcttgccaacttttggcatgctttattttttatgcaaatgccccaatttgcactctaa

SEQ ID NO: 104467 - DNA, 1284 bp, Glycine max
  Peptide Sequence Number=SeqID_221245
atggcctccttacaaatctcatctatatgtctatcttctttttccttaaagagaaaacattttcctatcaatgcctcaaaatccagacgaatgcctttattagttccaaaaatatcaaccaaaaattcgtttcatgaaaccaacaattccatagacacaaacccgcttgaagtgaatgtcacaccaaaaatattgcatgatgaagatatacataatctcaatattctccacaccaagacaaaaatctatacaattttagagttggtaacggacagggtcgaaatgcaccacaacgttggggaacaacgtgacaattggaacacccttctgttgaactccatcaacatgatcactctcactgccgcaacaatgtctggtcttgctgccacgtgtccaggttcaggtgcaccactgttggctcttaaactatcatccacgctcttgttttgtgctgccacagggttactagtagtgatgaacaagatccaaccatcacaactagctgaggaacaacgaaacgcaacgagattgtttaagtgcctgaagaccaaaatagaaactaccattgctcttcggaatcctacagaggaagatgtgaatgatgtgatagagaaggttttggctgttgatagagcttacccacttcccctcttgggaggagccatgcttgagaaattccctgaaaaatttgagcctgttgtttggtggcctaataagacttcacaaccccatgaaggaaaaccaaagagtgagaaaatcgaagaagagttagtgaatggatggagtgaagagctagaaatggaactgagggaggttgttgaagtgacaaaaagagaagattttgaggactatgagaggttaggaaacatggtgttgaggatcaacaagagtttggccattctaggatctttgcttatgggcattgcaacaattggttctgtgtttgtggacaatattaggtcgtgctcatgggcatatttggtgacccttttggctgggtcactggctgctgtggtgaattcctttgagcatggtgggcaagtgggtatggtgtttgaaatgtatagatactgtggaggattcttgcgtctattggaagagacggttgaggcaacactcgaagagaaggatgtggagaaaagagaaaatggagaggtgtttgagaacaaggtggcaatgcaattgggaagaagtggtttgcagctgagaaagcttgcctctaagtctgcttcctgccgtagggaaggcattgacatggatgaatttgcaagcaagctcttctag

SEQ ID NO: 104468 - DNA, 1992 bp, Glycine max
  Peptide Sequence Number=SeqID_221246
atgggggaagaagatattttggtttgttcaaagaggactactgaacttccatttaggaaaggactagaggcaaataagtgtcttactgcattgaagaagaaaagaatacttgaagacgctatcttaattaacaatttggaagatgataaagtttatgttccctcgaagacatactccagaagcaaagctagaaaaatggatgatgtaaagacgtcaaacaagtgcatcagagatgatgaaaaggttcagtatcttcaatacactattaacctgctccttccgtttatacaacgagtttgtgaagaacaaagtcaagagctagagattgaagctaaaatacaagcagtgaccattgtgctacttcatttactgacctttatcgaagctgccccaagtgttccattgaaatctgccttaactgttgcaaagaaatacgcaatggaagtatatcaccccggtcatagagagatatttaccaaatggagtgctaacagtgatggaagtattagatgtgctccaaaagaaatggggggctgtggtggctctgtgttggagctgaagcgcttgtttccaaatggatggatatcagacttagaagccaaagctcgtaacatgctaaaaacttattgcaaaactgaacaagcaactcttcagaaagaagcaacatcaagtggcaattctatgataagagcagcttttagagatggcacaaatgataataacttatactgtccattgtcaagtgacctcataaatgaaggactgtttctcttccaaaaacattggactaaaggtgaaccaattatagttcgtgatgttcttaaccaggggacaggtctgagttgggagccaatggtcacatggcgagcactatgtgaaaatgtggttccagggatcagctcaaatatgttagaagtgacggccattgattgcttggctagttgcgaggtagaaatcaacactcgtacgttctttaagggttacacacaaggaagaacatatagaaatctctggccagagatgctgaagctaaaagattggcccccctctcataagtttgaagatcttttgcctcgccattatgatgaatttatccgttgcttgccatttcaagagtatagtgaccctcgagctggaatcctcaaccttgctgtaaagttgccaccccatgtcctaaagccagacttgggtccaaaaacatatattgcatatggcattaaagaagagcttggcaggggagattcagtaacaaaacttcactgtgatatgtctgatgctgtgaatattttgactcacacggctgaggtaacgttaactgatgaacagaactgtgttatttcaaaactgaaaaaagcacacattgcccaagatgagaaagagcactgtgcccgagaaagggttgatgaatgcctgaatgaaggaccctggaaagaccacagagaacaggaggataacaagtgtcccgttgacatcaatggaaaaatctttccaaatgatatgcccacaatctccagagaaacaacagaaacaggtggtgctctttgggatatctttcggagagaggatactgatatgttagaagcatatctaaggaaacactctaaagaatttaggcatacttattgttctccagttgaacaggttgtccatccaattcatgaccaaagtttttacttgactttggaacacaagaagaagttgaaggaggagtttggtgtagaaccttggacttttgagcagaaacttggggaggcagtatttattcctgctggatgtccacaccaagtcaggaatcttaagtcatgcacaaaagtagctgcagacttcgtgtccccagaaaatgttcatatgtgcctgcatttaactgaagaattccgtcgtcttcccaagaatcacaaggctagagaagacaaactcgagataaagaagatgatcgtctatgctgttgaccacgctgtcaaagaattagaagctttagttagatgttcttga

SEQ ID NO: 104469 - DNA, 231 bp, Glycine max
  Peptide Sequence Number=SeqID_221247
atgggcatgcataatgaatcgtatatgaatgttgctgttgctgttggtcgagacgaggagaggaggaacagtgaaatgaacaatctcaagtctcataccaaatccgagatacaaacatcatggggacccagcactctgcactcgcattctgtgcatcatgggcaccacccaagaaaatcgaaaacgaaagaaagggaaaagttagagaaaaagaaaaacaaagttgattag

SEQ ID NO: 104470 - DNA, 1235 bp, Glycine max
  Peptide Sequence Number=SeqID_221248
tagtacctatcaccttcagagggcttcacgccttcaccttcagaggactacacgtcctcgccatcagaaggctacacactctcgccttcgtagggctgcacgccctcaccttccgaggactacatgtcctcaccttcagagggctacacgccctcgccttcatagggctacacgccctcaccttccgaggactacatgtcctcaccttcagaaggctatacgccctcaccttcagaggactacacgtcctcgccttcagagggctacacgtccttgccttcagaggacaacatgtcctcgccatcagagggctacacgccctcaccttcagagggctacacgccatcgccttcgtagggctacacgccctcaccttccgaggactacatgtcctcaccttcagaaggctacacgcccttgccttcatagggctacatgccctcaccttccgaggactacatgtcctcaccttcagaggactacacatcctcgccattagagggctgcacgccctcacctttagagggctacacgccctcaccttcgtatggctacatgccctcaccttccgaggactacatgttctcaccttcagagggctacacgccctcgccttcgtagggttacacaccctcaccttaagaggactacacgttctcaccttcatatggctacacgccctcacctttagaggactagaattcctcgccctcataggactagacgtcctcgccttcagagggctgcacgccctcgccttcagaggactacatgtgccccttttcagagggcgacacgccctcgcctttagaaggcgacacgtcctcgcctttggaggggccagtagtttccttttatcagttcctgggccaccccctgatattggagggcgaccaactgtgcaagcacaaccaaaggaggaggctatcgtgcagctactatgcataccggggcaacatttcaaccgtgctgctgcaaagagacaagtgcagatcatgcgcaccaacatgaccactattacacagatatggatgacgttgctacttagcaacattctggccagcgaccgtaatgtcgatctccccctgcagaagaatcaggatcgtacccacaagacacccagtgagcccagagaagtccaacagggccctggggtctccagctttggttacgggcctctgtcagtcctacagggtgcccattccccccagcaagttcatattgttctgacatag

SEQ ID NO: 104471 - DNA, 762 bp, Glycine max
  Peptide Sequence Number=SeqID_221249
atgaacgatgaaaatggaaactttccaccaatgcagttgagatcaggaatatctagtggagccattgctggcatagctgttggaggagctgttggggtcttaattttggcacttcttctatatgttggactacgcagaagaaggaaagtggctgaggtatcccttctcccagtcccaggagcatctgaagatcagtgtagtccactccaactccatcatggtattggttgtggaagcagcttggacaaggcatctgaatcttctgttgtagcctctccaaggttgacagggattacagtggacaagtcagtggagttcccatatgaggagctagacaaggctactgatggctttagtgcggctaatataattggtcgaggtggctttggatctgtttactatgctgagctccggaatgaggtgaggttaataggatattgtgttgagggctccttatttttggtttatgagtacattgagaacggcaatttaagtcaacatttgcgaggctcagggagggatccgttaacatgggcagctcgagttcaaattgcccttgatgcagcaagaggattggaatacatccatgagcacactgttcctgtctacatccatagagatattaaatcagcaaacattttgatagacaaaaactttcgtgcaaaggttgcagattttggtctcacaaaattgaccgaatatggtagttcttcattacatacgcgtcttgtgggtacatttggttatatgcctccagagtaa

SEQ ID NO: 104472 - DNA, 306 bp, Glycine max
  Peptide Sequence Number=SeqID_221250
atgtggggcaagatattgcaatccataaggaaaagtctcataagccttcaacagaagtctatgaattctcgaaagagtgaagaagttgatagtagtgtcactagtgtgtctgtgtcactgcatgatggtgtgcagtgggtaaattgcaattgttgcatagaggaaaacaaacaatgcaattttgaccacattaatgcctcagaaggcgcaaataatgtccacgcccagcgtgatgccaacgccaacagttcttttactcatgctgtaatcaacatggtggggatgctcgtagctcatataacataa

SEQ ID NO: 104473 - DNA, 318 bp, Glycine max
  Peptide Sequence Number=SeqID_221251
atggtgtgggaacagaagctgtacgagattgtcagaataagagggagaaaacttcttcagtcggctctggacaatgttgctgtgagccaaatggcggtggtgaacccaggtggttctggaaactacacaactttcgatgatgcagtggctgcggctctaaataacaccgatacctggggtgtaaatggatatttcttgattcacgtggtgattggagtgtatgaagagtatgtttctattccccaaaacaagcagtacctgatgatgataggagatggaattaaccaaaccataatcagcttgatggttgaaagttga

SEQ ID NO: 104474 - DNA, 1092 bp, Glycine max
  Peptide Sequence Number=SeqID_221252
atgggactaggagtgatgtgtgcttatagttctcacatacttggagtatgccttagaaagaatcccaagttaacaagtttcatggatattgggaagcatgcatttggatcaaaaggtagaaacgtggctgcaacaatcatctacatggaaatcttcatgtccctcgtttcctacaccatctcactacatgataatttgatcacagtgtttttggggacaaatttgaagcttcacttgcctaatttttcttcatcccagctcctaactgcggtggcagtcttcattgcaatgcctagtttgtggatcagagacctttcttccatatctttcctttcaagtgttggcattctcatgtctctactcattttcctgtgtgtagcagccactgcactcttaggacatgtccaatctaatcattccatacctgtcctccacctccataatattccatcagtatctggcctctacgttttcggctatggaggacatattgttttccctgaattatatacagccatgaaagacccctccaaatttacaaaggtttctattgtgagcttcgcagtagttacagcaatttacacgacattggggttcatgggtgcgaagatgtttggtaaggatgtgaagtctcagatcacacttagcatgccacaagagcacattgtaacaaagattgctctgtgggcaaccgtggtggcacctatgaccaaatatgcacttgaattcaccccatttgcaattcagctagagcatgcacttccaacttccatgagtgtcagaaccaaaatgataattagaggctgcgtaggttcattttcacttttgttcatactaacccttgctctgtcggttccatatttcgagcatgtactaagtctcactggctccctggttagtgttgccgtttgtttaattttgccaagtgctttctacgtgaagatatgttggggtcagatatcaaagcctcacttactactaaacctcttcctcatcatattcggctttgttcttgccgtgatgggcaccatttcctcctcacagttactactcaaaagtcttcaatcacataacttgaggcacaaggaatga

SEQ ID NO: 104475 - DNA, 414 bp, Glycine max
  Peptide Sequence Number=SeqID_221253
atggaatcctgtgcaactcttccactttctcagcttccttatgtctacccttcaacacttagcagcaacaaagcttatcctttttggccttgcaagcgaaggagctcatcacaaccaacacgcttacactgcagcaagatgtttgtacctggatttggagaagcatcaccagaagcaaaggctgctcaaaacctccacaatttcttcaccttcgttgcagtgaagattgttgctgctcaacttgagagctacaatcatgaagcatatgaggagctgatggaattcttgagtagacactcgttgaatgatggtgacaagttctgtgccagcatgttcagagaatcatcaagacataagaatttgggtaacgactattatcaactacccaacacccaatcggtatctaattattaa

SEQ ID NO: 104476 - DNA, 762 bp, Glycine max
  Peptide Sequence Number=SeqID_221254
atgaccacacacccaactacaaaatcaaaaccaccccatgttttcttccttctcttaattcagttattgatttcgattacaagagtcaaaggtagttgcgttactggctgcaaccttgctttagcttcctattacttagggaacggcacaaacctcacttacattagcaacctcttcggaaggccaacatcggagattctaaaatacaacccaagtgttaagaacccaaacgtgattcttagccaaacacggatcaacgtgcccttttcgtgtgactgcttgaacggtgcgtttttggggcacactttctcgtacgcgatccaacacggaaacacgtacaagatagttgccgaggttgatttctcgaacctcacgacggaggattgggttggcagggtcaacagttacccgccgaatcagatacccgacaacgtgaacatcaacgtcaccgttaactgttcctgcggaaaccgacacgtgtccaaggattatgggctgttcatgacgtacccgcttcgggtcggtgacagcttacagcgggttgcggccgaagccggcgtgccggcggagctgctgctgaggtacaaccccacggcggatttcggtgctgggaatggactcgtgtttgtgccggctaaagttgaagaccagtgcacattgcacctctggatgaccctagggccagccctggttgtcttctggaaatctggtgggatgatttgtaagggttgggggcactccttgcacccttatcctatttaa

SEQ ID NO: 104477 - DNA, 786 bp, Glycine max
  Peptide Sequence Number=SeqID_221255
atggagtacaaacttgacagaatcgcaggactaatcatggccaaagggaaacaacacagtgccatcaacctttttattctaggagcctgcagaactgagaggtgggtggtaatgttgatcctaattctcatatttgctggtgtccatagtggcttagctagcttccggaacactggtgagaaactcattggagaaagacctttccgtgtactttttgcagggatatcactacctttggctgtcagtactgttgtgtattttattaaccacagatatgatggacttcaactctggcagctccaggatgcccctgggcttcatcaacttctgtggctttcaaatttcatttctttctttttcctatatccttcaactttcaatcttttagaggttgcagctgttgacaagcctaaattgcatctatgggaaactgggatcataagaataaccaggcatccacaggttatctggtgtcttgctcatacgatttggatcggaaattccgtggctgttgcagcttcaattggcttgattgcacatcatctatttggtgtctggaatggagacaggcgactggccataagatatggggaggattttgaattagttaagagtcgaacaagtgttgtcccttttgcagcaatcctcgatggccgacaagagttaccaaaagatttctacaaggagtttattcgactgccatacttgacagttactgcaataacgttaggtgcttactttgcacacccgcttatgcaggctgctagtttcaaccttcattggtag

SEQ ID NO: 104478 - DNA, 547 bp, Glycine max
  Peptide Sequence Number=SeqID_221256
ttcaagctcttgaggtcatgtacaatgcgttgaatagtccaactcagctaacgggttggaaaatcggtggtggtgatccatgtggagagtcatggaaaggggtaacgtgtgagggatcagccgttgtttccattaaactctcaggtttaggactcgatgggactctggggtacctgctttcggaccttatgtcactcagagagcttgacttaagtgataacaagatccatgatacaattccctaccagttgccaccgaatcttacgagcctgaatttaagcaataatgcactctccatgacagttggcgatatttttgctagtcttcaagatcttggtaccctggatctatctttcaataacttttctggggatcttcctccttcatttgttgcattggccaatctttcttctcttttcttgcagaagaaccagttgactgggtctcttggtgttctcgttggtttgcctttggatactttaaatgttgcaaacaataatttcagtggatggataccccatgagcttagttccatccgtaatttcat

SEQ ID NO: 104479 - DNA, 1112 bp, Glycine max
  Peptide Sequence Number=SeqID_221257
gaattcctggaagtggctatcttagtcatgcaatcaatttgtatttacgctataagccccctccggatgatttacaatgcttcttggagtttcaaattccaaggcaatgggcacccatgttttatgaccttcctctgaggcatcaaaggaaaaagtgttcttccccttccctgcaatttggtttcatgtttcccaagcttcgtgtcagctgtgcacaggtagtaagtgaccaaaaacctgtggtaggcctacggatgtacttggaaggcagaaaaagtgatagacttgcaatacatgtacaccatctttcaagcctcccaaacacaatgatccactcttcatcaggcatatcattgtggcgaggatctgatgataatgaatccagtgacatctttctagaaccaataaggtggaagggatttgcaaatgtgtgcactgcagtggtcaaacatgaccctaactggttgcatgaaacaagtggtgtttatattgtaagtggtgcacaactcattagtaaaggaagttggccaaagaatgtgcttcacttgcgcctcctatacactcacatacccaattgctgtataaggaagtcagaatgggatggtgcaccagaggcttcaagaaaatcatcttttctcacaaatctaagcacaacattttcattcacacaacaaagtcctcctcagaagcaggctccaacagtacttgactctggtgtgtatccagatggtccaccagtgcctgttcgttcctgcaaaatgcttaaatatgtggatacaagtgaggttgtgaggggcccgcacgatgctcctggtcattggttggtaactgctgctaagcttgtgactgagggtgttattcattcattttctaagttacttctctttcatgtatatgtggatacaagtgaggttgtgaggggcccgcacgatgctcctggtcattggttggtaactgctgctaagcttgtgactgagggtgatcacatgtacataggcatatgcttaatttctgatgactttgtacagtacagtatacataatgagtggtggttaacttcagccacaagaaaattagaatgtggctataatactgcattggtttggtgttga

SEQ ID NO: 104480 - DNA, 486 bp, Glycine max
  Peptide Sequence Number=SeqID_221258
atgtttgtgttggaatccactaatccagaaagcaaagaccctgaagtaaagatattgagcctcattattacaagcccagacaagcctgacctcacccttccaattccatttactactgatgctaagaagagtcttttcatccttaaggaaggaagcaaatgccaaatgaaattcaccttcactgtctccaacaacatcgtttctggtctcaaatacacaaatgttgtttggaaaactggcgttagagtggacagcagaaaaaagatgttgggaacttttagtcccaagcaggaaccatatacatttgaattggaagaagaaactatcccttctggcatgttcgtcaggggaacctatgcagcaagaaccaaggaagagagagctaactcaaatttcttgcttcagtttgtagatgacgatcgaaaatgctacttggatgtcagttactactttgaaattcagaagaacagaccaacacctcaatga

SEQ ID NO: 104481 - DNA, 516 bp, Glycine max
  Peptide Sequence Number=SeqID_221259
atggagaaaaaggttctgatattgtgctgtgttgtggccttcttggggctgttgtcggctgcaactagcttcggtgctgaagcgacaaggattaaggtttctcaggttcattttgttgcaccaaaccaaaaaaattcgcaaatccctgattccaattggaaggtggcactggtctgctttgttttatcttggctcacatttgtaattggttttctcctattgctgactggcgctgcactgaatgatcaacgcggtgaagagagtgtatactttggctactactactgctatgttgtgaaacctggagtgttcacggggggtgcaattttatcccttgcaagtgctgcatttggcattttgtattacatttccttaactgaaagaaagaatggtagccaatacccatatcctaatcaaggggtcatagccatggcacaaccgcagatcccatctcagactagtcaagaacctgtatttgtgcatgaagacacatacgtcagacgacagttcacatga

SEQ ID NO: 104482 - DNA, 1056 bp, Glycine max
  Peptide Sequence Number=SeqID_221260
atgaagaattggtcgaaggagggttggaggtggctatctaagattgattttcacggaaatgttgcttcgaaggtgatcgtgactcgccgatttggaagcggcgttaacggtggaaaggaaaatgaaatggatgttcacaagttgacgagggagttcctggtaaagctttgggttgatgatagaaaaatgagaaaccctagagacagagttaaatcattcggaggttatggtgaccccaggtggttttccgctacatctgctgtccccaggagacctaaacgacgtgccgttttgaagcagccccctattagtcaatctgtctctgacttttttgatccgcagtctcccgaagaggccaaggtagcaccgctgcttgccaggtccaacttgctaattaccagagatatcgagtgggcaaatcttgtactaggctttgaacaggaaaatcgatatgccattgtagatgcttgctaccctcagtcggtcagtgacaattattatctccttttcattaccaagttataccatattcatcccgtaggttttattcgtgaacagagcaacatcattgccagacagttgcttcgtcttaggcggccatttgttgcatacataactgatgccttggggaacgagctctttagggttcgcagacccttttggtggataacaagctcaatttatgcagaaattgatggtaaggaagttggagtagttcacaggcgatggcatctttggaggagaatctatgatttgtacttggggaataagcaatttgctgtggttgagaatcctggcttatggaattggacattcacattgaaagatattaatggtgagattttgactgatgctggtcagtatgtgattcgatttgggagttctgatcccagctccaagattggccttgctagtgcaattgaagacctggaagtcagtcgcaaactgacccttgcagagagagctgtaactgtagctcttgctatatcactagataatgactacttctcaagacacgggggctggggactacccttctttgttgccgaagagtaa

SEQ ID NO: 104483 - DNA, 813 bp, Glycine max
  Peptide Sequence Number=SeqID_221261
atgcttgttgctgggtctgaaacttcagctactgcaatggaatgtgcactgtcacttctcttgaatcatccagaagcaatgcataagactaaggtcgagatagacacttatgtggggcaagatcaactgttaatcgaacaagacatagcaaaactgaaatacttgcaaaacgtaatcacagagacacttcggctatatcctgtggctccactcatgatactccacgagtcctccaatgattgcaataaagagaagaaaagagtggaatcgaagacgaagacgaagatggaggacgcatcagcatcaaagttcatcccacaccaaatcggaggggtccaaaacgacgtgcttcgatttggtctccatggagtcaagagcgacatcacaaggagaatggatgaagcgatgaagaagcaatgcaaagttaacctgtacggaactgcttttcccctgaaggaggagcttgacaggcaaatcctgtctaggttccagcggcctcctggaccaattccatcttcaatgctgggtttggagactgttacaggaagtgttgatcactttggttttgaggattgtctaaatgacccccgtgagtcagagactttccggccattggacatgcatcatgggatggaagttcgccttggtctgtctaagggaccagtgtacccaatgtccaaggagttggcatattttgtgatcaaagcttcttgttttcctaatgctctggatgctagaaatgttattgatccatataaacagagcatgtctttcaaattaaagcagaatttatgcatgaggcatttgagttga

SEQ ID NO: 104484 - DNA, 2601 bp, Glycine max
  Peptide Sequence Number=SeqID_221262
atggcagctcattcacatatttacttgagcgtcagagccccttttgcaggttccccctcccttgatcctctcatgaaggatacacgcgagtctgacataggagattgtagggctcactctgacgaaggtctatccttacatcaatcagctccagatttcggtaagtacatattcaatgagtggaagttagaagttcgctccattaccgccgcagagatatcaagggttattttggcattgaagtatgcttggagtttgggggagaagaagttacgacgaccacggttcccggatcctgcgctcatcggttctccggggaagcgtatgatggattgcggtgttggatccatcgtgtgggtgcgtcggagaaacgggtcgtggtggccgggtcaaatcctcggccccgacgacctctccgcctctcacctcacctcgccccgatccggaacccccgtcaagctcctcggcagagaagacgccagcgtggattggtacaatttggagaaatccaagcgtgtgaaggcattccggtgtggcgagtttgatgattgtattgaaaaggctgaaaccgctcagggagggccgttgaagaaacgagagaagtatgcgcgccgagaagacgccattctccatgctcttgagcttgagaaacagatttcgaagaagccagggaaatcaagtgctagttcattgaatgctgttaaaaaggttgcggttgcggttgcatcgccgcccgaaacactgggaaatgataatgaaaaccatgcaaatttgaatgtgtattgtgaaaatgagactggtggaggttcctttccttccgaggttgccaaggatggcaatcaactgcatgtggaagtagattattctgaaacgactcctcggatgagagacttgcaggattttgggctcagaatcgcccctgcgaaaaagaatctttcatcttctgttgatccatacttttctcagaagcggattgttgatgatggtgctcgggctcttgcaagtggtggtggtattcgtacggggagtgcacttctcatgaatggagctgggcaaatagcagattcccgagcaaagaggagtagatatgtgcactttccgactgagtctagtgattctcttgaatacagagagactctaccctgtgttgagatgtcaccttcccaactcagaagggagtttccttatcatgattctttggttcgagaggctgaatatacttttatggatgatgctgaatctgattcttcagaaacagcctctacagattctgattctgattcttccgagacagaaccagacatggatgaagagatgactatattttcagctttctttcacatcatccttcatggctttactcaggatgttcctataactgcagaaactggtcatgatgctgaagaacacgaaagtactagcagtgaggagcttgatgaattgccaatttccaatgacatgtctcacctttatcctcgtgacttaataacatgtaatgatgctgtatctaaatggcaacttaaagggaaaaggaataatcggaatcttgtaaagaggtccgttggtgcttctgaaggaaaatgtattttggatggagcaggagcagatgttgaaggaaggaatggtcatttaaggcacaatagaaagggtccaagtttgcaccgctacaaatttgattttggtgatacttttgatgacgatggtcagatttttggactggaagatgaatactctctaacttctagatctatatcaaaaagtggaagtaaaattcatcgtggtgtagcttggaatgatttggcctggggtgaccatcttgcttcaaaaggatattgggatgttaaagcatattctccaatgcatggtgatcgttatgattttggtgggagggtgaggtcgatgctggttgatgtagatttgaaggttcaagcaagctataggaaagagcatgtacctttcatttctctgatgagtaaattagatgggagggcaatagtagggcacccaattcaggttgaggctctcaaggatggttcatctgatattctatttcctgcaactgatgacttcagtaatgatgggactgctattgagggaactagcgtgcttccaccagcatggaggactgcaaggagaactgcaaattttcgtgtgcgacgcccccatgttccatcttcaaatggtgttgaagttgctgcagagcttccctcttcagatcaagaacaaaacttcgaatttagaagtttaaactctggaagttccagtcaccaggctagccttcaaaagaagagtggccttaaaagtcatcggtcttcagctgacagaaagtccttaaaaaaggtgccaaagaaattgggcttgtcatctagccaaaaaactcgaactctgtcctcattatctactgaacataatcttagtagaaagccattacatgatagcagtagttatcaaacagatagattgactaaaccagaaatctctaggcccactacagtagcttgcataccagtccagttagtatttagtagattactagagaagattaataggcctccattgaaaacagctagtaatgcggctttgctgtatactggtgtgtag

SEQ ID NO: 104485 - DNA, 285 bp, Glycine max
  Peptide Sequence Number=SeqID_221263
atggagacggaatcacatgaagatttacagcacccgtcggtttcttcgaatgacacgcacagtgatgatgcgtcgaaccacagagacgctgagcaaaagcaagatgtttcgagggaagaagttgtgcagattctacaagttattgcatctacggggaggttctggtatgacttattgcagtaccgactttttgttcttaggcttcttgtttttgtgatagttagggatggtgtttgttatagggataatatcgtgttgaatttggaaataacgcagaagctataa

SEQ ID NO: 104486 - DNA, 1950 bp, Glycine max
  Peptide Sequence Number=SeqID_221264
atggatttccacaccctctcaaggaagcaactccagaccctctgcaagaagaacaagatccccgccaacatcgccaacgttgccatggctgacgctctcgctgctctcaacaaagttgaaggattggatgattttttgaatccaatcgagggggatgctggaaccccaagtgttaatcatcgtacggctgttagaacctcaactcaaaggaaaacagtcagagaagaagcagaaggttcgaaggtggaggcctcgacccggcgggttagagttgcagaagaagtggttgagctagagaacaaggatgccaatgtcccaccagtcactcccgctgcaagtaggagaagggctacagcagtttctactcgcagaaagaaagaagttgagatggcagaagaagatggtgacaagaatggtgttcaaggaaatcctaaaacacctgctccagtagctcccgtgagtaggagaagagtcactggccgttcagtttgcaccaccaagattgagacccccggtgccggtggtacttctgcgtataacacgaggagatcagttagattgttggagaaggacttatctaagatgagcttgattgatactgaagacattggacctgccaagattgatgatgatgtttctcaagaatcgagtaatgtctctcaccaagtagaatacttgtatgatactggaaagggggatagtttgcagatggaatcaactgtggtttcggaggatattcaggagttggaagtttgctctcttgagcaacacactgaatatgaatgccaatcacgtgatttagattcagatgtgaaattagttcctgtgacagaaattgatatggtggttgagtcacatggtccaaatgaagctggatcgaagaaagtcaattgtttggagttggaggctgaaccaaatgcttcggatgaagcaggatctgagtccttacctgtacttgaggaatcttctgattcttctgaaccagaaactgtaaataaggaatgcttttctctggtggcatccgaagatgcttttccagatgttactgaccaagatatcgccgctgtgactgttgtggcacctgatgacgtttccgtggatgctactcatcaacaggttgctgccattcctatgcaatctgagtgcattatggatgatcaagtcagcaatgagggtgatcataaagaagataagaacaatgagacaagagaagaggatgaacccaatgattcaaatttgaatctggaaggaagttttggcacatgtgataaatctgatgatgcaggatttgaagtgttaacagtacttgaagaaagcgctgtggtcatgcaagacattttgccttctgatgcatctcaagatgctcctatggagattgccccccaacatactgcaactttgactgttgtggtggctgatgatgcttttgatcaagatgttgctggctcgcttcctatgtcacctgtcaatgatactccagagaacataaaggaatttgttgagtgcaacactgatgatgatcaaggcatcagtaagggtgacgataaccaagatatgaacgatgaaactgaagatttgaatctggctgatggcaacatggatgatgaagactgccagcatcctcttaatgttgatgaaagtgactcgatgacaggttctgaagaagattctatccaggagcagaagagtactgatattccggttcaatctgatcagttgaagggagatgtgcacgaaagtaaaatgatgaaggaaaacgtgacctctgatgatctaagtactaagagtatcggggagctgaagaggatgctgatgcagttgacgctaaataacaaatcaaaatccaagactaatgatgtcaaggatgtagagaataaaaggactgcactgcaggtactgccacagaatcagatgaaagccagtgaagctcagattttgatggctgaatga

SEQ ID NO: 104487 - DNA, 1152 bp, Glycine max
  Peptide Sequence Number=SeqID_221265
atgcccatattctctgcaagcttgggctccttcacttccatctccttcctctcaacttcacaatcacaatcacaatcacacctttctcctttcaagttaactgtgaagacaccttggcaatggcagcatcatcactatctcacttctaaagtgttggtctctgcctctggcaacacccaaattcctaatactgaacttcttcaacgccctactcctccagaccctctcgatgacgttcgtcaggctcggagatcgtcagattggaaggctgcaaagacatatcaagatagtaaactcatctataatggtagagtggaaggttttaattctggaggcctgctggttcggttttattctattatgggctttctcccattcccccaattgagtccagtgcatgcttctaaagaaccagagaaatctatacaagaaattgcacaaggcttaattggttcaatcatgtcggtgaaggtaattctagcagatgaggataacaagaaattgatcttctctgaaaaggaagctgcctggtccaaattttcaaaacaggttaatgtaggggacatttttgaagtaagagttggttatgttgaggactatggtgcttttgttcatttgcgcttccctgacggtctttatcgccttactggactaatacacgtgtcagaagtgtcatgggatctaattcaggatgtcagagatatcttaaaagtgggcgatgaagtgagggtcaaagttgtcggtattgattggggaaaatcaaggattaacctatcaattagacagctagaagaagatccactcttagaaactctggacaaagtaatacctcaggatggttcagctgatcctgattccatgagcggtggtgatagcggtagcattgagcctcttccaggacttgaaacaatccttgaagagctgctacaggaagatggaatatatgacgtaagaatcagccgtcaagggtttgaaaaacgagtggtctcgcaggacttgcagctttggctttgtaatgcacctcccacgaaccaaaggtttactcttcttgctcgggctggaagacaggtgcaggagatacacctgactacatcccttgatcaggaaggtatcaagaaggcattacaacgagtactggagcgtgtcccctga

SEQ ID NO: 104488 - DNA, 300 bp, Glycine max
  Peptide Sequence Number=SeqID_221266
atgacgagaagagaggtggtcttcaagggcaacacaacgaacatgatgattatcgacaaaggagagaacaaggagaaaggtgatcttgggcaacacaaccaaatgcatacatggagagaacaaaaggcgatgacaaggagagaggtggtggccttcaagtgcaacacaacgaaatgcgcagtaacattgacaaagaatagaagaacaaaaggcgatgacaagagaggagcggtcttcaagggcaacacaatgaaatgcatacgtggtaatatcgataaaggagagaacaaaaggcgatga

SEQ ID NO: 104489 - DNA, 219 bp, Glycine max
  Peptide Sequence Number=SeqID_221267
atgtctgaatacaaacactttgacgtcatcaccctgcagcatggcgactggcctctggatttggcaaaagaggaatcaaagctggaggagataaagaactattccatctatggtcacaatcatcgccatacaacaatgtcccctcatgcctgtgttctgatgcaagtaggcagtgtttcattctctagtgcatatgggaggaaattaattattagatag

SEQ ID NO: 104490 - DNA, 1200 bp, Glycine max
  Peptide Sequence Number=SeqID_221268
atgttaaccagtatttacgagttgcatgccatgaatgtcaatacaggaatatgggcaatattgaggaacaatgagatgctgacctggccagagaaagtcaaatttgcaattgggcttctaccagctatgcttggtggacagccatatgttgaggctcaagatggtctttcagttcaagaatggatgaaaaagcagggcgtacctgagcgagtaaccgatgaggtgttcatagcaatgtcgaaggcactaaacttcatcaatcctgatgaactttcaatgcaatgtatattgattgctttaaaccgatttcttcaggagaaacatggttctaagatggcctttttggatggcaatccccctgaaagactttgtatgccgatagttgatcatattcagtccttgggtggtgaagttcatctaaattcgcgcattcaaaaaattgagctaaatgatgatggaacggtgaagagcttcttactaaataatgggaaagtgatggaaggagatgcttatgtgtttgcaacacctgtggatattctgaagcttcttctaccagacaactggaaagggattccgtatttccagagactggataaattagttggagtcccagtcataaatgttcacatatggtttgacagaaaactgaagaacacatatgatcaccttctctttagcaggtcttccacaaactttgaaacacctgtaatgtctggaagggatagaaatgctgttcatttaataagtccccttctaagtgtatatgctgatatgtcagtaacttgcaaggagtattatagcccaaaccagtctatgttagagttggtttttgcaccagccgaagaatggatttcacgtagtgatgaagatattattcaagccacgatggctgagcttgccaaactcttccctaatgaaatatctgcagaccaaagcaaagcaaagattctcaagtaccatgttgttaaaacaccaaggtcagtttacaaaactgttccaaattgtgaaccttgtcgtcccttacaaagatctcctttagaaggtttctatttagctggagattacacaaaacaaaaatatttagcttcaatggaaggcgctgttctttctgggaagctttgtgcacaggctattgtacaggattctgagctactagctactcggggccagaaaagaatggctaaagcaagtgttgtgtaa

SEQ ID NO: 104491 - DNA, 1035 bp, Glycine max
  Peptide Sequence Number=SeqID_221269
gttgcccggcgttcgcttacgcggcgtacgcggctgcaccattccatccaccttcagcagtcggggtgctgctggcggaactgaacaaggcgcgcggcgatgtcgagggcgattttatcggactggagatggcgggcgcgggagagattttcaagcgaggagagctcgccggggttaaagcggctgagccacttgtagccggttttgcggctgatgccgtggcggcgaggatgaattcaaggcgtagcatggtaacagtctcagtccagggcatagtgagtctcctctgctatgccgtttataactgttacccatgtgcccggtctaaagtgttacccatgtggccggtttgtacctcaatgcgcaccctacgggatgttaccccggctgggcaatgccgcaatatgggtctgttaaaccttaacactgttcgcaaaggttgcactctgacgctgctgatggagccttaccttatgagcctgcctgctgtcctgctggaaaacgccctcacctggcgtcgtcagttacatcaacaccctgaactgggttaccaggagcagcagaccagcgagctgttagcccaggtgctgaccgatgccggactgcaggtgtttcgcggcctcgccggcactggcgtgatcggcacgctggaaaacggtcccggtccggtcatcgggctgcgcgccgatatggatgccctgccgattaccgaaaaaggcgagccgcagtggaaatcgagccggcctggcgtgatgcacgcctgtggtcacgatggccacaccgcgatattgctggccgcagcctgtcagctggccgccacgcgcaatttcaaagcgcttcccgatggatgccgtgtacgcgatgcacaactggccgggattgccggtgggatcgctggcgattacgctgcacggcaaaagctgccatgcggcgatgccggaaagcggtgccgacccgatggtggtcgccgccgagctgattctggcgctgcaaaccatcccgtcgcgccgcctgtcaccgctggcgtcggcggtg

SEQ ID NO: 104492 - DNA, 742 bp, Glycine max
  Peptide Sequence Number=SeqID_221270
atggatggttttatgtcttttaccagttcttcctcccgaattgagaccgattattcaaatcgatgggggagaaattggtacaagaagccgtggatacactttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggtccatcactttcattacatagatgtggattgccccgcgaaatagcaatagaacttttccagacatttctaattcgtggtctaattcgaaaacattttgcttcgaacataggaattgctaagagtaaaattcgggaaaaagaaccgattgtatgggaaatacttcaagaagttatgcagggacatcccgtattgctgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgag

SEQ ID NO: 104493 - DNA, 108 bp, Glycine max
  Peptide Sequence Number=SeqID_221271
atggtgtcgtcgtcacaaaaagttgcgccacaatatcgcaagtcgcaacacggaaacgagaaaatccttttaaactcaccagagaaggtcgttggaatcgccggttga

SEQ ID NO: 104494 - DNA, 3198 bp, Glycine max
  Peptide Sequence Number=SeqID_221272
atgtggggtcctgccaattgtttgtcggaggaaaatgatcagcaaggacttgccccccgtgtttttcagcgactctttgctcgcataagtgaagagcaaactaagcattctggcaaccaactcaattatcagtgccactgctcttttcttgagatatacaatgagcaaatcatggatctgttggatccgaatcagaaaaacctacagattagagaagatgtgaagtctggtgtctatgttgaaaatcttacagaggaggatgtgtcttcaattaacgatgtaactcagcttttaataaagggattatcgaacaggagaactggtgcaaccagtataaattctgaaagttcccgctcgcatactgtttttatttgtgttgttgaatctcgatgcaagagtgcagcagatggtatgagcagatttaaaacaagtaggatcaatcttgttgatctagctgggtcagaacggcaaaaatcaacaggtgctgcaggagagcgattgaaggaagctggcaatattaatagatcactctcacagcttggtaatctgataaatattcttgcggaagtctcccagacaggaaagcagcggcatataccgtatagagattctaggttgacatttttgttgcaggagtctcttggaggaaatgcaaaattagcaatgatttgtgctatttcaccagcacaaagttgtaggagtgaaacattcagtacactgagatttgcacaacgtgccaaagctatcaagaacaaggcagttgttaatgaagttatggaagataatgtgaagcacttgcgacaagtgattcggcaactaagggatgagcttcatcgaattaaagcaaatggttacaacccaacggagtcaagtggaggtcattcagcagcttggatccgacaaagcttgaacttgttacaatccagcctcaatcgaccaccaccattatcccgtctcgatgaagatggtgatgaggagatggagattgatgaggaaggtgttgaggaccatgatggagtttcctgcactgccaatatgccgagtaattgtaatattgtagacaataatgacaacgaaatgaacactgatgatcaggatttggctcaacctggtgtggagaaaaatatacctagttgctctggcagtaaaggtttgaatgaagaaccatcccgtgcaatggtccaaaacagtttctcttgtcctattggtgaatctgattctcctagtgcagcaacaaattgtgtctcgcctgccggccttagcatagttcagtgtgatttatccccaatccttaaatccccagctcctagtgtttcacctagaatcagcaccagcaggaaaagtctgaggacatcaacagggctgtctccttctgagaatgatcttcatgttgaaaaagatttggacatgaaaaccatcactaagaaaagctcaacttctgccttgtctagtcagacatctccaaatttccttagtaaaacagaaaatttagcagcaagcatacggcatggtcttgaaattatggatagttacaaacgtaattcagctttgaggcagtcaccatataggttttcattacaaccaagagagtctagattaatttttcccactaacaaagttgatgtgggcctacagacttctcttgatgatattgttggagaagattctgttctattcacctgtagtaattgtaaaaacagagctcatcttgatgccaatgagactgacaatgattcaaatctacagttgatacctgttgattgtcttgagtttgctgataagccaaagaagcaagttatcaaagcagtagagaaggttttggcaggatctataaggagagaaatggcccttgaagagttctgtgccaagcagacttctgagataatgcagcttaatcgcttggtgcaacagtacaagcatgagagggaatgcaatgccataattgcacagacaagggaagataaaattcttcgccttgagagccttatggatggtgttttacccactgaagagttcatggaggaagagctagtggctcttacccatgaacataagattttaaaggataagtacgagaatcatccagaagttttgaagatggagatagagttgaaaaaagtgcaagaggaactagagaagtatcaaaatttctacaaattgggggagagagaagtgctgatggaagagatacaaagcttaagaagccaacttcaattttatgtagactcttcatccacatcagcaaggaagcaatatccgctattgcaattgacttactcgtctgagcccagtatggcagcaaccctcactgtcattccagagtccacagaggagagagaagaaacaaatgaaactcttgcatcatccaggaatgatactgaagcacaatttgaacaagaaagaattaaatggacagaggcagaaagcaggtggatttctctttctgaagaactgagagctgagcttgagagtagcaggttgctagctgaaaagaggaagcaggaattagatgcggagagggagtgtactcaggagcttcaggaagccatgcacatggctatagaaggccatgcaagacttttagagcaatatgcagatttggaagagaaacacatccatttgcttgcaaggcatagacagatccaggatggaattgaggatgtcaagaaagcggcttccagagcaggagtacgaggtgcggagtctaagttcataaatgccctagctgctgaaatttcagctttaaaagcagaaagagaaaaagaacggcgaatcttaagagatgaaaataaagggcttcagtctcagttgaaggacactgcagaagcagtgcaagctgctggtgaactgcttttgcggcttaaagaggctgaggaagctgtcactactgcacagaaacgggctatggatgcagaacaggaagctgccaaggcctacaaacaaattgataagttgaagaataaacatgaaaaggagattatcacactaaatgagcttcttttggaagcacgtttgccaaaggaatctgtacgaccgacttatgatgacgatgttgtcatgcctagttatgacgactcaaaggagccaaagagtgttaatgatcagtttgagccatttactaataatgcagagtatggtgagctcgccaaagtaacagaatcatcgtggttctctggttacgacagatgtaatatataa

SEQ ID NO: 104495 - DNA, 1668 bp, Glycine max
  Peptide Sequence Number=SeqID_221273
atggcgcctcccattcccaaagttctcatggtcgcagagaagcccagcatcgctctctctattgcttctgttctctctcacgctcagatgtttacgagaaggggaagcactgaagttcatgaatttgatggcaagtttcttggatcgcctgcacattttagagtaacatcagttattgggcatgtattcagtgtagattttcctggtaaatatcaagattgggcagccacagatccgttagatctttttcaagctcaggttataaagaatgaatcaaacccaaaggcacatatatgtagacatttaagtcaagaagctcgtggatgtcgttatttggtattgtggttagattgtgatcgtgaaggagaaaatatatgttttgaggttataaagtctactggtttccatataaatgatacttaccgtgcacggttctcttctgttactgagaaagatgttgtgaaggctctagacaaccttgtcagacccaacagagatgaggcgctggctgtagatgctaggcaagagatagatttgaaagttggagttgcctttactcgatttcaaacgagttatttccagggaaaatatgggaacctagattccagagtcatctctctcaagccaacaaacaaaggacacccatttgatacttttatgccattgcaggttgctatgatgtttcaaaagctggtttctgaagatggacttttggaagttacagaaatatcagaaaaacaggaaaccaaaagtcgccctgttggtctaaacacagtgaatcttctgaaggttgcttcaagtgctcttggatttgggcctcagatggctatgcaactagctgaacggttgtatactcaaggttttatcagctatccacgcacggaaagcacagcataccctccttcatttgactttcgtggtgtactctctgcacaaacaaataatccaacttggggtaattatgtacaagggctacttaccaatggttatcaaaaacctcgattgggaacagatgtaggtgaccatcctcccattactccaatgagatcagcagcagaagatatgctgggcaatgatgcttggaagctgtaccaatatatctgtcaacacttcatagggacagtgtctccggactgcaagtatataaggagaaaggttgaattttccattggcggagagtcctttcattgtacagggcagcatgttgtcaccaaaggatttactgctattatgccttggttggccataaatgataaaaatatcccatcatttataaaagggcagaaaatagaagtatcaaaattggagctctatgaggggagcaccagtcctccagatttccttactgaaagtgagctgatatccctgatggagaagaatggaataggaacagatgcatcgattcctgttcatattaacaacatatgtgagcggaattatgtgcaggtacaagcaggcagaaagcttgtcccaaccacattaggcataacattagtaagaggttatcaaacaatagatccagatctctgcctgcctgatattcgtagcttcattgagcaacaaattactcttattgccaagggtcaggtggatcatcgtcatgtggtgcagcatgtaatccaacagttcacgcagaagtttagttactttgtcaaaaaggttggctaa

SEQ ID NO: 104496 - DNA, 699 bp, Glycine max
  Peptide Sequence Number=SeqID_221274
atggccgcgtgtggctatatatctgctgccaacttcaatcatcttgttggcgccagaaacttatccaaattcagttcttcggatgccacaatttcgttatcatttggcgggagcgattcaatgggtcttagtttgcgacccgctccaattcgtgctcctaagaggaaccatttctctcccttgcgtgtcgtttgcgtcgattatcctcgaccggagctcgaaaacactgttaatttcgtcgaagctgcttacttgtcttccaccttccgtgcttctccgcgtccactaaaacccttgaacatcgttattgctggcgcaggattggctggtttatcaactgcaaaatatttggctgatgctgggcataaacctatattgctggaagcaagagacgttctaggtggaaaggttgctgcatggaaagacaaggatggagactggtatgagacaggtctacacatcttctttggggcttaccctaatgtacagaacttatttggagaacttggcattaatgatcggttacaatggaaggagcattctatgatttttgctatgccaaataagcctggagagtttagtcgatttgattttcccgatgtccttcccgccccattaaatgttggatgtctctataaaaagcacattgaatgcctttatctttggaaatcctacaatgctgaatttgcagttgtctga

SEQ ID NO: 104497 - DNA, 1098 bp, Glycine max
  Peptide Sequence Number=SeqID_221275
atggaaatgtcaagtgtatacttttggctacctgaacctcctgaaaattacaatgcccttggctatttggttactaagaaacctgacaagcctttgttggatgaaatgtgtcgtgttcgtgctgacctcactgataaatgtgaaccttaccacctaatactcactgctggttctagaattctagagttttcatttcaggtatggagcttgagaccttgtgaccgtggcatgctagggaaaggagtttctgttggtacttttttctgctgcagtggctggaccatgggagaagatatacctgttgcatgcttgaagaacctaaatcacgagctaccagcagcaatgccaaatttgcaacaaatacatgcacttattaagcattatggcccttctattttctttcatcctcaggaaaaatacttggcatcttctgtggattggtttttcaacaacggagccatgctgtgcaaaaagggtatgtctaaaggagagggaattgatgcaagtggctcaaatctaccaagtggggcaacaaataatggccagtattggatagacttgccaagtgatcatgatagaaagaattttgtcaaacgtggggacttgaagagtgcaaggctttatgttcatgtgaagccagctcttggtggaacttttactgacattgcaatgtgggtgttttgcccttttaatggaccagccactctgaaaattggaattaagaatattccattgagcaaggttggagagcatgttggtgactgggagcattttacaattcgtatatgcaacttcagtggagaactctatagtatatacttttctcagcacagtggtggtgaatgggttgatgcctatgacttggattatattgaaggcaataaagctattgtttactcatctaaatgtggacatgcaagttaccctcatccttggacctatatgcaaggttcttcaaaacttgggattggcattaggaatgatacggctcgcagtaatttgtatgtggattctagtattcactatgagcttgttgcagctgagtatcttgaaaatgatgtcactgagcctcaatggttgcagattatgagagagtag

SEQ ID NO: 104498 - DNA, 828 bp, Glycine max
  Peptide Sequence Number=SeqID_221276
atgttctgtgttatcctcttagttgcaggatctgctgctcaagaatcattcagccacctctctatatccactgcaccctacagtgcttcttggggttggttgtgctgcatggctttctgggattcattactatggccaaacttaatgatagttgacttgaacatggatctgtatattcaaagggctaatgtggtgaaatttttgaatgacaggcatgactgggataagttgaagagtatgctatcatttcagctgaagcaggtactgtcagaatatcctgaggcaagaatgacaagtgagcagcagtacgcgtcatttggtgaatcctacattgagttggtcaacaaattggatgaagtctcaaccagaccagttcatgctcgaactggactgaccagttggtgtggtctagttctcaaaacattggccataactacaaaactcacttgtttcattgaaggccccccatttacgttgcaaaggctttgtgagatcctattggatgcaaaaggcctttatccaaatctttcaaagcttgctttagctcttgaaaagaacttgttagttacatctacattgacaatctgcactgatccatacccacaagctacagccaaagagctagatgaccaagagaagccaagtgaaaagcagcagcaacagcaacaatccgatagtgcagaaaatggcgttgagcttctggtgtctgacaaagacgaagtaatgaccgaggctgatgtaggtgatgatatgaccattggcatggaagcttttgaaggcgttaaatcatcagaaacaaattccgagctgaatgctaatagtgcataa

SEQ ID NO: 104499 - DNA, 2574 bp, Glycine max
  Peptide Sequence Number=SeqID_221277
atggccgccgagaagctccgagatttgagccagccgattgacgtccccttgctcgacgccaccgtcgccgccttctatggcaccggatctaaggatgaggtctctctatcactctcgtctcttccaaacacttcgcacttacacttagggtttaaccactcaattgaatataacgccttttggtttcgttatacgaattatcctcttgctgatatgtgcaatgtggagatatatcaattgttctactcgtttcgcgtttcaactacaagccgtttcgttctgttgttttcgtcgttaagaaatgccgccgatcagattctgcgggacttgcaaaataatccagatatgtggcttcaagtcatgcatattttgcaaaatactcaaaacctgaataccaagttcttcgccttacaggttctagaaggcgtaattaaatatagatggaatgcattacctgttgagcagcgagatggaatgaaaaatttcatatctgatgttattgtacagctttctagcaatgaggcttcatttcgagcggaaaggttgtatgtcaacaaactcaatattatattagttcagattttgaagcatgagtggccagcaagatggcgaagctttattcctgaccttgtttcagctgctaaaactagtgaaacaatttgtgagaattgtatggctatattgaaacttttgagtgaagaggtttttgatttttcaagaggagagatgactcagcagaagataaaagagcttaaacaatcattgaacagtgaatttcaactcatacatgagttatgcttatatgtgttatcggcatcccaaaggactgagctcatacgagctactctatctacattgcatgccttcttatcatggattcccttgggttatatatttgaatcacccttgcttgagacactcctaaaatttttccctgtcccagcataccggaacctcaccttgcaatgtttaactgaggtggcagcccttcaatttgtgaattattatgatgtgcagtatgtcaagatgtataacatattcatggtccagttgcagggaatactcccgccaactacaaatatacctgaggcatatggacagggttcaagtgaggaacaatttcacattcgcatcctggaatccactcaagagaatatagctgctttgctagtgggccttgaatatgtgatcaacatttcatatgtggatgatactgaggttttcaaggtctgtttggactactggaattccttggtatcggagctgtttgaaccacaccgaagtttggataatcctgcagctgctgcaaccatgatgggacttcaggtaccagcaatgctccctggtatggttgatggacatggttctcagctccttcagcgccggcagctttatgctggtcccatgtcaaagttaagaatgcttatgatctgtcgaatggctaagcctgaggaggtgctcatagttgaagatgaaaatgggaacattgtccgtgaaaccttgaaggacaatgatgttcttgttcaatataagattatgagggagactcttatttacttgtcacatcttgaccatgatgatactgaaaagcagatgttgaggaaattaagtaaacaactaagtggtgaggattggacatggaacaatttgaatacactctgctgggcaattggttctatatcaggttccatgatggaagaacaggaaaacagattcttggttatggtcattcgcgatttattaaacctatgtgaaatcacaaagggaaaagataacaaagctgttattgcgagtaatatcatgtatgttgttgggcagtatccacggtttttaagagctcattggaagttccttaaaactgttgtgaacaagttgtttgagtttatgcatgagacacatcctggagttcaggatatggcctgtgacacatttctgaaaatagtccagaagtgcaagcgaaaatttgtaatcacccaggttggggaaaacgagccatttgtgtctgagcttctgacaggccttcccatcactattgcagatcttgaaccccatcagatacattccttctatgaatctgttggtcacatgattcaggcagagtctgatgcacagaagagagatgaatatcttcagcggttgatggagctcccaaatcagaaatggatggaaattattgggcaggcacatcaaaatgttgattttttgaaggatcaggatgtaatccggacagttcttaatataatgcagacgaatacaagtgttgcaacttctttagggacatatttcttgccccaaatctcgttgatctttttggacatgttgaatgtgtacagaatgtacagtgagcttatttcaaagagtattacagaaggtggaccttttgcatctagaacatcctatgtcaaacttctacgttcggttaagagggagacacttaagctgattgagacattcttggataaggcagaagaccagccacaaatcggcaaacaatttgtgccgccaatgatggatcctgttcttggagattactccaggaatgttcctgatgcaagggaatcagaggtgctttga

SEQ ID NO: 104500 - DNA, 2601 bp, Glycine max
  Peptide Sequence Number=SeqID_221278
atggagaacttgttaagcgaagtcaggttcattacaaaaagcgccggcctcacccttccttaccctccgtttctcaatctcgccgccggcgcaactgcttcatctctccggcgaacgcaaccgaattcttttcccatggcagagaatctgatagcgccgaagcttcccgtcgaaggaaagcgcaacattctcatcaccagtgccttgccttacgtcaacaacgttcctcacctcggcaacatcattggatgcgtgttgagtgctgatgtattcgctcgctactgtcggcttcgcggttataacgctatttacatctgcggtactgatgagtatggaactgccactgagactaaagccatggaagaaaactgctctcccaaagagatttgtgacaaatatcatgctattcataaggaggtgtacaattggttcaatataagttttgatgaatttggacggacgtcatcccctgagcaaactgaagtttgccaagcaattttcagaaagatattcgaaaacaagtggctatccgagaacacaatgcagcagctttactgcaacacctgtgaaaggttcttggctgataggcttgtggagggaacctgcccgactcctggctgcgagtatgattctgcccgaggagaccagtgtgagaagtgtggaaagcttctaaatccaacagaattgaaaaatcccagatgcaaggtttgtcagaaaactcctcatattcgtgatacagatcacttgtttcttgaactccccctattaaaagatagattggaaaaatacatcagtgagatgtctgtggttggtggatggagtcaaaatgctatccaaacaacaaattcatggcttagagaagggttaaagccacgctgtattacgagggatctaaagtggggggttcctgttccacatgaaaaatacagtgacaaggttttctatgtttggtttgatgcacctattggatatgtctcaattacttcgtgctacacacatgaatgggagaaatggtggaaaaacccagagaatgtggagctgtatcagtttatgggcaaggacaatgtgccattccacactgtgatgtttccatctactctacttggaactagtgaaaattggactttaatgaagactattagtgttactgaatacttgaattatgaagcagggaagttttctaagagcaaaggtattggggtttttggtaatgatgcgaaagatactaatattccagttgaagtatggagatattacttgctcacaaataggccggaggtatcagatacgttatttacatggccggacttgcaagctaaactaaatagtgagttactgaataatttgggcaactttatcaaccgagttttgagttttattgccaaacctgcagggcaaggatatgattccattatcccctctgttcctgataatgtaagtggtgactcccatggtccgaccaaaaagttggctgataaagttgctgcatatatagaccaatacatagaagcaatggagaaggttaaactgaagcaagggttgaaaactgcaatgagcatatccagcgagggaaatgcatatctgcaggaagctgaattctggcgcctctacaaggaaaacaaatctctctgctctcttgtcatgaaaactgcagctgggattgtatatcttcttgcttgtttgttagaaccttttatcccatctttcactcttgaagtatttaagcagctaaatttgcctgcggatacacatgtttcacttagtgatgataaaggagatgttgatagggtaaaaagaccctgggatatcataagtgctggtcataaaattggaacacccaagccattgttcagggaactgaaagatgaagaggtggagttctacaggaagaagttcgcaggaagtcaagctgataggattgtgcgtgcagaggccgaagctcagaatgttgctgagcaactgaagaaaacgaaagtttcagataacagaattgttcaagattacttacacttattagggctattgtttactacagatggcaatggaaagaaaaaaccaggaaaatcatcaaatgaagccaaaaataaagctgctgctgaaccagatattaccatcacaaggcttgatatccgggttggcctcataataaaagctcaaaaacatcctgatgcagatgcactatatgttgaagagattgacgtcggtgaagaacagaccagaactgttgtcagtgggcttgtcaaatttataccactcgatgaaatgcagaaccgaaaggtctgtgttctttgcaacctaaagccagtaaccatgaggggcattaaatctcaagcaatggttcttgctgcttccgatggtgatcacaccaaggttgagttggttgagcctcccagttctgctcaaccaggagaaagaattacattccctgggtatgaaggtaatcctgatgaactcttaaacccaaagaagaaagtttgggaaacattgcaagtcgatttgcacacaaatgaggaactggtggcatgctacaaaaatgttccactcaccacatcagctggcgtttgcaaggtttcatccataagctgtggatccataaggtag

SEQ ID NO: 104501 - DNA, 844 bp, Glycine max
  Peptide Sequence Number=SeqID_221279
atggtttcttatacaagttatttcatttatagaagagcagagaacccattgcaaatccttaaatttcgtagcatcttctttttctcactggaagctacatgttggcaaacatacggtaccttgagacattgtcattctgggtcagaacggggtaaaaatcagaaattgacaaacagggtggggcttttctgggacttggacaataaaccacccaattcaatcccaccttatgaagttgccaataagctgagaatagctgcatcttcctttggtgttgttcgttatatggtggcttatgcaaatagccacacttttagccatgtccctcaaggtgtccgggagagtaggaaagagaaggaactgttgtatcgtttagagaataagggtgtcatcaagccaaatcaaccttatcgttgtaaggtttgtgggagaaagttttatactaatgacaagcttgttaaccatttcaagcaactgcatgagagtgagcacacgaaaaggatgaaccagatagagtctgctagggggagcaggagggtgaagttggtggccaagtattctatgaaaatggaaaagtataagaaggctgcaagtgatattctcactcccaaagtggggtacggtttggcggatgagctcaaacgggctggtttttgggttcgaacagtgtcggataagccacaagctgcagatcaagcactgcaaagccacattgtggatatcatggatcataggcgggttgagtgtgtggtccttgtgtctgatgattctgattttgttgatgtgataaacgaagcaaagatgcgatgtctgaagacggttgtcattggggatattgatgaag

SEQ ID NO: 104502 - DNA, 1725 bp, Glycine max
  Peptide Sequence Number=SeqID_221280
atgacagagaatctgaaagcgccgaagcttcccgtcgaaggaaagcgcaacattctcatcaccagtgccttgccttacgtcaacaatgttcctcacctcggcaacatcattggatgcgtgttgagtgctgatgtgtttgctcgctactgtcggcttcgcggttataacgctatttacatctgcggtactgatgagtatggaaccgccactgagactaaagccatggaagaaaactgctctcccaaagagatttgtgacaaataccatgctattcataaggaggtctacaattggttcaatataagttttgatgaatttgggcggacgtcatcccctgagcaaactgaagtttgccaagcaattttcagaaagatattcgaaaacaagtggctatccgagaacacaatgcagcagctttactgcaacacctgtgaaaggttcttggctgataggcttgtggagggaacctgcccgactcctggctgcgagtatgattctgcccgaggagaccagtgtgagaagtgtggaaagcttctaaatccaacagaattgaaaaatcccggatgcaaggtttgtcagaaaactcctcgtattcgtgatacagatcacttgtttcttgaactccccctattgaaagatagattggaaaaatacatcagtgagatgtctgtggttggtggatggagtcaaaatgctatccaaacaacaaattcatggcttagagaagggttaaagccacgctgtattacaagggatctaaagtggggggttccggttccacatgaaaaatacagtgacaaggttttctatgtatggtttgatgcacctattggatatgtctcaatcacttcgtgctacacacgtgattgggagaaatggtggaaaaacccagagaatgtggagctgtatcagtttatgggcaaggacaatgtgccattccatactgtgatgtttccatctactctacttggaactagtgaaaattggactttaatgaagactattagtgttactgaatacttgaattatgaagcagggaagttttctaagagcaaaggtatcggagtttttggtaatgatgcgaaagatactaatattccagttgaagtatggagatattacttgctcactaataggccggaggtatcagatacgttatttacgtggtcggacttgcaagctaaattaaatagtgagttattgaataatttgggcaactttatcaaccgagttttgagttttattgccaaacctgcagggcaaggatatgattccattatcccctctgttcctgatgatgtaagtggtgactcccatggtccgaccaaaaaattggctgataaagttgctgcatatatagaccaatacatagaagcaatggagaaggttaaactaaagcaagggttgaaagtcgcaatgagcatatccagcgagggaaatgcatatctgcaggaagctgaattctggcgcctctacaaggaaaacaaatctctctgctcccttgtcatgaaaactgcagctgggattgtatatcttcttgcttgtttgttagaaccttttattccatctttcactcttgaagtatttaagcagctaaatttgcctgtggatacacatgtttcactttgtgacgataaaggagacattgatagggtaaaaagaccctgggatatcataagtgctagtcataaaattggaacacccaagccattgttcagggaactg

SEQ ID NO: 104503 - DNA, 258 bp, Glycine max
  Peptide Sequence Number=SeqID_221281
atggcaaagccatttgttgggcatctatatgtgggtcaactgactaaagatgagaagattattgttgctgatatgacgaagtccatggtgaagccaagaaatgttcttttgacgttgaaggatcacaatgccaatagttatacaacagtcaaaaaaatttacaatgtcagacatgcttaccaatattccctaagagggagtaacaccgaaatgcaacagctcatgatgctccttgaccgagatcaatatattcactga

SEQ ID NO: 104504 - DNA, 1446 bp, Glycine max
  Peptide Sequence Number=SeqID_221282
atggcttacatgtgtgcagacagtggcaacctgatggcgattgcgcaacaagtgattaagcagaagcagcagcaagagcagcagaagcagcagcagcagcagcagaccaatccaattccatggaacagcactcctcctctccctcccaccgatttccccgaccccttccaatccgatccccccttccacttccaacccttccgcttctccgacttcgactccgacgactggatggactccctcatcgccaccccctcctcctacaccaccgatttccccttcccctcctccgatctcaaccgcctcatcttcccgccccaatcccccgactcggactccccacagcagcctctcctaaaagccctgtcggagtgcgcctccctctccgaaaccgaaccggatcaagccgccgaatccctaagccgtttgcggaaatccgtctcccagcacggaaaccccaccgagcgggtgggcttttacttctggcaggccctgagccgtaagatgtggggagacaaagaaaagatggagcccagtagttgggaggagttaacactctcttacaaggcccttaacgacgcctgcccttactccaagttcgcccacctaaccgccaaccaagccatcctcgaagccaccgaaaacgcctccaacatccacatcctcgacttcggcatcgtccaggggatccagtgggccgcgctcttgcaagctttcgccactcgtgcctctggaaagcccaacaagatcaccatctccggaatccccgccgtctcccttggtccctctcccggcccttctctctccgccaccggcaaccgcctctctgacttcgccaggctcctcgacttgaacttcgtgttcacgcccattctcactcccattcaccagctcgaccacaacagcttctgcattgacccaaacgaggtcttggccgttaacttcatgcttcagttgtataacctcttggacgagcctccctccgcggttgacactgcgctcaggttggccaagtctctcaaccctagaattgtcacccttggcgagtatgaagcaagtgtcacacgtgtcgggtttgtcaaccggttcaggactgcgttcaagtacttctctgctgtgtttgagtctctggagcctaatttggccgcggactcgccggagaggtttcaggtggagagtcttctgctcgggcggcgtattgccgctgttattgggccggggccggtgagggagagtatggaggacaaggagcagtggagggttctgatggagcgtgctggttttgaatcggtgagtctcagccattatgcaatcagtcaagctaagatacttctctggaattacagctacagttctctgttttcgcttgttgagtctaaaccaccggggtttttgtctctggcttggaaggatgttcctctcttgactgtgtcctcttggcgttaa

SEQ ID NO: 104505 - DNA, 1392 bp, Glycine max
  Peptide Sequence Number=SeqID_221283
atggagcttttgggaagtctactcactggcaacaataatagttcaccaacattaagtggagtatcttggtacaagttgtcttctgttgaaattggtcttcttactagtggatcattgtatggtgccttaattggctctgtgttggccttcaatgttgctgacttcttaggtagaagaaaggagctgattggatctgcagtagtttatcttgttggagcccttgtaacagcattagctcctaattttcctgtattggtgcttgggagacttgtatttggcacaggaattggactggggccagaggtagaaggaggtgggacatgggcaatgcatgctgctccaatgtacattgcagagacagctccaacaccaatacgtggacaactaatatctctaaaagagttctttatagtacttgggatggttgcaggatatggaattggtagcttgttcgttgaaactgtagctgggtggcggtatatgtatggagttagtagtcctatggcaataatcatgggacttggaatgtggtggctcccagcttctcctagatggttacttttacgtgctatacaaggaaaaggggatgttcagaattcaaaagacatagtaattcgtagtttgtgccagcttcaaggtcaagcttttaatgattccattccttggcaagtagatgagattctggcagaactttcttatctaggtgaagaaaaagaagctacctttggagaactgttccaaggaaaatgcttgaaagccctctggattggtgcaggattggtcttgtttcagcagatcacagggcaacctagtgtgctctactatgctggatcaatctttcagagtgcaggattctctggagcatctgatgcaacccgagtctctattctccttggggtttttaagttgattatgactggagttgctgttgtcgttgttgataaacttggaagaaggcctttactacttgggggagtttcagggataggttatgccaatctgctaatcagtgctgcacggatggtgatctctttattctttctgggttcatattacattttcttggataatacaccagttgttgctgtagttggtctgctgttgtacgtaggcagttatcagatttcctttggtccaattggttggctaatgatagcagagattttccccttgcgcctaagaggtcgaggactaagtatagctgtactcgtcaattttggtgcaaatgccctggtgacatttgctttttccccactgaaggcattattgggagcaggaattttgttttacacatttggtgtaatagcggtgacatctcttgtattcatataccttgttataccagaaaccaaggggcttacactagaggagattgaggccaaatgcctctaa

SEQ ID NO: 104506 - DNA, 3858 bp, Glycine max
  Peptide Sequence Number=SeqID_221284
atgtactggcgcggcgattcacagtcagaggatgacggtggcttttcaatttcatgctctcagggccatcgatcttcgttgaaccttcaaacgcacgatgaaggtggctccctctgcctcgtgtgcttctccaaccttgtctccaatcctctctccccaaccgtccatgtctcctacgctctctcccagctctctcgctccctctccatccctcacttccttcaatcccttctcactttccaccctcacttcctcctctcccctctcctcgccgccctctcctccttccacgaccaacctatcgccgctcagctcacgcatctcatcctctctctctcttcctccgctgatccttccctttgctcccaattcatcgctaggatttccgatcgcatcgcttccgctgctttgggttggacttcccctcagttgcacatgattcactgccttggggctcttctgaattgtgagaaggatgatgatctccatgcacacatcaaagacatgtatagtttcatttctgttcttgttacgggccttcaattgccgagtgaggagattcgcggggaggttctctttgtcctttacaaactatatgttcttcagagtacatcagcagggggagatggaagtgatatgttgattcccttctgtccacagatcttgtatctgttggtggatgttctcatgaagactcaaaatgatgatgttcgcttgaattgtattgcacttttgactatgctggctcgaagacatttgctcagggaagaatgtgcatacgatactagtaacatgtcttccaatggaggagttaactctaaagaaaccgaggacggaaccaagggcacatctctggtaaatctgtttgctgaagccatcaaaggcccattactttcgtcagacagtcaagtccaaatcggcactctagatttactctttcactatttgtcttcggtcagaaattcagactatcagattcgagttttggtggaagaaaatattgcagattatttatttgaaatattaagattatcagagtataaggacccagcagtcaagatgtgccttcaggtactaggtcttttatcaactgctgaggaaacctttaaactaagactcgttgttggaatctcaactctgattccagcattacgttatgtggctgaagttccttttcaccccgtgcaatgtgagacactgaagctcatttatgaatgcatttctgagtgccctggatctgtatcaacttctcaactagaggagctgattcttgttttgataagaatgcttagaaagcattctgatggggagatgggtatgattcccgagacgtttataatggtctgctctatctttgttgctcttataagatctccatcttgtaatggagctttagatctctcaaaatcgattgaggaagcaacgaaccatgccattttagcttgtctctctgtctctgaaaggaacataaaccaaattttgcaatgtttgtacctacttaaagaggcatatgcatatagtcatgatggaaactccattaactctagtaagctggagcttagaagtggcattctagatatatgcagaacccatttactgccatggcttgtagtgggcatcaatgaaatggaagaggacattgccctgggattgctggaaacttttcattcgatattgcttctgcactctagtattaattccatggaatttgcagagactctgatttcaatcggagataggatgaaaaatagaatatatttgttgctcagttcactcatggattctctcctgggaaatgattctggacaaccaattagagaggctgctttgcacctgcctcgcgatcctattgatttactctttttgcttgggcaaaggagtactaacagtttggatttgccttcttgtcaatctgctgttttgctgattatgtacaccagttcgctatatgatgaaagttttctgactttcattgccagacttgcagatgagaagttgattttagcgtctcttgaacaatatattcttcttaataggggcaattttcataatcggaccactgataatttgaccgtgacacgactggtgaatctttacagttcactaaggggtcttggcagtatgaactaccaaattcactatagtcgagatgcggaggagataatattccagctcataaacaatgatgaatgggacttactttcagcaagaattcacacggtgtcattgaagtggctgtttcaacaagagaacataatcaactcattaagccatcagattttgaaattctgcagaagctataacttagaagaggctgacataattatcggaaacaattatcaaactgtaaatgtacagacactttcggagttggtatcaactgaagataactatggagctagacttttcgtgtgcttattagcacagctcttggaggaagaaggccgggaatatgatataatatgtgttctgaatgtcatggcaactatggttctcgtctgtccagctgcttgtgaacaattatctttgcatggaatagcgacaacaatcaggacttggtgttatttgagcaatagcttgtcgacaacaacatacatgtccatcttgattttggtttttaacactttgagttcagtgcatcctgaaacactatcggttgatcaaagctgggtagcgataaccatgaagatgatggagtgttcaattccatccaaagaggttgatatcttgagtgacgaaagcctctttgttattggcattctttccttaattttgcatctttccaccaataaagcacttgaagagacttccaaggccattctttttaatacttgtataatctccatggtcaacactgtagtctgcgcggcttcttcgaagggacctgctttggttgaccatgacgagggaacaagtacaggagaaactttaatatttgttcttttgcttcattacttcgccgttaaaagcttgcatgctattctaccagggttcgtggattggcaaagcttctttgcttcaacgaatccatccgagccgctagccttcattggaatccgttgccatgacttgtgcagacttctgcattttggttcaactgtaatcaagattgctgcttcttatagcctgttagagttatttaaaagaatatcagatcaaataaacagtaatcatgaagagttgagatgtactattgggtacataatgtccataaggagtatattggaagggctagttttctataatgatctgagagtggctacaaattgttccctctgtctgtcaatgattctgggatgggaaaagctgacaaaggaaacaaaagtcttagaagagagtagctggtgtagattgattatagaggagatgacagtatctttggcagctcctgctttagcatcacaatcattcatgaacaaccaaaggcctgcagtgcttgtagctattgcgttgctgaaactgcataaaatccctcagtggatgagatctgtgtttgataattcaagcatatctggcatattggggaacctttctgctagtaacttgagctcggagattttggctttatttcgagaactactgaaatctaacttcttaagtacagagcaaattgcaactataaatcaaatgctccaggaatgcagaaagcgtatgtacagtaacaatgctcaagaggatctcccaaatgagccgataaagaaggtcctcaccacatcgtataatatgggagacatttgtgagtatctcattgatttaatgacatcagaggcgtacttagatacgggcagtaagaagctcttagaagaaattgagctgtttttcagtaccttgtctgtagataatggtagttgtatgtag

SEQ ID NO: 104507 - DNA, 2751 bp, Glycine max
  Peptide Sequence Number=SeqID_221285
atggctacctccaaattaaaacccaaaaccctactttctccttctaagctctttcttctctcgctgtgtctcgcgtgcaccgccattgccgacgatggcgagttcatgtccaagctcgccaaggcgctgagcccgacgccgtctggttggtctgggagcagcttctgcgcctggaatggcgtcaagtgcagcgcccaccgagtgacctcaatcaacatcgcttcgcagtccctcggcggaatgcttcctccggatctcaactcactctcccaactcacctcgctctctctccagaacaacgcgctctccggcgcgtttccttcactcgccaacctctccatgctcgaaagcgttttccttagcagcaacaacttcacctccatccccgttggttgcttccagggactccccagtttgcaaaccctcagcatgaccgatagcatcaacctcgctccatggacgattcccgccgagttgactgatagcatcaacctcgtcaaactagaactcggaaacgcaaacctcattggtaccttgcctgatgtattcgacaagtttgtgagtttggtggagcttcgtctctcttacaacaacctcaccggtgtcttacccaaatccttcgctggatctgcgattcagaatatgtggctcaacaatcagaacggcttcgggttttcgggtaccattgaggtgcttgcttccatgacccacttgtctcaagtgtggcttcagaagaaccagttcacgggtcccattccggatttgtcaaattgcaccactttgtttgatctgcagctgagagacaaccagttaaccggtgtggttccaccttctctcatgtccctttctggcttgcagaacgttactttagccaacaatgcgcttcagggtcccgttccttcgtttgggaaaggtgtgaagttcactctcgatgggatcaatagtttttgtttgaaagatgttggaccctgcgattctcgcgtcaccactttgcttgatattgctgcgggtttcgggtatccctttcagttggcgcgttcctggactgggaacgatccttgtgatgattggagttttgttgtgtgtgcaggggggaagattattacggtgaatttggcaaagcagaatttgactggaaccatttcacctgcgtttgctaatttaactgatttgaggaacttgtttctcaatgataacaatttgggtggttcaataccggggagtttgacaaatttggctcagcttgaggttctgaatgtgtctaataacaagctatctggcgatgttcccaagttctcaagcaaggtgaaattcacgactgcaggtaatgatttacttgggcgttctgatggtggtggtggcagtggaactactccgtccaagggttccggtgatgcaccgagtggaagtccgagtgcagggacaagtggatcttcactttcacctgcttggatcgcagtcgtggtgtttgtgttttgcaagtgtcatgctaaaaaccggcatgggaagtttggaagggttaataatccggaaaatgggaaaggagaggttaagattgatatgatgagcgttaccaattccaatggatatggtggtgttccgagtgagttgcagagccagggcagtgagcgtagtgaccttcatgtttttgagggtgggaatgctactatttcaatccaggttcttcgacaagtaactgataatttcagtgagaagaacattttgggtaggggaggatttggggttgtttataaaggggaattgcatgatggaacacaaattgccgtgaagagaatggaatctgttgcaacggggagtaagggattgaatgagttccaagcagagattgcagttctaagtaaagtcaggcacaggcatttggtggctcttttagggtattgcattaacggcaacgaaagacttttggtgtacgagtatatgcctcaagggacattaacgcaacacctgtttgattggggtgaaaatggttgtgctcctttgacttggaaacaaagggtagcaatagctttggatgtagctcggggagtggaatacttgcacagcttggctcagcaaagcttcattcacagggacttaaagccctcgaacatattgctgggtgatgacatgagagccaaggttgcagattttggcttggttaaaaatgcgccagatgggaaatattctgttgagacacgcttggctggaacatttggatatctagcaccggaatatgcagctaccggaagagtgacgaccaaagtagacgtgtacgcatttggagtagttttgatggaactgattactggtagaagggcattggatgatactgtgcctgatgaaagatctcacttggtttcctggttccgtagggtactaattaacaaggagaacatcccaaaggcaattgatcaaactctcgatcccgatgaggaaaccatggagagcatatataaagtggctgagctagctggccattgcactgctcgtgaaccataccaaaggcctgatatggggcatgcagtgaatgtcctgggtcctctggtagagcaatggaagcccaccacccatgaagaagaagaaggttatggcattgaccttcacatgagccttcctcaagctctgcgaagatggcaagccaatgaaggcacttccacaatgtttgacatgtccatctcacaaactcaatcaagcattcctgcaaaaccttcaggatttacagactcctttgattcaatggattgccgctga

SEQ ID NO: 104508 - DNA, 1959 bp, Glycine max
  Peptide Sequence Number=SeqID_221286
atggataacaaccaagatcaaggacacgagggccatgcatttagatgtagcgaaaccgttgaaggttacgaactgtcagtttcagagcgccaaacccattccaatgcttcagaatcagatgataatcctcactcacaaggtccaaactcattggacactggcaacaatgagaaactcaatgttggaaccggagaaattttattatctagttcaggtgatgagttgtttctagatgcaaatgcaaacttttcagatggtgcagcaagtccacgaagtaaggaaccattgcgagatagctcggaatcggctactgatgaggaaataggcaacataaaatatcaagaattttcttctgggtcttcttctgattttaatgatgtaaatcagttcattgtgaaaggccaaatgcaggaccctagtattttgcaaagggaaagggtcaaggaaggaaacatgctggagttgcaaggtcaactatcaggttctcatgtggatccaccatcatcaagttcaatcacagatttgaggactattgaggatcgctttggtttatcaagtgactcaaatcccagcaaaggtgaagccgcaccagatttgttgctagaaaataagatctatgctggtgaaaatgtgagacaggaaatgggagaagaaaatgttaacatttttacaagtcctgtgtgtgatgatagtgctgatgtgacacatccccaaaatgagtgtgctgattttaaagatcataaaggagtgttaccacaaaattccttaagcctactctcatctgaagcagggaagccaaagcaagatgacttgaaggattctgatgatgatgacgattattgtcatatcaacctaagtcatttgagtgaaaaaagagaggtgctccctccagatggcaccatgacggatcaggaaagctgggagattgtgtctgatgaaatgcatgatgaagagagcattggagtttcttctgtcaagttcataactgaaagtgataaaacatcagatgaaataggagcctctatgaattgtatgaaatttacgatgattgaggattatctgagtaacttttcagatggcgtatataaaagtgatgatgtggttgaaatggataaatttgaaaaatgtgatataactgatattgaatgtgcaacaaataaaagtacaccatcaggtgctcaagaagacatcgaagacaatgaaatcaatagcagttgcagagtaaacaaagagtgtaacagactcattagtacttctgctaattcacatcaaacacaaaatgcagaactatcagtgaaggctgcagaagagcccggtaggaacgattcatcgctttattctttaggtgttgagccttctgctcaatgtgtttctgttgttcgagaaactcaaggagaagtgtctggaattactgttgtgcctgttcaagatcaaagcggtaataaaaataacaatgttcaactaccttcatctgcaattcacacttctattgattatggtatccagtgtgacagtttggaaggaaatcgggactcagtttcaggtataccatccaacttgaatgacccaaaggctgcatatgaaatccagaaggggctgaaccaacaacatcccagttctacctcttcacaggctggttggtttaccagactagttactgaagttactaatgagtctcaagggagagagaagaatgaagaaataatagccgagataacaaacgacagcaccagtgaacaacaaacacctccacagagtccattgagtgaagctgcccatagcaacaacaggcctgagtcccccaaactggaagaaagtccaatatttggaaaaaatggtgaatcagctgttgtgaaaggagagggtgacatcaatcgacaaaataagaaagtcaagagcaaactctattattgcccattattttggtgctgctcatctgtagattctccaccaagatag

SEQ ID NO: 104509 - DNA, 282 bp, Glycine max
  Peptide Sequence Number=SeqID_221287
atgacgatgtctagggtggtcattgcattgtgccatagtcagagaccaacagtgtttggccattctaccccgtcacttgcatcgattgtacctcttaccaaaacaaaggatttggtggtgatggtcatccccggtggtggcaaactatgtgggtggcagcgattaaaggtgtcgccgatttcttcaacctccaattgcctccgtagcctccttccatctccaccgcatatgttgatgaccaccacccatcagcacatcaaagacattaaccctaaaccttaa

SEQ ID NO: 104510 - DNA, 1521 bp, Glycine max
  Peptide Sequence Number=SeqID_221288
atggtgaatgcactcactcacagtcagagtcagtttgtgttggtgctattgaactccaattgcagagggagcaagagtagtagcaacaccgtcttccgaaaaccctttgcgaaattttcatccctcaccactaaaatttgccacgcctcttaccaccgtttcgctgacacaaagcacacaacccttctggttgagacttaccatctccatcacagcctcagagccttacttgcaaagcttgagaacgaatattccaaccctcttcacatgctcgcagaagacgctgattggtccaaagaccatttttgggctgttgtcaggttccttaaaagttcctcaaacttcacccatatccttcaggtgtttgatatgtggaagaacattgagaaatcacggattagtgagttcaactataacaagatcataggcttgttatgtgaaggaggaaagatgaaagatgcattatctgcattgcaagatatgaaagttcaaggtatcaagccttctttggacacttacaatccaatcattcatggattatccagagaaggtaagttcagtgatgctttacgttttattgatgagatgaaagaatctggcttagagctggattctgaaacctatgatggtttgattggagcctatgggaaatttcaaatgtatgatgagatgggtgagtgtgtgaagaagatggagttggaaggatgttctcctgatcctatcacttacaatatacttatccaagagtatgctggtggcgggctactccagagaatggaaaagctttatcaaagaatgctttcaaaaagaatgcatgtcaaatcttctactctagttgcaatgctggaggcttataccacatttgggatggttgaaaagatggaaaaattttatagaaaaatcttgaactcaaaaacatgtatagaggatgatttgattagaaaagtggctgaagtatatatcaataacttcatgttttctagattagaggacctggcactagatttatgtccagcttttggtgagagcaacctcgaatggtgtttccggcttctttcttatgcatgtcttttgagtaaaaaaggtatggatatagttgttcaagaaatgcaagatgccaaggttagttggaatgttactgttgcaaatattatcatgttggcttatgtgaagatgaaagaattcaggcatttgagaattttgctatctcagttgccaatctaccgggtgcagcctgatataatcactattggaattctatttgatgcaactagaattggttttgatggtagtggagctttagaaacatggaggagaatgggctatctatatagagtagtagaaatgaaaacagattctctggtccttactgcatttgggaaaggccattttcttaaaagctgtgaagaagtgtactcctcccttcaccctgaggacagaaaaaggaaaacatgcacttaccatgatctcattcctttattgtcaaaacatactggtaccatccactgtataaaaacctag

SEQ ID NO: 104511 - DNA, 513 bp, Glycine max
  Peptide Sequence Number=SeqID_221289
atggaaactatgagcatattgccatttttctataatacttatttgcataggaggtggcttgcacgccacatgctgctcatggctatgtcgattcatcaaaatgttgtaaccatagatgtccatgctgccaaagatctgctcaattcatctggttatcgttatctggatgttaggtcagttgaggaattcaacaaaagccatgttgagaatgctcataatgtcccctatgtcttcatcacagaagcaggacgggtgaaaaatccagattttgttgaccaggtggcagcaatatgcaagactgaggatcatttgattgtggcttgcaatagtggaggaagatcactccgagcctccgttgatctgcttgattcaggatttaagaatattgttaacatggggggaggctactctgcgtgggtggatgctggatttgccgggaacaagccaggagaagacctcaaaactagctgcaagttccgtcctaacatcgcaaaacccactgcacaaccatag

SEQ ID NO: 104512 - DNA, 1812 bp, Glycine max
  Peptide Sequence Number=SeqID_221290
atgtcggcaattcctatcagttccagctatgcttccaccttctcttattctgctgctcatgctcttcctttcttctttgctcgcaacaactactccaccaggatcaatcttcatccacctgtcttttgccaacttcaatccgagacagagaaaccgctgacaagaaggtgttccccctttctagaaagttcattactctctggtaatggtggtgtggcctcaaacgagtggaaagctgttcctgatatttggagatcttctgctgagaagtatggtgataaaatagcattagtagatccgtatcatgatcctccttcaactatgacatataaacagttggaggatgcaatattggactttgctgaaggattgagagttattggagtaagacccaatgagaagcttgcgctttttgctgataattcatgtcgctggcttgtagcagatcaaggtatgatggcatgtggggcaatcaatgtggtaaggggttcgaggtcatcaattgaagaactgctgcaaatatacaaccactctgaaagtgttgcactagctgtggacaatcctgaaatgcttaatcggattgcaaaactgttttatttgaaggcttcaatgagatttattattctgctgtggggagaaaaatcaggcctggtcagtgaaggagacaaggaggtgcctgtctttactttcacagaagtcatacatttgggacaagagagtcgcagagtattgtttgattctcttgatactaggaagcactatatgtatgaagcaatcaaatctgatgacattgctactcttgtatacacaagtggaactactggaaatccgaaaggtgttatgctaacccatcagaatcttttgcatcagataaaaaacttaggggatattgtacctgctgaagttggggatagatttctaagcatgctgccttcctggcatgcatatgaaagagcttgtgagtatttcattttctcgtgcggtgttgaacaagtatacacaactgtgagaaacttgaaggaggatttgggacattatcaaccacattacttgatttctgttcctttagtttatgaaactttatatagtgggatccagaagcagatatctacaagctcccttgttagaaagcttgttgcactcacattcataagggtcagcttaaggtacatggagtgtaagcgtatttatgagggtaaatgtctaacaaaggatcagaagccaccgtcctacctccattcaattttggactggttatgggcaagagttgttgccacaatattatttccagttcatttactggcgaagatactggtctaccataaaattcattcagctattggaatttcaaaggctggagtaagtggcggtggtagcttatcttctcatgtggatagattttttgaggctattggtgtgaatgtgcagaatggatatggtttaactgaaacttcaccagttattgctgctcgacggcttagttataacgttattgggtctgttggccatccaattaagcatacagaattcaaagtcgtagattctgagactgatgaagttcttccacctggttcaaagggaatattaaaagtcaggggcccacaattgatgaagggatactataagaatccttcagctacaaatcaggtcttagatagggatggctggctgaatactggggatattggttggattgttccccaccattcaactgggcggagtcgtaattccagcggagtaattgttgtggatggccgtgctaaggacactattgtgctttctacaggtagaacagaagtttgtgtatgttga

SEQ ID NO: 104513 - DNA, 279 bp, Glycine max
  Peptide Sequence Number=SeqID_221291
atgcggagacaaattatggtcattctgcacactttttcgccattcagacacagtcgcgtcaaatggcacgcaaagactaacgtcgtcttctgcgccttttgtcatccagaggcggcaggcccgatgacatgcgggaaccatttggtcccgcactttttcacctttttgtcatctagaggcggcgggcccgatgacatgcgggaaccatttggtcccgcaatttttcaccttttgtcatccagaggcggcgagcctgatggcatgcggggaaccatttga

SEQ ID NO: 104514 - DNA, 264 bp, Glycine max
  Peptide Sequence Number=SeqID_221292
atggctttcttagttgccatatgtttactagaaggtgaaaatgttgaaccaggagaacttgaagaagctgccatgaggagtagcctcatacatcaaattgttgttattggccaggataagcgacgtctgggggctgtaattgttcctaacaaagaagaagtcttaaaggcggcaagggaatcgtcaattatagattcgaacagttcagatgccagtcaagaaaaagtgaccagcctaatatataaagaattgaggacatggtaa

SEQ ID NO: 104515 - DNA, 1278 bp, Glycine max
  Peptide Sequence Number=SeqID_221293
atggcggcggcgaactctgagggtaatggtcagaaaccgagattggaaacgtttcagttattctcttcctccgcttccgccttcggaatcttcgacgatgctgcgcaacaagttcctcatatacctcctcctccctgcgttgaagtccttgcttctgaggttccttcatccatcaaacacaacgtggactctgtaaatttggatggagttactttgttaaaggggcgggtgaatacccaacaagtttttggtttgtccaactccaatttagttccctggaaatatgaaggaggacttaagctgtgggaaggttcacttgatctaattaaagcccttcgttcagatatcagaaatgggcttatctcatttagtgggaagcgagtgttagagctgttagatggagtcctgatcataatttttcacgtagaaagatacacattgcacgaagcagatgcttgcaccttgcatagcacatctgagaccgtttcttatcaatattttgttattacactacacttaacatggacattaacatcaccatatgatggagttcttaatgtaggatctggtcatggactccctggaatctttgcattgcttgagggggcagctgctgtacattttcaagacttcaatgctgaggtcctacgtttcctcacaattcctaatttaaatgctaatctttctagagatactcaactatcgtcattcaactccacaatttgtgacaaggcagaagtttgcttttttgctggtgactggagtggaattgataaactgctccctcatgtcagtacagatgcaaaaaataatcaaggtgatggttatgactttattcttatggctgagacagtttactcaatcaacagtctccaaaatctctatgatcttatcaagaagtgcttgcaacatcctgatggagttgtgtacatggcagcaaagaagtattattttggagtaggtggtggaactggtgatttctgtctgtgttgcataataaaaagtagtgcccttgatatgcaaacaacttgtagtaataacataaacatactgatccttttaacatatttgttctccactataagctttgcacacacagtgatttctgtactacctgttagctggaaccttaactacggaaccatgtgttccatgcccgatgggagtcatcagaagcttgctcacgttatgcaatgtgtcatgactagtagcctggttgctgaaatcacagatggttcatctaatgttcatgaagtatggaagcttgcatacaagtag

SEQ ID NO: 104516 - DNA, 1826 bp, Glycine max
  Peptide Sequence Number=SeqID_221294
atgggaaggtctctccagtctcaactgtgctccgcggcacggcagagtccattgctggcgaagaagcttcacgcacaaatcataaaagctggtctcaaccaacacgaacccatccccaacactctcttaaacgcatacggcaaatgcggtcttatccaagacgcactccaactgttcgacgcattgccccgccgagaccccgtcgcatgggcctccctcctcaccgcctgcaacctctccaaccgccctcaccgcgccctctccatctcccgctcccttctctccaccggcttccaccccgaccacttcgtcttcgcctccctcgtcaaggcttgtgctaacttgggtgttcttcacgtcaaacaagggaaacaagtccatgctcgcttcttcctatcacccttctccgatgacgacgttgtcaagtcttctttgattgatatgtacgcgaaattcgggttgcccgattacggacgtgccgttttcgactccatttcttccttgaattcaatttcttggactaccatgatatccgggtatgcgcgaagtgggcgaaagtttgaggcttttcggctgtttcgtcaaacgccgtatcggaatttgtttgcgtggactgctttgatttctgggttggtgcagagtgggaatggagttgatgcgttccacttgtttgttgaaatgcggcatgaagggattagtgtaacagacccgttggttctttctagtgtggttggtgcttgtgctaatttagctctctgggagctagggaaacagatgcacggtgtggttataactcttggctatgagtcttgcttgtttataagcaatgcgcttatagatatgtatgccaaatgcagtgaccttgttgctgcgaagtatatcttctgtgaaatgtgcagaaaggatgtggtttcttggacttcaataattgttggcactgcccagcatgggcaggctgaggaggcattggctttgtatgatgaaatggttttggctggggttaagccaaatgaagtgacctttgttgggttgattcatgcttgtagtcatgctggcctagttagcaaggggcgtactttgttcaggactatggttgaagatcatgggatttcgccctctctgcagcactacacttgtttgctggatctttttagtagatcagggcacctcgatgaggctgagaatctcattagaacaatgccagtcaaccctgatgaacctacttgggctgctttgctcagttcttgtaagcgccatggtaacacccagatggcagttaggattgctgatcatctgttaaatttaaaaccagaagatccttcttcttatatattgttatctaacatatatgctggagctggtatgtgggaagatgtttcaaaagtgagaaagttgatgatgaccttggaagctaaaaaggcaccaggttatagctgcattgacttgggaaagggaagccatgtgttttatgctggagagacttctcacccaatgagggatgagattataggtttaatgagggagttagatgaagagatgaggaaaaggggttatgctcctgatactagctcagttttacatgacatggatcaacaagagaaggaaagacaacttttctggcatagtgagaggttggctgtggcctatgggcttcttaaggctgttccagggactgttatacgtatagtgaaaaatcttcgtgtttgtggagactgtcatactgttctgaaactcatcagcgctataacaaatagggaaatttatgtccgagatgccaaaagatatcaccattttaaggatgggaattgttcttgcaatgacttctg

SEQ ID NO: 104517 - DNA, 1470 bp, Glycine max
  Peptide Sequence Number=SeqID_221295
atgctcctccttagtcctcctcagcctcaacttcaacctttcttcacttcccttcacatggcagctcttgtgaaaccaatttccaatgtcactcccaaatttgtcagcagccccagaatgggctcatcacactcctccaaattcagcaccataataagaatgtctgccactgccaccccaccaccatccacctccacaaagccagcaagcagcaagaagggcaatatcaaggagaccctcttgactccaagattctacaccactgactttgatgagatggagacactcttcaacactgagatcaacaaaaacctcaaccaggatgagtttgaggcactgctccaggagttcaagactgactacaaccagacacactttgtcaggaacaaggagttcaaggaagccgctgacaaacttgagggtcccctcagacagatctttgtggagttccttgagaggtcctgcactgctgaattctctggcttccttctctacaaagagcttggaaggaggctaaagaaaaccaaccctgtggtggctgagattttctcactgatgtctagggatgaagccaggcatgctgggtttttgaacaagggtttatctgatttcaatttggctctggacttgggtttcttgaccaaagctagaaaatacacatttttcaagccaaagtttatcttctatgctacatacttgtctgagaaaattgggtactggagatacataaccatatacagacatctcaaggccaaccctgagtttcaatgttatcccatttttaagtactttgagaactggtgccaggatgagaacagacatggagatttcttctctgccctgatgaaggcacagccacaatttctaaatgactggaaggcaaagttgtggtctcgattcttctgtctatcgcttaagtttgtgagaaaagtaggcatacagaatcctacagaccttaattgtgcaaatccaatggataaaggcaaaaggaaggaccttgatcttttggcaaaattacttttgcctcaaaagcacttttcacctgaaaaccaaacatgcactatgtccaagatgcaaaatctcatttaccttggcattactcatcatgtttatgtcacaatgtatctcaatgattgccaacgtacagctttctacgaaggcattggacttaacacaaaagaatttgacatgcatgtcattatcgagacaaaccgcacaactgctcggattttcccagccgttcttgatgttgaaaacccagagttcaagcggaagttggaccggatggtggagataaatgagaagcttgttgctgttggtgagagcgatgacatagcggtggtgaagaacttaaagaggatcccactggttgctgccttggtgtctgaactcttggctacatatctaatgcctccaattgagtcagggtctgtagatttggcagagtttgaaccacaacttgtgtactaa

SEQ ID NO: 104518 - DNA, 2010 bp, Glycine max
  Peptide Sequence Number=SeqID_221296
atggcagagttacaattcaataaaaagatcaaagctctacaaactgatggtgccaaggagtacctagtgctgactaagtaccttgtagatcatggcattagacatcgcatatcttgtcctcatacacatgagcagaatggtgctcttgaaagaaagcatcgccatttgactgaaaccgacctcactttgctagcagactcttgttttccttccaagttttgggcagaagcattcaacactatcactttcatcataaatcgcattccctctccaatgatccactataagtctccctttgagcctactctccctccttctatagcaaccatcaatcctcctacttcaacaccagctgcacccatcactcccataccagatcccattccccccacatctatcacacctgtcactgagcactctactcctcctaaccctgcaaccaatacccatcctatgactactagagctaaatctggcatcttcaaatccaaagccttactaacagagatgactccaaggtgtaccatggatgcactgcaaaatcctcaatggttagctgcaatgaaggcaaaatatatggcccttatgcagaataacacatgggatttagtccctttgccccctcataagaaggctattggctccaaatggatctattgcttgaaatacaatgctgatggctctgtaacattcagtcctgttattaaaccagccactattcgcacaatcttgagcattacagtcaccagaaaatgggatacccgacaagtggacatcaacaatgcttttctaaatgggaccattcaagaggaagtctatatgcagcaaccagaaggtttcgcttctgccaattctcatctcgtttataaactgaagaagtctatctatgggctcaagcaggcaccaagagcctggttttccaagcttgcatctagtctgatttcttttgggtttaagccaactaggtgtgatacatctctgtttgtgcatgctacaccaaaatttatcacctacattctggtttatgttaatgatatcattataacaggcagctccacctctgcagtccaatatgtgatttctaaacttcactctctgtatcctctcaaagacctagacaccttacatttctttctaggcatcgaagccaaatacaccactactggggctcttctcctatctcaatccaaatatatcactgatattttaaccaaagccaatatgcataatgccaaacccataaagactcatcttgcccttggttcaaaactgcatatggatggtacaaatgccttttctgacccaactctctacaaatatgtagttggagcccaacaatatgccaccatcattcgtccagatatagcttatgcagtaaataagctttgtcagtttatgcacaaccctcttgaaagtcattggaaagccacaaatcgtgtactcagatatctcaatggcacaattgatcatggtttagctttttatccttcccagcatctcttcatcactggctatagtgattcagattgggctgactcatttgacatgcggtttacctcaggcttctgtgtttatttaggaaacaatcttgtgtcatggcttgcaaagaagcaacaatcagtctctaggtctagcactgaggtagaattcagaagtttagcagctctagttgctgaaattaaatggcttcagtctctccttacagaattgcataatgttcaaacaaagcctcctttgttgtggtgtgataatcaaggtgcagtgatgataacagctaatccagttttgcactccaaatccaaacactttgaattagatctttggtttgttcgtgaaaaggctgccaatggtgaaataattgtcaagcacatcccctcccagtttcaagtagctgatctgctcaccaaggctccttcaagcaatacctttttaagtcttcgaccaaaactgaatgttcatcaactacccacactcagtttgcagggggatgtaaaggatagaggaaaataa

SEQ ID NO: 104519 - DNA, 1467 bp, Glycine max
  Peptide Sequence Number=SeqID_221297
atggaaacttatgcttaccgtgctccagactatgctatgactggacagccgactgtgaagtctgacgcacgtccactgttcaaggatggcaggaagtttccagagttagcagatgcgaggtctttaccaagctctaactgtggcatcaatgtgcattcacgaacaggcaaaagttcgtcctctcattggggatgtggtggagtatctggaagcagatgggatttggaaggatctgagaaagatgactcctcacgtgaaacggcaaggacgtcaaacaacggagttccaagggtaaatcatgatcgtctttccgtgccaacttgcctgttcttggtatcaagaacttttagtgatggtgtatcaagatgggtgtcatctttggtttccaaaaagttgaaaattttaaagaatggcattaaagtagtggaggaaagttctataaagggcaaagatagcttagccaattcagctaaggaggcttggaatattatgaacaagtcatacagagaactaattgaggaatcaaaggatcttgaaaagttgagggtggaggagcaacaaaattctcttaaagctcatgaacaaagggctctagagagaagtggtgactgggtggaagtgtgtgtggcggttagaagtgggggaatggaagagaaatactcaagcctggaaattgtggaggagagcccaaactcgggtgtgttctttcttatcttaaatcgtccgtcacgacggaacgctctctcgcgcgaattcttcagcgagttcccgaaagctctgcacgcactggatcacaacccggaggtgaaggtgatcgtgttgtccggcgccggggaccacttctgctccggcatcgacctctccctcctgggatcaaccgccgcgagttcgggttcctccggctccggcgaaaccctccggcgagagataatggcgatgcaagacgcggtcacggccctggaacggtgccggaagccggtgatcgcaagcgtacatggggcgtgcatcggcggcggaattgatatagtgacggcgtgcgacataaggatgtgcagcgaggaggcgtttttctcggtgaaggaagtggatttggcccttgccgctgaccttggcactcttcagaggttgccgcttattgtagggttcggcaacgccatggaattggctttgaccggtcgcactttttccggtaaggaggctaaggagttgggtctcgtttctcgcgttttcctttccaaacatgacctccatcaggccgtccgagatgttgctcaagcaattgcgaccaagtctccccttgcagttgttgggacaaaaacagtgttgcttaaaagtagggacttaactgtggatcaggggttggattatgttgcaaccttgaattctgccagattgctatcccctgacttaactgaagcagtgatggcacagaagcagaaacgaaagccagttttttccaagctctga

SEQ ID NO: 104520 - DNA, 378 bp, Glycine max
  Peptide Sequence Number=SeqID_221298
atgggtagtcggcgggtagaaagggaggggtgggcaagtggaagtgcgtgtaagggcaacggtgcaaaggtggctagaccatggcttgtcaatggtgtagaggaagttgtagtggggtggtgcacagatttagtgtcgagagagacgcacgacattattggaatcatggttgtgttacgcatgaccatgattggggtggtggtgatggttgctaggaaggggaaggaggggggttggggtcgcaagccaggggaggatttgcacttaggggcggtgatacggcttcaatgtcccatcctttatcactatgactgtgactcaccgtgtgactatgtctacactgccacatgcatcccatgctcatgtctttcagggtaa

SEQ ID NO: 104521 - DNA, 1425 bp, Glycine max
  Peptide Sequence Number=SeqID_221299
atggacaagtcgtgcgtgatttctccaagttgctacgacaatcatcacctctgctttgcatttctcttctcctttctcttttgctctctgctgttatcctttcatgctcccaacctcctccgactcacatccaagaccaaaaatgtcacagattcctgcactggccgctatgtttacattcaccaactcccctcccgcttcaacgattacttgcttcagaattgccagtccctcactagaggcactgacaaacccaacatgtgtccatacatgcaaaacaatggtttaggtcctcacattacctactcccaagggcttttctccaacaacacttgctatgccaccaaccagttcttgttggaagttatttttcacaacaggatgaccaaatatggctgcttgaccaacgattcctccctcgcctctgcaattttcgtcccattctatgctggtcttgatgttagccgtttcctttggctctctaatctcacagagagagattcctctggtcgtgatcttcttcaatgggtcgcaaaaagacccgagtggaagcaaatgtggggcagagatcatttccttgtttctgggaggattgcttgggatttcaggagacaatatgatgatgcgtcctattggggtagtaagttcaggtttatacccgaatccatgaacatgtccatgttagcagttgaagcaagttcgtggaataatgactacgcaattccgtacccaacttctttccacccatcagaggacactcatgtttaccggtggcagagaaaaatcagacatcaaaagcggccatacttgttcactttcaccggagctccaaggcctgaacttgaaggttctatcaggggtaagattatagaccagtgtcgagcttcgagtgtttgcaaattcgttgactgcagctatggtgtagagagatgtgacgaccccatcaatgttataaaggtgtttgaaagttctgtgttctgtttgcagcctccgggtgactcatacaccagaaggtccatttttgattccatcttggccggttgtattcccgttttctttcatcctggtactgcttactcgcagtacaagtggcatttacccaagaataggactaagtactctgtgtatatacccgtgaaggatgtaaaacaatggaatgtcaacgtggagcaggtgttgctgggaattccagagggtgaggtgtttgcaatgagagaggaggttataaagctgcttccaaatattatctatgcagatcctaggtctaagttagattgctttgaagacgcgtttgatttagcagtaaaaggaatgcttgaaagaatagagaaggtgagggaagcaatgaggagtgggagagatcctagcattggttttgcggatgaagaccattataagtatacattttcacaaaattacagctaa

SEQ ID NO: 104522 - DNA, 567 bp, Glycine max
  Peptide Sequence Number=SeqID_221300
atggagaaaaggacaacttacgagaacttccgaaatcaatatgataagaaggggaacccattcaataggggatcatgcagaaatctgaaagaaacactttgttccagtattccccattcgaagaataatttccgatcatttgttgtggaggatgaacagatgatggttgggtctctgactccaaatactggggatggaattttgaccccaaaggagaaaattgatcttgaaatgggatctatgcgtgcagaagatggtcgtaggcctgttcctgaacttctgcgaaattttgattttgataattttgatagtgacatgaagtttgcagatgatgacgggcagccttcttttgatccattctacagtattgaggatgatgtaaaagactcggcccgaacatccattcaaacagttttgaatttccaaagcataactgaagatgtaatggaagagtctgtgcaaagctcccatgctggaggaaaagtcagagaatctacacaaaggcactttcctgctgatggaacatatacaattaaggaaactgatgacaggaatcattcacattaa

SEQ ID NO: 104523 - DNA, 444 bp, Glycine max
  Peptide Sequence Number=SeqID_221301
atggacccctctttcaatgaactagagtggagttggattgtcaactgtcagaggttgtgcgctaagcgcacaaaactattggaactaggctggcacttctatggcctttctggggtcgcatcgagcccgtgcttgagctgctttggaagctcctcgatccccctgtcaggaccatgctcctcctcagcccaccttcgtcacttaggagtagctcatgcctatgatgaacagtctttatcaggggcaatactggatcatacaaagccttcatcaactctccattcggtagtcggtcatgactttagaggacttcttggagcaaagccaagctgggagtcatttgtatcgagcatgggtgctaagtgtgcacttggaagcttagcacgtggtcacctaagacagttgtactttgcatgtgtgctcagtgcgcacatgcaaacttag

SEQ ID NO: 104524 - DNA, 855 bp, Glycine max
  Peptide Sequence Number=SeqID_221302
atgacgatgcgacccttactaaccctctcctattttcccaactacacttctctgagaatggaaagcgtccatccaacgataaggacttttgatgctgtagagaaagctgcaacaaagctcttacaaattctccaagagatgatgcaaattgcaattggatttgacattgagtggaaacccaccttcagaaaaggtaataataatgatgtgtatttgatcaattggggtggaaaggagagagataagaagaagaaaagaatgtttcaagtccagaatctgatccttgctcaaacttatagaacgttggtggactgtcttgatgaggaatttcaaaactcatgggaggcagagcctctctattttgtgttgcaaattgcaatgtggatgaagcttttgcttgaagatcccacagtcttgaaggttggagctgggattgatggtgatgctgtgaaggtttttagagattataacatatctgttaaaggtgtgacggatctttcttttcatgctaatcgaaagcttggtggagatcataagtggggtcttgcatctttgactgaaaaacttttatcaaaacagcttaaaaagcctaacaaaataagactgggaaattgggagactcctgttttgtcaaaggagcaactagagtatgctgcaacagatgcttttgcttcttggtatctttatcagccttatcttgatttcaaactactaacgtccgtagtcttctcgtccattttattgatacttgattcaaggaattggtttattcttttgcatgcgattaaagatctcccggacgcccagaaagtcactgacagaagtggcgaagttgatggtgtacctcaagaatga

SEQ ID NO: 104525 - DNA, 201 bp, Glycine max
  Peptide Sequence Number=SeqID_221303
atggccccaactgtccccagcacccccattgaaggaaggctagttatgctgccgacagtggaaagatatcgatatatagaggcaaagttgctgtcaggagtgcaagtagggtggattaacaacatggaaaacgacaattcgatcgatcgtttcttaagacagtggcaattggctctctctcatatcatgctagttacgtga

SEQ ID NO: 104526 - DNA, 180 bp, Glycine max
  Peptide Sequence Number=SeqID_221304
atggctcaagtccttgcctttagggacatagctccaagagctcctacccatattctaatcactcctaaagttagggataggttaactgctcggtccaaggcatattatgttgtctcacatgttcatttgaagatcatttatatacatgtgctcaatgtgcacaataacactatttattaa

SEQ ID NO: 104527 - DNA, 459 bp, Glycine max
  Peptide Sequence Number=SeqID_221305
atggttaagcttctcttgaggagagcaaaaggaaaacaaactacactgacacggacgcgtgtcggacaccgaacacgacaaagagctggagtgtctgtatttcataggtctcaattatgtattgtttacactttccaagttgaggagaggcactgtgagattctaggttctcttctatacaccgctaagctgattacaaagcaagaaggtcttgatgaaggctttaggattgtaaaattaatgatggaccagacgggggtgaggattggttttgggcagaccaatcagtttaccacattcacgtgcacctcattgggggacgacagatggcttgagcccccttttaaaaggtctcacagtatgccagtgccaacgtgcagtaatgctctgcctatgcaatctataaataatggttttaaacgactaagtagtgtcttcatgttacaaaattcattatga

SEQ ID NO: 104528 - DNA, 261 bp, Glycine max
  Peptide Sequence Number=SeqID_221306
atgggagtgtttgagaactccacactctctctgtggtgtcatagcaatcagcactgcttgcaattggccaaagaacatatgggaagtgtgagggagacagcttcgttcttgttgggtttaatcagtgtcattgtttgggttgttgctgagatacctcaaatactcacaaactatagaacaaagtctgctgagggtctctctgtcactttcttgatcacatggataattgggaatatggatgaagggaagattatgttctaa

SEQ ID NO: 104529 - DNA, 309 bp, Glycine max
  Peptide Sequence Number=SeqID_221307
atggaaccgttagtgatatttatcatagtagttgtctgcatgttcaccttcgttgtagtatttacattgtgccaagtggctgctggaaggcaagcatttggaagtggtggtggtggcggcggcggtggttttggccaccacaaccaccatcatcattctcatcacggtggaatgatgggtgggattattggcagtggagcttgtggtggcggaggaggaggtgggggtggtggaggtggaggtggaggaggaggatgtggtggtggtggtggtggtggtggtggaggaggaggagagctgattcaatga

SEQ ID NO: 104530 - DNA, 864 bp, Glycine max
  Peptide Sequence Number=SeqID_221308
atgccgagaattttgcaggctttttttctttgtcttttgggactatatgcaattgagacattcacaaaagttggacacgtggaaaaagccagtgatgctgaacagagtattcaagttgacggttcaaatagaagcaccgatctgagttctcctattcctcttccagcacgtcctcaaagaatttctactggaagagaattattctaccagtcagcaagatatttgtcaaagagtaatactccaacagcgggatccatcttagcacagaaacctcctactttagattctatacaagagagcttgcttggttcaaccattgcaacacaatctgcaccagctttaaagatgaagaatactctttgtttggtttcaacattaacttttcttggtgctatcaatctacttcaaccactagatgaaagaattaattctatggcctcaaacccaagacaacaatttgtgatttatgttggacgaaagctttttcaggttagtgatgatcagctgccaaaaactgatgtttctggaagcatagggaccttctttggttgggcaatgacatttatatatttgggtggaagactgcctcaaatttgtttaaatatcagaagaggtcatgttgagggactcaatcctttgatgttcctgtttgctgtaattgggaatgccacttatgtagcgagtatacttgtgatcagcttggattggtcaaaaatcagaccgaatttgccatggctagtagatgctggaggtttatatattttcgctgttggacctcccaagccctgtagagcaattacaagcatcaattgttgcctattgaggaagaaacaaggatattcaggtctctctctcactctctga

SEQ ID NO: 104531 - DNA, 678 bp, Glycine max
  Peptide Sequence Number=SeqID_221309
atgaagatgaaagccaacaaaataagaaatgaattgaaagtctcagattcaaaaacttacgggttgaagaccgaagaatgcacgaagaacagacgaagaacagcgaagaacgacggaaaattttcacggaattgctcacggaaacaacttggaagagttacagaagggtcaggggcccttttacttagcatctttgcccttatttatagccaaaatggggaggaggttgtcgccaagcttgagtttcctaatgcaccccccatattgctaagttcaccccccatattgcccaggcttcctcaggaagtttcttgcgagcccaagcttttacggaaaaggtttcagaaatgttacagaagcattacgaaagtctcgaatgctatttttcaacaaaatgggggaggtggttgccgcccagctcgcccaggcgagctaggttgtttccacctgaagcaagaaaaagtccagaatcttctagatgggcccagatttgaaaattgctatttacaccctcactttgataagttcatccccgtttttgtgttttttggttgttttctttccgaaacctcacgaaactttacggattccacggcgatgggttttaagcattctgaagcgatcaaaaatggtccccgaacgaaattagggtatgacaactatcaaatcaaaatgtaa

SEQ ID NO: 104532 - DNA, 399 bp, Glycine max
  Peptide Sequence Number=SeqID_221310
atggcatatcaacgaggcatttcatacaaaaatgagactatatcaaatggatataaacacacattccacaatgggttgatacaagaggaagtctatgtagaacaacccctagggtttgagagtaacacttttccacaccatgttttaaaactaaataaaggattgtatagagttacgcaagctcttcgagcttgggatttttctaagctaatgcaggtagaattcgaaatgagtatgatgggagagttaaagttcttcttaagacaacaaataaaacatactagcaacgaaatctatatccgtcaaaccaagtatgtcaaggaacttctcaagaagttcaagctggaagatgcaaaagaaatgaagactcgtatgcatccaacaacatgtcttggatag

SEQ ID NO: 104533 - DNA, 333 bp, Glycine max
  Peptide Sequence Number=SeqID_221311
atggttgagcagaatcccaataagtatatgcttaggattagggttcgtcttggaaagagcagcaatcagatcctctgtgaaaaaaggaagaccctgcctgcgagaataagcaatctccaggtagaaatgctgaagcagggtgtttcgaaacccacaattggaaggtctgaagagaacagagctcatgcccatttcatgcaaaccccgcgagtacgatccaatgaaaacctagaaaatccagtaacggaaagaagctgggtagatagccagggagagaaagaaaaccctaattccaatctagcgaggaagaggaatgaaaacttgatgggttaa

SEQ ID NO: 104534 - DNA, 1527 bp, Glycine max
  Peptide Sequence Number=SeqID_221312
atgtcgagaccacgagggtggaatggacatgaaaagcacagagaaaaaaagcataaaaaagggaagagggacaaagagaagaaggaaaagagagacaaagaaggaagggatggaaagcgtaaggaaaagaaggacaaaaaagaaaaacatagagaaaaaaagaaagacaaggacaagaacagagataaagaaaagagcaaaaccggtgctgcaattgagaaagaatttccaggacaagctcagggtcccaatgctggtaaactacatcaaaaggaaatcaaaccaattgataagattgttttacttgaggataaacttaccaaacagtttgccagtaacaatggagagaaggctagagagaataatcatttttttgaggaaaacaaggattctaaattcctcctggatttggaaaggaggattagggataatgacggaggagctgagaatcaattggctcaaaagtttgcaactgcaggacacagaaagaatgagggagctgttagattggttactaagggtagtggcacctggcctgatggtaaggaaaggcttcaggataagggcattgatactagaatggttgataggagagaaatctgggctgagtcccgaccagttggaaatataacagttcagaataatgctggaaaatttcatcacagggttgatgaaatgcccaaatctttggaaaataatttttacaaacctttggaagcagcagttgaaggaaaagagagggttaaggaaaaaaaagatgataaacacagagataaaaagaaaaataaagagaaggggaaaaaaggacatgggaaggacaaagacaggagtaaagaaaagaaaaaggaggagaaagcaaaggagaatgctgaacatgaaaacagagagcagcagaataaattaaaagaaagcaccaaagctggtccattaggctcaaattctttcacacaggtttccaggcacatctatgagaattctgctgttggggaaaatctcaagaaacggaaggacattgaatcaaatggaattatgcatgcaaatgacaattggcccagtaagttgccaacgccctccccctctccctcccatctcactgaaaatgggaggatattggaaccctgccaaatttcccttcagaatacatctgataataggctagcagcagcctctaatatcaaggttgataacaaaaaacgcaggacaaatggcatcattgaagttctaccatctgcagtttcctcaaaaactcccactcccactgctaccttgccagctccagtcagtgaagcatctgcaaaaccacctcatccagataccaagtacataagtcaggtatattccgtacccaaagcagatgagtggtctgattttgatgaccaagagtggttgtttggcagcagtcattcgcaagaaaggaaacctgtagtgaaatcttcagaggttggggatacactgcaggtatgggcagaagccgtgcatatagagccagcagatatttttgctctgccatatgtcattccatactga

SEQ ID NO: 104535 - DNA, 738 bp, Glycine max
  Peptide Sequence Number=SeqID_221313
atgactgtacggcgcaccctttttaaaggcggcactatcctgacgctggacgccagcgtgcccgacctcgtctgtggcgatgtgctgattgaggacgatcgtattgccgccgtgggggaaaacctttccgccgacgatgcgcaggtgattgatgcctgcggccatatcgtgatgccgggcctggtggatgcgcatcaccatatgtggctcggcgcgatgcgccgcctgatgcccaacgttgacgacctgtttgcctatatcgatgtggtggcagaaacgctcggcgcgcattaccgtccgctggatatgtacctcagcacccggctgacggcgctggcatgcctggatgccggcatcaccacggtgattgatgcctgccacagttcacgcagtccggcgcataccgatgcggcgctcgacgcgctgcaggagaacgggattcgtgcgctgcacatggttggcgcagcaatggataagcaggcttccagcgatcatctgccgggcgatctggcccgtctcgccagccgctggaaccacgccggcagtcgcgtgcaggttggcctgtttggtcagctcaatctggcgtggtggcgcgtggcgcgcgagctggatatgcgcattctcaccgatttgccgaacccagcttgctgggtccgcacaacattttcaatcactgtacgcgcgtaccggcgcacatctggcagcagctggcggacgcgggcgtcaacattaccgtga

SEQ ID NO: 104536 - DNA, 744 bp, Glycine max
  Peptide Sequence Number=SeqID_221314
atggagaacaggatgagttttgatggccgactattatccggcatgagcgtgctggcagccgtggttgaagccggcagcttcagccgcgccggtgaggtgctggggttgtccgcctcgggcgtcagccgggcgatttcacgactggaacagcgtctcggcgtgcgcctgctggatcgcaccacccgcaccctgcatctcaccagcgaaggtgccagcctgtatgagcgggcggcgccgcatctggaagggattgaagaagcagcaaactacgtctccggcgccgccgtgacggtgcgcggtacgctgcgcgtgagcctgaatccgctgttttcccgctatgtgctggcggcaaagctgccgctgctgcgtgcccgttatccgcatctggaactgacgattttgcagcagcccgatgtgggcgatctggtggcagaaggtattgatgtggcggtgcgtttcgggccacagccgccgtccaccatgacctcacgcctgctgttacaaacgcgcgtcctgacggtggccgccccggactatctggcacgctgtggtcgcccgacgcagccgcagcagctgactgagcacaattgtctgcaatacatcgatccgcgcagcaataagccctttagctgggagtttcatcgtggcacgcagcggctgacggtcgccacccacggccatctgaccaccaccgatccggatttaatggtacaggcgtgcgtcggcggtgccggcgtagcccag

SEQ ID NO: 104537 - DNA, 233 bp, Glycine max
  Peptide Sequence Number=SeqID_221315
gggtacaacatctgaaaggtttaaagaagaatttattgttcgttgggcaattggatgacctcaagtgcaagatccatactgaaggtgggatcttaaaggtagcgaagggcaatcttgtagtgatgaaagctgaaaggatcacacctaatcaatacatgcttttaggagatacgttgaaggaagtagatgcatcagttgtagcaacaagtcaagaagaagcaacaatgatgtga

SEQ ID NO: 104538 - DNA, 261 bp, Glycine max
  Peptide Sequence Number=SeqID_221316
atgcagaggaagcaaaacacagtgggtttgagcgaaaagattattatatgtggaaaaaatggaagcactgataggtggaagaggaggtcgttggtagtggatattgaccatgctctgcatctaaaaagcaagagcagtttcactgagaacaaggaatacattggaatggagaaggagaaagatgattggagatgccacttcaaggagaagatgagtctagaagaagctcaccaccataggaagccatggataagagcttga

SEQ ID NO: 104539 - DNA, 690 bp, Glycine max
  Peptide Sequence Number=SeqID_221317
atggttgtactgcatcagaaaaaggagcttgtaaacatggattggcaagctctaaaaaggtattatagattgggagctcattgctctggtttggaacctaaagagaagccatcattcgatggagttcatcataccacagggaactactttcaaactatcaaccataatccttttctagttgattcaccatccaaccgcatttgtgtatggaagaaagaacttgttactatgtctgagtgcaacttttcattcacttttcatcttccacactccacttgcaccttcattcatcaagttaagccaatcattgaagaggtggattctaatgatgagacccatgttgctactgaagatatggccatggaagtctatgttggtcctcctccatcccgagagtatgtgtattttcttgagaaagcactactcagaaccagggaggcacttgttgaagctcttcatgataaggctcatgctgaaagaaaagccaagaggtggaaactctttggggatttcttatttcagaagttccctgagaccctaatgggcatcttcactaatgacgactctggggatgagttctttcgcaagctagaggctaatgaagcagaagaagttgccaaacaaaaggggaagaagaacaaagcaacaaaagcagaagatgcaaaagttgaggactatacatccatataa

SEQ ID NO: 104540 - DNA, 1164 bp, Glycine max
  Peptide Sequence Number=SeqID_221318
gatgggaaagagggcatggaccattgccatatcgggattgctattacccatattttgtgccttttcaatgatttggttgttgcattggtctcccacaccgtaatttcatttgcggtcatttcttccctccttagtgaacttcaaatccaaaactccgaacttgggaaattggcattatcttcagcattgatcagtgacatattgtgcacaatcgctaccgccatcggcactgcagttatgattactgagaattctaatgtcaaagatgttataagaaacgtcttggctttgatatgtttggctatctttaatccattagtgtgtcgcccaacaatgttatggatcatcaaacataccccagaagggagagctgtgaaggatgaaggacctccactgggatctgcattggttaagaagcttaatttccttggtaccaccttccttttgccaatcttcgtcactatcaatcatgcctgccttgtaccttccctctactgcaacatgcaaccgcgtgatgctgtctctcttgccctcattttgaactgcaaaggcgttgtggaagttggcctctactgcttcttatacgacaccaacgtaatcgatgggctagctagcatttggagtaatgattttgagcataatggtggtagcatgcattgtgcaatgcacaagtcatactctgatgagcatgacaacccagatgctgtatctgcatacccttgcacagcaatagctccacccaacctcatcgaacatgatgatgaagaggcattgtgtatagctaggagagcaattaggaacccggggatgaacattgttatttacaaccttgtttttaaagcagaagatgatgagtgggggcaagaggtggatgatgatgagctagaagatgtgaagcatgcacgtgaacataatataaggtatcaacaaatcatagaaacagaaggatcccagacagctgcttttcttagtgacatagtgaaagagcatgacttctttatagttgggaggcgccatgggaatgggattgagtctcctcaaactgatggacttacagactggagtgaattcccagaattaggtgccatcggtgattttcttgcttcaccagatttggagagtcgtgcttcaattttggtcgtgcaacaacaactctcaccatag

SEQ ID NO: 104541 - DNA, 894 bp, Glycine max
  Peptide Sequence Number=SeqID_221319
atgggtcttaaaaaagctgccgaccacggcaacagagcagccacgggagggcattcgtatctgtatgagccgtggtggtgggctggaatgatttcaatgatcgctggggaaatagccaattttgcagcttatgcgttcgctcctgcaatccttgtaactcctttgggagctttgagcatcattttcagttcagtgttggctcacttcatattaaaagagaaattgcacatttttggcgtgcttgggtgtgctctgtgtgtggtgggatctacgtctattgttttgcatgcaccgaaagagaaagacattcattctgtcaaggaagtgtgggaacttgctacaggaccaggttttattgtctacatttgcgctatagtgatattagtttgcgtccttcatttccgttttgtgcgaagccatgggcagactcatatgatggtgtatctcggaatatgttctcccaccggctccattacggttatgggtgtcaaagcagtgggaatcgctttgaagcttacatttgaagggacgaatcaatttgtttactttgagacctggatatttacagtggttgtgataggatgttgccttttgcagattaactacttgaacaaggctttggacgcctttagcactgctgtggtgtcaccagtttactacgtgatgttcacatcatttacaatcgtggccagcattatcacgtttaaggaatgggcgaagcaggattcaacgcagattgctactgagttgtgtggttttgtgacaatattatctgggaccttcctccttcacagaactaaggatatgggaaataaaccctccgacgcctccgttcattcaagtcctgaagataacaatagtaatactaagacacctctaagcaaccaaatttga

SEQ ID NO: 104542 - DNA, 1047 bp, Glycine max
  Peptide Sequence Number=SeqID_221320
atggtagaatctggcgagctccgcagtcgaattgcagagattcagaagctttgcaatgctaatgacgacgaattggacaatgactctgctcttcttcattttaagaccgcactgcagcagattgattccgacttctcttctatggaaattcaagatgcttacctacaccatttgaaagaggagcttaacaacctccaccttgaaaccgcccaatatcagaagaacacagctgaaggcattgattcccctatgctggcagatgattgtctaaatttgaccgttgcaaatctagacaagaatttagagcaattcgaacttgataataagattgatgaaatgaagtcggttctaaactctctccagaatcttcagtttacagtcaaatggtttgaagttgtagagcagattgaggatgcattcacggggctaaaagtgcttgcattcgatgagaattgcattcgtttgtcattgaagacttatatgccaacatttgagggtatttcctacctaccgagaattgaagctaccgttgatgcagctgaactcaattatgagttattaattgaagtttttgaggggactatgaggttaaagaatgttcaggtttttccaaatgatatatatgtgaacgacattgttgatactgcaaaattagtcagcaagtcctcgttgcagtggtttatacagaaagttcaagatagaattatactaagcacacttaggcatcttgtagtaaaggatgctaataaatcaagatattcgcttgaatacttggacaaagataagactattgtggctcatatggctggaggaattgatgcgtacataaagttgtcacatggttggcctatatttggttctccattgaagctgatatgtataaagggatcagatgatttgaagagaacttctttaagttttcattgcaaagttgaggtgagagaatttcaatctgtattagctataacctataaattttctgtcatcattcttccttgtggtttatcgatatgtacaagcgttctcaatgtggtatcagggttttaa

SEQ ID NO: 104543 - DNA, 351 bp, Glycine max
  Peptide Sequence Number=SeqID_221321
atgttttatagtctcttggtcaataacatcagagattttccatttccttaccaatggttcactgtataccagaccatctatttgcgggtttcttcatatgaaaactcagaagatctaaaacaagatgtgaggttgttgctttctcctgttagacttggagcacaagcattttcatgggctgctggaaaattagaatcaaatggattaggattacctacatcaccttcatcatcagatgttcagaaccgggtattgcaggctgctgccaaacatgaatcccaaccatctgatagtgaaggtaaccaagatccagttcctgaaccgacagttcctctcaatcagaatgtatga

SEQ ID NO: 104544 - DNA, 540 bp, Glycine max
  Peptide Sequence Number=SeqID_221322
atgaagaaaaagaagcaggtgccggagtggatgaacagtgctctgtggtccaccccctccgaccatggccgctttgacccaccctctcctcctcctcctccccctgtttctgttaaagaagattcccggacaatcccaaccaatcagaattcctctcctcctcctttttcttcttcatccgtttcttctcctactgcttccgccgatgacatctcccggcaggcccaggcccaggctcaggctcaggttcagttgttggccgagttatctaggaaggtgatagacatgcgcgagttgaggagagtcgcttctcaaggaatacccgatgctgctttgcgtcccaccctctggaagcttctgcttggatatcttcctcccgatcgtgccctttggttctctgaattaaccaaaaagaggtcccagtacaaaaatttcaaagacgacctcctcatgaatcctgtaacttacttactccatacttacttacatacttacttattgattccccaaccacacacatttgaatgtttctgtgcctag

SEQ ID NO: 104545 - DNA, 723 bp, Glycine max
  Peptide Sequence Number=SeqID_221323
atgggtgtagagatgcagattgctaacaaaagtgagagagcaatctcacttgaggcaaatggtcaggcatttgctgtcattgttgcttctccacttcgggtggatctatcatgtattctagagcatgtggtagcagagttgactgcattccttcaaaaagctaatcgtgctctaaggcaggctaccttgggatccttaaattcacttatagttgcttatggtgataagattgttttgtctgcttatgaagttattatcgtagaactgtcaggactaattagttttgattctctactggagtcattacttgcctgtgctaagccttctccacagtctggtggcattgctaaacaagctttgcattcgatggctcagtgtgttgttgttctatgccttgctgctggtgatcagaagtgttcatctatagtgaaaatgctcattgacattctcaaggatgatagcagttctaattccataagcttttctcttcagtatttttgttgtgtaaggttgagtcttgaagtgctaaaagtggtagttgcgctcagctcaccatttgggttcagcgcgcatccaacgctaagcgcagcttcaatgcgcttagcgcggcaaaagaatctagcagagcataaatatcaaggtcgtgcgctaagcatgatggttgtctttagccaggctcagcacatgactgacgctaagctcaaatccactaactcgcgctaa

SEQ ID NO: 104546 - DNA, 297 bp, Glycine max
  Peptide Sequence Number=SeqID_221324
atgcaatcacaagtgaaaatcaacgttgacgaaagcttccgcaatagctacatgggggttggaggtgttcttcttgatcatgcaggaatttgggtggaaggatttgtgaattcaattcccaatggagattatgttaaagttgaactgctagctattaaggaggggcttagtgcaacttggaattatggattttgggatgtggcttgtgaaacagatgatagagaagcttgtaatgatattctctgtcatgaaactaacagagggggcatatcaagtgagaggagtgttttattatga

SEQ ID NO: 104547 - DNA, 736 bp, Glycine max
  Peptide Sequence Number=SeqID_221325
tgatggtcaaacagaggtgttgaacagagttattgagcagtgcctccgttcgttcgtacatcgccgaccgagctcatggggtaaatttctcctctgggttgaatggtcgcacaacacgtcgtggaacgcggccactgggtccacgccatatgaagtcaccttcggccggaaacccttcaactttccggaatacattactggttcatccaatgtggacgcggtggaagagatgctgaccaatcgtgaggagactttcctatctattcgaaagaaactccttaaggcacaagctcagatgaagcattatgcagatgcaaagcggaggaacgtggaatatcacccgggagattggcaacgtgttggacaggtcgcatataagctgcagttacctgagggtgctagaattcacccgatattccactgctctgttttgaaaccttttaaaggttcaccggagacgatggagccagtaaccttgccatctcgctttgatcagaatcaaccaatcattgcacccttaacgattctagactatcgccagcgtacggataagaagtgggaagttttggttcagtgggagggcttatctcccgacgagacgacatgggaggagctagaccagcttcgttgtgattaccaccttgaggacaaggtgtttctgcaagggccatggaatgatatgaatagtggaagagaggtgcaggaagtaactcagggtctagacagcaatgagggg

SEQ ID NO: 104548 - DNA, 204 bp, Glycine max
  Peptide Sequence Number=SeqID_221326
atggagatgatatttcaggttgttttccttgaaccagcggaagctcgagcagcttttagaggtttagcttacaagcgtttcaagcgagtctacaactgtactgttatgtcttctatgttttttggaaaatggaaagcattgactaagaatggttttgtcagaactctttctctcttgcacacaaagggaggagtgtgggagtaa

SEQ ID NO: 104549 - DNA, 282 bp, Glycine max
  Peptide Sequence Number=SeqID_221327
atgaaaaacaacaacacgtcatatgcgaatagaagatgggacaccgatagacctcccctagacatatggatgggataccagaaccttcgtgatgaccttgtaaacgacattgcacaagcttataggcttgaactcctagaggcaagttggttgatcaactttggggatcaaaacaaggactgtatggaaaagactatcctcagtaaagctagacttggaaagcctcctggtgtgatccttattaggagtggatcccttggtgcaggtcaaggaattagatga

SEQ ID NO: 104550 - DNA, 306 bp, Glycine max
  Peptide Sequence Number=SeqID_221328
atggtgaactgcgtgcctgatagcgcgcttccgttgagtgatagagtggaaagtagtagtgaccagaaagtgaagatgcttagtgttcttgataccttgcctcctattgcggaaattaggagttctgttatgatgaagaggcacgggggtgccatgaaaggttctgttgaggacttctctgaagtattgagcaaacatatatgtaaaataggaacaaatttgagagtgtttgctgatagttacaagaaacagtgctcggccattgagcttctgaagatgttgattaaaacaatagggtttaggtga

SEQ ID NO: 104551 - DNA, 2364 bp, Glycine max
  Peptide Sequence Number=SeqID_221329
atgagtgctgagattgattcaacttatgctcctgaacctcacaaaatgtctggagcaactaccagtggccaaaagctctctatattttctgccaaatctggatttgtcatccctaaaaacaaattgtcagggtcgctggtccctattttccgaggggctaaacaacatggggtcactgctgctgccatcaatgaagaaagttcaaaacaaattgagaggagatcaaaatggggtcctgatctcacacaagatgcagctgtcaggaggggaaaagttttagctttgcagattcgagtggatcaaattacaaagcagttggaatcagaaaaactggaagttggggacactcagaacttgaatccagatcaaagcatatctggccctcaaattaacagcaagaaggcagaaatgctcgaacttgaaaagcgggaagcaataggtgaaatactaaaattagatcccagttacaagcctccacgtggttttaaaccattgttaaaagaagccagcattcctttgcctgtccaagaatatcctgggtacaattttgttggtctaatatatgggcctgaaggtgataatcaaaaacaactagaaaaggaaactggtgcgaagataaaaattcatggaatcaaagcagacacaggagagaaaggtgaaattaaacccggaactgatatccagtgcaattacaaagagatgcatgttaacctatcagctgatagttttgaaaaagtggatgctgctatgttaatcattgaactgctaatcacctctgtaacagagaatttagctgctggttctacaccctctatatcagtttctagggacagcactaatgttctgagtcaaaggcaagaaggccatgcagattctctatctctggaaaaccaggctgtgttgcaaccagtagctgttacacaaatgcatggtgataacttccaatactctagtccatggttttcagtggttccatctcatacccctgtgtttgcttcgtctggcactgtagcccccccaaatccactaggtcttgctagaactccccatttttcatcacaaacttcaaacatggcttcgacttttggtgctcaacctggacctgttgctggatttcagtcgattattccaaatcaacatgtttctgtgcaaacaccaccaccaagacagattttacagtattcgcatatgactcagacaagtcctttgggtcacattgggcccctaagaaatcctgtacaaaatttgtcaactccaaattcttcattttcatttcctgttactttaagccaagcaatgccaataggacaacatcagacatctgtgtcttcaatgcatctacctatatctggtatatcatcaccaccgatacctaaccagccattgacccatcttggtgtctcttctggcctgaacgaagcccctgtcactgttaaaatgtctgttggtcccagcaatatggggccagtggttccacctgcaagacctgtttctctacatcaacagccagatgttgcatttaagccaccgcagtcaaatatgtcaatgattacacgatctgccacctttcttccacatcaagtaggaatttcccctggacaaccatcttctttgagatcaatgcctgtaccaatacgtgcacctacacatttatctgcaaaccatttatcaggacctgtttcatttccttcacgtggaatatccccttcacttccattgcctcagcaagcaggaatacctaatcttgcttctggagttgctccttatcacacccatgtaaaaccaccagtcttggggacatcaaaatctggaaattttacttttcaatcacatctgcccaatgcagactatggtcaagtgttttctggaccaaacagtcaatcaggtgctacacaagagccaccttctggtccacgacctccaccatttgggtttgctgtgcctgatcagcctcgtcaaatctttccaaggacacaattccctggtcaagtggatcaagccgttccctttggggtaagattaggttccatctcgaactcaattccaccacccagacatgctgtatttccatatgctggtcaacctgcacctagatcgtcagtcccacaaatgggtatgaagaacttcatttctgcccctcaaatgccaaatttgaccaatgctggtgctcaaagaggcatgcctattcggcaaagctatcctcctcagatggcacggccagatatcccaatgcctctgaatcaaaagtttgtcaacaatccccccatggcttctggtaagatagcatatgctgcggaccaaatttatgatcccttttcacccacttctgcacctccacaacagaaaggtaatcctggaaaatga

SEQ ID NO: 104552 - DNA, 1548 bp, Glycine max
  Peptide Sequence Number=SeqID_221330
atgatagacgcgagctgggttcgaggcccagaacctcctaagaagaaaggaacgcagagaacagagaaggaaaagattacaagcataacggaaatggtattgctgccccctgaggctcgacaacaatctcagcagattctctattctctattccagctcagcttggtcacgcataatctttcagccattgttgatggcggcggagttccaacaactctggatggacccttcaagcctgtgaccgttcctcttgatcagagcttccgagcggttgacctgccagatacagatcctctggttcaaagaaccgttcaagggttccagccagaacaaatctctctttcactctctgtttctcatgattctgtttggatttcttggattacaggggaattccaaattggggacaatatagaacccttagatcctgaaactgttgctagcatagttcaatatggaaggttaggaaggtccatgagacacaatgctacgggctattccatagtttacagtcaactttatccttttgaaggccttcagaactacacctctggaattatacatcatgttcgtcttacaggattgagacccaacacactatatcaatatcaatgtggcgatccttcgttgtcagcaatgagtgacgttcattatttccggactatgccagtttcaggccccaagagctaccctagcagaatagcagtggttggagacttgggtcttacatacaataccacatccacagttgatcatatgaccagtaaccatcctgatcttattctgttggttggagatgttagttatgccaacctctatcttactaatggcactggggcagactgctcctcttgctcattttctaacactcccatccatgaaacctatcagcctcgttgggattattggggaaggtacatgcagcctctgatttctagtgtcccggtaatggtaatagaagggaatcatgagattgaagaacaagctgaaaaccagacatttgttgcttatagttctcaatttgcattcccatcagaagagagtggatcatcatccactttctattattctttcaatgcaggagggatacattttataatgctcggggcctacatatcctatgacaaatcaggggaccagtacaggtggttggagagagacttggcttctgttgacagggaagtgactccgtggttgatagctacatggcatgcaccttggtatagcacctacggggctcattatagagaagcagagtgtatgagggtagagatggaagacttactatataaatatggcattgacattgtcttcaatggacataaatttcttatgggagaacaggttcatgcatatgagagatcaaacagggtatacaactacacattgaatccttgtggtcctgtttatatcacggttggagatggtggtaacagggaaaagatggcaatcacacatgctgatgaacctggacagtgtccagaaccatcaactacaccagatgactatatgggtggattgatacgcaatccacccataaaacgttaa

SEQ ID NO: 104553 - DNA, 255 bp, Glycine max
  Peptide Sequence Number=SeqID_221331
atgccttggagaagaaagcaaattgcggatgaaaacagtactgctggagttacaaatacaaatacaacagtgacaacacctgcagcgatgccgaatgtggcagcacctaccacaacaactccaatccatggcggggatggtgtaggaatgaaccctctaatccctgaaaattctacatcagcacccaattcgaacacaatattaaccactacctcatttttagttttccttctcattatgtcccttatcccttaa

SEQ ID NO: 104554 - DNA, 3447 bp, Glycine max
  Peptide Sequence Number=SeqID_221332
atgtctgattcctcccatacccctggttctgcagtcaccctcgaaaccgccattctcaaacttacccagcaccaaatgtccctcagtgaatccgtcgacaatatgacccagaaattcgatgaactcctccttcgcttaccactctccccgattcaaccgcaacccacttctgctcctaccctcaccccccctgttcctgcaacacagcatcgtatgaaacttgacatacccaggttcgatggcactgacccttgcgggtgggtgttcaaaatcaaccaatactttcaataccacgcgaccccagaacatgaacgtcttaccattgttgccttctacatggagggtcgagcactggcgtggttccagtggatgaccagcaatggtcaactgacatcgtggccctctttcctccacgccttgcaaactcgatttgccgccaccacgtacgaggaccctacgggctccctcttcaagttgacgcagaccggcacggtggctcaatatttgtccgacttcgaggacttagccaacagaatcgttggtcttcctgcgcaattcctcttgagttgcttcatttcgggcctcacgcccgaaatacgccgtgaggttcaggcgttgcagcctatgacccttgtgcaagccgcgggtctcgcacgcctccaagaagacaagcttctggatacccgctcttccttccgtcaccgtgcaccgccgactttgacgataccggtttctcgcccagctcccactacggccctcttaccctctccaccttctcgcatgcccacccctcgctcacccacactgcgacctcaacccactctgaaaaggctctcaccggaggagattatctcccacagatgtgcctctagggttttcttcttggttgctaaagaagacccagctgctgaggttaatatagaggaactggacccaggacccgacccacccgcaacccatgacccgttagcggcccaaatcagtttcaattctttggcgggtcaattagccccggaaacgctccgactgttagggacgctctccggccaccaagttatcatcctcgtggacgggggtagcacccataacttcgtccaggaggaattggtggttcgtttgggattgaagacacacgaaacgcgtcctctccgggtcatggttggcaacgaccaacacttagcttgtaatcaatggtgtgaagctgtcgcggtcgccatacagggcatctccttcaccattgatatgtacgttttgcccattgtcggcgcgaaccttgtcttgggggtgcagtggctcaagtctcttgggcctgtccttacgaactacaactctatgttaatgaagttcttccacgaaggccagctagtggagctccacggcgacactgagctcagcctgaatttattgtctccaccccaattccggcgactcctccgtaaatcccatacgggagtctattttcacatcaccgtgctcgaagacgaacctcagactggtaagagtccccacccacgtattcaatctttaattgatcgtttccctgccttatttcagcccccttcttcgctaccaccggcccgggaaatagaccaccacatccaccttctgccacaagctgcgccggtcaatgtacgaccttatcgttatccacattaccagaaacacgagattgagtcgcaggttgaatcaatgctccagaaaggactcattcgcccaagtaacagtcccttctcctcccctgtgcttctggttcgcaaacaggatgggtcatggcgcttttgcatggactacagagctttaaatgcaatcacggtgcgtgatcggttcccgatacccaccattgacgagctcttagacgaattgggcaaagcttgttggttctccaaacttgacctgctccagggctatcatcagatcagaatgaattccgacgacattgccaagactgcattccgtacgcaccacgggcattatgaattcaaagtcatgcccttcggcctctgcaatgcgccgtcgtcatttcaggcgaccatgaacatgattttccggccattccttcgcagattcgtgatcgtctttttcgacgacatcttgatttatagtgtgacatttgatgatcatcttgttcatctggaacaagccttccaagtcttagctgagaatcaattcgtcctcaaattgaccaaatgctctttcggtcaacctcaggtggagtacctgggacatatggtttcttcgaagggcgtcgagcctgtggcttccaaggtcagcgccatacaccattggcccgttccacagtcaactcgtgctctacggagttttcttggacttgcgggattttatagacgcttcataagggggtatgcttccatcgcggcacctctgggagcatttagcaggttgaagcaggctttgtcggaggctccagttctcgcgcttcccgatttccaggttcccttcactgtggaaacggatgcttccggggtaggtatgggtgccattctctctcagcgaggccatcctatagcttattttagcaaaccatttcctccgaaactccaccatgcctctacttatgtgagggaattattcgcagtgaccaccgcagtccggaaatggagacaatatctccttgggcaccgttttacaatcattacagatcatcggagtttgaaggaactcctcacccaagtcatacaaactcccgaacagcacatgtacttggcacgactgatggggtttgattatcagatacaatttcgttccggcgcaagcaaccaggcagcagatgccttatcgcggcttccagagcacaccatttccttgttcttgacactatcagtaccctgcctgacattcatggacgaattacgagctcagttgacagcgagttctgaattccaggacatggtcaaagccattcaaacatcaccctcaacgtatcctgattacactattgtcaatgatttggtactcagaaaagggcgaatttggctcccttccaaacttgctctcattcctacattgctgaccgaattccatgcaacccccactgggggacacttgggaactgctaagacagtagcacgcataatggagaacttccactggactggcttacggaaagacgttgctgactttgtagctcaatgcatggattgtcagagtgtcaaatacgagacaaaacgagtagccggactactttgccccttgcccgttcctcaccggccatgggacgacctctcccttgacttcattgttggccttcctccgtatcatggtcacactgttattcttgttgttgtggatcgattttccaaagggatccatttgggcatgttgcccacagcccatacagcccattctgtagcttgtctgttcatggatatcgtcggaaagattcatggtatgccccggagcttggtatcggaccgtgaccctcttttc

SEQ ID NO: 104555 - DNA, 1521 bp, Glycine max
  Peptide Sequence Number=SeqID_221333
atgcgaacttcatgggctgatttggctgccaattcggcgcctgaaaatgcgggaacctctaactccacagctccttcgcggccggtttatgtgcctccgcatctgagaaaccccagaaacggatggggtaacagaagttgtggtagttgggatcggcgcgaagtgaatcccttcggggatcaggaggaggcagcagcagcgtttggcggcgaggagcagcaggaaaacacgggaattaacttcgatgcgtatgaggacattccggtggagacgagcggtgaaaacgtgcccccggctgtgaatacttttgcggagattgacttgggcgacgcgcttagtcagaacattagacgctgcaaatatgtgaagccaacgccggttcagcggcatgccataccgatatcccttgcgggacgggatttgatggcttgtgcgcagactggttccggaaagactgcagcattctgtttcccaatcatcaatgggattatgagaggccaagcccaacccctccagaggccccctcgcggcgtccgcatagtctacccacttgcccttgttctctcaccaactagggagctatccatgcagatacatgaagaggctagaaagttttcataccagacaggggttagggtcgttgttgcttatggtggagctccaattaatcagcagctccgggaacttgagagaggggtggatatccttgttgcaactccaggaagattggtagatttactggagagagctagagtttcattgcagatgatcagatatttggccttagatgaggcagatagaatgctggatatgggttttgagccacaaataaggaagattgtagaacaaatggacatgcccccagcaggtgccagacagactatgctgttcagtgctacatttccaaaagagatacagagacttgcctctgatttcctttcaaattatatttttctggctgttggaagagtgggctcaagtactgatttaattgtccaaagagttgagtatgttcaagagtctgacaagagaagtcacctcatggatcttcttcatgcacagaaggcaaacggtgtacaaggaaaggctttcaaagtaaacctgatgattagtattgtctcaagtagtgttgtcaaatggcggttatggcggcgccatggcggtatggcgtggcggatttttgaaaaaacgccaccaaatagcggtggcgttgcgggtttcaaatggcggcaccatggtggccaccataagcttaacggtggtggcggaatggcgcacgcagcacgcgaactccaaaactccagcgcgagcaccatgcgaactccagcgcgagcacaagcagcacgcagcacccagcatgcaccagcggcgatggcaccacgcaccagcgtgaggtctcacccgaagtcgacgacggcaccacgcgagcaccatgcaccacgcatgcgagcaagggacggcggctcctcttctactaattacaacgaagaggattatgttgggattggagaagatgattag

SEQ ID NO: 104556 - DNA, 2004 bp, Glycine max
  Peptide Sequence Number=SeqID_221334
atgtgcacggtggtttcaagttcagtccttgtgggatggctttcttcttcttgttctaaaacgaaagggagcgttggcaatggcataagccatttaagccctgccactcgtgctatatccgtactagccacggctatggctaaagatgtgtggacccgaacatcatcttccaacaccagtaggcaacgtagtagtagtagtagtagaaggcagcagcagtacttggaccgcagcgtggacatggaagtgctattagcggcaattggacagacccagaacgaggatgaactgtatgcggttatgtctccctacaacgggaggcagttatccatgcgcttcatggtttccctgctatcccgcgagcctgattggcaacgcgctcttgcccttctcgattggatcaacgacaaggccctctatcgtccctccctcttcgcctacaacgtccttctccgcaacgtccttcgggccaagcagtggcacctcgcacacggcctgttcgatgaaatgcgccaaaagggcctctcccccgataggtacacttactccaccctaattacttgtttcggcaaacacggcttgtttgattcttccctcttttggctccagcagatggagcaagacaacgtctccggcgacctcgttctctacagtaacttgattgaccttgcccgcaagttgtccgattattccaaggccatttctatcttctccagattgaaagcctccactattacccccgaccttattgcttataactccatgatcaatgtctttggaaaagccaagctcttccgtgaggctcgccttcttcttcaagagatgagagacaatgccgttcaacccgacaccgtcagctattccacccttcttgccatctacgttgacaaccaaaagtttgttgaagcactttctctattttccgaaatgaatgaagctaaatgccctcttgatctcaccacttgtaacatcatgattgatgtttatggccagcttcacatgcccaaggaagccgaccgcctcttctggagcatgaggaaaatggggattcaacccaacgtcattagctataatacgctcttgagggtttatggagaggctgacctatttggggaagccatccatctattccgtttgatgcaaagtaaggatgtacaacaaaatgttgtcacctacaacactatgattaatatttatggcaagactctcgagcacgagaaggctacaaatctcattcaagaaatgaataaaaggggtattgaacccaatgccatcacttattcaaccataatatctatatgggagaaggcagggaaactggaccgtgctgccatcttgtttcagaaattaaggagttctggagttcgaattgatgaggttctttaccagacaatgattgtagcctacgagaggacgggtttagttgctcatgcaaagcgtctacttcatgagctcaagcgaccggacaacattcccagggacactgcaattgcaattcttgccagagctggtagaattgaagaggctacctgggttttccggcaggcttttgatgctcgagaggtcaaagatatatctgtgtttggttgcatgattaatcttttctctaagaacaaaaagtatgccaatgtagttgaagtgtttgagaagatgagagaggtgggatattttcctgattctgatgttattgctctcgtgctgaatgcttttggaaagctgcgtgaatttgataaagcggatgctttatatagacagatgcatgaagaagggtgtgtttttccagatgaagttcatttccagatgctgagtctatatggtgcaagaaaagatttcgtgatggtagaatcattgtttgagaagctggattccaatcctaatatcaacaagaaagagttgcatcttgttgttgctagcatttatgagagagcagatagacttaatgatgcatcccgaatcatgaataggatgaataaaaaagcaaacagaattcatgatcatgcttag

SEQ ID NO: 104557 - DNA, 426 bp, Glycine max
  Peptide Sequence Number=SeqID_221335
atggactggccaaggaaagggatatggaaggacggaggatcaaagccttgttccatgatcaatactgggagcaataggaaaccatgttgtggtcgtagaagatttggtgttataattaggtcggaagtaaatgtggctcccaaacaaagaggaattctccgattgtcaaaacaaggagttcctcttgctgtacaagaggttgttcacaggaggatggatggacttgttgatgatcctaacgcggtgtatatgagctctgctattcttgataggtgggaagatagattgcacgacatttttaatggacaaccctatgatatgcttgatgctgctcttactgatatcgtctccaagtttcccttggatattaaggtcattacttattaccaccagaattatttatttatctggatcagaatcggctag

SEQ ID NO: 104558 - DNA, 519 bp, Glycine max
  Peptide Sequence Number=SeqID_221336
atgggcttgtacatagttggtgaggagtgtacacggctagtggccttgggaaaggtatttgatactaccgttgcgatacacaatgtcccttacacagatgatgtggtgagggattcacaccctaatgtgccaaagtcggtgggaagtgttgaaaggtgcaatacaggtgctgtagaggatccattgggagaattgatgaagatattgtatgacatgtaccagaaaccaattcaactgccatgggatgggacgaaattcgggcttccaaatgtacaagcaagctttttcatcacacatgtagatgtggctgaaataatatcaggtttatggatggttgcggtagaagcagaggtcatggttcagtgtatgttttgcttgagcctcagtctatacataatgctaaggatagacgtcaataatgtcaacattacattgaaacatgggtcaaggagtcacaacgacaactgtactaagctgaaagtaatagacgaaaatgtaatagatcaattacctatatga

SEQ ID NO: 104559 - DNA, 762 bp, Glycine max
  Peptide Sequence Number=SeqID_221337
cacgccttcagagggctacacgccctcgccatcagaggactagacgccttctcctttagaggactattcgtcctcgccatcagaggactatacgtccttacctttagagggcagcacaccctcacctttagagaactacacatccttaccttcagagggctacacaccctcgcctttagagggctccacgtcctcgccttcagaggactacatttcctcgccttcagaggactacatgtcctcccctttaaaggactacacgtcctcaccttcagagggctgcaccccgttgccttcaatgggctgcacgcatttaccttcagagggttgcacgcccttgccttagagggctacacgtcctcgcctttagacagctacacgccctcgccttcagaggactccacgtccttgctttcagaggactgcataggattgtacgtcctcctcttcagaggcctacacgcccccgccttcagcgggcttcacatccaccccgttacaggacaactcgtcctcgaaatcagaagactacacgtgcttagagttaaagagctgcacgccctcaccttcagaggagtacacatcctcaccttcataggactacacgtcctctccttcagagggctacacgccctccccttgaaagggctacacgccctcgcgtcagaggactacatgtcctcccctttagaggactacacgtcctcccctttagaggactacacaacctcaccttcagagggctgcacgccctcgccttag

SEQ ID NO: 104560 - DNA, 363 bp, Glycine max
  Peptide Sequence Number=SeqID_221338
atggagtgcctagagggtgtttgggagaccctcgaaggcaacgagaggtgccgattctgtggcacaattcgactcactgctacttcgctacctgtggagtggatattacctacgcctactccatatcgactagtggagccggttcaagtgatagaggtgtcatcctctgaagaggatcttgaagaggacccagaggagttacctcctgaacctgctatggacgcccctgactttccaaaggatgatgaggacccactccctgatgttgattctccagaggatattatgtcagcatctgaggcagactctacagaggagagtggccctggagggacaacgattagtgacgactcttcatcgtag

SEQ ID NO: 104561 - DNA, 1444 bp, Glycine max
  Peptide Sequence Number=SeqID_221339
atgctgatgatttcggagctgttcccgcagcgcattcgcgctttggggtttgcgttggtctacagcctcggggtggcgatcttcggcggttttgcccaggcgggcgatcacgctgcgggtttccatgcgcacttcggcgatggtgacctgcaaggtgtcgctctggcggtaaaccacttcacccttgatctgcacggtgccggtttcctggctgcactgcatctcgtcgcgcaccgcgtgaataaacggtgccgggatgaaggcaacggcgccgttgtccagcaggcgcacgcgcaggccgccgcgggtcacgtcgatgatctcggcgttgaagcgggtatcggtaccggccttgtcctgcaggaagcgagcgtacagccagtcgccgacgtcgcgctccgccatgcggttgaggcggcggcgctccgccagctgtaccgtcacgtcatcctgcggtttttccgccggctgctggttgatgatcgccttcagcaggcgatggttgaccatatcgccgtatttacggatcggcgatgtccaggtggcgtaagcctccagccccagaccgaagtgtggccccggcgtggtgctgatctccgcgaaggtctggaagcggcggatgcggctgtcgaggaactgggtcggctgcgcgtccaggtggcggcgcagttcgcagaaaccgtcgagggtcagcagcttgtcggcttcggcttccacgccgttggcctgcaatacggtgaccgcttgctcgaccagcgcaggatcgaaaccggtgtgcacgttgtacacgccgaagcccaggcgatcgcgcagcacgatggcggcgcagacgttggcggcgatcatgcactcttcaacgatgcggttagcgctgcggcgctgctcggtaacgatctccagcacgtcgcctttttcacccagcacgaagcggtagtccgggcgatctttaaacaccagcgcatgctggtggcgccaggcgttgcgcgcgtcgcaaacgcgtttcagcagggttacctgctgtgcgatggcgtcgctcggcggctgccagccggcaatgccttccagccagtcggacacttcgtcgtacaccagcttggctttggattcgatccacgcggcaaagaagtgggcatcgtcagccaggctgccatccggcattacagtgacgcgacacaccagcgccggacgcctgacgttagggcgcagcgagcagacatcatccgacagttcgcgcggcagcatcgggatgttaaagcccggcagatagttggtgaaggcgcgtctggaggccagctggtcgagttcgctgccggcggcaacgtaagcggtcgggtcggcaatggcgatggtcagggccagcttgccttctgccagctcttcaacatacagcgcatcgtccatatcttcggtgctggcgctgtcgatggtgacaaagttcagcgcg

SEQ ID NO: 104562 - DNA, 228 bp, Glycine max
  Peptide Sequence Number=SeqID_221340
atggtcatgagtggtgtggggatcaagagtgttggggatgagaatgaaagaaaatcatcgggtgatcatcatggtgctgcttgtcctacgtgtgagatggctattgtttggattcagaaccaactgagccgaaatcagacacaagatcagatactaagttacatcaaccagcatcctgctgcatctcttgatttattgcctcatgatgacattgctgctttgcgataa

SEQ ID NO: 104563 - DNA, 258 bp, Glycine max
  Peptide Sequence Number=SeqID_221341
atgaaggaaaatgaaaggcacaccagtaaccggaaggagcatcaacttggatcatcatttggtggtagtgatggagttggagtggtgggtgaaggatgggattggagcactggtgttgggggcctgggtggtggcgtgacgacacgatggtggtgtagggtttggggaatgggtccgcatgtccaaattcgagagacattggtgtggcacacactgttatggttggtcgaacttcccttctttgctgacccttcgtaa

SEQ ID NO: 104564 - DNA, 372 bp, Glycine max
  Peptide Sequence Number=SeqID_221342
atgacaaaagacaaggttgatacctcaatgccctactctggggaaatgaggggcaccatgcatgaacctcaagcgaacctaggggcagatcaaaagtactcacccatcgatgtttttgaacaaaaaaagggggacaaaccctgggatttcaatggattgattaaacgccaaacggctccattgtcatcactccaaaatggtcaagtgtttaaatcaaacagaacatacactctgagggagttcccagagagatttgcaaaagatacgataaggttgcatgaattatcacctctttcaaaaggacagtcaatctgtgttttccaaaaaaatcaaatcaaatcaaaatcacaaaatagggaaagaatgtcatga

SEQ ID NO: 104565 - DNA, 123 bp, Glycine max
  Peptide Sequence Number=SeqID_221343
atgggtgtagatcagcttagttttcacgtaaccttcacgatgagtgcacttgtcgcacttagcgagtatgacggtattcgtgttgtaatcacaatgagtgcacttgtcgcacttgtcacgtga

SEQ ID NO: 104566 - DNA, 210 bp, Glycine max
  Peptide Sequence Number=SeqID_221344
atgtcactgatcaagttgagaagttcccggcctcaattctctttcaatctcatgaagggaacttcatcattgccaaaatcgaatggagatatccatgtctccctgtcacagaaggagatcggcttggggtttgttggttttgagcctttgaagtttgcagatgggtatataacaagatcatcaagagagctccagatatttcagaactag

SEQ ID NO: 104567 - DNA, 282 bp, Glycine max
  Peptide Sequence Number=SeqID_221345
atggctttgccacagcaacatacggttgactatcccagtttcaagcttgtcatcgtaggcgacggaggaactgcaaccattggtgtggaggttcatccactagacttccataccaattgtggaagaattcgcttttactgctgggacactgctggccaagaaaaattcggtggtcttagagatggttattatattcatggacactgtgctatcattatgtttgatgtaacagctcgcatgacatacaggaacgttgctacatggcacagagatctctgtcgg

SEQ ID NO: 104568 - DNA, 1428 bp, Glycine max
  Peptide Sequence Number=SeqID_221346
atgaacagggaagtggaagaaggtagaatatttcaatttcttacaggtctgaataaggagctagatgaagttcgtggcaggatcattgggagagtaaccttaccttcattgggtgaggtctttgctgaagtcagaagagaggaaactaggagaagtgtgatgataagaaagatcaaaattgttctacctcctcctgagaccaatgctcttgttgcagaaactactgcccttaagagttcaactaagcagaagaatttttcaaacctctggtgtgaccactgcaacaaaccacgccatacccgagaaacttgctggaaaattaataggagacaaactcatctaaagggcaccaaatcaggtcctaaagttcatagacccttccctacaactcatgaggcaaaaaagacttctttgagaaaggaacaagttgaggaactcataaggttgttaaattctaattttttatctggtacccctagtggttctgtggcacaaaaagggaaaggggatattaccttatctaaaaacattgacttaaaaaatgttttacatgtacctaaacttacctataaccttctctctgttagcaaaatctgcattgattctcattgcagtgtgaaattttttgacacttattgtgtttttcaagaccagacttcggggaagatgattgacaatgctaagataatggatggactttactactttgagaatactttcgaaaataaagaagctcggggtctaagtggcattcagcatcaatcgacatgtccaaatactcctcaacaaaatggcactgctgagagaaaaaataaacatctccttgaagtagcctgtgccatcatgtttgagagtaatgttccaaaatatttgtggggggatgccgtcctaacagcaacctaccttatatatagaatgcccactcgtgtgttaaattaccgcatacctttggacactttcaaaacaatttttccagcatgtcgattacatactgaaatgcctttaaaagtgtttggttgtattgtttttatgcatacaccctccatatctcggtctaaactggacccaagggcagaaaagtacatttttgttggatattctccaaaccaaaagggatacagagtatttaatcctattacaaaaaagctttgtgttagcatggatgttacctttgtagaacatcaacctttttttcaaaaaaattcccttcagggggagaatgattatgtgagtgaagacaattttttacattttcatgaaccattgcctatccctgttgtgcatactaaaaatacagattttattgatcaaacaaatgaaaacaagttacacaacaaggaagaccatgtggaaacaagtcctgaattttccaaaggaaatcctatgccagacttaggtggagcccaagcagggaaagaaataccatag

SEQ ID NO: 104569 - DNA, 249 bp, Glycine max
  Peptide Sequence Number=SeqID_221347
atggtgaacggaagctcacagcgcttcatgttactgttcatgcaaacagaaaaacgcatgctgaaagaaagaaaagaaaattgtttggcatgtgatagcggttgctggagaagcattggaaaaggagaaagggtcgctggaagatatgcagcgagcagaaagtatatagaaggtacatgtaagcagacttatgccccacaagcagagaggctgtttccaggacttcaatgcatgaactctaggtcataa

SEQ ID NO: 104570 - DNA, 99 bp, Glycine max
  Peptide Sequence Number=SeqID_221348
atgcccaataggtatcaggatgattggctcaagacatcagcaaactctttgcagcactgggagaaggctcctctagagccctatgctctacagaaacct

SEQ ID NO: 104571 - DNA, 1383 bp, Glycine max
  Peptide Sequence Number=SeqID_221349
atgaaagtgaatgatgaagactggaacgttcgcgtaggcgagctggccttcagttcgatgcccctcaatcgttatctggaatacacgagcgaccacatttcggtcatattcagagaaataaatgaaaaggttctggcagaccttaagctcatcccctgtgtgctgatgaccgaattcgagaatgaacggcacgcggacgggcggtcacgccagtgttccagcatcagggtgggcatgcttgaggacgtgagcgtcagagggaaaaatttagagtatgcagtacgcatatactatgacttcggcaaagtggtcgtggataattacagggcgctcgccgaccggttcttctttcacctgtttgaaacatcgagaacccattgggctatcaaggaggtcaaccttcctgaagtgatgaatacctttgggttacaggtcgcggctcctagcgcggcagttcccgcacttgtaccgcccccaccaccgccagctgaggaactgctacgccagcagagcgttaagtcggtagaggcgtttttgcaaaaaattaacgaatttcaggcacaggatggccatgagatgttttaccgggggcacagtaaacacgggtatagacttgagccctcactgtttcgcgaagatgagggggtgccgctgtacaagtacaaagaaaggaacatgattaatgagatcctgacggcacatccggccgaattctatcaggaccattttatgatagataaactggtccgcatgcagcattacggcctgcccacgcgcctgctggacgttacggccaacccgctggtcgccctctatttctgctgcgcagatatgctcgataaagacaagaacgaggaagagaaagtcggggatgtgaagattttttccgtccggacggacgacatcaagttttataattctgacaccgtcagctgcatcgccaacctgtccctgcttaatatggacgaacaaaacaggctcattcctgaaacgaatgttccccagggtgaacgtggtgaagaaacaccggaaatgaagaaactgctacattttatccgggcggaaaaaccgtacttcgaaaacgacatacgtccgggtgacttaagccgcatcctgtttgtccgcggcagaattgccaaccagaggatttcctctcagtccggcgcgtttctgctgttcgggcatgaagccgtgctgccggatactggacacagcgacgacctcagagtgaaccgcatatacgtcagcaacaagaaggccatcctgcaggaactcagccgcctcaatatcaaacccagcaccatctaccctggtattgaagagacggcgagagaaattgcccgccggacgaaaggcgaagagatcctgtaccgggtgaaataa

SEQ ID NO: 104572 - DNA, 255 bp, Glycine max
  Peptide Sequence Number=SeqID_221350
atggcagagagaggatggtacgcggagaagacagtagagaacgacaacaggaaaagtcaaaaccaccacaacaagaaactagccccagggaggaatcaaacagttttgagttcagccggacctgtatctcactcatcggtgcagatgaacatacctgcggacgaaaagacatggctaaataggacatgggtgggaagactgaggaacctcacactgtttgacaggatagaagacggccttatgtggactgggtaa

SEQ ID NO: 104573 - DNA, 948 bp, Glycine max
  Peptide Sequence Number=SeqID_221351
atgacggaggaagtaaatgaacaacattcggcattattctattcgttggaaaagtggacccctcaattgaggactgggcaccgtctggtctggctcttatgttggggtataccattgcatgcctgggacatggagcacattaaacagattgcaacagcggtcagagaagtggtggaggtggatgatgacatggacgaactccacaggctggataggaggcggatactagttaagacaccacaaccaccattaatccaacataaggtctcagtatggattaacagagtagagtacaccgtgcacatggatgctcggccaagtgcaacgggaggcgagaaagatcaagtagtcacggtgacacaacggaccgaaggacaataccagcctgtcaacccacaggcacaagggactgctgatgagtcaaatcgcacccctagcagccatttacggaaagaggataaaacaaatggagacaagatggagaaggaattgcttaaggaggtaggaaaggtagtagctgtaatttcggaaaaggaacttttaatggaatcagaaaattgcaaggatggtgggccctcaatgggcctctcaaaagattacctacgtgacaaaccagggggtgcagaaagaaatacccattgtgaacaaataggcccaaggcacatgggaaaggagaacttctcaccaggaaccagaggcagtgggtcggaagaagtggcagagacaacagcaccagtcgaagcacagcttaaaactcagactcctttgcaaaaagatagccaccagacatgtgctcaaataagggaagcctcagcacaatggaagatggcacaaaacctaggagttacatgcgaggaaggagatgcaacagtggtcacaaaatttatgaagatggaggtgacggataaggaggaggccaacaagttgggtaacaggaggcctggataa

SEQ ID NO: 104574 - DNA, 438 bp, Glycine max
  Peptide Sequence Number=SeqID_221352
atggcgacggaggaccgcaaggcagcgacggtgacagaggacggaggaccacgactgaggaccgcgagtgagggctttcaaagcagaacaacggtgagtagcagcttcagcacaacacgaccacagagtcgcgactctgatcaaggagctcccatgaaccctaagagaataaaggtcattcctgagtggcacactccaccaacaccacttattgagttggtgaggaatcatattccttcatcggaagatgcccaggaaatggattttcagatcttaccttacttcaacataccaaacaccactaatatatatgtttttgttctttttaccggtgttcaggaaaaaagcccaaagtttcaagaacctcgggatttgaggtcaaatctttttcaagggggagggaatgatgcaatcctaccccgtaagggcattggatag

SEQ ID NO: 104575 - DNA, 165 bp, Glycine max
  Peptide Sequence Number=SeqID_221353
atgaaattgatgacatatgttgacctcagaattgattttctaaagctttatattttacttgtcctgacccatgaggggcacatggccccattatgtcttgggtctattaggacaagattagggaagggttcctttgcgtgggcaccccaatgttgggtcaactag

SEQ ID NO: 104576 - DNA, 951 bp, Glycine max
  Peptide Sequence Number=SeqID_221354
atggcaaggctcgacacagtttatcctggaaagaaatttctcggatcattgcccaggtggttcaagaatcttggtcgaacaatcagatttgcaaactcaaaatgcagatccagcaccttgagaggagtggttgtaaatgatgtatgggttgatgaacctggaagggtgaaggaggagacatacatgtttttcaagaacagatttcaggaggttgaatgggaagttatcaaggttgacgtgcttcgattcatggacgagttctatgctcatagatctttctcgaaagggtgtaacacatccttcataacccttgtccctaagatcaaggacccacagaacctacatgaatacaggcctatttcttttataggttgcatatacaaaacggtggccaaggtgttagcaaggaggttgaaggggggtaggcacctgctgcacaacactatcactgcgaatgaagtgatccatgaagcaaagacaaagaacaagtcgtgtctggtcttcaaagtagattacgaaaaagcttatgattcagtatcttgggagtttttattgtatatgttgaagaggatggggttttgtggaaaatgggtatcttggatcaaaggctgtctaaagtctgcttctatatccatattggttaacagtagtcctacatctaagttcattccccaaagaggcctaagacaaggagaccctctagctccgttcttgtttaacattgttgtggaaggactaaatggactagtgaaagaagcaatggataaaaacctgtttctaggtttcagtgtggacagaaacgaagtcaaagtcagcatactgcagtatgcagatgacacacttttccttgggaaaacatccatggaaaaagtgaaagccaccaaggtgatcttgagaagctttgaattagccttaggcctcaaaattaacttctcaaagagtagatttggg

SEQ ID NO: 104577 - DNA, 948 bp, Glycine max
  Peptide Sequence Number=SeqID_221355
cccgacgggcggtacgacggctttgagctggataacgccgtattcacgcagcagggtccagcgatcggcctcaagccagatagggaacaggaattcggccaggcttacggccgccctgtgattgatgatgtaggagtgagtgaagacggcttcagtcacctttaccacgctgtgagacttgctgatcaccccggagcggcggcggtgatgcttgtttgtctcgctcagaagcacgacttcaggacgtctccccggcgaggcttcataccacgccagaacttcaggcagcgccgcggtcagttcaacgtcatcctcgaggataagcgcgcaggggatgttttcatccgcaatttttttatagatgtagtaatgactgagcgaacagccgatttctcctggcgtcataccggaagcataaagcgggtgcgtcagagccgccgtttcgtccgcggtcaaaagccgtccgtccgttgcgctgacaacctccgcatccaggttcaggttgcggcactgctgcaggatgtgctcacggcgaacaacgtctttatccagagtgacgaattcccggcagatccggcaggttgttcagctgtccgggcaggtctcatcgggatatccccgcagctgttcaatggcgaaaatcagggacggattgcagtctgcatttttgtcgatacaggcttctgcgagcgtgaccagctcctgaatcagctgctcccgatgtgtttcttttccccggtcagcaagactaaggcagatcataccggtgatccggcacgcctcccaggggcagttttcgcttcatctgccgttagcgcagactatataagcctgaaagtaacaccaatgatgattgcagcgaaggcatctttgctgaaacaggcctggccggcgagcagtgcgcagcctgcccctgaatgccgcgtcagcggcatggaggcgccataa

SEQ ID NO: 104578 - DNA, 1353 bp, Glycine max
  Peptide Sequence Number=SeqID_221356
atggctgtgatgtttcctgctccttccctcttttgcaaacttgacacttactacttgcgggagcgggactgtgcaacattcctagtttggtttggacccactgttcgtctcaccgtctctgagccagacctcatccgggaaatcttcacatccaagtcagaattttacgagaaaaacgaagctccaccacttgtgaagcagctagaaggtgatgggctccttagcctcaaaggagaaaaatgggctcaccacagaaaaattatctctcccacttttcacatggaaaatctcaaattgctggtaccggtgatggcaacaagcgtggtagagatgctggaaaagtggtcggcaatgggtgagaagggcgaggtagaaatcgaagtttcggagtggtttcaaagcctaacagaagatgtcattacgaggaccgcgtttggaagcagctacgaagatggcaaagccattttccgattacaggcccaacaaatggacttggccgccgatgctttccaaaaagtattcatcccaggttacagattctttcccacaaggaggaatataagatcttggaaattggagaaggagattaagaaatcgctggtgaagctgatctcacgacggagagagaatgagaaagggtgtggggtggaggaaaaagaaaaagggccaaaggatttgttgggactaatgattcaggcatcgaacatgaacatgaacatgtccaatgtcacagtggatgacatggtggaagagtgcaagagctttttctttgcaggcaaacagaccacatccaacctgctgacgtggacgaccattctccttgctatgcacccacactggcaggtgcgggcacgtgaggaggttctcaaggtgtgcggatcacgtgaccaccccaccaaagaccatgttgcaaagctaaggacgctgagcatgatagtgaacgagtcgttaagactgtacccgccgacgatcgcgacgataagaagggcgaaagcggacgtggatttggggggatacaagataccaggagggacggagctgctgattccaatcctggccgttcatcacgatcaagcgatatgggggaaggatgcgaacgagttcaatccggggcggttcagagaaggggtgtcaagagcgggcaagcatccattgggcttcataccgtttggagtaggtgtgcggacatgcatcggacaaaacctggcgctgctacaaaccaaactcgcccttgcaatcatactccagcgttttactttctgcttggcccctacttatcagcacgccccaaccgtcctcatgcttctctaccctcagtacggcgcacctatcattttccaactcatccactaa

SEQ ID NO: 104579 - DNA, 1432 bp, Glycine max
  Peptide Sequence Number=SeqID_221357
atgaaacttacttcagcggcgatcgcggtggcgatgtgcctgactttttcagccgcagcgtcagcagacgcgccggccattgacgtcggattttcaccggaaggcagcgcgcagcagctggtcctgcgcacgctggacagcgcccgggagagtatccgcctgatgggctacagcttcacctcgccggaggtggtcagggcgctggttgccgccaggcggcgcggcgttgacgtcagggtggtggttgacgacaaaggaaaccgcagcaaagccagccaggcggcactgaacgtgctggccaacgccggcattccgctgcgcaccaacgggcagtacaaaattatgcacgacaaggtgatcgtgaccgacgggcagaacgtggaaacgggctcgttcaattacacccgcagcgcggcggaatcgaactccgagaacgcgctggatgcggttatgccacatatacagcctgctacagctcagtcgaaacaaaaacagactagaaatcgcaagcaccctatgagcgactctgaacgccagttatcttatgtggcacgtaaaagagaagcgctcaaagaaataaaaatctttgttgagcctgagctcaagaaagctttaatgcgtatgtgtgaggaagaaggtgcaacgcaagccgatatcctgcagcgtttgatcaagcatgaagctgagttgaaaggaaaattatacaggagactggaaggcgtggctgagcaacttactgaaagcacatcattttaccggcaggtaaaaaatccgaatccggaattcattccggaagaaggcaaaaaaacgctgccgttctgcgaaaaaatccgtgaaaaggcggccggctttacgcggcgcatggagtttcagacgcttgttgcgatgtctatcgcccggggtgagcgcaaacgccgcccgccggagctgcgcatgcgggccctggaagcctcgctgcaggcgctttgccactactttaatccgctggccaaccgcgtgggcgcttcgctcacgaccatgagcatccgctgcgggctggccaccgagaagaaacgtctctcgatcacccgatttaccggcgccgtgcagttcatggcccagctgaaactcctcacctacaacaccgaatacgataaagagatcggctgcaatatcccgaccgacatcacctttacgccgctgatgtggcaggtgcttgacgtctccgaggaggcggtcaccgctgcccgccgcagccgcatcgagtgggaaaaccgtcagcgcgagaagaaaggtctgccgcgagccggcgccgacgaacttatcagtgccgcctgggcatttgtgcgcgaacgcttccgcgaataccagaagtcgcgccgtgaacacggcatgaagcgtcatcgcgcccggaaaggatgcgccacgtacccggaaagatatcgagcagctg

SEQ ID NO: 104580 - DNA, 585 bp, Glycine max
  Peptide Sequence Number=SeqID_221358
atggagagcaatgctaggattttcaaagaatccttgataaagattcctgtcctttgggatagcgttttgaatttgcatatctttgctaatgtgaacacggtcatttttggcctattatataatttacgaggcttgactggttgttctcctagtgatcttgtcaagcaaagctacttcagttctaccaaatttagggtgtccaatggaattataggtctcccatatcatgtttcccagggtgttggttgccagctgagggggcagaattgttatgttgaagtaagtcttggcttccctagatctggaactgacaacacgttgcagccaaacaaaaatagtgttaggaatttacccaaacttcatgttgccgaatctcctattgtgggacgaagtgatcacaagggatcaccagatcatttgttggattatgataaaacatttctctatccagctgaggcagtgcttgtgccagttttacaaacatcattagcaaggtcttccttgagaaggtattttttttccatggacatatgctatgctattttcttcctttctttggttaagagctttgtgtataactgttaa

SEQ ID NO: 104581 - DNA, 672 bp, Glycine max
  Peptide Sequence Number=SeqID_221359
atggagaacttccctgtgatcaacttggagaatatcaatggtgaggagagaaagactatgttggaccaaattcaacatgcttgtcagaattggggattttttgagaccaccccatccttagaagcagtgaatgaaattccctgctatgtaaattacctacaatatgtctttgatgaagacataacttacataggtttgagaagggacttatgctcaaaggaaaggagtggaagttgttctggagagaccataaaaaggaaaaggggttttgacctagaaaggcctactgagagagacattttttatggcggctgtgatgaacatgaggcaggacttacctcctacactgcactagagagatgcaaaataagcagcaacaatgatgatggttatgatgaagacgtggaagtggatttgactctaagcataggaggaggaagccaagttaatattaacaagaatagaagttgtaacaaaccttatctacttccattggggtacttagactcacccaatgggaaaactaaggacctaaattcttctgtctctttccaatcctacagggtgggagatttcagtgaccccaccacccctatgagcagctcaagtgtgacatttgatcaagagagaaaggggccacattggatttctcaaggtttaaagcttaaatag

SEQ ID NO: 104582 - DNA, 288 bp, Glycine max
  Peptide Sequence Number=SeqID_221360
atgatgttcttcaaaggtgagaaaagagactcaaggacatgcagattacatggaatagagaatttgagcaacacatggaattgttgggaaggagttcatgacagggaagaagaagttcatggtgaggatgcagggggcgatggaagggaggaaggggaacttggccataacggtggaggtattcgagattgtctgtttgacggtggtggcatggcgtggtcaacggttgtggtggtttttgttggagaaggggaaaaaggtgatgacgtggcaaggacgagacaatga

SEQ ID NO: 104583 - DNA, 357 bp, Glycine max
  Peptide Sequence Number=SeqID_221361
atggccgagagcacacaaagagtactatttaagaccttttggtgcagcaaggtcttgatcgggtctagtaagccaattgatgataagctctctgatgaggagcaattgttgttgttgttggcctcaccagcaaggtccttcaaagctttggttcaaacgttgcttataggaagatcaactttgaatttggatgaggtgaatgtcattcttagagaaaaagagagaatgatgagaactgaaaatgttgatgatgaacaccatgtaataattgtggtggagtctgagcgagagaggaatcattcaaggagacatgatggtccaagaggaagatcaaaatcacaatcacacccgcaatga

SEQ ID NO: 104584 - DNA, 204 bp, Glycine max
  Peptide Sequence Number=SeqID_221362
atggcccaaactcgcaacccaattcttcaactctatcacctcgcaacaccaagtgtttccccttatgatgaggacacaactaagggcaaagaccatgaagcacttgaagagcccatgactagaggcatacttaaaagggtccaacacagtgatgaggacacaactaagggcaaggaccatgaagcacttgaagggccaaaatga

SEQ ID NO: 104585 - DNA, 375 bp, Glycine max
  Peptide Sequence Number=SeqID_221363
atgggggagacacatgaagtacaccgagaccacactctagcctactccaagccttgcctcggatatgccactgagggacaagtgttgcatcctgccatggtagaaagggaaaattttgatcatatagaagaaaggctaagggtcattgaaggaggcggaaattatgcctttgctaacatggcagagttatgcctagtgcccgacgtggtcattcctctgaagttcaaggtgcctgactttgataagtacaatgggactacttgccccaagaatcacttaaagatgtactgcaagaaaatgggggcatacgtgaaagatgaaaaattgttgatgcatttcttccaagaaagtcttattggggcagccatcacctag

SEQ ID NO: 104586 - DNA, 237 bp, Glycine max
  Peptide Sequence Number=SeqID_221364
atgcgaaaaatactaaaaagagggggcaaaagggtcttttccttttttttcctagaccctagctcccccaggcaagcctctggctcacctgggccaccaaatagcttcatggtgaagaaaccagctcgcctgggtgagctgcaactgccccaaagtgaccctttgcctataaataggtgtcctagaggtgttttaaagggtttcaggggtcagaagtggagagaattgatagaatag

SEQ ID NO: 104587 - DNA, 294 bp, Glycine max
  Peptide Sequence Number=SeqID_221365
atggcgactggtatcggtgcctacgccggaatggaagatgaaaaatgtggagtgggattgcgagtttggctaagacagcctcaaggcgatcctcggtggcagacgaaaattcaaggtggtgtggtggttgttgtgggggcagccatgggagcttcgtatggtgagtggcaaccatggaagcttcgtatggtgagtggcatgggttgtggtagtggagggtggtatggcagccatggaaggcagccatggaagcttcgtatggtgagtgacatgggttgtggtagtggagggtga

SEQ ID NO: 104588 - DNA, 431 bp, Glycine max
  Peptide Sequence Number=SeqID_221366
gcaatcctatagaattgaatcgataccttcatgacgatgaagaggatgaaccaataactattgaagatgaggtctacatgggtttgaaccagaaattcactcctgaaaatgcagagcatgctggacatgaaactgattcatactcgggtggttttgaagctaacaatggtcaagaaccctacattggaatgaaatttgagtcaaaggaaaatgctgcttcaatgaggtcctttaatggtgattatccaccatggagatgcagcggaagacaaaggagaagaggtgagaggaggcgccatccactagggaataagccatggaagaaggagcttcaccaccaagatgagccttggataagaagcttggagaggatgcttcaatggaggaaaagaaagagggagagaaagagagaagggggagcacgaaattga

SEQ ID NO: 104589 - DNA, 801 bp, Glycine max
  Peptide Sequence Number=SeqID_221367
atgacttatgagtggtccatgtttggttgcttagaaaatgtggacaaggctgatgcttatcaagttgctggtgtattggtgttggaggttctcgatgctgttctcgatgttgggggagtgtatgaccctgcccgagatcggtatgatcatcatcaaaagggatttgaagaagtttttgggcatggtttttccactaaattgagtagtgctggtcttgtttataagcattttggaaaggagattatagccaaagaacttgaggtagatgaggaacaccgagatgtgcatcacatatatttggctgtttacaagagcttcatggaggcaattgatgctatagacaatgggatcaatcagtatgatacagaccagcctccaagatacgtgaataatactcatttatcctcaagagtaggaaggctaaatttggattggacagatcctgatcagtcacctgagaaagaaaatgaggcctttcaacgtgcaatggctcttgctggcagtgagtttctggatagtgttcgatttcatgtcaattcatggttaccagcaaggtcaattgtaatggagaccctagcggctagacatactgttgatcctagtggagaaattctagttttgactaaattttgtccttggaagcttcacttatttgagcttgagggagagttgaaaaatgaccctgctgtcaaatatgttccattctatgcttttagtcctcaaagagtctcactaaaaatttcagatgattgtttgccttttacaatgactgaatttcaacaaaaagttcagaataattaa

SEQ ID NO: 104590 - DNA, 294 bp, Glycine max
  Peptide Sequence Number=SeqID_221368
atggagtcagtggctaagagaatcaaccagcagctggctgcctgtttctatggacctttgctaagctgggggaagttgcatataagctccaattaccagaacagtcaagtattcatccggttttccatatttcccattggagattttcaggtgcacagtgagctgccacaaaagttggaggttcaaactgccttgaggacaaggctgattctatggaattgggaccatgaggaagaattggacgagttggtactaatagaaagaccggagctattagagagagggttggagtag

SEQ ID NO: 104591 - DNA, 366 bp, Glycine max
  Peptide Sequence Number=SeqID_221369
atggctactagaatgagagttgaatatgacaaatatcagggaacacctaatgtaatcaacattttgctattgattgtcgttgtccttgatcctaggtgtaaggcagatgaattgaagttgcagttgtcttctagtttaaaatcactttatgagcaataccaaggtgttgaggagggctttcaaattaaccaagaagtagtacaattggatgaagatgatgatgatgatatccatgcatcaaaatctccattcactgctaaagggaggattcttgatccttatcaaagttcccttacttctagaatggtggaagtattggtttgcacgaaagattggtcgaaaggaacatttttcaatgtttactaa

SEQ ID NO: 104592 - DNA, 384 bp, Glycine max
  Peptide Sequence Number=SeqID_221370
atgggttctgattcagatctacctgttatgaaaagtgctgctgaaatcttggagatgtttggtgtgcctcacgaggtaagaatagtttcagctcacaagactccagaattggtgttttcttatgcctcatctgctcatgaacgaggcatacaagtcattattgctggtgttggtggtgcagctcacttggctggtagtgcctttttaccattaattaagcctcaaatctcaggtatggtggttgctcttactcccttgcttgttattggcattcctgtgcgtgcttctaccttggatgggattgattcactcttgtcaattgtccaggctctaacatccagtgactgcatcaattgggtagggcctaggaaattgcgccagtga

SEQ ID NO: 104593 - DNA, 369 bp, Glycine max
  Peptide Sequence Number=SeqID_221371
atgactcaaccacagttttttcgccattaccgggagttacaagaagacaacctgcatggcacaacatggcttgatcaaataccaagggagcaatggaccttggcatgggatgatggaaaatgtgtctacaaaatcccgttagcaggcatacgtcatcatgattactggccaccatatgaaggaccacaattgtgtgtcaatccagccatgaggagaaacaaaaaaggtcgaccaaaatctataagaatccgaacaaatatggacgagagagaaagaggtcaaccaaaacaatgttccatctgcaggctagttggtcattcgaaaaataagtgcccccactatcctggaagttcaagtcaagcaaattaa

SEQ ID NO: 104594 - DNA, 213 bp, Glycine max
  Peptide Sequence Number=SeqID_221372
atgggtggaaatgtgaagtttgtcatctcagatacaagaaaagttaaggacagtttccacattacaaaaacctcgagagtgacagtgtggttgcagcgcgccgtgagtgataacgacagtgatgttgcagcaccgagagattgcaatgctagcagtgatggagttacggtgtcgcgagaggttgcaaatgagagtgtgaaagcatttgagtga

SEQ ID NO: 104595 - DNA, 327 bp, Glycine max
  Peptide Sequence Number=SeqID_221373
atgacatcgatggattcgatcaccgaaaaagtgactcaacaagtaatgttttccttcaaccaaatgcagtcccagatgcaacccaaggaacacatattgcctcctaagcctgaggttggtccttctactgcctgtgttagcacaaagggaagttgtttcgatccctcggggcagaatccaaacacagatgaatcagacaaatgtggagtttatgagggatcgataaccatccacaacatccctttggacaatgatcaagggaaggtcgatgttgaggaagttcaagatgttgatgctcacgtccctatacccattcaagaggtttag

SEQ ID NO: 104596 - DNA, 608 bp, Glycine max
  Peptide Sequence Number=SeqID_221374
atgaaagctagagcaaaaacgtatctaggagacatagctagagcctgttgggaatcgtttaagaaaactttcccagaacaaatcaaaacaaacctagtagaccctggaccaaacatctacaatttctgtagcttaatacaaagaatttttacaacccagtctgtaaatgatgggaacaacatcagacaaaaaatttacctaggcaatctagaaagactctccataagttattttggaaaaattaaagaatttacccaggattatttaatgtatgcctctatagcaggaggatttacagataaatctttaggagaaaaattatttttaaaacttccgagtaagttaggacaaaaaattagagacagctggaatcacgaccaaattgatccagtcatgaataatttaactgttagaatccaacacataatgaaggtaatggaagatacatgtaccaacatagccattaacaaagaaataaaaatggctcattctgaaatgtgcaaacaaatttacactccccaacaataccataaagaaattaggagaaaaagacctcaatatagacctcataataaacaacctcccaagaaaaagaatcccactggtag

SEQ ID NO: 104597 - DNA, 177 bp, Glycine max
  Peptide Sequence Number=SeqID_221375
atggtaggcgccaaatgtgctcaccgaaatctggagttgactgatgttagggtctacataggcaagatgagttccatgatctcacacgtcggactacaggtacccttcactaggagaacaaaggggggaacctacaaagcaaaggactctaacgctcaaataattcctaacttatag

SEQ ID NO: 104598 - DNA, 216 bp, Glycine max
  Peptide Sequence Number=SeqID_221376
atggcaagcacaaccaaaacttaccttgtgattgtgagtacaaagacaagcaaagactgctttcgtgccaatggaatgcctgcaaggaaaccaacgaagcttgttcaaagacaatgcgatgacggtggcctgagggtggctatgcgagacttagcgttgggggtcagggacaatggcagtgatgacggcgacctgagggtgcctttgcaagagtga

SEQ ID NO: 104599 - DNA, 513 bp, Glycine max
  Peptide Sequence Number=SeqID_221377
atgggaggtggaaatggtggtgttggaggtttaggtggtggtggtggtggtttgggtggtggaagtggtggattaggtggacctgttgtgccaggtggtgtggaggctttaggtggagctggtggtttgggatgtggtgttggtggtgctggctgcatgcatcaactaggcccctcatttctcaatccactgagccacttgaaaccctatctctcgaaaccatccatttctctgtcctgccgctatgcctcgagaaaccttgccggatatttctaccacgacatcacccgctgtccaccatcatgtcgacagcagcttgtctactacattgtgcgacaactatcaatgcgccttgaggtttccattgttgtccgaagtgctaagttaaagcaagggggtctacaagaaatagatgagacgaggcccaaaaggaagaaaaaggcaccagcatatttggaggagtatgcaccatgcaagaagcgcatagcagtagctaggattcgtaccttgtag

SEQ ID NO: 104600 - DNA, 352 bp, Glycine max
  Peptide Sequence Number=SeqID_221378
atgggaaaatgggataccttgcttgtgttgtttgtgttagtcacagtgcatgcaactgcaagtgcacgtgatgtgccaaagggtggtggtggtgaagaagaaatcctaggtgtgcatgcaagtgcaccacatgcaggtgttggtgacaagaagcactttttgtttggtggggttggtggatttgctggggtgggtggttttgttggaggtgcaggggggatagggaagtttggtggagttggtggcattggaaaatttggtgcacttggtggtgggattggtggagggatggggaaggttggtggaattggaggtggtgcagggattggtggcttccatggcatgggtggtg

SEQ ID NO: 104601 - DNA, 123 bp, Glycine max
  Peptide Sequence Number=SeqID_221379
atggtggtgccacacttaagagtgaagtctagtaagcacttgaggaagtccaatgatttgcacttaagcgagcagcagcccccacttaagtttgaacctaagcttagtggtagctctctgtag

SEQ ID NO: 104602 - DNA, 243 bp, Glycine max
  Peptide Sequence Number=SeqID_221380
atggctcgctcacatgtctcaatgagttttctgaaatttatgatctttgcagcagccatgcttgttgttctattttcagttggagttagctgcaagcagtggtgtccaggaacatgccagcaatatccgaaagggaaatgcgaggccttctgcaaggccaatggctatcaaatagggaaatgcgttccaccagaaaatgcattttgctgttgtgccaaaattggtgaccagatttttaactaa

SEQ ID NO: 104603 - DNA, 771 bp, Glycine max
  Peptide Sequence Number=SeqID_221381
atggaagtcaatcttagtgatctgatggtgccaagtagaaggattgtccctcaatgggctatagggataatagactcatcttcccccaagagttcagatcgacaagaaggtcagggcggatgtagtaatcctatacccgtagccgtacccgatttttggttatcggggaaaacccgaacctgttcccgtactcggtcaacttgggtattacccatcaaagtcgggacagattcggatgggtatccacgggatttctccaaagtggtcgacgatgggctgaagctctccaagtgcatatacttcgggaaggacagggcggtgtccctgtcgaagcatccgtcgccgatggcacgcttgaccaccacgttcctcccctcgacgccgatggtctacgcggtgatctccgatccagggatcgtggacaaccccgacatcccgagctaccaaccgcacgcgtacggaaggtgtgatcctccagcgttgattccgcttcagatgaacgtgattgagatggaagctgattgttaccacaaaaccgcttcagatcccacagccccagccgtcccctgcaaaggagccactggatttgacgacgacgaaagaggagagaaagagagaggtgaaggctttgctgctgcactgattgatgatcctgtgtgggtgatgaacactgtccctgttgcggctaaggtcaacacacttggtgccatatatgaacgtggattgattggaacctatatgaagtggtttgtcatttcttccattttctaa

SEQ ID NO: 104604 - DNA, 159 bp, Glycine max
  Peptide Sequence Number=SeqID_221382
atggccttctcaataccaccacctttgctcccaatcctgactactacagttttgtggcatcggttaatgcgaaagaaggttcttgcggtctcaagtgatgttcatattaaagacttttacctacagttagaaaatttgaagatgatagatacatattaa

SEQ ID NO: 104605 - DNA, 633 bp, Glycine max
  Peptide Sequence Number=SeqID_221383
atggaagaaggatactctaccaacaagccacccatgttcaatggtgtgaatcatgattattggaaggtgcaaataatagatcactttgagtccattcacatcaacctatggggcatagtagaaaatgataattatattccatatgatgatgaactaaatgagatcccaagaatccagtgtatggaggagcaaaaacttagattcttgctcaactccaagactcggaacattatgttgtatgctctattagaagaagagtacaccaaagtacatagtttcaagagtgccaaacagatgtgggacaccttagctataacttacgatggaacgtcacaggatggaggacttaagaaggcgaagtctttggcactcaacgtccataagaccaaaaaggcctcgttgtctgaagagccatcctcaaaatcatcctccaaaagctcatctagagctcttaaagtggaaaacccctctaataaagaatatgaggatgagtttgatgaagatgagctcactttcatctcacaaaagatctgtaaaatgtggaagaataaaagcatatccaaatggaataaatcttccaaaaaggtgttcaaggaaaggaaggacaaagacaaaagctccataatatactag

SEQ ID NO: 104606 - DNA, 213 bp, Glycine max
  Peptide Sequence Number=SeqID_221384
atgtcgcccaataggacaaaggtagcaaaaaggaagagcaaagaaaaaggagctacacctactggtcccaatcttgatttgtctagcatagaaagtgcagtgaaggagaaaaacacaaaatacaataaacttattaagttaaaggaggcacaaaaaatccatatggagtatgaaatcctcatgaaggacatgtctggcatggctgatcagtga

SEQ ID NO: 104607 - DNA, 228 bp, Glycine max
  Peptide Sequence Number=SeqID_221385
atggcatcatcaaaacatcaaaagcaaagtctttgcttctacaatctcaaagtatttgcttctacactcaggagcatggaccttgaagtagagcatggatttgatggaccaatcacaagagcacgtgctaagaaaatggtgaatgaagcccaatctgaaatggaaaacaagatgcccaaacccaaattcatcaatagcttgaagagtaaggaaaatgagctaacttga

SEQ ID NO: 104608 - DNA, 588 bp, Glycine max
  Peptide Sequence Number=SeqID_221386
atgtccaagtgcagggatcaacctagaataggtgtgtccaatgcatttaaagctaacacaagaggagcaaaaaagattaggatacctaagaaaaagaagattcctgttgtagatgtctttgacagtaggaagcaaacacatatcatggtacaaggacaatggtttctcacgtcatatgataaaaagacaaatttgaaaggaaaaacacaagttgaagctgccatttcatttgcggaaacttttagatggatatgcaagaaacaaggttcaactacattgtccactactaaagcagaatacatgttagctacaagctgttgtattcaccatttaataaagaaccaacttgaggactacaacatctgtcttgaaatcaatgagacactacttttctatggagcaaggctcctcaatggacctcagactatatacctagaactagttagaatgttttggaggaatgttgagttcctaaacaacaaggtaatagtgtccaaggttcttggagtaagggtgactgtttctagtgattgtatagccaaggccactagttgtcttcgtgaaaaaagtatatatcatgagggttag

SEQ ID NO: 104609 - DNA, 867 bp, Glycine max
  Peptide Sequence Number=SeqID_221387
ctcctagcagttaacccaactaacctagacctcacattggcagactactccatgcttggaggactatatgctcaaatgtacattcataatcaagcaactgcttatccacctggattacagatctcaaaggccactgacgtcacaatagttgcagataaggcctcctcaactggttatgatggaagtgacaatgttgatctccatgacttaactcaagtgcagtgtctagtcaggacatatcattttgatgatgcttgtgcgtgtttcaccaaggatgctagcaactacactttcatagattgtttgaagagctttcctaccatttttcatgagaccacttatgacctcactaaaacggaggaaagatactccacgatgctcaaaaggaaagaagagcatgtatggaagaacttattttttactattgttgttaaggtgcaagttgcccaagtgcaagctgaagcttttgccaaaactgtggacaacaacattgttcatgaggtgtccaagcactctgcaacctcaaatgaagctacatcaacggagaaggatgcacctgatgctatcattgtctactttaccagtttaggtcctactccactcaattatgctcctccaactgttgtgactagagatcaagagaatgagcaattaaggctatctatgcaaaatgtcaatgcaacgcagctctccaaccttggtgttgtgttactccaaaacttgcaacaagcccaaatgtctatgttgggtgttgtatctactccaatagctgctattgctgcccctgaatccctaactctcatccaacaaccaccacctgttgaaccaacaccaccaccaccaccacctacgcatcctccaccatga

SEQ ID NO: 104610 - DNA, 410 bp, Glycine max
  Peptide Sequence Number=SeqID_221388
atgagaatcaaggagacaattaggaaaggcgccacaattccaaaggaaatgataagccaaggatcaagattgccacaaaggattagggtccttgataagatcaaaggtggctcaatgaagaaccctagggagaacaataccataattggacaaaaagaacttgagaaaggaagagcgcatagggatgactccaaggttaggctggaaataccaatgagtggaaaactaaagagactaaaggataatttagagcctcctgtcgcaacctacccttcggcgggagggcgacgcgtgactcgcgggatgcgtgttccacgaaaggaatacgcgcggagtcgccaccaacgtttatttgaggaaaacgtcagaaaaaccggaaaagacgcgatctacgaacttttaagtgaaag

SEQ ID NO: 104611 - DNA, 195 bp, Glycine max
  Peptide Sequence Number=SeqID_221389
atgtctccttcacctctaggatctcacaaccactcacaaactcatctcaagctctcagaacagcttcctcttcaagctctgcgcgtgcctttctcgctaagcggatggactgaagcggtgcgcttagtgagatcaagcggtgcacttagcgaaactatacagctcatcttcttccagattcttccttgcgcttag

SEQ ID NO: 104612 - DNA, 376 bp, Glycine max
  Peptide Sequence Number=SeqID_221390
atggagttacttcaggacaagtactttagtgaagaacctcttcctgttccaatttgtgaattacaggttcctttgactagaaatggacaagaacaggattcacctggtggccataatgaaatggggtctaattctgatttggaggagtttggcaccttgaataccaccacaactggtgacaaggtgtttgctaaatcagatggacattctgataaccataaatctaatggtaagaaccacaagtccaccaacatgcctagtgatttgacaagtgctggggatcatggactagacatgaaaaaacaagaagctgctgctgctgcagggaatggttctgatgatttctatgatggacttggatgttgtcatgttcggg

SEQ ID NO: 104613 - DNA, 1374 bp, Glycine max
  Peptide Sequence Number=SeqID_221391
atggcatggcgtcacaaggcggtgccaagggctgaagtcctcggcatcctcgcctttgacgccggaaaaaccatgtgccacctaatctccctctaccactccctctccgacaaagaaataaccaagcttcgcaaagaggtgatcaactccaaaggggtaacatacttgaattctcaacatgagtgcttccttctcaaccttgccgccgcagagcgccttgaggagcttgacacggccgcagacactgtctcacggttcggccggaaatgctccgaccccagcctcagccgcttcgacctcgtctacgccgacctcaagctaggcctcatcgacctccgcaagcttagttacggtgctcgaaacaccccaaagatcatctccaaaatggaaaagtttgtttcttctaccagaagtctttattttgccatggaatacatggcggaactcgaggcttctgataagaagagacaaagattgaagacggtgggagccactaattacaacagcaaccccaaacaaaacatggaatacttgaacgagcagatagcgtatcatagaaaacaagtgcagcagtacaaggaagtttcgctatggagccaaacattggacaaaaccgttgggatcatggctaagcttgtttgcattgtatacgctagaatatgttctgtttttggaggctacatttctaattgcaactgctatgaaatcaatgatgttgacaacaacaacaacaattgttgttgcctcttggaacaccgcgagttgtacaagaaaaattattgtctttatgaagaatcacttcagaagcgtgtcacaagatcaggtcctattcccaaggctagtaataacaacaaaaccggtgtgatacggttcttgaaccgtgacggtgaagttgataggccaaagagtagcgttaataatagggttttgaggctggcgccgccatcgacggtgggcggggcggggctggcggtgaggtatgcggaggtgattttgtccgcagagcagtggttgcacgctccggcaacggtggggcaggacgcgcgggaggggttgtatgagatgttgccggacaggttgaggcaaaaggtggcggcgaagctgagggggcggtggaggagggaggaggagggggaggcgctgtcagaggggtggcgggacgcggtggaggagatgttggagtggctgtcgccggtggcgcaggacacgatgcggtggcaggtggagaggagcatggagacggggaggtttgaggcgaagacgacggcgttgctgctgcagacgctgcattactccgacttggagaaggcggaggcggccattgtggaggtgttggtggggttgagttgcatatattggtgtgagagaaggtga

SEQ ID NO: 104614 - DNA, 384 bp, Glycine max
  Peptide Sequence Number=SeqID_221392
atggttactagtcgagctactcctgcaccatcatctacccaaaccaagttctattatctaaaattgactacttctttgggtcgaggaataaagagaatcaagcttgatactatcaccaaaaatttgcatctacccagattaattggtttatttgtgggcaatgttgtcttcaaccatgacatgcatcaacaaagattcaattcaacaacaaccaatttgagtcaactaagggagctacatgctcaaaattccatttataacaccaattttcaattaatggacgttgaaaggcagacaaacttagctgaacaagagcacctcaacaagagggttgaagatttgatagcaaaactcgatagggtcaacaaagaattggccatataa

SEQ ID NO: 104615 - DNA, 309 bp, Glycine max
  Peptide Sequence Number=SeqID_221393
atgcagtggaaaatgggaaaggactgttcaacgacgtgcttttgtagcaccgtcgttgatgaagaagctaatattacaaaaatgccaccgttgttaggatcgaagtcccacatcgcctgcctcagtctttgcggtgcagcttatatatctgttggacaacttcacttagtgccaattggttttaagatgaaatctaacatggtatcagagcctatagcccgtcttagttctctccgccatgttggcggctctctccgccatatcggcggctcacctatatcagcatcatctgtggaggggggatgttag

SEQ ID NO: 104616 - DNA, 1242 bp, Glycine max
  Peptide Sequence Number=SeqID_221394
atgattgcaactatattgttctcaactctaagggcccctaagaaggaagaaaatatacagagatgttccatgtcagcagattctcaggttgaaaacagtgggagtgaagattcaactgatgatgattatatagatgtgaaagaaaatggttaccatgatgcagagaatgaagttgataaggagacagatgatgatgttgattgtattcagagtggaaaattgagtgagagtagtggttatgctggcagtgatctttatgattacaaggcatttggaggtgatgattccaatgttggatcctccagtagtaaccatgctaagactaaaaatgttaatcttaatgttgttccagataccccactctctgaggatcaaaacaagcaaagaaagggcagtgaaaacccagttgatgagaatgatgcttcaaatttgtttccttcaactgaatcatatcgatccatgggtgagattttatcttctatggaccctggcaaccatttacccatgcaagtgactgaatcaggttttggaaagcaaacaagtaaagctagtagtgctagtttcagttctaagcggtcgacattctggggaaggagcaatccaaggaagacaccgtcaatggaatcagttgattcttctggagaagaggagaggtttcttcagcaatattttgattcaaccctggcctttgttaatcacgagaggaaacaaaggactaaggagagtttgttgggcactaattggagaaatatcaaaggacaagtattggcatctagtaatggtactagacagccttctcgaaagaaatttttaaagtcaagtcctagcaattccaaaagtattgaggcatcaacaagcatgtctgtcgatgatcttggtgcccttgattctgcctctgtgccttccacctcaagagcaacagaggttgacccactttcaacatcgatgctgacgttaattgatgtgtctgcaaatcatcctctagatcatgtgttattgaagaatgtggcagagtatgttgatacaaatgggaactggttgctggataatttcaaagaatatgttcccaataatgtggtgcaagatgcggttgccatgattttccctcaaatgcctgagaataggaatgtgttagcttggagtttgtctagtgatgaatcgttccttattatgtggtgcataatagtgtggtgtgccctaaccaaatgctattcgaagtcatcaataaatggaaaggtctag

SEQ ID NO: 104617 - DNA, 372 bp, Glycine max
  Peptide Sequence Number=SeqID_221395
atgaagaacgaacgaagaacggctgaaaatcttcgcgaaaatcaccacggaaacgttacgaaaacgttacggaagcggcttggctcggattttcttcacggaaccaatttttttcactcatttcaagaaaatgggggagatgcttgccacccagctcgcccaggcgagcaaggtggcttcttcctgaagcaaccgccttctggaggaatcttctggagggcccaaaacctcacaaattgtgcaacgatgcttccttttgagttccggcatgtcacggaacttcacgaattgcttaacgatgggtgccaagtacctcaaaatggtcaaatgaaagttgcatgccaccaagcaaaggtccctggacgagattag

SEQ ID NO: 104618 - DNA, 453 bp, Glycine max
  Peptide Sequence Number=SeqID_221396
atgcctaagaagatgaagaacagggaaactcaagctaaccccgttattcatgacaactcatggactccacctactcagggatcaagctcaattgatacgtcttctagagatatttctatagcctttctcactcaaaatgctcaatacgaagacaactcacttcaagcatccaaattcattattcctacacccatccaacctcatgaagttgtgtttgtagttgagtggatgaggtatgactatgagcattcaccttctaaagcctttgaaactcttccattagatgctatagccaggatgcaaccacattggttggtccctggtacacaacaatgtttacatccatcttctgaggtagatccaccagaagaaagggcaaagatgaagaaaaatgtctggactaacatcctttccactaacaatccacttgcaaagtttgccaaaagtgattga

SEQ ID NO: 104619 - DNA, 270 bp, Glycine max
  Peptide Sequence Number=SeqID_221397
atggcttgcccttgtgctcagctcctccacctcgtcccatgctaccacgcactcatcgcttgtcaggtcgccgatactcaccttctacgcattctttatgctctcctccatcttctccaatatgcactctggagctgtgcgaacgggtcaattcctcatcaccttacccaacctattactaccatgtcacatcccttagctgagtggaagtgcaaactatatgacatacgtgttttatggggggttatgatgatgaggtctaaagagtag

SEQ ID NO: 104620 - DNA, 588 bp, Glycine max
  Peptide Sequence Number=SeqID_221398
atgggatgtgaaagagatgctggatttgatgctcaatggaatgctggaattgttgcagaacagttgcaactatctaagggagatcataatgtgattcctctctgtcaaaggcttatagctgctttaatctcagaggaggagtgtggtggtggaagtgaacacttcaagtttgatgcatatgatactgagtttgagcctgatggggaaccagaattgaatggtttggatcaccactcaggaacaaattttcagtttccttgtcattctgcctataatggttttaggattatggacaaaccagaacatgatgaaactgaaagggatatatttggtattcctccaactgggttgaattctagctttggtaaatccataaatggttttcttcgtgataaagcaatgtctagcttcacctgttcagagttgcaatatgatagcttggatataaatgataagcttctcttggagcttaaaagtattggacttctcttgcatctttggcccaatcttcttggagtcttctatccaatgcccttggagggtaggattgcatcaatcttcatctcacatttgttgaattctcaatga

SEQ ID NO: 104621 - DNA, 561 bp, Glycine max
  Peptide Sequence Number=SeqID_221399
atggccaacccaattccaatttgtccatggccctgcttaccttctctcgaagcaacaagcacttcctctcatgaaaaaaccaaagaaaacgaaacgaaagggaaaggtattcttcacacaaacccttcgggttatgatgatgccaatagtataagggtcataacaattgtaggggaaaatagaggtgctgaaatgaaaataacccaatcccaaaagaaacagcaacccattcaaaagagtgataaagttgtgagaacactatattccactccaataatgaaagttgtgtacagtactaacaacaatgtacaaaatttaggagatgcttacccctatcccatcaaagatttaaaaaatgtcataacaacagcagcagccacaaagaaatttcattccaagaagccagctgccgcagcagcttctgctgctccaaaagttcttaaatctggtttgagcaggaaagaggcacttgaagaggtatcatacattggaaaaattgcttatatatcaggcaaccagagcagccccagccagaagcaccctgaattgagtgttggatga

SEQ ID NO: 104622 - DNA, 974 bp, Glycine max
  Peptide Sequence Number=SeqID_221400
atggcccagacaaagaaaactggtcaaatgacgtctgaggcagcaaaggaaattacagacaagattgcaagcctcacagggaagctttgtcacccatggacgtcaggatccggtgtcacgatcaaagaatactttggaccggctccaagaacctcccacatgtctttgtccatggctcccaaagacggacttgcactacctcctgagcctgagattggtccttctgctgctcatgccagcacaaaggagagttgtattgatccctcgggacacgacctagacatgggtgtgccagagaaatatggattgtacgtcgataaaaatcctccctgcctggttgcccttggctttagaagactttatgagggtcgaccaccgttcacaacatccctttgggaaatgatcaagttaaggtcggtgtttaggaagtttgagacgttgatgctcatattcctatacccactcaagagcctaccagaacctaacatagagaagaaccaccatcaccgtcaccagcagcagcaacaacaccgtaacgaagcgtacgtggggcacgtgggaggagttgttgctagagtatgccatgaaccgccatggcttcaaggaatgtgcagttgcgcaccatgccacttctcgccatcgcgggctgctgggagtagaaatttgacgatttcagtcactgattcattgaccaatgcaacgacaatgttccaccatcgcgccataatggtatcgccaccgccatctccgatcacatcccttggctggacgaattgcacaaactccatgtcttcgagcttcgtcgcgaggctgctgcaattggaggtgaatagattagaggaggagaaaacgaaggagaaagacaaaaaggatgacgagaaaccagatgttgcagtttctagcgagttgtggccgaaaatgacagagagacagtctaacacgccggaaaaggacaaagagagatggaaaggccg

SEQ ID NO: 104623 - DNA, 210 bp, Glycine max
  Peptide Sequence Number=SeqID_221401
atggcttcatatatgctccttatgcttaatgaatatcttcgaaatatctttgaaatggattcatatgttgagggtaatttgaagactgctcgagctacaaaaattgatgtagctcaatgtagagcttgtaggccttggatcttcttcataaatggagtcttttacttcttgaagatcaatggcagaggaatagagaatgaggaaaggtga

SEQ ID NO: 104624 - DNA, 210 bp, Glycine max
  Peptide Sequence Number=SeqID_221402
atgggtgtgcttcaaccacatcaattccacctcccaaatttcaaatataaatcaaatctagatcatgaggatgaagttaaggacaatgcgctggagcactacgacgaagaaaggcctgtcggcggcattgcgcttcttcatgaaataaaaggcttctggaacctccatctgaaacccgggtcaaggaacttggataccgcaaaaaaataa

SEQ ID NO: 104625 - DNA, 258 bp, Glycine max
  Peptide Sequence Number=SeqID_221403
atgtctggttttcgcatcaggatgtgtattggtcatgtaatggggaaaggactagacaatagaagagtggtttatcttttggaagatgctacttgggaaccaacaacaaaggttagagaacagtttccttctttctaccttgaggacaaggcaatggttacaggaagtggtattggtagtatccaacaagcaactatagggaggcatttccatgtctatactcggaggcccaaaactcataagcccaacaatgcctag

SEQ ID NO: 104626 - DNA, 429 bp, Glycine max
  Peptide Sequence Number=SeqID_221404
atgactatgcagaacatgcagtttcaacaagagaccagagcttccattcagagcttgactaatcagatgggacaattagctacacaattgaatcaacaacagtcccagaattctgacaagctaccttctcaagctgtccaaaatcccaaaaatgtcagtgccatttcattgaggtcaggaaagcagtgtcaaggacctcaacccatagcaccttcctcatctgcaaatgaacctgccaaacttcactctactccagaaaaaggtgaatcttcttccactggtaattctgatttgcagaagcagcacattccccctcttccattccctccaagagcagtttccaacaaaaaaaatggaagaggtagagaaagagatcttggaaacattcagaaaagtagaggtaaacatacctctgctggatgcaattaa

SEQ ID NO: 104627 - DNA, 450 bp, Glycine max
  Peptide Sequence Number=SeqID_221405
atgggtgctgagaatggaggtttctccgtgaatgtgaccaatgaagaggtggtggcagcagtggtgccaatgcaagaacattggcttccactctctaaccttgacctacttctacctccaatcgatgttggtgtcttcttttgctataagaaccccatgctaacgtccactaccttaggggacacttgcaccaacaaaataacctttgaatcaatgttggggtctctaaaaaaggccttagcacaagctttgatctcttattatgcatttgcaggtgaagtggtgcccaacaacgtgggtgaacccgaggtgctttgtaataatcgtggtgttgattttgttgaagctgtggctgatgttgagctaaagtgcctcaacttttacaacccagatgacaccattgaagggaagtttgttccaaagaagaaaaatggagtgcttactgtccag

SEQ ID NO: 104628 - DNA, 348 bp, Glycine max
  Peptide Sequence Number=SeqID_221406
atggtaggtcagggaggcaaagagttgggaagtacggacgacccccattttgtgcatgttcagaacaagcatgccttcccgccatctggcttgccgcccaactataaccgacccaatgtggtgcacactcccgatgagaatgtcaacaactccacttccatactcattgagggccaacaacttcaatctgatcatgcacatgtctctcaacccatgggggagacacatgcaataccccaccacaatctagctgacttcaagcctggcctcagatatgccactaaggggcaagcagttggtggtgtacccctgcaaaagactttggagggccctcaattttgcccataa

SEQ ID NO: 104629 - DNA, 777 bp, Glycine max
  Peptide Sequence Number=SeqID_221407
atgctgtgcgccgccggcgacgatgtgcacgccatcgccagcgcggcgctgctggtggcgattctggaggatccgccgcgcagcggcagtgtcgatctgcgtgatgcgctcaaccagccacagccgcagtggctgcggcgcgcgcgccactggcagcagcgcctgaatgcaggtcaggggcgcgttgacgccgatcgcttcccggcgctgctggccgccggatttgctgaccggctggcgcagcgtcgcggtcacagcgcgcgctatcagctcgccaatgggatcggcgcgatgctggatgagcacgacggcctgagccgctatgagtggctgattgcaccgagcctgctgcagggggccagcagcgctgatgcgcgcatgctgctggcgctgccggtagagatggatgcgttacgccagcagtgcccgcagctggtggagcagcgtaccgatgtggactgggatgaagacaaaggcacgctgcgcgcgtggaggcgggaagcgattggcgcgctgatcctgcgggcccagccgcaggcgcggcccgagccggagatcctgcatccggcgatgctgcgctggatccgcgaaaaagagctggcggtgctcggctggacgccagaggcagagcagctgcgtctgcgcctgcagtgcgccgcgcagtggctgccggaagaggcgtggccgacgctggatgatgacacgctgctggcctcgctggagcactggctgctgccggagatgggtgcagtacgcgatttgaaagggatcctctag

SEQ ID NO: 104630 - DNA, 105 bp, Glycine max
  Peptide Sequence Number=SeqID_221408
atgtcggctgaaaatatcagtcgaggaaatgttcgatcggcgtcatccgatgatgctcccgttttcaacctcgatcgcttaactttcctggccgaagtcggctag

SEQ ID NO: 104631 - DNA, 486 bp, Glycine max
  Peptide Sequence Number=SeqID_221409
atgtcgttaaaagttgtcccctattctacgacgatcgcaaagaccatcttagaaggcggagtattcaacgccagtgtctcgacaaccgtcttagatatgtcttcattctatgtcggtcctttacgcatgaccgatgtagaatgcaacacattctacgacggtcacgtgacaaggatcatcttaaaatgcgttgcattctacatcggtcacggcaaaaccggcatagaatccatacaagttgttaaggatgactttgatgaagaccagtcactgatagagctagcaggtgaaatactagaagaaagctttgtggctgacatcaagcttgaaagactagaaatgtcaggttcaactttatttcttgaagcaattcttgaagataaattgttaccggaagatgtggaagtcactgatctagtcgtggttgatactgttggaccaaaaggtcatttggattgtagtgttggcttatgcatagaacgttga

SEQ ID NO: 104632 - DNA, 1416 bp, Glycine max
  Peptide Sequence Number=SeqID_221410
atggtggtttggtacagtaatgtaccccatacacgtctagtcgaggataaaggtggtcaaaattggatattaataaagagggataaatttgtttttcctggtggtggaactcagtttatacatggtgcagataaatacctggatcagatttctgagatggttcctgaaattgcatttggtcacaacaccagagttgctttagacgttggctgtggagtggcaagttttggtgcctttttgatgcaacgtaatgtgaccactctttcagtagcaccaaaagatgttcatgaaaatcagattcagtttgctcttgagcgaggtgtgcctgccatggtagcggtatttgctacgcaccgtttgttgttcccaagccaggcatttgacctgatccattgttcaagatgcagaattaattggactcgtgatggaagacaactcaaagctattcaggcacatggctacaccacagtggcaatgaaagatggaattttgcttcttgaggccaacaggctcctgagggcgggtggctactttgtctgggcagcacagcctgtttacaaacatgaagagacccttcaagaacaatggacagaaatggagaacctgacagctagcatttgttgggaacttgtacgaaaggagggctatattgctatatggcggaaacctttggacaatagctgctaccttggtcgagacattgatgcgcatcctccattatgtgagtccaatgatgatcccgataatgtttggtatgttggtcttaaggcatgcatcactccattacctaataatggatatggagcaaatgttacagagtggcctttgcggcttcatcaaccaccagacaggctccatagcatccaattggatgccattatatccagagatgaactcttgagggctgactcaaaatattggtttgaaataatagaaagttatgtacgggctttccgttgggaggattacaacttgagaaatgtaatggacatgagggcaggatttggaggagttgctgctgcgctgcatgatctccagattgactgttgggttatgaatgttgttcctgtcagtggatttaataccttgcctgttatatatgaccgcgggctgacaggagttatgcatgattggtgtgaaccatttgatacatacccaagaacatatgatctgctgcacgctgcaggtcttttctctgttgagaaaaagaggcaaaagtgtaacatctcaaccattatgcttgagatggatcggatgctaagaccgggaggacgagtgtatatacgcgacaccacacttgttataggtgagcttcaagaaattgcaactgcattgggatggtcaactaccataaatgatgtaggagagggtccctattcaagctggaagatattaaggtctgataaacggttctga

SEQ ID NO: 104633 - DNA, 618 bp, Glycine max
  Peptide Sequence Number=SeqID_221411
atgaagctgagttgcaacctttgtgctgtattgtatgtttatattaataatggtaatacaacattcaaggttaaggagaaaatgatactgattgcagtgaagaaaccatttgatttagctgtaggcaacacttcaaaagatcattcacatgaccattgggggaatgttgtactaaagcaattatatcattcattaggcaatgataatggtggcatggagtggtgtataagggaagcactcatgagccatcctaaaattagttgtgccactacaatgacggaaactcttaatattgtcaaggatggtcaggagtgctctccgcaattagaaagtttgttttatagattacagagtgaagctaatggacatgaaaatgttgtgaacaatggattttctagtgagtcaaatggccatggtgcaactggcaggtgtcagcgtgtgttccgtgatatcttagcctctgagaagttcagttcattatgtaaagtgctacttgaaaatttccgaggaatgaaacctgaaactgtatttgactttagtttgataaactcaaggatgaaagggcaagcttatgaacaatcccctacacttttcttatcagattttcaacagatgtag

SEQ ID NO: 104634 - DNA, 1026 bp, Glycine max
  Peptide Sequence Number=SeqID_221412
atggaagctgaggagggaagtagcaacggtgataacggtgaaggggttgggttggattggaggttgggttctcaagatggagataatggggggagaattttaggtggaaatggtgttgcggagggcgaaggagatcggggcttgaaagatggagctgtaaataatggggtggcaattgaagctgaagaagtttggggtctgaagaaggaagctgtagataatggggtggcagttgtaggaggagatggtgttgtagaaggtgaagaagttcggggcttgaagaatgtaactgtaaataatgggatggcaattgagggtggaaatggtgttgctgaaggcaaagtttgggccttgaagaatgaagttataaatagtggagtggcaattgctgatgggaatggtgctgctgaagatggagaggtttcaggctcaaagaatgatgttatcggggtggcaattgctgatgggaatggttttgctgaacatggagaagtttggggatcaaagaatgaagctgtaagtaatgaggtgccatttgttgatgggaattgtgttgtttacagtggagaagttcagggctctaagaatggagctgtaaataatgaggtggtaattgcagatgagattggtgttactgaaggtcaagaggatcactgcttgcagaatggaactgtggataatgtagtggcaaatgcaaatgaagggaactctggttcagttgaatgttttcaaacatataagaggcgcaagcatgtaaagttgagttcagaatttgaagtccaggagaacagcagaaaacatatggcagctgcaagtcaactgtcagaacaggttttctctactgcttttacgacatgtgtgcctgtgatggttctgtattgctacttgtcactctgtataagagatttcatgtgttatgtatgtcttcttgtggaattcttggaggtgcaagctgctagatttttatgtttatgtagaaaagaggtcaatcagcttgcaagatgcacatgtgcctctaacttgtag

SEQ ID NO: 104635 - DNA, 1134 bp, Glycine max
  Peptide Sequence Number=SeqID_221413
atgggtgcagccacaggcacttactctagtatagtgatacagtgtatacaattatacaatacaatacaggtggtttggcgaaagcttcaaaatactggaaatcagattgttgctatggccaggagcctctccaacatgtcaaaagcttccttctgtgagcaggtgggaatttcagcgcagagttcctttgaagatgaaaaacaagtgctctgtaaccaggaatccatctctcacatgaaaccagagcagacagtagaatgtgttgcattcaaagttggcaactgttggcattgtggagacaaagcagatgggatagactgtttggtttgtgattcatgtgaggagatgtatcatctgtcctgtattgagcctgccgtgaaggaaataccccgcaaaagctggttctgtgccaattgtactgctaatggaattggatgtcgacacaagaattgtgtggtgtgtgaacagttgaatgtcctgaagaccctggatgactttgttggtgaggaaaacttccctacaaatgaggaaacactaaatgaattggaagagtattcaaattgtacttatgatgggattcaagtttccacagatgggagaaactcatcaaactgcaaaatttgtaaaatggcggtggatggtgaaaaagtaaaaatctgtggtcactctttttgccctagtaaatactaccatgtaaggtgtttgtcaagtaagcagctaaagtcatatggtaactgttggtattgcccttcttgtatatgccaagtttgcctcactgacaaagatgatgataagattgtactctgtgatggctgtgatcatgcataccacatctactgtatgaaacctccacaaaattctattccgaaagggaaatggttctgcataaaatgcgaggcagggatacaggcaatacgccaggcaagaaaggcatatgagagtaaaaaaggcaaagttggtcagaatgattcaaagccaaatgaagatattgacaagaaatggaacaaaaagcgaggacgggaatcagacaaagttggtggaatgatggacatgcttataaatgctgcaaatactctgaattctgaagaggacatgaatgcaatgctgattgactcaaagaaaacattaacatga

SEQ ID NO: 104636 - DNA, 783 bp, Glycine max
  Peptide Sequence Number=SeqID_221414
atggctttcgacaccagcagcctctccaacatcacctctccatggtatcatacaaccccttatggtatcaaagtgcttggtaaaggcaaaggtggttaccttaccagcactgctgatcctccttccaagtctgatccaaatccaacgaggaacttgggaatagggcctctttctgctgccgaagattctgctcttgctgttcatgtaaaccagaatcagggaagtgatggtagaccacggaaagggagaccatcatgtgaccttttccagagtctaggacaaattaaggaatgtggatacaagtcggaaaattcacagcaaactgctgactggaaacccaacaagtcacagtctcaccgagataggaaatataaagtgcatattacagatgggtcagacccactgtttcctgctctgactctcaaaggttctgaagatttaacacttgaatctgtcctctttgttccaaatttggtgtctgcttctgtcaaaacccttgatgatgttatgttatggcattttagattgatgatcatgtatcctgcaaagctgtttccatcctttgcaacttctcatcaaacccacggtccatgcaaaccaaaccaaaccactgttgttaaacaccatacaaagacctccaccactgaagcacagcttgatgccaagtctcaccatctccaacaagctcatcttgcaagtgaggggcttcattgctactccatgtccctcgtgtattctcctcaagaagaagctgagcaaggagcacttgaaggcaattcatga

SEQ ID NO: 104637 - DNA, 537 bp, Glycine max
  Peptide Sequence Number=SeqID_221415
atgaaagtgacttggaagaacaagaagaagaaacgttgtttacccacgttgtcacacttcactgaccttccctttgagcataatcatcaacaacactccaacaccgacgctgaagatggcgcgcatgttcccgacgccacacaattggctaacgaatttcaagctcaaggagacaagcttgctatggatgggaagtaccgggaagcactaggtaaatgggaagctgctcttgcgttggcgcctgatgttccagttgtgcatgaacaaaaggcccaagttttactagaaactggagatgcttggaatgctttaaaggctgctactcgtgcgtccatgcgctttattcttctcaatcattgcttgaaatttgataatggtgctctctacataacaggagctactgaattggacccatcatgggctgaggcatgggtcacacttggcagagcacaacttaattttggtgagcctgataatgctattgaaagctttgaccgtgctctagctctcaaggttagtcgatgttggagcacataa

SEQ ID NO: 104638 - DNA, 1224 bp, Glycine max
  Peptide Sequence Number=SeqID_221416
atggattcaggtttctacttggtgtcatcactgaaccaccaagaagtagtccaaagccgtttcttcgatccctcttggctacaaatgcaaccccacgttcccatgagctttgtttggcccaaagagtgcttagtggacgcgaacgaggagttccacgctccaatggtggaccttggagggttcctaaggggtgatgatgacgaggccacaagccgagccgttaggctcgtgcgcaaggcgtgctcgagccacgggtgcttccaagtgatcaaccatggtgttgattcccgtctcatcagggaagcatatgatcaaatggacgctttttttaagctttcgattcgtagaaaagtgagtgctcgaaagactccaggttcagtatggggatattctggtgcccatgctgataggttctcctccaaattgccttggaaagagaccctctcttttccctttcatgacaacaatgagttagagccggttgttactaggttctttaacaacaccttaggggaagactttgaacaagctggagtggtattccagaattattgtgaagccatgaagcagttggggatgaagctgttggagcttttggcgattagcttgggagtggataagttgcattataaggacttgtttgaagaaggttgttccgtcatgagatgcaacttttacccatcatgtcagcagccaagtcttgcattagggactggaccacattgtgacccaacatctctcaccattcttcaccaagaccaagttggagggcttgatgtgttcgccgacaacacgtggcagaccgttccacctcgtcccgatgcccttgtagttaacattggtgatactttcacggtcaccatcagaaggaaacggttgagagtagagactaaagaagttgcagttccagtcctaattcttggagaactttcacgactcaactcacttagggcattatcaaatgggagatacaagagttgcctgcacagggcagtggttaacaagtacaaagagaggaggtccttggcattctttctgtgccccaaagaggacaaggtggtgagagccccagaggatattgtgcgtagggatgggacaaaacagtatccagatttcacatggtcgagtttgcttgaattcacacaaaagtactacagagccgacgaagctacactgcagaacttcaccaagtggttgctatcctccaaacaacaaaccctttag

SEQ ID NO: 104639 - DNA, 207 bp, Glycine max
  Peptide Sequence Number=SeqID_221417
atgggtattgatccagaaactcacaagccaaggacagacttgaatgatctcacgagtctttctcagtttcttcgcatgtcaatcttgagcagtgccattaacactagttggggcaataaccctctagagaagcttacctcgacgccaacaacgacaatggtagcaagactggctacaagtggtagcgagaacgacaccggagcttga

SEQ ID NO: 104640 - DNA, 711 bp, Glycine max
  Peptide Sequence Number=SeqID_221418
atggatgtcatgcttcacctctatcaagagcactcagctgacgctctcaatactttagaaaacattactactcgcctggaaaacatagaaactaggctaacccttaacttagaccctccaaatgcactcaacggaaaattcaagtttggcatcatcaaaaccaaaacggagaagattgttagagatggggagaaacatgaagacctagccttgaatcttcaagatcagcttgaagaagttttgtcttttacattctcaactctcttgagtggcatttgtattgattgttatattgaatgttgcatcttagcctttatcatatcttttgtgcatcatgcatcatcatgtgtgagtaagaagaaaatttcttcaatagaccaaactctctattgtcacaacctaccctttggcgggggagtgaaaaggccaaaatcatgggccaaagcatctatctccaagggagaaaatgagcggagtcgccaccaatgtttatttgaggaaaacattagaaaaaccaaaaaggacgatggtttacagattttgaaaaagagggttcaggagttgtttacgcacggggaagcaaaacaaggcatttgggataaaggtagctcacctaggcgagctgtttacttcattctaaagcaaccttgctcgcccaggtgggctgagctcacccaggccagtcaggggttagaaaaagtgtacaaatga

SEQ ID NO: 104641 - DNA, 219 bp, Glycine max
  Peptide Sequence Number=SeqID_221419
atggcgagcaacccctctagagctcagaagaaactcaagtcttctaagaggaagcaaggagagtactctcaaactgctctcaacaggctggatatagggtttactattgaaaggtttaacttccctaagctacttgaagctcaagggtttaacttccctaagcctgctctcaacaggctggatatagggtttactattgaaagtaagaagaacaactag

SEQ ID NO: 104642 - DNA, 285 bp, Glycine max
  Peptide Sequence Number=SeqID_221420
atggagtcgccatctgtcgcaacctacccttcggcgggggagggaaaaggccaaaatcatgggccaaagcgtttgtctccaagggagaaaacgagcggagtcgccagcaacatttatttgaggaaaaagttagaaaaaccaaaaaagatgatgattgattttaaccgcgaacaaaattcgtttaaggcgttggaccttgaaacaatctttgattttaaaaagcggaaagaatcattaaggcgttgttggacctttaaacgatctcttgattttttgatgaaatga

SEQ ID NO: 104643 - DNA, 219 bp, Glycine max
  Peptide Sequence Number=SeqID_221421
atgactttgattttcatgattacgatgatacctcctcatcccaaaaatggcaaaagtggtaaggttagtaacaatgtcaaagaaggccagatggacccgggcccaataatggttaataatattccaatgcgtcatcagatggagaatattcaagcagtacaaggacttccgatgatgaatggtgatggtgggaaggtggaagctaaggaattaggataa

SEQ ID NO: 104644 - DNA, 315 bp, Glycine max
  Peptide Sequence Number=SeqID_221422
atgggttacacaccttcaagcttagtggatttggtcttcgccggcgaaatgatcaaagtgggtctagaaagaggcaaatttgatcatcctgctttgatgaatgcgaaaactagggcaaatgaagaggatgagaatgagggagaaacccttgctatgactgccattcatacatggtcaaatttcccattagtcaaacaatgtcattactcagccaataacagtccctctcacccaatcatcaacagaagccatccccaaatcagccacaaggcctgcctgctcaccacacgcccaatgcccaaacaccacctatag

SEQ ID NO: 104645 - DNA, 204 bp, Glycine max
  Peptide Sequence Number=SeqID_221423
atgaaagacgaagaagctgtagcatctagtgggctaatcttgctagagcctatgcaattcaagcttggaaagcgacctaacagcaagatagcccaacggttttctcaagagtgtggactgtggtgtagtgtagtagtagccactagcaagggcaccaaaataaaagtagcagtaagggcacacgtatatggaataaagagatga

SEQ ID NO: 104646 - DNA, 411 bp, Glycine max
  Peptide Sequence Number=SeqID_221424
atgcgtcctttgcaggtggaaatgaacgcagcatggcaacaggaaaatctgagaaaattctgcaaagagaaaggaattcacgtgagtgcatggagccctctgggagctaatggagctgtgtggggttcccttgctgttatggacagtccaattctaaaggacattgcaatcaaaacgggcaagactgtggcacaggttgcattgagatggataatagagcaaggtgctactccaatagtgaagagcttcaacagtgagagaatgaaggaaaatcttaaactatttgactgggagctaagtgagactgattcggagaagattaaacaaataccacaacataggggtttcagtggtgagcgttttgtcaatgaatttggaccttacaaaactccacaagatttttgggattga

SEQ ID NO: 104647 - DNA, 343 bp, Glycine max
  Peptide Sequence Number=SeqID_221425
atgaagcaaaatgccctcatcacttgtctttcacaaagcatgcagttattcaaagagaagaataaaatgtcacctgtatatggagatattcattcaagttcagggttcaattttgaaaatgtaactcagctcacaaagggtgcaaaggatacaattataattcaaggtcctgggcatcctgagtctgagcctcctcctcatctatcagatggaaaaataggggaatcagagagagcaacaacttctccatataaggaatcagaaagatcagcagcttctccagctggggattcagggggagcagcaacttctccagatggggaatcagagatgataatcaaag

SEQ ID NO: 104648 - DNA, 735 bp, Glycine max
  Peptide Sequence Number=SeqID_221426
atggagagtgaaactgaaagtggactagattacaaaagaaaaggtgaaaggaaagatattgagctggtagaggaggaagagccacggattggtgctaattgttctagtgcaacctctaataaatctgagatttataaggaggaagcagggaatgcagcacaaaagcataaagcaaagagggtggagagtgtcaatgctaatgcagaagcctttggtgatcactgggaaagttcagattgctttatgcattatgaagctgaagcactagaacatatgaagaaaagagatagaggccatcaaagtgtgtcattggagaataagacaggagattcaactgtggtcaagatgagtgagaaaaataataatgttgatgccagcgactgcatgattcttgatgaccatgaaggagaagagcattgttatggcaaaggaacaaatgcgaggagtgtttcttttttgccaagaagccaagagaagataggagattcggctaaagttgtgataaaacaagacataaagggaggagagcataaatatgggtttaacaacaataaacgtgagaagccagagaaagtaagggtggtggatgatgaaactggcgacaaacatgagctgtttgtagtcctaaggatgccatctagaacaaaaaaccgatgcctcaagttttttactgagggcaggagggttattataaacatcgttttctacatctaccagacaccaaatccaatgcat

SEQ ID NO: 104649 - DNA, 1121 bp, Glycine max
  Peptide Sequence Number=SeqID_221427
atgattcgctttgaacaagtcagcaaagcctatctcggtgggagacaagcgctgcagggggtgacgttccacctgcagcagggcgagatggcgttcctgaccggccattccggcgcggggaaaagtaccctgctgaagcttatctgtggtatcgaacggccgagcgccgggaaaattctgttcagcggccatgatatcagccgcctgaagagccgcgaggtgccgttcctgcgccgccaaatcggcatgattttccaggaccaccacctgctgatggatcgcaccgtgttcgataatgtggcgatcccgctgattatcgccggcgccagcggcgatgatattcgccgccgcgtatccgcagcgctggataaagtcgggctgctggacaaagcgaaaaatttccccatccaactctccggcggtgagcaacagcgtgtgggcattgcccgcgcggtggtcaacaagccggcggtgctgctggcggatgaaccgaccggtaacctcgatgaggcgctctcggaagggattttacgtctgtttgaagagtttaaccgcgtaggtgtaacggtactgatggcgacccacgacctggggcttatttccagccgtccgtaccgtgtcctgacgctaagcgacgtgaaccagattcgccagttcggcagcaagttcgatcgtctccgtaacgccaccggcggcggcaacggcgggcgcaatgcgccaaaacggtcaaaagcggcgccgaacccggcatcgcggaagagtaacgtctttaacgagcaggtgcgctacgcctggcacggcgcgttacaggatttaaaaagcacgccgctggcgaccttcctcaccatcatggtgatcgctatttcgctgacgctgccgagcgtctgctatatggtctacaaaaacgtcaacagcgcggcgtcgcagtattatccgtcgccgcagatcaccgtctatctggaaaaaacgctggatgatgatgcagcggcgcgggtggttggccaactgcaggcggagcagggcgttgagaaagtaaattacctgtcgcgcgatgaggcgctgggcgagttccgcaactggtccgggtttggcggcgcgctggatatgctggaagagaaccc

SEQ ID NO: 104650 - DNA, 930 bp, Glycine max
  Peptide Sequence Number=SeqID_221428
atgcggcgcatagatcaccgagaacggccgcgaccgcccccgcagctgcggcagcacttctaccagctgcccgcgctgcaaccgctcgcgcacgatgaactcatagctctggcagatgccgatgccctgttcggccagcgacaccacgcccagcacatcgtcggaggtctcgatggacgaacgcggcagccagtccacgtcgcgtccaccgtcgcggaagatccacggggccagccgcccggtgcgcggcatcacaaacggcaggcacaggtgctgctgcaggtcgtccagcgtctgcggcgtaccccggcgctgcagatagtccggcgcggccaccagcaacagcggcgcatcctcaagcttccgccccaccagcccgctgtccggcagctggcccaggcggatggccaggtcgaagccttcggccaccaggtccacgttgcggttggtgatgttcagttccacctgcacctgcgggtactgctgcgcaaagcgcgccagcacgggcggcagccggtagtggccataggtggtgggcacgctcaggcgcacgcggccggccagcgcaccgtcctgggccagtacgtcgcgctcggcgtcgtccagcaggccgaaggcggtgcgcacctgttccagatagagccgcccggcgtcggtcaggcccacgcggcgggtggtccgctgcagcagctgccggcccagccgcgcttccaggcgggtgaccgcgcggctcagcaccgagggcgtggtggacagcgccaccgcgccggcagtgaacgagccgtgctcgaccaccgccaggagcacctccacatcgcccaggtagtcgaacttgcggctcatttggctctccggggaacagatgttttgcgatggggccaatttatcgccgctggggcgatgaataaagtggccgccattccccgatag

SEQ ID NO: 104651 - DNA, 558 bp, Glycine max
  misc_feature (357)..(357): n is a, c, g, or t
  Peptide Sequence Number=SeqID_221429
atgttgatattgtttgatcttccatattggtccgatctagatgtcagacattgtattgatgttatgcatgtggagaaaaatgtgtgtgatagtgtcattgacacactccttaacattcaaggcaagacaaaggatggtttgaatactcgtcaagatctggctgagatgggtatacgagaccaattacatccaatagtcattgatcctgtcaagttagatgagttggaaaatgaggctattattatcttgtgtcagttggagatgtattttcttccttcattttttgacatcatgtggatgtacccagttgagcgatacatgaagatcttaaaagggtatacaaagaattcacaccancctaaagcatctattgttgaaaggtacattgcggaagaagctattgagtttattttagagtacattgaaaagacaaaacctgttgggcttcccgagtctcggtatgaaaaaaaagtaggaggtacaggttcaagaggactccatgttatccctccaaagtctagaagaattgcaataagctcatttgcatatactaaataa

SEQ ID NO: 104652 - DNA, 516 bp, Glycine max
  Peptide Sequence Number=SeqID_221430
atgcgcgaggggacgccgcttcccgccaccacgccgatccgctcaaaagcaaggaacccgatcatgaacatcgcactggaacgcctggcgcggcaactcgacctggacgcgccccgcaacgaaaccctgcgcctggccttcggccacgcctgtgcccggcgcgtcgagcatctgctcgaagacccccaggcgatggaatgcctggccatcctgggccgctatctcgagggcgcttgcggcccccaacaactggcgcaggccgccgccacggcgtcgcggctggccaaccatcatccgggttcgacctccatcgacggctgtggccatgccgccgtgtccgccacctacgccgtggccagtgcgctggccggcaaggcgctgcgcgcggccgaatacgcggcctatgccgccgtctacggccagggaggccatggcgcggtatcggatccggcgtcgttcgacatcgaacacgcctggcaggcggattgcctggagcgctgtgcgctgccagcctga

SEQ ID NO: 104653 - DNA, 752 bp, Glycine max
  Peptide Sequence Number=SeqID_221431
aagcaactgctcaatcctcttcaagctcatcaaccgaagcaactgaaatagacaatgaaggaatgacggaagtaaagcaaaccatgataaaatttgcaactggtcaaggagctgacatgagccaacccgttagaccaccaaacattggggacaaccaaatcaatttcccattgtgggtccacaatagcctcaaccactaccaattcgtgggagcaagcactgagtgtggtcgattggctcaactcgcactcacatcatccactaaccacatgggaggaattgaagctatcatggagcacatcgtcaacttcaaacaaactccaactgaaatgttatttgatgcatggaagagatacaaatcccttttaaggagttgtccttttgatggaaacaaccaattcatgcaaatttcaatgttgatgaaaggaattaccaacgattatagaaggatgatcaatgcatcattcgaaggaaactacctcaataaaaccaccactcaagtgaagaccataattaaagatctgccagctagtgagaaaaccataaaaacaaacgggtcaaatccccaaaaaggtgaagaagaagaggtagaagaaagaaccatgctagaagaagagatgaaagcacaagttaaccctttaacccaaggagacgatgagatgatggccaaattcgagaaatacatggagatgctacaagggaagaaggaggaaccacctattgaaaaactcacatgggacgtgttaaatgaa

SEQ ID NO: 104654 - DNA, 741 bp, Glycine max
  Peptide Sequence Number=SeqID_221432
atgtcccatgtcaaagttgacatggccaaagtaggcttcaagatctcacatgtcggactgagattagcctttgttaaaaggacaagaacctggaaaacaaaggaattcatcgctcaatacataagccccccaagctttgagccagcttgtgagcaaaagaggttgtccattgtcatggaagattgttttgtgtcgagggtagtagcctcgacaagtaggagggtcgaaaaatcagacgtgccatgtgaggggagtcttgtatttgaaaattctgcccttcttttgactattggagagtgcattgaagacaaatgtttcatttgtcattttgctttaagcgagtacaatgctcgcatgttgctcttgcatatgtgtcactcacagagtgggcacgtactgaagatgcagtacatgggtttgatagtggctgaagaagtcatctccatcaaaggttcctcctcagaggagactcatcgtggggcttctgatagcaactcatcttcctcaaagaggttgacgatcttgcgtcgtgttgttggaggcccctctcgcctctacaagagagcacaacatcttgcttcttctctggacgaggaacctgttccagtcaccacaattcttccctcttctattttttggggagtaggaaagagtggtgctggggatgttagggcttccctcaggtgcggcgtagtcataatgctaggtcgccatcgtcacccctgttgttgctggccatga

SEQ ID NO: 104655 - DNA, 336 bp, Glycine max
  Peptide Sequence Number=SeqID_221433
atgaatgaaaaaaagaaaagatataattggtgtgctagttatacgtgctcctctatgttctcaggcctgatcgatgttccacaatctcagacaatgtttcttgaagaagacggaaatgacagaataaaagagaatagaaggtctatagaatattcctcagaggtcatttttgacatggataaggagcacatgttactgtcgagcatgccacatcgcctcgcctcccagtgtcatacaacggtcatttcaagactcaacactaatcctgtaatggaccctttactaaagtctataaaacacagccactaccctaaagccagactaggaaatatgtaa

SEQ ID NO: 104656 - DNA, 2679 bp, Glycine max
  Peptide Sequence Number=SeqID_221434
atggggaagcaaattcgcgagaaagaatgtgcattgccaaatcgaaatagtcatcatactcatccaggacgagtatggggaattcttcacgttataaagtaccatcattggcgtcaggtcaagagaaggcttacacgcaggaggcatggtggcgaaagacccgatgctagagctaaaattccaggaacttctgatgattcaggggttcactctattccagaacattataagccacatacagaactatctaatgttgaagaaaagccagtatactcctctccaccagccaaaattactatcaaatcccgattaagatcacttcttaatgaagatatatacagaaggaagagtggacacaagagaagctcaacctgccctgcaaagtcgcaactaactcatgccaattctgttcacaacttagaggttgatctacttggtgaattgttactaactgttcagagccctgacccagtcctagaaacctttcaaaaccatcttgctgctggtacattggatgagttgacaccagttttatatgagaaaccaattgccaacaatgacaaatgtgtagattgtggaacaatgttttctaaagacattttggaacatagcaagattcataagcacttgtgctctcctagtcaaggtggtcctgaagagaagttgatgaatgcacagatacttacaactgatgcttcaccccatcttgtcaaggactttcttgatgcattggatgtgatcaacacaaacaaggacttcctattagaatatatacaggatctaggctctcatttgccattccacactcatgatcaacaatctttcaacggtaaacagagacgagccaaatctctctcatttcctgtatctgcctcatcatcaggaagccaagattctgtttcaggccaactcataaatcaaatggtagattattggttggattcagaagaagagaagttgcaaaatcaaagtaacatgcaaaatacgagcatggatgagtcctcagaagattctcaccaacagtccttaccatcaggtttttcaaataattatgatcaatggggtgaaagaggtactaattctccatcagtttcatcccatgttcccaacaatgtgaaaactaggcatttcagggatcttagaaagaagatgaagcacataattgaagatggaagaaatgaaaagcatcgcattaccatggatgctatacttgacaaaattccttgtggaaagaggctcacaaaaaaagtaaaaaagtttatccacatcaaatccaaagaccccacagttaaatgggaagatgaagaccgtgcaaccagcggttttggtagccatctctcttctaattccttcaacaagcatcaaccatcacccatgaggacttcatttctaaaagattcagctggtagatattctcagttgtatcatcagacttgttttaacagtgatgccaagtatcctaaggctgagaacttaagattgagaacagaagagagaaattcaatattaaagaccccaaaatcctttaaaaggtttctttcaatgcctaatttaaaatcttactttcaccataatgaggagctgcctttacctttatccccccagaattcaatcaagaattttggagatagaacaacaagcacaaatgtcactgatcagcaacaaagaagttttgacaataatgatgattcaaagagtcaaattttaccacctacatttgttgataatataaatcaagacagcaatttgaatgttgaccaaaagcaacttcttgccaggagtgcttcaaaatcaagattagattttagtactgaggcagaggcagataagagcataggaattgaaggtttaggtgacttgagagacagtgaacaagacattggagctaaaacagaatctattgtgccagtggaagcaagctcagtcttctcttctgacactagcttcctagattttacatttgatctcgagaacttaaacatacaggaagaagaatcagacatagaaataaacccagggcaaggtgatgatggattggatgatatggctgagcatcaagaggctaaagaggatcaccctgagaaggttgagaattttcaaaaccttggaactctaagcaagcgtttcaactatgaaattccaagtattgaagtggatccaagtaatgaagctgcatttaattatgtgagaaaggttttagagctttctgggttcactggccatgattcccttgggatatggtattctgataaccaaccacttgatccttcaatgtatgaagaattggaggggtgcttgcttcttgatcctgattgttctcgtaatagtgaaggtggagaatgtaatcatcatctgcttctgtttgatataatcaatgaagggttgctggagatttttggcagatcttacaactattatccaagaccattgtcttatctctcccatgttcacccactaccatcaggagaaaatgttctctgtaaagtgtggacactcattagctggtatctgatgaactcaacaacatctgagctttacctatcattggattattatgtgagcaaagatcttgcaaaatatgatgggtggatgaatctccaatttgattctgaatgtgtggggcttgagctagatgacttgatttttgaagatctattggaggaaataatctccacctaa

SEQ ID NO: 104657 - DNA, 354 bp, Glycine max
  Peptide Sequence Number=SeqID_221435
atgtatgggaatgtgcttgtacttaatggaatagttcaattgactgagaaggatgaatgcgctcaccaggagatgatagctcatcttcccctctgttcaattcatttgcccaaaaatgttttagttgttggtggtagagatggcagtgtagtaagggaagtagcccaccatagctctgtggaacatattgatatttgtgagatagataagatggttactggtgtttctaggaagttttttccacaattagttgttgggtttgtagattctcgagtgcatctgcatgttggtgatgggaagtctgatgccataattgttgattcctcagatcttgtgggtatgtcatttcaataa

SEQ ID NO: 104658 - DNA, 540 bp, Glycine max
  Peptide Sequence Number=SeqID_221436
aaacgtgaaattaaagtaggagataaagtggctgggagacatggaaataaaggtatcgtttcaaaaattttgtctagacaggatatgccttatttgcaagatggaagacccgttgatatggtcttcaatccactagggcctgctataatgggaaaaccttatattttgaaattaattcatcaagttgatgataaaatacatggacgttccagtggacattatgcacttgtttacacaacaacccacttagaggaaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 104659 - DNA, 186 bp, Glycine max
  Peptide Sequence Number=SeqID_221437
atggaatcctggggggaatactttggcggttgccttgaaaggattcttgtcccagtattctggtctgtttcagaatcatcgtctgattctgaggccatttctgcccaggtctttttggccaattttggtactctggtgaggcctatgtcttctaaggccaggagagtttgtattgaccaggcatag

SEQ ID NO: 104660 - DNA, 324 bp, Glycine max
  Peptide Sequence Number=SeqID_221438
atggagaattgcactaagcaatcactacgcatagctctaaacttgaaggtggacgcgtggaggacacacgaacgaaaacgcaattcatggggctccgaaaagattgagaatggagaattgcactatgcaatcactacgcatggctccaaactcgaaggtggaggactcatgaacgaaaacgcaattcatggggctccgaaaaagggtgagaatggagaattgcactatgcagtcactacgcatggctccaaactcgaaggtggaggacacatgaacgaaaacgcaattcatggggctccgaaaagattgagaatggagaattga

SEQ ID NO: 104661 - DNA, 504 bp, Glycine max
  Peptide Sequence Number=SeqID_221439
gatggtttggatacttgccaagatctagttgagatgggtatacgaaaccagttacatccaaggtttgatgtaccacaaggatactctttaaatattaagagtcttgtgcaattgaaggatctaaagttaattggcttaaagtcttatgattgtcatgtcttgatgcaacaactgttagctgtggtgatacaagacattttgcctaagaaagtcaagcgtgccataacttgcttgtgttttttcttcaatgccatatgtagcaaagttattgatcttctcaagttagatgagctagaaaacgaggttgctattatcttgtgtcagttagagatgtattttcctccttcgtttttcgacatcatggttcacttaattgttcatctagtatattgcgaaataagctatgagttttgtttcgagtacatggaaaagagaaaacctgttgggattctggagtctcgccatgatgagagaatgagagataagggttcaagaagattgcat

SEQ ID NO: 104662 - DNA, 261 bp, Glycine max
  Peptide Sequence Number=SeqID_221440
atggactcgggaaggttccaagttggtgtaccaggtaacaactaccccagtgtagctgggggtgatgttgagggccttccgaagtgttttcaaggggtataccaccaactgcttgcccttcagtggcatatccgagccaaggctcgaagtcagctagattgtgatggggaatttcatgtgtctcccccacggtttaggagatatgtgtatgatcagtttggggttgttggctctcaatggatatgggagtggggttattga

SEQ ID NO: 104663 - DNA, 1002 bp, Glycine max
  Peptide Sequence Number=SeqID_221441
atggaagctcaggccgatctcgtggccctcaacgccgtcgatggcgtcgatggcgttttcgatcaggttgccgagcacgctgatcagcacgtgggtggtttccgcatcgtcggtttccggcagcaggctggtttcttcgatggtcagttcaatgccggcttcgtgggcgcggctgatcttgccgatgaagaagcccgccacttccggcgagtggatcttgcgcagcagcgcgccgatctcttcctgatagttgctggcggtattgatgatcttgttcataaattcgtgcgactgcacccgcagcgcatcggcgtagtgcgccatgccgctcagccgctgcagcaggcggctgacctcggtcttgtcgcggaaggtggcgatggcgccggtcacctggccgttgacgatcaccggcacggtattggtcagcagttcgctgccgttgaagccgatctgccgatcgcgcagcggttggccgctggccagcacctccgccagatgcagctgcgccggccagtgcttgctggcggcttccagcagcaggttttccaccgggccgctctggcgcagcaggcgcttggcttcgtcgttgacgatggtgatgcgggattcattatcgaccgcgatcacgccttctttaatcgactgcagcatggcgttgcgctgttcgaacaggttggagatttcgtaaggctcgaaacccagcatgatgcgtttgagcgcggagaccaggaagaaggtgcccaggctgccgaccagggcggcgaaggcgatggtccaatagatgatccagcggctctccgctaccacccgctgcacggtgtccagcgcgatgccgagcgccaccacgccgatttgttgtttctgcgcgtcatacaccggcacgtacacccgcagcgccggggccagcgtgccgcggttgatggcgctgttgacgttgccttgcagcgcgggcgccagatcgtcgccgataaaatgcttgccgatcagccagggtttggg

SEQ ID NO: 104664 - DNA, 417 bp, Glycine max
  Peptide Sequence Number=SeqID_221442
atgataggaagagccgacatcgaaggatcaaaaagcaacgtcgctatgaacgcttggctgccacaagccagttatccctgtggtaacttttctgacacctctagcttcaattccgaaggactaaggatcgataggccacgctttcacgatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 104665 - DNA, 268 bp, Glycine max
  Peptide Sequence Number=SeqID_221443
ggctctgagggctgggcacgggggtcccagtcccgaacccgtcggctgtcggtggactgctcgagctgcttccgcggcgagagcgggtcgtcgcgtgccggtcgggggacggattgggaacgggccattcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 104666 - DNA, 598 bp, Glycine max
  Peptide Sequence Number=SeqID_221444
atgagccaggccccgcggacgcgacgcccgcggggcctggctggaactgctatcggtgttgcaacggcccgtcacaggccggcgtgcctagacgatgatgccgccgcccaggcagatatcgccatcgtaaagcaccgccgattgcccgggcgtgaccgcccattgcggctcggcgaaatcgagcgtgaagccctcggtggtcgcgtcgcccaggcggcaggccgcatcggcctggcggtagcgcgtcttggcgccgtattcgcccgcggcaggcgcctgccccgccacccagctgacgtcctgcgcccgcaacgagccggacagcagccagggatggtcatgcccctgcaccacgtaaagcacattgcgctcgaggtccttgcgcgccacgtaccaggcctcggccgtgccgtcatcgcgctggcggcccttcacgccgaccacgcccaggcccttgcgctggcccagcgtgtagaacgacaggccctcgtggcgcccgaccttctgtccttccggcgtcaggatcgggcccggttcggtcggcaggtagcggttcaggaactcgcggaacggacgttcgccgatgaggcagatgccg

SEQ ID NO: 104667 - DNA, 369 bp, Glycine max
  Peptide Sequence Number=SeqID_221445
atggcgcatcgtctgggccatggcgcccggcatcatcctgggcggcaactgtcgggcggcgaggtgttagcggcgctcagcaccatgtggcggtcgctgttattaacgctattcgtgggttattccggatggaacatgctgcgcaacaagaagcccaagccgagccgacagatgccgggcgtggtaggcaccagcgcggccggcgccggcatcggcttccggtcggggctggtgggggcgggcggcggcttcctgtcggtgcccttcatggtctggtgcaacgtggcgatgcacaatgcggggtcgacctcggcggcgctgggttttcccatcgccatggccaacagcatcggctatgtggtgtcgggg

SEQ ID NO: 104668 - DNA, 344 bp, Glycine max
  Peptide Sequence Number=SeqID_221446
ctaccaccaaggctttggaacaagagaccaagagggctcgtagggaagagcacggccagaacaagtttcgaggggctttgtggggtagcaacagtgagctcaagcttcgaagggaagagagagaccagtcacgagcacatagcatggtcttgaaagaggagttagctgcttgctcaaggtccaagagaaacttgtctcagcatttatgcgagacaaagaccaacatgttagccatcgtcagcaagtaccaagaagaattaaatctagccacggcccatgagcacaaagtggcgggcgagtatgcccgagtgtacgcggaaaaggaggctagaggaagagggtga

SEQ ID NO: 104669 - DNA, 363 bp, Glycine max
  Peptide Sequence Number=SeqID_221447
atgttggacggggtgagatgtggtgttggtgggatgattgaggtggtccagaatggagtcaactttgcaggcaagttcagaatggtggtcagaccaattgataaaagcagggacctagcccaggtattggggttgtgccacgttcctcttgggcctacttgtgtgggcttcgtgcatattactaacatatacccacttctaaaagaatctggatatgagagcatagtatttaattcgtccattgcagctgtaaaggcttttcccgttttatctgcttattcagcctctaaaggagccatgggtcaattcaccaagaatgtagcattggagtgggcaaacgataacatagtgcaaatgctatag

SEQ ID NO: 104670 - DNA, 155 bp, Glycine max
  Peptide Sequence Number=SeqID_221448
ggcacttggtggacttgcaactcgcccaggccagccagaggctagccaaggcgagccaaggtccaaaaaattgcttggaatgacccttttacccctccctttgggtattttctgcatccttaaccaaaacgtcgaacgatctttcgtcttgcatg

SEQ ID NO: 104671 - DNA, 354 bp, Glycine max
  Peptide Sequence Number=SeqID_221449
atggcgattgcaaaatccaaagctccaggagagttgttgaattgggatgacatccagaagatgaaatattcatggaatgtagcttgtgaagtaataaggcttaaccctccagcccaaggagcttttagggaagccatcaatgactttatcttcgatggattctcaattccaaaaggctggaagaaacctataccccaatgttacatcctatcagagcattgtgtctcgacgtccttcagaataaggttccttaaagcaattcacctagtcatctgctcccccgaacacaaagctcaaaatcatcacaggatccagacacaaacaacacacaggagtgagttatcacattcctaa

SEQ ID NO: 104672 - DNA, 204 bp, Glycine max
  Peptide Sequence Number=SeqID_221450
atggacactttatttgggatgttgctcctgaaatgtgtgattcagactgctcctacgatgaccatgatggagacacaaatgatgaaggatatgatgatgaagatgaaggtgaaggcagatggaagccgaaacctaggccttgtaaaccacctccaccgccacaaagaagaagtgacccaaaaaatggaccatggacaacaataa

SEQ ID NO: 104673 - DNA, 225 bp, Glycine max
  Peptide Sequence Number=SeqID_221451
atgtttctagggatctggacaatagatggggtttcttcctggttattagccaggataaagagagcactatcatggctaggtagcagaatgggcttcagatacttgttcagctccagtgatctggatttgaactttcatcctttatgggagagagggatctttcaaactgacgttgtaatttgggaagatggtgagaactacgcttccagcatggagggtggttaa

SEQ ID NO: 104674 - DNA, 288 bp, Glycine max
  Peptide Sequence Number=SeqID_221452
atgtctcatcaaaacaacgatctcagactcattcaccgttggataatcatgaaatttaggagcatgattcaattacgcacacatttaccattgggattggcgataaaatatttatggagggagataaaggaattgcacgaagacagtacaaataaaggcttcagtcccttcttcgtctctctgacgtttaagaattctatcggagtagtcggaggaaaaactggaggaatcttagggaatcgctggagatgccgctatcgctgtcggaagacacatgagtccgcttag

SEQ ID NO: 104675 - DNA, 513 bp, Glycine max
  Peptide Sequence Number=SeqID_221453
atgccaatctccccctgcagatgtatcggttgggatcgcgcccataagacgcccagtggacccgaagaagtccaacagggccctggggtttctagctctggtcacgggcctctggagtcctacaaggtgcccgtccccccagcgaggtcatgccatcgtgacataggtaagaatcacacccacaaagacactcagtggacccggagaagtccaatagggccctgtggtttccagctctggttacgggcctctgtagtcctacagggtgcccattccccccggcaaggtcacatcatcatagggatcgcgcctgcaagacacccagtggactcgaagaagtccaacagggtcttggagttgtcatgctctaattacgggtctctggcatcaggccccctactaatcgagctttcatcaagaagtactgcatccccaggcaggcgtagggagaaacaccacagcagcctgaggatggccagcagcaggcaacagacgcaccgccataacctctag

SEQ ID NO: 104676 - DNA, 405 bp, Glycine max
  Peptide Sequence Number=SeqID_221454
atgggggaatttcatcagcagactctccttccccgtggagaaaacaccgagactttttcaagtctcacaagttatccagaactacgtaggtctgagttcctcattggaggatacgtaggagcaagagcctcgcttttgtcgaccacaccgccttttgtcgccatgactcaagagctggtagcccgcggagacaccttacggttatccgcacctcgtcattcagtgatcccaagtgtgattgacgagcagagaccaatatggtcatctgcgccctttccggagatgtcagcattttccgatggagacttttcaagtctcacgagttatccagaactacgtaggtctgagttcctcattggaggatacgtaggagcaagagctttgcttttgtcggccgccccataa

SEQ ID NO: 104677 - DNA, 357 bp, Glycine max
  Peptide Sequence Number=SeqID_221455
atggagagggagatgataacaatgatagacacgttaccggtgttctactatgagaagatggtgggttacacatcttcaagcttttccgatttagtttttgccggtgaaaggatcgaagtgggtctgagaggaagcaaatttgattatcctgctttgatgaatgggaagcctcatgcaaatggagagagtaagaatgaaggaggaacccatgttgtgactgccattcctacattgccaaattccccaccagctcaacaatatcaatactcggccaattttagtccttctcattacccacctccctaccagtcgagaaagctcaatcatccgcaaaggtcacccctaaatcatccataa

SEQ ID NO: 104678 - DNA, 540 bp, Glycine max
  Peptide Sequence Number=SeqID_221456
atgcctgcgttattgcaaatgaggaatctaattatgagcttatacataacacttaccattaccacattttctggccaggactatataaaaataccagcattctatcatgaacagtgggtgccggactaccccaactttgcccactttcactatgacagagcctcataccatatacgactcagacaacatcgaggaaaattgttctttgctgatggcctcaaacacttgagaaaatacttagacatctacgagtcagtaaccataaattttatggcgtgtaagcacagatggattttcaacctccatttcactcctccactggaacaacaagcatgcggcagacccctactggcaactagaatgcatgtctggactcttgaactcacacaggctctgcttggtgatcatcaaccactgaagcttccacctcttgcagcaatacatcttccttcttgtggttttcatatgacggttttaagaaagttcggccctccattgcaatggccaatccttccggttgcccctggctttcatggctag

SEQ ID NO: 104679 - DNA, 353 bp, Glycine max
  Peptide Sequence Number=SeqID_221457
atacgaaaaagaaggctgcatttagcaaaagtggcacagaaaggaagaaaaaagaagaaattctgaagcaggcccaatccaataggggcgctcagcgcgcatcaggcgctaagcgagcaactaactggaggcgctgggcgtggcggaaaccgttacgcgcgctaagccagccaggcgcccagcgcccgatccaacagacgcacaggcgcccagcgcccgatccaacagacgcacaggcgcccagcgcccgatccaacagaagcacaggcccagcgtacatggcgcgcccagcgcgcgatctgaacgcgctaagcgcgaggtgtggcgctgagcgcaactacgaaggcccataa

SEQ ID NO: 104680 - DNA, 1125 bp, Glycine max
  Peptide Sequence Number=SeqID_221458
atggctcttctactggacaactgtgaaagcattttgttgtctttggacacacacaaatcggttcctgcaccttttcttacaaaaacataccaacttgtagaggacccttccaccgaccacatagtctcttggggcgaaggcgacaccaccttcgtcgtttggagaccccccgaattcgctagggaccttctccccaactatttcaaacacaacaacttctccagcttcgttcgccaactcaacacctatggttttagaaagattgtgcctgatagatgggagttcgcgaatgagttcttcaagaaaggagcgaagaacttgctgtgcgagatccacagaaggaaaacccctcaccagcatcatcaagaagtacaagccatgaataaccatcaccaccactatcatcatcatcagtttggactcaacgttcctccattctttcccttccacaatagcagactcagtatttcccctcctcatgactcggacgagttaataatacccaattggtgtgactcgccaccaagaggagttgcaagtgtaaacaacaacaacaacaacaataacaactacaacactgtcactgcactttctgaggacaacgaaagacttaggagaagcaacaacatgctcatgtcggagatcgaacacatgaagaagctttacaacggcattatctacttcgttcagaaccatgtcaagcccgtggctccaagcaacaacaacactttcccttcttttctactctgcagtaataacattaatagcaatagcaacaacaacacatcatcacaaccacaagcctctcctatgagcaatgtttcaacggtgcaaaggcaagtgaagcaatttctggggtgttactccaacaacacaaagcaagcgcgtgctgtgaactcttctcccactaacagttccataaccattgttgaagaagaggctagcagtaacagctgcaagaccaagctttttggtgtgtctctccaatccaagaaaagggtgcaccctgatgagtacggatctaactatattcttcaaagctccgaaacgaataataaggcgcgtttggttttggaaaatgatgaactattaggcttgaatcttatgcccccttcaacttgttaa

SEQ ID NO: 104681 - DNA, 228 bp, Glycine max
  Peptide Sequence Number=SeqID_221459
atggatggcatatggatgcatgggaagcaaaagtatctcgccagtggtattgcgaaagcctttgggtggctacaacttagcggcaagtgcgagcgaaacaaggttgatgagggatcgagactcgctggaccaggggagggtgtcgagaaggacgaggtgaggatggagacagatctgagaagagaaattatgtttggtggggatctggcattgggattgggaggatga

SEQ ID NO: 104682 - DNA, 216 bp, Glycine max
  Peptide Sequence Number=SeqID_221460
atgccaagcacctcacaaggaccaaagaaaggtcgcatgtcatcaagcaaaggtccccggacgaaattagggtgtttcctccagcctatcatcaaggtcgatgatgactatgttcttcaaccttccacttggttgattgttgaaggaaatgacttcttgtacaactttctttgttttactaataaccctcctctaatcacttctaaggaattttga

SEQ ID NO: 104683 - DNA, 294 bp, Glycine max
  Peptide Sequence Number=SeqID_221461
cgagacaacagtggcttagtgcatgaggataagcctgaagagagttcttccacgccaacacacgctcagtgcatatgcagctcgctaagcgaggcgattgtctcttctgtgctaagcacaagattggtgctaagccaaatatcacttactcgtgctaagcgcgccttcgaggtcagcaagccctttttaagcttgatttgcacagaaaaaaagaggagggggctgaatagccgtcagagcttgaagagtgaaatacacagaggcaaagaacagagccaaggagccaaattttaa

SEQ ID NO: 104684 - DNA, 297 bp, Glycine max
  Peptide Sequence Number=SeqID_221462
atgcatatgaggatcaaaaggtctttaaaggttgtaatggggccaaggacaagattaaagcaagaactaggcaatatacagatacatcaagcatggccaaaaatcatatcttccaatgaaacataccccccacacttattcccagcttattccaaaaacaattccaaagctccaaaattccttaagggtaaggaagcatcaacaagaattaagccaaggctattgtgcaagcaatcaatggggcaaaacacaccaaatgattatgatgatagatggctcaaattctcacaaaggtaa

SEQ ID NO: 104685 - DNA, 513 bp, Glycine max
  Peptide Sequence Number=SeqID_221463
atgtttgttgacaaaaacagcaaaagggtgccaatgagatatttgcaatttttgagagaccttagagagtgcagcacttatgcatggggagctgctcttttgggtaacctttatatagagatgtgcatcgcaacagactataatgttaaatcaacaggcggtttcactctcttgattcaattatgggcatgggaaagatgcccaacgttagccccgttgtttattcctccacaacaacaaaatgcaccacttgcctacagatggttgggaggtgaatttcatcacataggcaatgacaatttacttgattttcgtcgtaaattagatgtcatgaaacgcgacgagggtgaaatcgccgaaacactatattttatggtgtcgcctattgggagaagggtttgtacttttgacgatttactggcatgtatcgagaatatcactcttttgtatgacgaagaggataggatacttgaggcacatgaagatgctctccccttctcagccacaatttga

SEQ ID NO: 104686 - DNA, 198 bp, Glycine max
  Peptide Sequence Number=SeqID_221464
atggttacttccttacttcaacttgactcgatgaaccttttcgtaaaagcacgagcttggttcaaccccataacccagggaatggcaattttgatcgccaatacttcaacaacatttcatagggatgaaagactcgagaatacgcatgctatgcatggaaaatgggaaaacgcaagggtcacgcatgagcaaacatga

SEQ ID NO: 104687 - DNA, 375 bp, Glycine max
  Peptide Sequence Number=SeqID_221465
atggggaaggagatactagcagtgctttatgcccttaaaaaagtttcgatcatatcattcaccaagaaagaaaaggagattgaagaagaattaccagacaagacactcatggaagtaagcttcaaggacgaggactacccttggttcattgacattgcaaattgtaaggccataggacaaccatcaaaagttatgaaattcaatgaaagaaaaaggttctcccgagaagccaccagggagaacaagctagcatactttggcattgtcagaacttaccatatggaggccacttcaacagataaagaacatatgcaaagatctttcatgccaaattttattcggctacactcttcacatatgattagtgaattttag

SEQ ID NO: 104688 - DNA, 284 bp, Glycine max
  Peptide Sequence Number=SeqID_221466
atgttggaaccctttctcagcccccctagcacgcctatttattggaaagggtcactttggggacttgccgctcgcccaggcgagctaaggcttactcctgaagtcgtgagcttgctcaggcgagctggattcttaaccttgaagtcatttggtggctcaggcaagctagggtccaggaaaaccaaggaaaagtcccttttgcccttctttcttgatatcctttgccttcctaatcgaaacaccgaatggttccttgctttgcactataactggcattcaacacc

SEQ ID NO: 104689 - DNA, 535 bp, Glycine max
  Peptide Sequence Number=SeqID_221467
ggagcaggccacacagggatcgttcatcccccatggatgtcaggatgttctggtcgctgctattggacgtccagagcaccctggacgtgtccgtgctgctggagccggtgtcaccatcaagcaatactttggatcggctccatggatgtctcgcagtgcttcctccctgcctcctgacgaattacagcagctgactcaacagatcagggaccagctagaggagtccatcacagagaaagtgatgaggcaggtcccatcatcctttagccagcttcagtcacagatgcaatctcagggacttgcagtgcctcctaagcctctggttggtcctggtccctccggtcctcgggtgagcacaaaggagagttgtgttgatccctcaggaaatgatcctgagacgggtgactctgacaagtgcggcttgtacatagaagcagatcctagaagtgggtttggtgatacaaaactgagagcaccccatcctatttatagagtttgtccatcacagagctctcaacttgttatcaaaacgtga

SEQ ID NO: 104690 - DNA, 216 bp, Glycine max
  Peptide Sequence Number=SeqID_221468
gaagctaggggagcttctggtaatcgattaccaggggatgtaatcgattaccaggcttcgaaagggaactggaagactgtggaggcctctagtaatcgattaccagtctgtgtaatcgattacacaggggaatgggtcactggtaatcgattaccaggtatgggtaatcgattacacagtgcctttttcaggttttcatgtcctgaagctgtgtaa

SEQ ID NO: 104691 - DNA, 372 bp, Glycine max
  Peptide Sequence Number=SeqID_221469
atggcccgcacgaagaagacatgggagatgacgactgaggccgcaaaggaaatcgctgagaagattgattcgtttgaggagcaggccacacagggatcgttcgtcccccatggacatcaggatgttctcactgctgctattggacgtccagagtaccctggacgtgtccgtgctgctagagccggtgtcaccatcaagcaatactttggatcggttccacgaacgtcccgcagcgcttcctccttgtctcctgacgaattacagcagctgacccagcagatcagggaccagctagaggagtccatcacagagaaagtgacgaggcaggtcatggcatcctttagccagcttcagtcgcagatgcaatcttag

SEQ ID NO: 104692 - DNA, 303 bp, Glycine max
  Peptide Sequence Number=SeqID_221470
atggcattttgtggtggctactggtggctgtgggtgatggagaaagagcttggaatgttggaaatggttttggaagaaagaaggagaagaaatggcgttttccaaagctacttggactacaaggctcaaaacgcacaagtgactaaggctctcggaaacggaagcgtcacgcacactccagacgtcttcccaaagatcccaacgggtgttacactcccccccccccccctctctctctctttcttttcctccattgaaacttcctccctaagcttcttatccaagggactctcttggtggtga

SEQ ID NO: 104693 - DNA, 357 bp, Glycine max
  Peptide Sequence Number=SeqID_221471
atgaacgcgctaagcgcgcctgtgcgcttagcctgttcatcgcaactcagtatagacatcgccattgtggaggagttttatgcgaacctctatgaccctgaggacaaatcacctaagcaagtgaggatgggaggccatttagtgaagtttgatgaggataccttgaacacatttttgaagacccctgtagtgttggaagagggagcgagcttgtgcacttattctcgatttgcactcctgaggcctgatcctcaggagttggatcctatgctttgtatcctagggaggggattcaagcttaatgctgatgggcagcctttgaagattctaaggaagaacatgaccacactcgcttag

SEQ ID NO: 104694 - DNA, 240 bp, Glycine max
  Peptide Sequence Number=SeqID_221472
atgtctaggcaagtgcagggcaatgcaccgcaggccacagacgtaccaccaccacctcatcaggctgatcctgctgagtcattaggcatggagcgggctgaggtcacatggcccggagattggcctgaggcccaggcaggggaggcgcctgcaaaggctcccggcgatgcagaggaagcccgcatggatgaggagatgacggatttgctcggtttcttaggagggagcggagccacatga

SEQ ID NO: 104695 - DNA, 447 bp, Glycine max
  Peptide Sequence Number=SeqID_221473
atgggtaaagtagaggaggcgcaagagaagatgaaggccgacatagaggccatgaaagagcaaatggccacagtgatggaggccatgatgagcataaagaagataatggaagccaatgcggttacagttgccgcaaccagcgctattgctacggtgaacccaatgcccccatctgatctcaaccaaacgaatcatccaacctcagatatggtgggcaaagatttgggaagtacggacggccccatgatgtgcaaattcaaaatgagcgcgccttcccatcatatggcttgcctcccaactatacaccacccaatgtggcatacactcccaatgaaaatgtcaataactccactccgatactcattgagagccaataacctcaatctgatcaggcacatgtctctcaaaccatgggggagacacatgaaattccccaccaaaatctag

SEQ ID NO: 104696 - DNA, 192 bp, Glycine max
  Peptide Sequence Number=SeqID_221474
ttctacggagttcccgtcgcccccaacaagttcatcaggcaccctattaaccgagctttcatcaagaagtactgcacccctaggcaggcgcagggtgaaacaccacagcagcctggggagtgctggcagcgggcaaccgatgcaccgccaccacctctagagttcacctcagctcagcaacaaaaaggttag

SEQ ID NO: 104697 - DNA, 162 bp, Glycine max
  Peptide Sequence Number=SeqID_221475
atggttagagcattctcgcaaaacactgtgaccctgactggtctccctatgatattacctagtgagagtgacttgccttactattgtgtgatgaataggtggatgactatgaagaacctcatgctagaggacacgggaacaccacgctttgattggatgtga

SEQ ID NO: 104698 - DNA, 152 bp, Glycine max
  Peptide Sequence Number=SeqID_221476
tgtcagatgacttgcaaacaccagtgattctaactggtgctctccaagaggccttgaaatttgtgaacacttctttgaagatgttgaaggttctgcaacagttgaaagataaggcattgaagagagcaggtctggcagaagatgagtgctaa

SEQ ID NO: 104699 - DNA, 780 bp, Glycine max
  Peptide Sequence Number=SeqID_221477
atgtatgctcagttgttgcttcttgctttgcctgcaccaccaatgggtggattggggatgcctccaatgccacctttttggattttgtcaagagcttttttcatcagaatattggtggagaatgtcgcaacctacccttcggcgggggtgcgaaaaggccaaaatcatgggccaaagtgtttgtctttgagggagagaacaagcggagtccccactaatgtttatttgaggaaaatgctagaaaaaccaaaaagacgatggtctgcagattttgaaaatgagggtttgggagttgtttccgtaggggggagggtgttgcccttcctcctactatcctcagttaaaacttactttacaaaagaaaagcgattaccgatgatcgaagaaggagatgaagacgcacaaaacaatagagaggacccctatgggtccataaatcaaacctctggaccttgggaccccttccttagcccctcttcacgcttatttatagcaaaagcagccacttgggatcatgacagctcgccaaggcgagctgttaacttcattttgaagcaaccttgctcacccaggcgagctggttacttcatcatgaagttatttggtggcccaggtgagccagaggctagtctaggtgagctagagcaactggcatcaagccgctcaattcggctagcaagaatcaaaacattagcaaaggaaggtcccctgatgaaattaaggtatgacagagaaaatgacaaggttctttttttcttcatgtcttttagtcatctttaa

SEQ ID NO: 104700 - DNA, 809 bp, Glycine max
  Peptide Sequence Number=SeqID_221478
cgccacgtcgcccggcaagaccaccaccgagacgccgcggttgaggatcgccttgcgcatggcgatctccagcacgcgcggcagctgttccgggttggaaaccagctcgcaatagtggctgcattcgcgaaacagctcctgcggatgcgtttcctggaagtagccgctgccgatttcgctggaaggaatgtgtgcggcgatcgccagcaccggcacatggttgcggtggcagtcgaacaggccgttgatcaggtgcaggttgccggggccgcaggaaccggcgcacaccgccagctggccggtgagctgggcttcggcgccggcggcgaaggcggccacctcttcatggcgggtgcccagccattcgatggtgcccatgcggtgcaggctgtcgctaaggccgttgagcgaatcgccggtcacgccccaaatgcgttttacgccggcttgatccagcgttttggcgatcagtgtggctacgatgcggtcaggaagggtaaagagcgtaggacgggggaaagtgtaaccgggcggggaggggggaacttgccgataaatgccccatcgcagagatggggccaagggcgtcatggtgctggtggtgatgtagtcgccctcgaggatgcgggttttgcacgagccgcacaccccggcacggcaggcggcgttgaccggcagggcattgcccttcagtggcatcggcctgcgttgtcggcgtgtggaactgctctttatggaaacgctcggccggcacgccgagccggcggcacagctgctccacctgttccatatagggcgcagggccgcag

SEQ ID NO: 104701 - DNA, 183 bp, Glycine max
  Peptide Sequence Number=SeqID_221479
atggcacgcaacgtgtccgcttcgtgcccttattcaagggacctatatgggagagagctaaaagggtttttagtgataatccccaaggtggtcaaatctctcttgatggtttctagagcagtagggactactagcaacaatatgttatcaaagagaaaaactctagatgagggttcattgtaa

SEQ ID NO: 104702 - DNA, 669 bp, Glycine max
  Peptide Sequence Number=SeqID_221480
atgtaccattcgctttgcttgtttgggctttctactgatcagggacctaacatttgtcccacgctttctcttctgttcggagggacctcaatttcattgatcacaccagcgaccttggatggaaagagttccccgtgggtcatcttgagccgatccttcctggagtattgcatctttggctgggataatttaccccgaacactcctgatgtattttacaaacgtcaagttatcccaagaaggttactttcactcggtcatttgcaatgcaccagaattcaagaacacaacagtaaatggtgacttgaggtatatgatctgggacaatcctccaaagatggagccgctcttccttaatgtatctgtttatgaccagatggcagaaagtggtgctgcttttgctagacagtttgaagtaggtgaccaggttttggacatgatcgataaaaagatacttaagcgagggcgtaatcaagctgtgccaggaggatggtgctcaggctggaggagctggtgggtggatccatgctcacaatggggtgatgatgtcaatattctgaagccaggccctcaggctaagaagctcaaggagtctgtttcgagccttcttgacgattggagctcacacacgaatcagtgccttattaccagtgaagagacagaagactag

SEQ ID NO: 104703 - DNA, 192 bp, Glycine max
  Peptide Sequence Number=SeqID_221481
atggagacacagttggattatttggatgagaagaaactgatgattgctaaattgttgaggagaaagagaaaaagaagtgatgtgcaactgcaaagtactgagacactaactaaagttagattggctgccaagaaggctgaactaccaaatcttgacggtacagaccaggtggagattgttggtgtatgctga

SEQ ID NO: 104704 - DNA, 561 bp, Glycine max
  Peptide Sequence Number=SeqID_221482
atgggcgttgagagaaaatggctcttcaccctcttcactgcagcatttctctccttcatcattctcatgttctcttccctctcttgcttcaattcccctgtgccctttccctctagtgtccactatggtcctcactaccctcctgcttttgcttacttcatatctggtggcaatagagacggtgaccgaatcttccggttgctgctggcggtgtaccaccccaggaaccgctacttgctccaccttgggttggatgccagggatgaagagaggcagaagctggctgcggccgcgatgtcggtgccagtgattcgcgcctttgggaacgtggatgtggtggggaaggctggttatatgacctacttggggtcatccaatgtggctgttactttgagggctgcttctgtgatgatgaagttggatgccgggtggaactggtttgtgaccttgagtgctcgggattatccccttgtcacccaggatggtaatgccaatacggtaatttctgttttagatcatgggtttgcactgtttattgttattgtatgtggtcttgcttga

SEQ ID NO: 104705 - DNA, 354 bp, Glycine max
  Peptide Sequence Number=SeqID_221483
atggcagcagttagagtggaaaatgtgaagtttgtggtgttgaggcatatgggtgcttttggtctcctccctcctgcgtttcgcttcttcttcctcaccttcgttcttcttccttttagtctaggcttgtctcgaaaaagcttgacccacggccgtcatcagccgcaacgcatttgttccccatcttcgtcttcttcgtcggcgtttcgttgtgcgaccgtgtcgtcgtgggtgttgactatcccagccaagttgacggtggtgttgctgcctccgcgcgtcggcatgattgtcgaggttacagatcaagttgatcaagttgtttgcagcagcccactttacagatcaagttga

SEQ ID NO: 104706 - DNA, 696 bp, Glycine max
  Peptide Sequence Number=SeqID_221484
aggggcaacattgcgagtttagtcagaggaaaagccagacctcgggattttgaggaggccataggccagctgctgtgtgttctaggacaggactttgcacagagtgtgacggggagacgagtgcagatcatgcgcactagcatgaccaccctgacacagatctggatgacattgcttctcaacaacatcctccacagtgatcataattctgatcttcccttgccaaagtgccagttggtctatgccatcttaacccaggtaagtgttcatgtgccccagttgatctcagatgccatttatcaatttgcagggatcacacctctcaggcacccagtggacccggagaagtccaacaaggcactagggtttccaaccttgatcacgggcctcttccagttctatggggaccagcagcagccagccgcagatgcaccgttgctacctctactgcagccaccatctctagagtccatctctgctcacatgtggaggatggagcttcagatgcacgcatatatgcaacatgtgatcgaccaacaagcaactaatcaaaggggtcagttcggggccatagttgcatcgcctggagataggcccgattttcaggtaggggcaggacccataggggcctctgaggatgaagatggagctcaggaaaatgatcacatggccaatgtgatgaaatatttcctttga

SEQ ID NO: 104707 - DNA, 372 bp, Glycine max
  Peptide Sequence Number=SeqID_221485
atgaaagagaccgttaaggcgttggaccttaaacagactcaagtgactttaacggataaaaagctcgattacgtgctgattttttcttggtttcacttatttactttcaatctcattaaaagaagacttgtgaggataaaatgggattacggcacaattgatcggttgaaatttgctttacgtgaagaaatgagattactgatggcgagctcagttcgcttaggcaagctggttacttcacccctaagttatttggaggcccaggtattttccgtattctttaccggaacattgaaaaacctttcgtattgtgcaacaactggtgtcaagcagcacaattcagctagcaagaatcaaaacattagcaaatga

SEQ ID NO: 104708 - DNA, 363 bp, Glycine max
  Peptide Sequence Number=SeqID_221486
atgggggtgggggttacctatgcgcgacagggtgacttcgacacttactgcctagttttcctcagtgaaagtgtcatgtggacacgcttaggctatttcttgaccaatggtatgacattgtgtcgcaacgtgcccttttgcgggcgagcgaggcgaggctcacgggtgcgctttccaaaggaggaaagatgcgcggagttgccaccaacgtttatttgtgggaaacgtcggaaaaaccgaaggaaaccggtcaaaatgaaaattctaagttcgggagttgtatttacgtttgaggaaggtcgacaaaagcagggcttttgctcctacgtaccctccatcgaagaggaaatcagacctacgtag

SEQ ID NO: 104709 - DNA, 333 bp, Glycine max
  Peptide Sequence Number=SeqID_221487
atgacaatacctatgtttcaaggtaaaaatgatcctaagttgtatttggagtgggagagaaaggttgaacatatgtttgattgccataattattttgaggaaaagaaaaaggttaaactagttgttgttgaattcatcgattatgctagtatttggtgggatcaacttgtgactattaggcacaagaatgatgaaaggcctatcaatagaggggaggagatgaagactatcatgagaaggagatttttacctagccactactatagggatttggacagaaaattgcatgagtatggaggactactacaaagcgatcgaaatagccatgactag

SEQ ID NO: 104710 - DNA, 273 bp, Glycine max
  Peptide Sequence Number=SeqID_221488
atggatcccaaagatcaggagaaaacaactttcacttgctcgtttggtgtgttcgcttataggtatatgccttttggtctttgttatgctctggctacgtttcagaggtgcatgatggtggataaggctaagattgatgttattgagaaaattcctcctccaataaatgaaaagggagatgttgcatttgtgtttaatgaagaatgtgtggaagcatttaatgatctcaagatcagactagtatctgctccagtgcttacaacaccagaatag

SEQ ID NO: 104711 - DNA, 180 bp, Glycine max
  Peptide Sequence Number=SeqID_221489
atgtcagtgaaaaacctcgtcggacacctaggagtagatgacaagaaagactacacactagatcagcataggcttcaaggaacattcaaactaagtgtatttacccccaaggcctacactccgaagagtttgtcaatacctttccctcctgattcaggtctaacccagaaaacattttag

SEQ ID NO: 104712 - DNA, 258 bp, Glycine max
  Peptide Sequence Number=SeqID_221490
atgagaccaagtacagtgatcacaactattggaacactacgcaacctcaatcaaaacgaacaacactacactacactatgctacccattattctacttttggaaactctgccaaaactgcagtggtcacaagtattggaacatcgcactcaaagtgcgaagtggccgccatggtgctatacacattacaatagacattaagcattcaaaggtctacaaagtgagcacgacttacctcaatcaaaatgagaccctatga

SEQ ID NO: 104713 - DNA, 252 bp, Glycine max
  Peptide Sequence Number=SeqID_221491
atggcagcggaatggagaaggaagagagagaggagacgccacttcaaggagaagatgagtctagaagaagctcaccaccataggaggccaaggataagagcttggaggattgcatcagcatgtttcttattgagtttgtgtaacgacccgcctcatgactacgatatcactactccaaaccgcataaagggcgtcggccacaacattagccttgccttgcttatgtctgatcacataagggaattactatag

SEQ ID NO: 104714 - DNA, 267 bp, Glycine max
  Peptide Sequence Number=SeqID_221492
atgcatgagtttgaagatgatgaaggccatgttttaattgaaagtagccacttagccaaaaagcttaccttgccccaaatttgggggattttattgggtgaaagcttccaacggcaaaatggagctactttgaagaagtccaaaggagtcatcacactaagcgagctcaatgcgcttagcgcacatcaatggctaagcctagctccagcatgcttagtgagtaaaggggaatctggaaagacatttgctctgcaagcacgcacttag

SEQ ID NO: 104715 - DNA, 201 bp, Glycine max
  Peptide Sequence Number=SeqID_221493
atggtggcgaaggagaagaagcagagacttgtgacgatgctcgagtgcgacgaagacgatgctcgagtgcgacgaacacgatgcttagatgcagacagggacggtttcgctagacggagattagaagaagaagagagcgcgaaagcttggatggagaagaagacagagtgtcagcttcttagggctcaccatattttttaa

SEQ ID NO: 104716 - DNA, 181 bp, Glycine max
  Peptide Sequence Number=SeqID_221494
atgtggaacattactttgcagactcagttcttgctggaccagttagctgatcttcagaataaggtaagggaaaatgccaatcagcagcaacgtcctaccggtgagcttgaagatgagtttcgacttgcagaagagaagtgtgaagaagctgaatcaagagttaggcaactagaaccaacag

SEQ ID NO: 104717 - DNA, 390 bp, Glycine max
  Peptide Sequence Number=SeqID_221495
atgaaggttcgtgttgctgaagcggagccatttgggggtgtcgatagtggcgtagaagggaaggaggaaggggtggtcgagctccgtgtgcttgaccttggcgatgaatgtgataggaggggaaaagccgaggtcggagaggaggatgcggtggctagggaacttcgtacggatctgaacgcctggggcttgctattatcggggaggtgggcggcagcaatggtaagcggagccatcaagggtgcggggtgttgcggcatgagtgtggggcgtggtggcggagttggcatgggcgacggagttggcacgggaggtggagttggcatggatgtgtgtgtgaggagtgccttcgcagaggaagaagatggaggtgcgagtgagtggtgttga

SEQ ID NO: 104718 - DNA, 789 bp, Glycine max
  Peptide Sequence Number=SeqID_221496
atggcattcttgggagagacaagcagtcaggcagttgtgaactccacattaggttttatttttccaaatggatccattgttcacaatgacagtggtgtttccttccaagcttcccctccagttcccattcgagtacctaacgggtgtgattttcaaacgttaaaaaccagaatacacaatacccttaagctaaccgacaaacaatttttggatgaaatttactaccgacagcctttcacgtatgcagatgatgctgatgttaacacaatgttattgtgtaatcatgaattttcgtttgttggtccgattgagttattatgtagcattgttagaaccccagatggtattttaaacttacttgaaactactatgacccctactcatgatgccctgttatattacaatgggaggtggaacatgtcacgccaaaatgagtttgttggttactcgttcacaggaaaaaatcccaaaaactttgacattcccatcggatgtaccatggatgaactaaaggatttgatcaagcaagttgcgcctcgtgggattcccccttatggtgttgatgaaacacaaatggtaaggcgattgttttttcggaaaccaagtcaccatgagtattcagaaaaagttataaaatttgaaataattgaactcaaaaccaacgaggacgtgatgaaggtgctcattgagtctaactactggaaaaatattgggccaatagaaattttagctgttttcagtattcttgcaccgcaaatggaagacgacttgtccttgtcgcaaaattag

SEQ ID NO: 104719 - DNA, 135 bp, Glycine max
  Peptide Sequence Number=SeqID_221497
atgatgggaaaaggggttttagggagagtggttcacggcagctatagaggttcagggagagatggtcgggtttcagctagagtggttcacggctacctcgagctcacgtggagggagacagtactaacgtcgtaa

SEQ ID NO: 104720 - DNA, 138 bp, Glycine max
  Peptide Sequence Number=SeqID_221498
atgaagaggattgcgagtgagaccatgagaggaccaccttgcagtggattggatggaaaaactgtgacgagcactaaggaggtggttatacttattcgagaagaagaaggatccgatgaggattccatgaaagtttga

SEQ ID NO: 104721 - DNA, 161 bp, Glycine max
  Peptide Sequence Number=SeqID_221499
gggtacgttgggagccaacttggaaagcgagaccttcgtggaggctgtaaagggtttcctcaatggtccccctttatccgatacccttatgaccaaaagaatgaagaaagatctccatggctcccctggtagactatcgcaatctaccgaggctggcgctg

SEQ ID NO: 104722 - DNA, 354 bp, Glycine max
  Peptide Sequence Number=SeqID_221500
atggcagacaacatgtctggtacaaccactaccctcttgccagctcgacactcctacttcttcctcctgagtggtggcagacaacatgtctggtacaaccactaccctcatgctagctcgacactcctacttcttgctcctttactcgagaaaggagaaaggctaaatccagggaatctgctactagacaaaaaacatataatgagatctatgactggtaaactcatgctggatcgagtttctgctgtcatgggtccctctggagccagcaaaactatatttctttctgccatggtagggaaggcaagaggatgcactatgataggctcatttctaatcaacggaaagccttaa

SEQ ID NO: 104723 - DNA, 234 bp, Glycine max
  Peptide Sequence Number=SeqID_221501
atgagcaggaggctccaagaggattgggctagagttgctgaagaaggccctaggattctcatgaacctcaagatggtgcctcatctcctttatcttccgttgcaactccatggtggaaaatcaccattgaaggaactcattgaagctcaaagatccagcctccatagaagcttatcaagcaagcttccatcaagtggtatcagagcacaagagcttccagtaggtgctccttaa

SEQ ID NO: 104724 - DNA, 183 bp, Glycine max
  Peptide Sequence Number=SeqID_221502
atgtgtgagtggactttgtgcaagattcactctgagtacacatattccaatggaggagctgagaactcacccctacaaccaacaatttccagctcgcaaggagagcggatatggccttgcacgaaggttatagaggaccaaggtgaccattgggacatgtcacctaaggagatggaggagtga

SEQ ID NO: 104725 - DNA, 417 bp, Glycine max
  Peptide Sequence Number=SeqID_221503
atgcagctgtcgccgctgcacgtgctttactacggcgcgctggacggcaacaacgatgcccgtctggcgcgcgtggatgccgcgctgcgtgacgcgcagtttgacagcgtgttcgccgataacattatcagtgagctgtgggagaagtggctgctgctgagcacgctgggtgcggtgtgttgtgtggcgcgcggcaatacgcagcacatcctgcgttcagccggtggtgaagcgctgctacagggcattttcgccgaggtgctggcggtgatcaccgccgatggctaccaacagcgtccggccgtgacggcgaagatttatgagacgctgaacaatcctgatgcggcgatgacctcatccatgtatatttgcagacgcggtgatcagtccggtgcgtggcgtgcctggtgcgcatga

SEQ ID NO: 104726 - DNA, 549 bp, Glycine max
  Peptide Sequence Number=SeqID_221504
atgattgccagtcatccgctctaccgccagatcgacaccgccggcaagggcgaagcgcagctgctgggcgagatggcacgcgtgttcgctgagctgcctgacgatcagctgctgctggaaaccgcctcacgcaactgtggcgaaaacgccgccctgagccagcgcctgctggatgagcagcagtggcagccacagcgcgtgctgctggtgcaggatccgttgatgcagcgccgcagctgggaaaccttccgctggcagtggcgcgatcgcgagcatgcgccggaattcatcagctggccggtgtttgtgccgcaggtgatgatggatgcgggcatgctgcgcatcgttggcgcgccgccgcaggggttgtggtcagtggagcgttttctgtcgctgctgatgggcgaggtgcagcgcctgcgtgacgacgccagtggctacggcccgaacggcaaggggttcttcggtcacgttgatgtacccgacgcggtcgaagcagcctggcagcgcctgatgcagctgcccggcgtgcagtcgcggctgggttaa

SEQ ID NO: 104727 - DNA, 1068 bp, Glycine max
  Peptide Sequence Number=SeqID_221505
atgacagcgcgttccgtaacgcttgacgatgtcgcccggctggctggcgtctcctatcaaacggtttcccgggtgctgaaccattccgcgcaggtgtcaccccgcacccgcgcgcgggtggaagccgcgatgcagcagctcagctacgtgccaaaccgggtcgcgcagcagctggccggcaaggccacgcgcacgctcgggctggcgaccagcgatctggcgctgatggcgccggcgcagattgcttcggcgattcagcagcgcgcggcggcgcagggctatcatctggtgatcgccatggccaatgccaccagccacgcgcaggacacggtgcatgaattgctggcgcagcgcgtcgatgctctgctgatcaacctgccgctggatgccgcgcaggcggcgcagattcagcagcagtgcggcagcaaaccgacgctgtttctggatgtggagcgcagcgctgccgtggcgcagtgtcagtaccggagcaccagcggtgcgcagcaggcggtggatcatctggtggcgctcggccaccggcagattggcgtgctgaacgggcctgccagctccgcgtcagcgcgggcgcgttttactgcctggcaacaggcgctggcgcgtcatcatctggcgccggtctgtgtactgagcggtgactggagcgcggcgtccggctatcaggcgctgctgacccggctgcccgaccagctgccgcaggcgctgctggtggctaacgatcaaatggcgctgggcgcgatgcgcgcgctgcatcagcatggcgtacgaattccggcggagatgtcgatcatcggttacgacgatacggcggagagcgcgtggtatcagccaccgctgaccacggtgcgccaggatttacagcagttaggcacggtgagcgtcaatcgtctgctggcgcagctggagggagagatgccggacagtcagccgctggagaccgaactggtcctgcgcgccaccacggcggcgccgttgcagcagcaggtggatgtggcggagattgcgcagcagttacagcagctggcgcgggcattaaaaaggtcgccataa

SEQ ID NO: 104728 - DNA, 1263 bp, Glycine max
  Peptide Sequence Number=SeqID_221506
atgatgaacagctacgtgcagaagctcggtctgacgcacacccacttcgaaaccgtgcacggtcttgatgcgccggggcagcacaccaccgcgcgcgatctggcggtgctgtcgcgcgccatcattaacggtgagcaggatttctatgccatgtacagcgagaaaaccctcagcttcaatggcattacccagaacaaccgtaacggcctgctgtgggaccagaatctgcacgttgacggcatgaaaaccggccacaccgagagcgccgggtttaacatcgtcgcctcgaacattgtcggtcgccatcgtctgattgcggtgatcatgggcgggaaaagttcaaagggacgtgaagagcaggcgcgtaaactgctggtgtggggacagaacaacttcgacaccgtgcagctgttccacgccgggaaaaagatcggcagcgaaaacgtctggtacggcaacccgcacaaagtggacgtcggtaccaccgaagatatctatctgtcactgccgcgcagcgaagtgtcgaacgtgatggcgaagtatgtgatcaatcgtaaagacctcgaagcgccactcaaagccggcgagcaggtgggcgaaattcaggtgctggataaagacaagcagctggccagctatccgctgtacgcgctgcagtcggtcgatgaagcaggcatcatcacgcgcatcagcgattacgtgaaacagaaactgtacctggccgctgattacgctggtagtggtgatgggaccgatctccacctggggcaatgttttgccgcgcgtggtgcagcgtatcagcggtacctttgccgggctgatatcagggctgatcgcgctgaagctggagctgctgtcactgccgctgatgctggtgtggtgctttatcgtgatgatcgtctgcggctatctgacgctaggcaaacacccgtatatggcactgctgatcggcatcacgcttggcgtggtggtcggcgcaccggccggcgatttcaccgtggcgctgtggcgcggcggcgatgtgattctcggctcgctgatggccctgctgttcagcgccatctgggcgcagcgcgcctatactcactggcgcattcagctgtcggacgcctttatcaacatggcgaagattcatcacgctggcttttctgccaatctggtggagaagccgcgcctcaatccgcgcttccagaagctgctcaccagcgtgatcaaaatgcgcgcgctgctggagccggcgagcaaagagacgcgcatccctaa

SEQ ID NO: 104729 - DNA, 765 bp, Glycine max
  Peptide Sequence Number=SeqID_221507
atgggcattatttttgacaagcctttgattggcgtagtgatgtgccagaaccccatcggcaaccacgttgggcagaccgtgcataacaaatacctcgacgccgtggtgctggccggtggcgtgccgctgccgttaccgcatcagctgatgcacgcgccgcagctattagaaaacagtatgacgctgctggacggcattttgctcaccggcagcccaagcaatattgaaccctggcattacggtgaagagggtcatgaagcgcatgccgatccgtcgcgtgaccgcttgtcctttgcgcttatcacccacgccagcgggaaaaagatgccaatgccgggcatctgccgcggtttgcaggagctggtggttgccaacggcggcgcggtgcatcgccagctgcatcagacgcacctgtttcaggagcaccgcgaagatgacagccagccgctggagcaacagtacgcgccggcgcatctggtgcagcccgaacccgatggcctgctgagccagctgctgggcagcgctgctgcgttcgcggtcaattcgctgcacggccagggcatccgcgagcctggcccgcagttacgcattgaagcccgcgcaccggatggcctgatcgaagccgtcagcctgcgccagcatccgtttgcgctggcggtgcaatggcatccggagtggcaatccgatcgcgatccggtctcgcgccgtttattcgaggcctttatccacgccgcagcacgttatcacaaggaaaagcagccatga

SEQ ID NO: 104730 - DNA, 1155 bp, Glycine max
  Peptide Sequence Number=SeqID_221508
atgggactgtttacaattgcaccagcgcaggctggttctcgcttccgtgatgattatggcgcggcgacaatcgcaaacactaatatcacttctcactgcagcacattgcgcagtatccctgtgccaatgaccctgtttgataccttcggcatcgtgtcaggcctcaccgacggtcacgtcgccaccgcttatgctttcgcgctgatcgcgatactgtttactgccgtgagctacggcaagctggtacgccgcttcccatctgcgggctccgcttacacctatgctcagaaggctatcagtccgcacgtcggctttatggtgggctggtcatcactgctggactatctgttcatgccgatgatcaacatcctgctggcgaaaagctactttgagtcgctggtgccgggcattccgtcgtggattttcgtggtgctgctggtggcgtttatgaccatctccaacctgcgtgggatcaaaaccgtggccaacttcaacagcgtcattgtggtgctgcaggtagtggtgatggctgtgatcaccggtatggtggtgtatggtgtggcacacggtattggcgccggtacgctgaccagtacgaagccgttctggtctgaaaatgcgcaggtggtaccgatgattaccggtgcgaccattctgtgcttctcgttccttggctttgacggtatcagctcgctgtcggaagagaccaaagatgccgagcgcaccattccacgcgcgattttcctgaccgcgctgattggtggggtgatctttattggcgtctcgtacttcctgcagctgtacttcccggatatctcgcgtttccagaatccggactcttcacagccggaaatcatgctgttcgtggcgggtaaagcgctgcaaatcggcattctgattttctcggtggtgacggtgctggccagcggcatggcggcacacgccggcgtttcgcgtctgatgtacgtgatgggccgtgacggcgtattcccgcagcgtttctttggcttcgtgcatccgaaattccgcacgccgtcgctgaacgtgctgctggttggtgcggtagcgctgctggcgatcaacttcgacctggtcaccgcaacggcgctgattaacttcggtgcgctggtggcgttcacctttgtgaacctgtcg

SEQ ID NO: 104731 - DNA, 315 bp, Glycine max
  Peptide Sequence Number=SeqID_221509
atgtcagaattcacaagcaattctcctcgaatttcagccaacccgcatcaattagaccttgcaccttatgcttcagggtcatacaatgctcaatggaatgccccagaactcctccatgataagcacatgtggcattcgagttgtatcctcggaaaaatggaggttgaggaaccttggctagggcaggctttggctgatttagggattgcctttgtggatgattgggtggtgggaatgatagtctcagcatgggttccttcctccctctcattctctctattttccccaggctttttatttgtcaaagaaggatga

SEQ ID NO: 104732 - DNA, 588 bp, Glycine max
  Peptide Sequence Number=SeqID_221510
atggtggtggcggtggcggtggaggcagcaacggcagggtgtgatgggggtggtggcagtggctggttgtggtggaatggtggcagtagaggcggcagtggtggtggcggggacagcggaggtggtggtacagtgatggtggttagaatttgtccttctctttggtctgagtccatgacattgtcatttattcaaattcaacctgacaatttgcaacacaaaaagaatgatcagtctgatattgttcccttaactactgtacaattggatatattttggaaagagatggatggagatgctgattggctaatgggttttctaacaatattcaactgtcaaggggatctagctctgttgattgagcagggtgcaactgcctgcaccaatggaggaaaagatgatagaaaatcagttgaagtggtttggatatgtgcaaagagcattggaggtactgctggtgaggagagtagattgcatgtttttagcccagtgaaaagaagtagagggaaaccgagaaggacattggaggaaattgtgaagaggaatcttgtggtaaataatattcctgagaatttggtctctaactga

SEQ ID NO: 104733 - DNA, 495 bp, Glycine max
  Peptide Sequence Number=SeqID_221511
ggaaaagtagatcaaatgggagatgcagaggagataatagaagtgcttatgatttcttcaccaaaacgtgatgaccttgtgtttccaaagggtggatgggaggatgatgagactgttacagaagctgcttgccgtgaagcgctagaggaagcaggagtcaaagggattgtaagggaaattcccttgggaagatgggagttcagaagcaaaagcagtaatgattcatgtagccaggaaggatggtgtagagggtacatgtttgccttggaggtcactgaagaacttgagacttggccagagcagaaagaccataatcgccaatgggtaaacataaaagaggcattcagactaagccgatatgactggatgtgcaaggcattggaggtgtttttaagagttatggcagaggaaagaaagctaaagaaggaggaaaataatgttgattcttcttcaagttcagtgctagatgagatagctatccattttggttattga

SEQ ID NO: 104734 - DNA, 1017 bp, Glycine max
  Peptide Sequence Number=SeqID_221512
atgtatgatggagttgaggatggctatgacagctcaagagatgacatctcatcagtttcttcttataaccccatgagagagagtctacacagaggctttggaagttcactgtcattgcgatcttcttctgcaagatcattgtccagggatgcttctactttagaaggtttccgaacaagtttatcttcaaatatggcacttcctaggctgtctgttgctgaagtgttgtctgattctggtgctggtgggcatattaaactataccttgttaaaacagatgtcttgtcaacccagaagtcatttgcgattgtctccccaaatgagcaacagaagctgcgaaagacattttctgcagaagatgatgtgggagtatcctcttcacctgaagctggggctgtagaatctttatcatacgcattggatattgtactccaaaatttcaaaaaagtttacattccatcagaaggctttattagaggaaggtcttataatatccgacttgatgatcaagttttgcttaaattttcccctagaaattccgactcaacttattacttcagtgatatgataggtggcactctcactttctttcatgaaggagctaggagatgccttgagatctcaataacattggaaacttcggaaactataaatcggcgatttgtccacccttctagaaggaattcacctacaatcacaaaggttcagagtgatcatcatgaggttgttgcagatttggtgcagacaagctttcttttttctatccccatggatggtccaatgtccttctcaactcaacatgtatctgtgcagtgggttctccgctttgaatttttcacaactccaaagcatgtagattggaaaaagtatgagcatcctcttctaattgagggaagggaaaaaacggaatgggttcttccaattactgtacatgctccaccaccaagaggagctcctgcttctggcacaagaagtgagaaacttttctctttggatcctatgtgggtacacaattga

SEQ ID NO: 104735 - DNA, 948 bp, Glycine max
  Peptide Sequence Number=SeqID_221513
atggtattaagatatgtgttaaaccagattgctgctgagttaaagcaagtgaattatgctagcattgaaagttctcatcgtggatgcattatgagaattactcatgaccaaagtttatctgcgctcgaagttcgcataacccaagagatgaaagccatattcaaacggtttgaagatctcgatatatgtggcaaagtgactctaaggagtaaacttcgagaacttgaataccctgatctaacttcgatgtgtgctcctcttgaaaaggtgaaaacaaaaggtggtcaaaagaaacggatgaccaaacaacaaagatcaatgaagcctaatccatcttactttgagtttgtggatgcattacattcggtgcaagataactcctccacactgaaacggtctggatcatcatatgaacaaacaaaactgaagaggaacatgtcaatgttggatcaatttcatccatgcattcaagatttcattgaagacattgttgatgtcaaggctgatgataattgtcgatatcgtgtaattactgtcatattaggtttggatgaagattcatgcggcaagcttgtatcgctattggcagcagcgggacgtaggcagtatcgccattggcatcagcgatacacttgtatcgtcattggtagcagcagaacaaaagttgagtcactacacccatgccgctattcaaactggcgagacatgttgactaagcatgtcgccattaggactggcaggacatgccaacgtgggcagtcccgccattggtgcctgcggaacacatgggtaggcttagggtttgcagttctgaaaagcttgcatgtgaacgttaaaaatttgaacgttggtgtgagcttgtgctttgctgtgtgcttcttgctttgtgctccttggttcaaatttggtgcgtggcttccttccttcaagtgctcttacccttacttg

SEQ ID NO: 104736 - DNA, 1665 bp, Glycine max
  Peptide Sequence Number=SeqID_221514
atgaaacttaattttaaagtatctaatttgaccgagagaaatgtaaacagtaaacatgctgcaactgcaagacaaagcggtgtctgccccaatcactttccaactgcgctcggtttgaaagttggaaaccctccactcctagctactacaccagcgcgtgccttcactctctcctcccttttcaaattcgctttcacaccttcaacttcaagctcaactcgaagccactccacagagagaaccaagcccaaaaaagctgagaactttggcacaaaaccaacaagcccaccttcaaatcaccccatattccccattcccatgcagagattccatctgggtctccctcattcaccaccaatggacaccagcacacccttccaagaccttccagaagcatctccaaagcccttcttcaagaaaaccacactcacttccttcatcatgtcttcaacaccttccttcaaggaagacacctactacatctcccacctcaaatcctccgagaaaaaagccctccaagacctcaagaacaaactccaatcttcttattcttccaccccttccatgtggggcgttcctttactcaacaacaacaacgccgacaacgccgacgtcatcctcctcaagttcctccgagcccgtgacttcagggtccacgacgccctctccatgctcctcaagtgcctctcatggaggaccgagttcggagctgacaacattgtcgacgaggagctcggtgggttcaaggaacttgaaggggttgtagcctatacccatggctatgacagagagggacaccccgtgtgctacaacgcctacggggtgttcaaggatagggagatgtacgagaatgttttcggggacgaggagaagctgaagaagttcttgcggtggagggtgcaggtgctggagagaggggtgaggatgctacacttcaagcccggtggggttaattctctcattcaggttacggaccttaaagacatgcccaagagggagctaagaattgcttctaaccagattctgtctctgttccaggataactatcctgaaatggtggctcgcaagattttcatcaatgtgccatggtacttcagtgtgttgtattcaatgttcagtccgtttctgacccagagaactaagagcaagtttgtgatctctaaggaaggaaatgctgccgagacactctacaaatttataaggcccgagaatattcctgttcggtatggtggattgagtcgaccaagcgatttggagaatggtcccccaaaacctgcttctgagttcacagttaaaggaggagagatagtgaacatacaaatagaaggaattgaggatttgtttattgcttgttattgggtgacactgggacagagtggtgcaactatcacttgggatattgtggtgggaggctgggacttggagtatagtgctgaatttgtcccaattgcacaaggtagctacaccttagcagttgataaggcaaggaagattgaggccacagaagaagcaatccataactctttcacatcaaaagaagctggcaaaatggtactctctgttgataactctgcctcaaggaagaaaaaagttgctgcttatcgctattttgtgcgcaaatccagcacaccaacaccatctgaggtgcaattaagccctaaatga

SEQ ID NO: 104737 - DNA, 1389 bp, Glycine max
  Peptide Sequence Number=SeqID_221515
atgagggacgcgcgcaaggtgttcgacgaaatgcttgagagcggcgtggagccgaattccgtgacttacagtgttttgattggtggggttcttcgggagagggatttggaaggtgggagggagttgatgtgtaggctgtgggagaggatgagtgtggaggtggaagattctgtgaagactgctgcgtttgcgaatttggttgattctttgtgtagggaggggttttttggtgaggtgtttaggattgctgaggagttgccgtttgggagttgtttttctgaggaggtttcttatggccagatggtggattcgctttgcagagttgggaggtataatggggcagctaggattgtttatctggtgaggaaaagagggtttgttccgagcgatgtgtcgtataatcatgtcattcatgggcttagcagggatggtgattgtatgagggcttatcagttgttagaggaaggagctgaatttgggttcatgttatctgagcatacttataaggtactagtggaagctctttgccatgtgatggatgtggacaaggcgagggaagttttgaaactcatgctaaggaaggaaggtgtggacaagactaggatttacaacatttacttgagagctctttgtttcgtgaacaatcccactgagcttttgaatgtgctagtgtttatgcttgagagccaatgtcaggctgatgtgatcaccctcaacactgtgatcaatggtttttgcaagatgggtagggttgatgaagcttctaaggtattgcatgacatgttggcagatgccgcaagagtcgatgaagctcttgatctgtttcataaggtgatgccagaaaatggtttaagacctagtgttgtgacatataatgctcttctccgagggttattcaaactaaagagagtgagtgatgcattgatggcttttaataatatggtaagtgaaggcattactgcagatagtaccacttatacagttgtggtagaagggctatgtgaatctgaccaagtagaagaggcaaagagtttttggcacaatgttatatggccttcaggggttcatgataattttgtttatgcagcaattctgaaagggctgtgccactccggcaaacttaatgaggcttgtcatttcttgtatgaattggtcgattccgggatctctccaaatatatttagttataatattttgatcaactgtgcgtgcaatcttggcttgaaaatagaagcttaccaaattgttagggagatgaaaaagaatgggctgactcctgattctgtgacatggagaattcttgacaagttacatggcaaagtgaggaaggacatccattctgaagatccaaccatgtcaacaacttatgagggacatgacatggaataa

SEQ ID NO: 104738 - DNA, 447 bp, Glycine max
  Peptide Sequence Number=SeqID_221516
atggtggaccaatttcggtgtctcttgatgacgcgtgtcgcaacctacccttcggtgggagggcgacgcgggactcacaagatgcgtcttccaagggaggaaaacgcgcggagtcgccaccaacatttattcgaggaaaacatcggaaaaaccagaacgtgtggtctacgaactttaagtgtgaaagggatagtcgacaaaagcggggcttttgcttccatgtatcctcgatttgtgatgaggaactcagacctacgtaattcttgcaaaagcgaatatataaattttatttactttcaaaacacttaccaagtaagggtaagagcacttgaaggaaggaagccacgcaccaaatttgaaccaaggagcacaaagcaagaagcacacagcaaagcacaagctcacactcaagaaaaaacacaaagagaactcagtaaggagaaatga

SEQ ID NO: 104739 - DNA, 240 bp, Glycine max
  Peptide Sequence Number=SeqID_221517
atgccttgtcaagttgaaaaatcttcatgcaatatcatacccgaggtgccggtgcacccatttcttgaaatgccattggattttgtaaaaattgacaacttcattgatttcctctttcatagactcaatgctagcaaaattagaaaagggaacaaggaatgtggtggaaaaagcaaagtgaacgttgatgttgggggtcgagggaggagagggggtgggagaggaatgggtttgggttaa

SEQ ID NO: 104740 - DNA, 465 bp, Glycine max
  Peptide Sequence Number=SeqID_221518
atgcatgcagttatcgacagacaaaagaatcatggtatgcactttcgtgtactagctaaagcattacgtttgtctggtggagatcatgttcacgccggtaccgtagtagatcgaagtcgcggtatttatttcactcaggattgggtttctctaccaggtgttttgcctgtagcttcgggaggtattcacgtttggcatatgcctgctctgaccgagatctttggggatgattctgtactccaatttggcggaggaactttaggacacccttggggaaatgcaccaggtgctgtagctaatcgagtagctcttgaagcatgtgtgcaggctcgaaatgaaggacgcgatcttgctcgtgaaggtaatgaaattatccgtgaggctagcaaatggagtcctgaattagctgctgcttgtgaagtatggaaggagatcaaatttgaattcgaagcaatggataccttt

SEQ ID NO: 104741 - DNA, 297 bp, Glycine max
  Peptide Sequence Number=SeqID_221519
atggaagttgaaagtgcctccaaaaagtcagcattttgtttggaggctatgatggatcaactaccaaccatccctaatttacaaagaaggcatgtctacatggctgaagcgaccttctgtcagttctgcaaggaggatgaagaagcaattgggcatttgttcttcgggtgctgcaaggttagagctatttctatttgggtcgaagcttgctcaccaaaattaaatgagtgtggaacttacggaattgtagaaacaagtgcatcttcaagtgagaacagtttgaccattgaagattga

SEQ ID NO: 104742 - DNA, 570 bp, Glycine max
  Peptide Sequence Number=SeqID_221520
atgaggagggtaagccggtgtggaggttcacgaggttgtatggattccaggaattgtaggaaggagtcgtggaatatgcttaggaacttggctcgagacaattctctctcatggtgcactatgggagactataattatctgttgtcgcaaaaagataagtggggttggcaggcacaacctgcttggatgctgcagaggttaagtcatattgtttctaacaagttggaccactcacccatcttgctttgcttggagggacaagctaaaagagtctccaccaaagtgttccgttttgagaatagcttgttgggagagcaggatttggatgttgtggtgacaaattggtgggacaaggaagggccctcaaatatgctaggcaaaattaactcgagcatggaggatttgaaagttaggagcagaaggttacgactgaaattcaggaaagatattgatatgtacagaaaggagatggatcaattaagaggaagaagagatagtcaggcggttgggcgtatggatgagttgcgtgaaaagatggcggtgctcttagctgaggaggattccttttag

SEQ ID NO: 104743 - DNA, 504 bp, Glycine max
  Peptide Sequence Number=SeqID_221521
atgaaggatttgcggcctatatccctttggaacgtcttgtataaaatattatcaaaggtgttggctaaccaattgaaacctttgcttcctaaatgtgtttctttggagcaactggtgtttgtggagcataggtccatcctggacaatgctttggaggttgtggaaccattcatcacaagaagtgcacgtataagagtgggactacgtacttacaagatattatgctcaagatgggattttgtcaaaaaatgggtggagtggctaagtatgtgcttgagttatgtctatttttcagagcttgtgaatggtgaaggatctagtccaattgttcctcaaaggggtctcagccaaagtgaccctctgtcaagagtagaggagaaggagagtagatgtattaaggaaatccgtaacacctatgaggaggcttcgggtcagttcgtcaatatagcaagtcagaagtttattttagcaggaatacaattgtggtcaatagagaagaggtga

SEQ ID NO: 104744 - DNA, 405 bp, Glycine max
  Peptide Sequence Number=SeqID_221522
atgtggcccagtactatatccctagtaattggaaggctatttggaggcttaaggtcggttccaaattgctacaatattggacaaccattttcattggctgaagcttgcaccgaggaaaaggtatatggtgtaaggatgtgtgcccgtgatgatagaggtcagtttgtcattgccaaaactttttgggctcatggggatatccatgcggttaaggctgaagctattagtttactggatgctattcagtggttgagagctataggctttaatgcagtctccattgagatggattgcaagccagtagttgatagtgtgatcagtaacccggtccctcaaactgagttaggggatattcttttggcttttttatttcgagacaagctaatcacgttgttcattctttaa

SEQ ID NO: 104745 - DNA, 1716 bp, Glycine max
  Peptide Sequence Number=SeqID_221523
atgaccgaccctcttgatgagtcaatccattgctttctcataagggtggacccttgggtactagtacctaccaccttaagagaactgcacgccctcgccttcagaggactgcacgtcctcgccttaagagggctgcatgtcctcgctttcaaaggacaacacctcctcgactttagagggctgcacgtcctcgccataagagggctgcacgccctcccattcagagggctacacgccctcccctttagagggttgcacgccctctccttcagagggctgcaaaccctcgactttagagggctacatgttctcaccttcaaagggctacaggtcctcactttcagaggactgcacgtcctcacctttagagagctacatgtcctcaccttcaaaggaaaacacgtcctcagttttagagggctacacgtcctcccaatcagaggactacatgtcctcaccttcaaaggaaaacacgtcctcagttttagagggctacacgtcctcccaatcagaggactgcatgtcctcgccttcagaggtctgcacgccctcgcctacggagggctacacaccctcgccttcagaggactgcacatcctcgccttcagaagactacacatcttccccttcagaggaacgcacgccctcgccttcagaggactacacgtcctcgccttcagaggactacacctcctcgccttcagaggaatacacgtccaccctttcagagcacttcatgtcctctccttcagaggactacagatcctccccttgagagagctaaacgccttcaccttcagaggactacacgtcttatccttcagaggacaacacgtcctcgccttcagaggactacacgtcctcaactttagaggactacacgtcctcgccttcagaggaatacacgtccacccctacagagcacttcacgtccttgccttcagaggaatacacatcttccacttcagagagctatacgccctcgccttcagaggactacatgtcttcacctttagaggacaacacatcctcgcctttagaggactacacgtcctcgcctcaagaggactgcacagagctacacgcctttgccttcaaaggactacacgtcctccccatcacagtattacacctgctcaccatcagaaggctgcactcactcgccttcagagactacacgtcctccccttcagagagctacacgccctcgccttaagaggactacacgtcctcgcatgcaaaggactacacgtcctcgccttcagaggactacaggttctccccttcagagagctacacgccctcgccttcagaggactacacgtcctcccctttagaggactacacgtgctcaccatcagagggctacacgccctcgcattcagaggactacacgtcctccccttcagagagttacttgccttcgccttcgcaagagacctccccttcagagagcgacacaccctcgccttaagaggactactcgtcctcaccatcagaggactacacgtagtcgccttcagaggacaacacgtcctcgccttcagaaggctacatgtcctcgccataagaggactaaacgtccttgtctttagaggactacacgtcctcccctttagagagctacacgccgtcgccttcagaggactacaagtcctcgccttcagaggactacacgtcctaaccttcagaggactacacgtcctccttttctga

SEQ ID NO: 104746 - DNA, 132 bp, Glycine max
  Peptide Sequence Number=SeqID_221524
aagttgaagaagtcagagaccttaatatgggtggactttgtggagtgtcctaaggttgaagtagtttatggttcaagttggaaaagtggggaccttaaaatggaggaccttgacatagacttgatggagtag

SEQ ID NO: 104747 - DNA, 615 bp, Glycine max
  Peptide Sequence Number=SeqID_221525
atggcttcatcaagcctatcagagttggctttggatcgcgtggattctgccatggaaacaagtcaacaagagcaccaaattggtagggcctttgtgtatactggacttcgagggccagaacctctagaacaaaagggaagaaaggaggagaaaaggggaaatgctttgtctccttggccttgctctagctggtgcttgtgtattctgctggttgctatcattttcgggtacctccaaaagcaccttgtcctcaaggtgcttccgttggactttagtaaaaatggcgttccgattggtcagcaagtcattgacaacatccacattggaagttccagtaatatgttgagggaaggtaatgggcttcttgccaaaggttatctcgtagggagaagcaccagacccagagtggcgcggtgtattataagaccatttaacccaactgagaaatttcccccatgttgttggcttcttatgaacaaagctacacaaacactgttcaatgacgtgattaagcacctcggtctgtccctccgtctgcgggtgataagcagaactcattcgcagatgggtaccactgaggcgaaacaactcttgccaaaaacggcagatgaataa

SEQ ID NO: 104748 - DNA, 912 bp, Glycine max
  Peptide Sequence Number=SeqID_221526
atggccatcaaaaactcaagggctcaaacacaaaccctcttctctattctcgtgctcattatttccttccttgcgttggtccacaacgttaaatcagtttctttctcattccctagttttggctcctacacaaacgacatcaccctccaaggcgatgcctatgtcaattcagaaggcgccataaagctcacacctgttgcccccaacagcgttggtagagcgtcctacgctgcacccgtgcacctttgggacgccaaaaccggcaagctcgccggtttcaacacaaccttctccttcgtcgttatgccgaatgttcctggactctttggcgacggcatcgccttcttcctcgcaccgttcaactccaacatccccaacaactcaagtggtggattcctcggactcttcagccctaactatgccctaaatgtatacaaaaaccaaatagtggccgttgaattagactctttcagtgggaacccctgggaccctccctctgcccatgtgggcattgatgttaactccattgcttcggtggcgacgagaaaatgggaaactggaaatgctgtgaatgggtttgttgcatatgcgaatttgaactatgagcccgttggcaagagtttaaacgtacttgtaacataccctggaagcaaagtgaatgcgactagcctctcgtttgtgattgatttgagaactgttctgccagaatgggttacagttgggttctcagtgtttgagctgaaacagtggttgaatctaatggaggccttgaacaacgtctggaaaattttaaagacggtgttgataaacccatctttgaaaattcattacgacatcggttcttggaaaatcgacgtagaatgcgaaaggaaatgcgtaccacgagcctctctcagacctaaccttatttaa

SEQ ID NO: 104749 - DNA, 1110 bp, Glycine max
  Peptide Sequence Number=SeqID_221527
atggtcttaggcgtccagtggctcaaatatttgggaccggtgctcactgattacaacatgttatccataaagttctcccatgaaggtcgtcttgttgagcttcaggattaccatgctttgaacgctattaccatcaaggattgcttcctaatttccaccattgatgaacttctggatgaacttggtggcaccagttggttctctaaattggaccttcttcaaggctatcatcatattcgtatgcatgaacaggatattggtaaaactggcttttgcacgcaccatggacactatgaattcaaatcgtacactggacgaacacgtgattcatttggagaaggcactccagattcttctggacgagcaatttgctttgaagattggccaattccacagtccaccctagcgctacgcagcttcttaggcctcgctggattctatcgatgcttcatccgtggatacgcttcaattgccacaccattgcatcacttgatgaccaaggactcatttgtctggtccaacactgctcaacaagcttttgatatgttaaaagaagctctgaccacaacccttgttttattgttacgaaatttcttccttccatttacattagatatggacgtctttcgagtgggcatgggcgtggttctatcgcaaaatggacaccccattgctttcttcagcaagctaattagtcccaaagttctgcgtgcctccacctatgttagggaaccatgtgcaatcaccactgctgtagtccaaacaccggaggccagactcctgggttatgattatcgcattcagtatcgtgccgggaagcataacctggccgcggatgccttatctagactccctgattccactacgagtaccatgttattgctttctattccttccccgaaattcttagaagagcttaagaagcaatcatctaacgaccctgttgcgaatgactttatccttaaacgagatcatatttggttaccacaaggatccaaattcattctgatgttgcttgaagagtatcattcgacaccaactagggggcatatgggcatagccaagacttttgcaaggctgacggagaatttcaattggtcaggactgtga

SEQ ID NO: 104750 - DNA, 753 bp, Glycine max
  Peptide Sequence Number=SeqID_221528
atgctaaagggagtggcaagagaagaggtaacgtgtcttacaaaagactttaacaagttcttggaaagctcaaataatttaattatgcttttaaaattcaatcaacatcctcatgataagtctggtgtatgcttagaaaaagagacatcatcctccaagtcacagtctgacttagaaaaatgtgacttttgtggggaaagatctatgttcctcgacctaaattcagttgaaggaggaattgttgtcgttggaagctcgggcaaaggaaagatcaccaatattggtaaaattggtattccttctctagcctccacagacaacgtcttatgttgtttccactttcatactgttataactgttgcacatggatcaattgggaccaacaagaatgttgagtctgggagaagtgaccatgggactgaatttgagaatgttgagttcaaatcattctatgaaaggaatgtatcaaagagagaacccaagacgatagaaacaacattgacatatgatgactggattattgctatggaagaagagcttcaccaatttacaagaaatggcgtatggaaacttgtccacaagtctaaaagcaaaagcatcattggaacaagatgggtgttaaaaaagaaactagacgagaaaggtaaagtagtgagaaacaaagctaggttagtatctcaaggctataaccaacaaggaggtatagatttcactaaaacctttacactaattgctagacttaaagctatatga

SEQ ID NO: 104751 - DNA, 519 bp, Glycine max
  Peptide Sequence Number=SeqID_221529
atgtgtgatctgaaggaagaggaaacaagtgatgcaagtgagaatttaggagacaagttgcattctaaggaattagctggtatgcatttagcagggaaaataattcctacacagaattttgatgagtatcttgataccctggatgacatacttggtatgcctaacactgacattagaccctctaatgatgttagtcatgacttctgttctttggtctcttctaatgatgatgttgcccaagttgcgatgcttgtctcacaagttcataaagatactaacttaagtgttgatcaactggtagagttgaagttggtggaacaaatttcattattaagtgatgcttacttagaggctaaggggaagtttaaagaggcacaaaaattgttagctgatctagaggaaaagaaacttaaagtttccagcttggaaaaggactatattgaattgaaacacaaaatgctttatatgatatttgcagatgtggcctttggacctatgggccctggcccaaataaataa

SEQ ID NO: 104752 - DNA, 597 bp, Glycine max
  Peptide Sequence Number=SeqID_221530
atgtcaatccttacccccggaagcagaaaagagaagaaaaggcaattcccaatcaaagaatgggagaaagtaaaaaaagaagaaagaaaagggaaggaaagaaagttcctgatcaaagaagcagaagaaatgtgcagaaagagaattcaagggactaaccgcttaagaattctttgtcctaacacattggagggtacatcctttgtggcacaagtagagggtacatctacttgggttgttatactgagaaaaagagagggtacatctcttgcatatcagttcaagtggagggtacatccacttggtttttcaaagagaacaagggagggtacatcccttgtggatctttggcttgtaaaggattttacaaggttgaaagaaatctcaagaaccgttggtttcttggggactggatgtaaccatgggttgttgcctaaccagccacttgatccaacaggggcctcagaaggtgttggttgtggtggtgtgtgttggtctgctctgattatgttgggaggagaaatgagaggaggagatgtaggtgttgttgaattgggtgattggctatgtagtggggaagattggatattggcatga

SEQ ID NO: 104753 - DNA, 156 bp, Glycine max
  Peptide Sequence Number=SeqID_221531
atggaaggtgctaagcctatgaaaacacctatgcatgcttccaatcctctgagcaaagataaatcatgtaaaccaacagataagagatctacaaaggagacagagttggacgaaaaagcacaagtggtggatgccattacattggaccctatctaa

SEQ ID NO: 104754 - DNA, 333 bp, Glycine max
  Peptide Sequence Number=SeqID_221532
atgttacgaaaccttacggattacgtaatcatcccctttttgccttccagaatgttacggaactttacggattgcgcactaacacttcctttcaatttctggcatgtcacgaaattcacggattgtgctacaatgctttctcttgactttcggcatgtcacggaacttcacgaattgcctaacgatgggtgccaagtacctcgaagtggtcaaacgagggtcgcatcccaacaacagatgctttgtaaatcagtcttgaaaacaatgctggctactagtaatcgattactaccttctagtaatcgattaccagagagtaaaactctttggtaa

SEQ ID NO: 104755 - DNA, 204 bp, Glycine max
  Peptide Sequence Number=SeqID_221533
atggcttgtttccatccaacatgttggagagccttagacacatacgttgttggagatgtcggaggagtagccactgtggaagcaatgctttccaagattattttgatgatgccaaagactcaagtcaagaatcaaagagtccttcaatcaaagcaagtttcaagaatcaaagagtcattcaatcaagattcaagattcaagtaa

SEQ ID NO: 104756 - DNA, 258 bp, Glycine max
  Peptide Sequence Number=SeqID_221534
atgtgtggtctcaaacaaacttcgccggtatggtacaatgagcttaaatcatttttggtagcctatggattcttcaactctaggtctaattcttcttttttcatctacaaaaagcttctatggttgatgccaagcctatttgcacacctctgtccacttcttgctctcttagctttgttggagatgactccacatgtgatgtcacctcttatcgcagcatcaaaggctcacttcattacttatccatcacctgcctga

SEQ ID NO: 104757 - DNA, 844 bp, Glycine max
  Peptide Sequence Number=SeqID_221535
aggacaacacgttctcccattcagagacctacacgccctcgccttcagaggactacatgtactcaccttcagagaactacacgtcctccccttcagaggactacacgtcctcgcctttagtagactacacatcctcgccttaagaggactacacgtcctcgccttcagaggactacaagtactccccttcagagagctacatgtcgtcgcctttagaagactacacgttctcaccatcagaggactacacgcactcgccttcagaggactacacgttctccccttcagagagatacacgccctcgccttcagaggactacacgtcctccccttcagaggactacacgtcctcctcttaagtggactacacgtcttcaccttcaaagggctacatgtcctccccttcagagtgctacacgcccttgcctttagaggactaaacgtcctcaccttcggaggactacacgtcctcaccttcagagaattacatgtcctccccttaagacgactacacgtcctcctcttcaggatacatgtcccaaatttcagaggtctacacgcccttgccttgggaaggctacacaccctcgccttgggagggctacacaccctcgcctttagaggactcacgtcctcccattcagagggcttcaccgcctcgccttcagaagactacacgtcctcgcctttagaggactacaggactacacgtcctccccttttgagagctacacgccctcgccttcagaggacgacatttcctcacctttcagaggactacacaacctcaccttcaaagggctgcacatctgatgcaatcctaccccgcaagggcattggatag

SEQ ID NO: 104758 - DNA, 258 bp, Glycine max
  Peptide Sequence Number=SeqID_221536
atgaggatcgaaaggtcttttaaggttgtaatggggccaaggacaaggcttgtagtgagcttcaaaacaaggaaagggaaacaaggctcaaaagggctatcaaaggaattaagtcaaggtaagtccatttggctagaagcttataagaacaaaaatgcctcaatcatatccaaatatgcatgtgaattaggaagcatcaacaagaatcaagccaaggctattgtgcacgcaatcaatggggcaaaacacaccaaatga

SEQ ID NO: 104759 - DNA, 126 bp, Glycine max
  Peptide Sequence Number=SeqID_221537
atgaagcttttaacagctagaaatggcttcctcacccaaccatggctctggactgataaaaacaaaaccacttattcggtgacaaagatccagatcaggacctccctcgtggctttaccttgttaa

SEQ ID NO: 104760 - DNA, 339 bp, Glycine max
  Peptide Sequence Number=SeqID_221538
atgtctcaatgtcaaccttcattcacatcaaaatggtttggagaggatgaaaagaacattggagctctgttcacactgcctgctaaggttgatagtatgattggacagaggactagaataggagagcatgaggccatgaggaagagaatgaaagacatggaaaagaagcaaagagaagcagaaggccaaagctcccaagatgcttcaaacaataaagacaaggaagaacaagaaattaaagcgaggcctttaaacatggaagacatgagacaggctaagagtcaggtggatgcaagttttgcgtcagaaggatccgtaatgaatgagttaaagcagtga

SEQ ID NO: 104761 - DNA, 726 bp, Glycine max
  Peptide Sequence Number=SeqID_221539
atgacccagcaaatcagggaccagctaaaggagttgatcacagaaaaagtgactcggcagctcatggcatcgttaagccagatgcagtctcagtttcagtcacaaatactttatgagggatccactattgttcataacactcctttgttgcctggccaagtaaaggtgggtgtggaggaggttaaagatccagatgctcccgttcctgtacccactgatgaggcagttgtgtctccggcaaaaccacctgaaaagccggatccgaaggtcaatgatccgctttatctgatgacattaaccatccaagagcttttcttgaggccttaccaggtttcatgggatgccaccatgttcggggtctttaatccagacttcttgctctacataaagcacgaagacatctccgaaatcgcgcacggtggtcaatgcctcagtatatcagtgttacagttgtggactctgcatctgcctgaaaaaagtatgcgagcggggatttctgatctgtatggattcctcgagccacaatccatacaaaggtctaggcaatcacagtttgagactaaaagttacataaagagttggatacagagttcaaaacgagatgtctaccttggagcctacttgaatggcggacactggcagatggtggtcatcatgcccaaggaacacctagtgtctagttttgttcattgcataacaggccagacaactaccttaaggggataa

SEQ ID NO: 104762 - DNA, 333 bp, Glycine max
  Peptide Sequence Number=SeqID_221540
atgtttggaagcaaaggcgagaaccttggcaagtcaagacgaataggccccgctcatggacatcctggcactcttgatcttcggggtgcgattgatgcttttctcgccttttacgatcgtaaggaaagcccagttgtcgctatcttagccgatttatatggcacattcgaccgaagatgtgagaagaatagtgcaaggatcgtttgctgtacaacgaccctctatgtatggttggtttcacacctttttcgccaagaggtgagacacgtttgcccgctagaaggccaccggtcatgcacagagaaaacggaggcaactgggaccgactcttag

SEQ ID NO: 104763 - DNA, 453 bp, Glycine max
  Peptide Sequence Number=SeqID_221541
atgaatgagtcctatttcttggggagatcccattgttacttctatcgagggcaaggatggaaattctcatcctgggtcgaggtttatggtggtttgaggttttggctcaaaaggctttgtagaaaggccagccatgatgtatgtcagggtgttggtttggccagcgaaattttatgcaaaactggttgtctgcacccaagatacgcggagataccttacggttatctgcacccctttgctaggcagacacagttgtgtccgatggcaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttatggttattcgcacccattcttttgctatctgtaa

SEQ ID NO: 104764 - DNA, 498 bp, Glycine max
  Peptide Sequence Number=SeqID_221542
gactttgatagccttggaataatgaaagcaagtgtgcggataaccaaagtgtgtctctacatgctacccaacttctcacaggatcagcaaatgttgtgtttgtatggattaccgctaggtatatccgcctgccgcctaactcaagggtcaggatcaggagatgttgggcttgtacaaattaccgctaggtatatccgcctgccgcctgactcaagggtcaggatcagcaaaactatgtttgtacggataacccttgggtatctccgcctaccacctgactcacgggtcaggattagcagaactatgtttatacggattacccttgggtatctccgcctaccacctgactcacgggtcaggattagtaaaactgtgttgtgtgcagataacccttgggtatctccgtatgacgtcgaactcttgagtcactgtaacaaaatgtgtggggtggtcgacaaaagcagggcttttgctcctacgtatcctcaattgcgatga

SEQ ID NO: 104765 - DNA, 281 bp, Glycine max
  Peptide Sequence Number=SeqID_221543
atgacttatctcttgcacttgatcaacaatatgatatttgccgacaactcctccactcacatccatgtcacctacctcaagtacctcaacaacctaaatgcttgtcatgagtacgcttggggaggggaggattatgttgtggacaaatcggtagccaccagattgaagccgttaagaggttctgggcgtgcccttctaatcatggagagactggatgacctacatatggatgctattatgtggtgtccatataaggaccatagggcagtgagaccttttgg

SEQ ID NO: 104766 - DNA, 165 bp, Glycine max
  Peptide Sequence Number=SeqID_221544
atgatatcagttgctaatggaatcaactacatatctgataccaacatagaaggcaaccacagggaaacaggagacaataacacaaatagcagaccaaggagggatatagtgaagcccacttaccagcagtggtatcaattgagagttcaggcagttgatgcttag

SEQ ID NO: 104767 - DNA, 912 bp, Glycine max
  Peptide Sequence Number=SeqID_221545
atgtatgacaaagaaacaaaaacaaagagaaaatattcaacagagaccagttacaacaagtcactttgttatctctacccatttatattatcaattcctccacaaagaaacaacaactctttatctatcttctctatcggcaagaccctacgtaggttgcggaagataaaaggatcgattcttcactcaagacccagagagaagaagaccacgtatatatatcctgtgctgtgtcccattcggtacgcaagcctcaacatatacatttttcttcttctctttaagatggcggaaatcccgaagttggatttgtcgtcttcttgttttgaccatagagaggctttggattcggaacagaagagccagaaaattttagtttcggatcacataaacgcatttcaatacacagccgatagctttgtgatcgatatggatgccttctcttccggccacaacaaagatgccaccaatgctaattccagaattacgaagttgcagaggagtctttccaggaagggatcccagcgtttgggtgacaggaaggtgaataacaatgctacactttatgataaggatatcgctcctgctatatgctctccaaaaggtgcacttgttgggcctttcacgcccgaaaagccagcagggatggaagtagggaccatggatcattccatgaacccacacgtccatcatccgattactacgacagccaacaacatccctacagagagcaaatgtagtataactcggagaaatagttttagacgaccttcttcatgggccattgatcccaaaagggttctccttttctttgccaccttgtcaagcatgggaacaatgttgctgatatacttcactctgacaatcagtaagcaaagtgcagatgaatatgggggtgattggaagcattga

SEQ ID NO: 104768 - DNA, 633 bp, Glycine max
  Peptide Sequence Number=SeqID_221546
atgaacccttatagtagtagcaaacttgagtctacccaagaaggccaagcaataaacaagaaagctagcaatggagactatggtggtctttggatgaagttgaaatggggtgggattttccggatatcttatttgcagaaaagccacaaggccaaagaagataaaagcaacaagggcatgcagaggattggtttctgctgccatattaagtacttggatatagatgatattgaaggttacttcagtagtacctctgaaagcacgatccaaagatgtaggcggtgcttttcattgagtggtgatccttatactctccacacgaaagtattcagccaagggaaagggaacagagaacaacagttccatctatggttcgaccccaccaaggacttccacacatactccgtccaatggaatcctgcaagcatcatattctctgtgaacgggataccaataagggagttcaagaatttggagacaaaaggggttcctttcccaaagaaccaacccatgagaatatactctaattcaggtgaaaaagaagaacccgcccttaagtggtggaaatttcatttaacgtatatttctaattcatttaaatttgatattctatcggaagagcgccacatataa

SEQ ID NO: 104769 - DNA, 400 bp, Glycine max
  Peptide Sequence Number=SeqID_221547
ccttcaaattgaaaacccaaacaaggactcgagcatttactatgacaaaacgattttaagtttcttatatggggagcctgaggacgaggtgggggagacaactatagtcccattccatcaaggaactggcaacacccgggatgtatctgatactgttaatgccaaacctcgaccattcaaacctctcttcagtgccatctcaaatgcaaccacagagttaaaagttgctttgatcacaagataccgatacaagacatggggaattaagagcaagttccacgggttacaactcaaaggtattctaccaattgattccgatgggaagctctcacgtaagaagaaaaagtacccacttagccgtaattccaacaaactaggaaggttcaaaataaggcactga

SEQ ID NO: 104770 - DNA, 371 bp, Glycine max
  Peptide Sequence Number=SeqID_221548
gatttggattttacgtggatggtgatggtaatatgataaagaagcctcagatgttgaatgtaataattgggaacaatgtggaaattggtgcaaatacctgcattgatagaggcagctggcgagatacagttattggggacaattcaaaaatagataatttagttcagaattgtttgctttgtggacaagttgggattgcaggttcagcaatcataggagattatgtgactacggaaggaagggtagcagtacgagatcatttatccatcatatcaaagcttttgctggttcaacttgatgcagcaagttgtgtaaccaaggacatcaaagagcctggggactatggtggctttccagctgtaatgatttag

SEQ ID NO: 104771 - DNA, 225 bp, Glycine max
  Peptide Sequence Number=SeqID_221549
atgcacataaagtgggagcaagaaaaggagaaggcaaaggcactgttagatcgtagatatgctggtgttttgtgtatatctttcgaagatatgatgattgtccttggaatgcaggacaatgagagtcctgttaggtcacttctggaggctatactgtacagtctgttgagtgcttttgtttattatgctgtgaagcataggattagtataaaagagtggtgttag

SEQ ID NO: 104772 - DNA, 1010 bp, Glycine max
  Peptide Sequence Number=SeqID_221550
gtaagaatggaatagacaatcatcaaatcaatcttggatctcttcgagtggctaccaataatttttctgatttgaataagcttggacaaggtggctttggccctgtttacaaggggaaacttagtgatggtcaagaagtagcaatcaagaggctctcaacttgctctgaacaaggctcagaggaattcataaacgaggttcttctgataatgcaacttcaacacaaaaatcttgtaaagcttcttggattttgtgtagatggagaagagaagcttctggtatatgaatttttacccaatggcagtcttgatgttgtactctttgatccaaaccaacgtgaacgactagattggactaaacgcctggatatcataaatggaatagcaagggggatactatatcttcatgaggattctcgactaaaaataatccatagagacctaaaagcaagtaatatattgttggactatgacatgaacccaaagatctcagactttggaatggcaaggatatttgcaggaagtgaaggtgaagctaacactgctacaatagttggcacatatgggtatatggctccagagtatgcaatggagggactgtattccataaaatctgatgtttttgggtttggtgtactattgcttgagatcattgcagggaaacgtaacgcgggtttctatcactctaaaaacactccaagccttctatcatatgcatggcatctatggaatgagggaaaggagatggaattaattgatcccttgttagttgattcatgccccggagatgagtttttgagatacatgcatattggactgctatgtgttcaagaagatgcatatgataggccaaccatgtcttccgttgttttgatgttgaagaatgaatcagcaatgttaggccaaccagaaagaccacctttctctcttgggagattcaatgctaatgagccaggttgcgaagattactcactcaatttcttaactttgtcagatatagtgccccagtga

SEQ ID NO: 104773 - DNA, 1443 bp, Glycine max
  Peptide Sequence Number=SeqID_221551
atgataaaacggtcaccaagtaggaacaacagatccaaaggcataaaggttaagcactcacatgataagaagaaggaatttgaggagaatgatgcaaaagtgtccgtgggaactcagacagcatatcagactctgaaacttggtagaaaagatcttcatccgggtaaggacgaagtgaatcaaaatgaaaagcatgaggaagaagaggaagatgataatgtagaggatgcatataagcatgaccacaatgaacatgaagaagaaggaaatgagcatgaatctgaagaaaaaggtgacaaacgtggagtgagaggaggaggaagtgaacaagaggaagatgaaaacaaaagcaatgaggtagaagatcaaaggggaggaggagatgatgagatagacgaaaatgaccaagagcaatcagcagtggatactgatcatgatgaggagttcacggatgaagagaaagaagaggagagtgatgagaaagagaaagaaaatagtagggatgaggaaaaggatggttctgttgaaaaccacaacagtcatgaagctcgggaggaaaattacaagggggatgatgcttctagcgctgtcactcatgatactggtacaactagcaccgaaagtgagacccttttagaaaactttgatgtaacctcagcaatgaatatcacgaaatcagagaacagacctaattataccgaggaaagtaacaggagccaaaatagttcaaattttaatattacagaagctgaattgctaggtgggacttcttccaatgcaacatctgataaagaaactggaagcgacagcttgtccaacacagtcgatagctcacatttagacaatactaccacaacatattcggacagtctttctggaacaggcagtaatctgacagcagcgatctctggaggtaacttgacaggaactagtgccaatacttcatctgaatcaaaccaagctcaaaatggtactgtgaatgcaacagtcatcgaagatgtaaaaaatgtgcagacagaaggattagatcagagtggcaatatagtctctgaagaaaacctgtctggttctaactcaacagtccctggtgaaaaagaaaagggacatgcagctgcagatgaatcttctaatctagagggtggtgagttagaaaacacaacaaaatctgtggcatcaaatgaaactgagaaaaatagtaacactgaaatgagtgaaacaaacaagaatcagactatctcacatgtggagaacactgatgctactaagaatgagttcaagggtgacacacaaacagatgaaacatcagactcagttgaacaccaagacactgattcttctgattctcacatcctaaaaaatgtggcagagggccgaactgatctggatacgttgccagatattagaaatgaaggggataaccgtgacgcaactgcaacagactaa

SEQ ID NO: 104774 - DNA, 456 bp, Glycine max
  Peptide Sequence Number=SeqID_221552
atgactaaacgtactaaatccaagagtgaagaaactaaatcacagttgacgatgaatgataaccaaattcataggggttcttcaagctttcatcaagataaaacaggcaatagaaaggacaaaggcttcctactaaggagaacttatctaggagacaagttgagattgataatgaactttgtcccttctgtcaaaggaaaccagagtctgcctcacatctgttcttcacatgtcagaaagaaaagcctttgtggtgggatttcaattcctaggttaggggagacagagttcttcactgtaggccaatggataattttctccagcactcaactacagcagatttttgatatatcgaagctggtggatgatacaaatttcctcacttggtcttggctgagggggtgggaaagggatttcaatgtactcctcatcgatggtcctcagctatgcctatag

SEQ ID NO: 104775 - DNA, 525 bp, Glycine max
  Peptide Sequence Number=SeqID_221553
atggagtctaatgacattcttgtagagaagcttctcatttctgctgttgcagatgctgatgttactgttcggcattctatctttacttctctccatggagatagaggttttgatgagtatttggcccaggcggacaacctgagtgcagtatttgctgctttaaatgatgaggattttgatgttagagagtatgcaatttctgtggctggaaggctatcagagaaaaatcctgcatatgttcttccagctcttcgtcgccatcttatacagttgttaacagcagaggtaatgttcaagtgtctcattttattggtagataaagcacatgtatggaaatattcattgctaatggagtgcattggtagattgaagaactctttttattacatgtccattttattctcttgctgtgtcagcagtgcagatagcaaatgtaaagaagaaagtgcaaagttaattggctgtttgataaggaattgtgaacggctcatcattccatacattgctccaattcataaggtttag

SEQ ID NO: 104776 - DNA, 186 bp, Glycine max
  Peptide Sequence Number=SeqID_221554
atggagaaccctaaagaaaataacaaggtagagaaccatcatacggtgaatgcagttttgagtcttgcttttgtcttttctgctacaaaacttgcagacgaattcggagatgcagaaggtaatatggatcctaatccagaacaacaaatattggatcctaaattaaaaagaatatttgcaaattga

SEQ ID NO: 104777 - DNA, 522 bp, Glycine max
  Peptide Sequence Number=SeqID_221555
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccctctcgcgaaacacggtttggttgataagtatgatctttcgtctctcaagcatattggttctggcgctgctcctcttgggaaagagttgatgaaggagtgtgctaaacgttttcctcatgccattgtttctcagggatatggtatgactgaaacttgtggaattgtttctgtggagaatgcaaggatgggaattcggaatagtggctctacgggaatgcttgtcgccggaatggaggctcaagtagttagtgtggatactctgaagcctctccctcctggacagttgggggagatatgggtacggggccgggtaccgagctcgaattcgtaa

SEQ ID NO: 104778 - DNA, 1335 bp, Glycine max
  Peptide Sequence Number=SeqID_221556
gattttgatgttagagagtatgcaatttctgtggctggaaggctatcagagaaaaatcctgcatatgttcttccagctcttcgtcgccatcttatacagttgttaacttacttagagcagagtgcagatagcaaatgtaaagaagaaagtgcaaagttaattggctgtttgataaggaattgtgaacggctaataattccatacattgctccaattcataaggcactcgtagccagacttattgatgttaatgccaatactggaaccattagtggagtccttgtaaccgtgggtgatcttgcgagggtgggcggttttgcaatgaggcaatacattcctgaacttatgcctttaattgttgaagctttattggatggagctgctgtctccaaacgtgaagtggctgttgctacactaggtcaagttgtgcagagcacggggtatgttataactccatataatgagtatcctcaattacttgggttactcttaaaattactaaatggtgaactagtatggtccaccagacgtgaagtattgaaggttcttggcattatgggtgctctggatcctcatttgcataaaagaaatcaaaaaaccttgccagggcctcatggagatgttacccgtcctgctagcgattcaagtcaacagattcagtctatggatgaatttcccttggacctttggccttcttttgcttcatcagatgactattactccacagttgcgattaattctctcatgcgaatattgagggatccatcacttgctagttatcacttaaaggtggttgggtctcttatgttcatattcaaggttttgcctgatctttttcatactgttcggacatgtgaagatagtttaaaggactttataacatggaagcttggaacactggtgtctattgtgcgccagcacattcgtaaatatttgcaagatttgctatctttaatatctgaattttggtcagccttcactcttccagcaccagctcgtcctggtcctggctatccagttagtgttgcttcttccctggttcttcacctggtggagcagctttgcttggctcttaatgatgaatttagaacatatcttccagttattctgccaggttgtattcaggtccttagtgatgcagaacggtgcaatgactacacttatgttcttgatatccttcataccctagaagtgtttggtgggccaaaaggtgtgatgcacctaatcatagccaaaaaggtgggaatggggagtgagggggccaaaacgttgctcaaagtgcctaaggagagtatttactgtaaaaagtgctatatctcaggatctggtccttaa

SEQ ID NO: 104779 - DNA, 4513 bp, Glycine max
  Peptide Sequence Number=SeqID_221557
atgtttcaggtgtcaaaatggatttttgaaattaatatcgtagtagctctgagggcgagccctggtgcagcggctgcgtacaacatccctcccccataccttcgcatagcgaagagcctctgggcaatggggaaaaatgatgagctccgaaaggatgctgttgatgcactttgttgtttggctcatgcgcttggcgaggatttcacaatttttattccatcaattcacaaacttctacaaaaatatcgcttgcggcacaaggaatttgaggaaattgaagggcgtttacagcgacgggagccacttattcttgggatcacagcttcacaaagactgaacagacggcttcctgttgaggtcattagtgatcctttagatgatgtggagattgatccttatgaagatggatctgatgctcacaaacttagagaccatcaggttaatgatggtcgattacggacagctggggaggcttctcagcgaagtactaaggaagattgggcagaatggatgaggcattttagcattcaacttctaaaggagtctccttccccagccttacgaacctgtgctaggcttgcacagttgcagccttttgttgggcgagagttgtttgcagctggatttgtcagttgttgggcgcagctaaacgaaactagccagaaacagctagttcagaatctagagatggcattttcttctccaaatatccccccagaaattttggcaacacttcttaacttggctgagttcatggagcatgatgagaaacctcttcctattgacatacgccttcttggtgctcttgctgagaagtgtcgtgcatttgcaaaagccttgcactataaagaaatggaatttgaaggagcacgttccaagaagatggatgctaacccagttgctgtagttgaagttcttattcatataaacagccaattacaccaacatgaggctgcacttggaatactaacctatgcccaacagcatctagattttcaacttaaggagtcatggtatgagaaactgcagagatgggatgatgccctcaaggcttatacagcaaaggcttctcaagcaacaagtccacatcttgtcttggatgccactttaggtaaaatgagatgccttgctgcattggctcaatgggatgagttgaatatcctatgtaaagaattttggacccctgcagagccagctgctcgtcttgaaatggcaccaatggctgcaagtgctgcttggaacatgggagaatgggaccaaatggctgaatatgtgtctcgattggatgatggtgatgaaacaaaacttcgaggtttgggaaataccgctgccagtagtgatggaagtagtagtggtactttcttcagggctgttctattggttcgtagaggaaagtatgatgaagcacgtgagtatgtagaaagagctagaaaatgtctggcaacagagcttgctgctttgaggctcttcgctatgcgaaggtatgagggagggatgttgtacgcagctttacccttgcatatgcaaagaggctgtttccggattcaaacccatgaccaacaagtcaccaaggcacaactttaccgctgcaccagggctcgccctcaagttttggagagttatgaacgtgcttatagtaatatggttcgtgttcagcaactatcagaactagaagaggtgattgattaccgtacgcttcctattggaaaccgagtagcagacgagcgacgggctcttattcgcaatatgtggactcagcgtatagaaggagccaaaagtaatgttgaggcacttttagctgtcagagcacttgtgctgcctcctgtggaagatgttgaatcctggctcaaattcgcctctctttgcagaaaaagtgggcgcattagccaagcaaaatctactttagttaaacttctacagtacgaccctgaaaagtctcccgaaaatgttcgataccatggccctcctcaagtaatgctggcatacttgaagtaccagtggtcacttggagaggattcaaagcgcagggaagcatttataaggcttcagaatttggctatggaactctcaagtgcacccaacattcaaccagttacaccatcaagcttcacaaatggtttgaatcttagtgttcctctccttgctcgtgtttatctaaatcttggttcctggcagtggtcactttctcctgggctagtcgatgaatctattaaagatatacttaatgcattcacaaaagctactcagtatgccaataaatgggctaaagcttggcataaatgggcattattcaacacagcagtgatgtctcattacactttaagaggtttccccgatgttgcagctcaatttgttgctgcagctgtcactggatactttcattctatagcatgtgcagcaaattccaaaggtgttgatgatagtttacaggatattcttcgacttttgacattatggttcaaccatggagctactgcagaagtacaaatggccctaaagaaaggattttccctggttaatatcaatacttggctagtagttctacctcaaataattgccaggatacactctaataaccatgctgttagagagttgatacagtcacttttggttcggattgggcaaaatcatccacaggctctcatgtatcctttgcttgtggcctgtaaatcaataagcaacttacgcaaagctgcagctcaggaagttgttgacaaagttcggcagcatagtggtgtactagtggatcaggcgcaacttgtatcgaaggaactgatcagagttgctattctttggcatgaaatgtggcatgaagcactggaagaagctagccgtttgtattttggtgagcataatattgaagggatgctaaatgtgttggagccattgcatgaaatgcttgaagaaggagcaatgaaaaacaatgtcaccataaaggagagaatatttattgaggcttatcgacaggaattattagaagcttatgagtgctgtatgaattataagagaactgggaaagatgctgagctgacccaggcttgggatatttattatcatgttttcagaaagatagataagcaacttcaaagtcttacaactttagacttggagtctgtttctccagaattgctagaatgccgcaatttggagcttgctgttcccgggtcataccgtgctgatgcaccagtggttacaattgcatcatttgcacgccaacttgttgtcataacatccaagcaacgacccaggaagttaaccattcatgggagtgatggtgatgattatgccttcttattgaagggacatgaggatttacgccaggatgaacgagtcatgcagctttttggtttggtgaatactctccttgagaattctcccaaaacagcagagaaagatctgtctattcagcgatatgctgtaatccctttgtctccaaacagtggtttaattgaatgggtcccaaattgcgacacattgcatcatcttattcgggagtatagagatgccagaaagatcacattgaatcaggaacacaaatgcatgctcagttttgcacctgattatgatcatttgcctcttatagctaaagtggaggtgtttgaacatgcgttgcacaatacagaaggaaatgacctagcaagggaggacaaattatacaaggagtttggcagttatgagcatgttcctccaagtagctttgctaaacctttgactttacaatcggctgggaaaggtggaacatgtgcctttgtatacaacaaaagccttgtcccactaggacgtgcactttgtaagctggttggttaccttcttggtttaggtgatcgccatccgagcaatcttatgttacaccggtttagtgggaagattttacacatagattttggagactgttttgaagcatcaatgaaccgtgagaagttcccggagaaggttccttttcgcttgacaagaatgcttgtgaaagccatggaagttagtggtattgaaggaaacttccgctcaacttgtgaaaatgttatgcaagttttgcgaacaaataaagatagtgttatggccatgatggaggcctttgtacatgatcctctcataaattggcgtctttttaacttcaatgaagttccacaaatgtctatgcttaccagcaatcatgtacctcctgttgtaaattctgaggaatctgccccaaatagagagcttccccaccctcagcgtggtgcccgtgaaagagaacttctacaggctgttaatcaacttggtgatgctaatgaggttctgaatgaacgtgctgtggttgtcatggctcgtatgagtaataagcttacaggacgggatttttcaacttgttcttcagtatcaaacaactcccttcagcatgctgtggaccatagcagcttaatttctggagacactcgtgaagttgatcatgctttatctgttaagttgcaagttgtgcattatccacacgattcaagccccaaagggctcttgtgtgagggtggtgccctttctg

SEQ ID NO: 104780 - DNA, 138 bp, Glycine max
  Peptide Sequence Number=SeqID_221558
atggagacgtcaggtttaggcatccaatccgataaattgttgaaggcgaattatgccttcaaaggcgggcaaagttgtgttgtgaggtacaatgctggggcaagctcacgtcaacaaattgcggaattcagcttttaa

SEQ ID NO: 104781 - DNA, 984 bp, Glycine max
  Peptide Sequence Number=SeqID_221559
atggatacttccaaaccacaatctgccaaacagctaaaagaacatctccaacaccaccaagagcctttttcattgcaaagttacctcatcgaaagaagttacatgttcaagaactccagctctgatagtagcaacattcaacacctttattcagccaaggatctgaagtggtccatcaaatatgatttacacaagataaggaaaaggttattacatgcttcagggatactaagatcactattatacaagttcattcccacagaagacaaccaggagttctcaaatgaagagcacaacagtgatctatattatgtgcatgaatacttaacagcacacactcaggcaactcaacaaacagattcactgaaaaccttagctgtgtcgtcgtgtcattttactaacaatgatgttcaggacaaggttttgccggcaaacatgtttcagacactcacactccccaaattgagaagatcagaggttgataaaggaaccaaaccatattggataacctcaaaagagaacaggcagcaatttagcagagaatcaggatggaaagaaccattacccaatgcagtgtgtgacttaaagagttcagagggccaggctccaactttgtcccagaaacttgttagagagtatgttagaaagctactagtgaactcaaatattctgaaattcagacgtgcaaaaaaagacaaagacaaaatacaggagatatgcggaagatacagaaggaagcagctacagtttgactatgtagaaaatgaaggtaaagctgtttcagaatctgaagacttcaacttgttggagaaacaatatagacaggttaaaaagatgagccagctgttgtacgcagaatcctgtgtagcatcagaagagtggaaaagcttccaaatcgtaaattgggagatatgcaaggagataggagattcaatcacggatgagattgtcagagaaataattgatttaatcaggcttggttaa

SEQ ID NO: 104782 - DNA, 912 bp, Glycine max
  Peptide Sequence Number=SeqID_221560
atggcttacgctgcaatgaagcctactaaggccggcttggaggagcctcaggagcagatccataagattaggatcaccctttcctctaagaacgtcaagaatctcgagaaagtgtgcgccgaccttgttcgtggtgccaaggacaagcgcctcagggtgaagggacctgttaggatgccaactaaagtacttaacatcaccaccaggaaatccccgtgtggtgaaggcaccaacacatgggacagatttgagctgcgtgtgcacaagagaattattgatctctacagttcccctgatgtggttaagcagattacttcaatcacaattgaaccgggtgttgaggtcgagggtactgaagaaagcaaaggagttacacgtcaagggagtggtgggcgttggggtgtccagaggagggaggagctttcgggaacaatgcccgtgaggaaccaaacatcattagtgccaatgataagaaatgaaacgttaacgagggcttctgtgtataaatataaatataatagaaggaaaatgagttattacacagaacctgaggtgagaaagatgggaacaattgaggaggataaacattgttattttgaggaagatgatcattccaactccaaggctaatctattgtatctctatccaagaaccaggccccatgttgtccacagccgcgctgtgcctgtgcctgtgcctgtggaggatgaggggaggggaggagagatcgacgacagggattcgaaagaagggaagcggagtgaggcaatggctggtactggacggcaaaggagagacggaggtggtggaggccgggaagcacgccatcatgaggcggacgggactccccgcgcgagacctgcgtatattggaccctctcttgtcctacccctccacccttcttggccgtga

SEQ ID NO: 104783 - DNA, 696 bp, Glycine max
  Peptide Sequence Number=SeqID_221561
catcaagattcttcccttcgagtcgtttccctcgaggcctgtctggaggctgcttgtagcgtcttggaaaacgaggctaaaaccttggagcaggaggctcatcccgccttggacaagctcacctccaagatcagtactctcaatttggaacgcgttcgtcaaattaagagccgattagtcgccatcaccggtcgtgttcagaaggtcagggatgaattggagcacctgctcgatgacgacgaagatatggctgagatgaccgctcctgaattatcgttcgacaatgttctcggtagggacagcgcctccttcagtgccgtcaccaagcaacttgatgtcgaggagcttgagatgctcttggaggcttactttgtccagattgatggcaccttgaacaagctctctacgctgagggagtacgttgatgacacagaggattacatcaacatcatgctggatgacaaacagaaccatctcctccaaatgggagtcatgttgaccacagcaactctggtagtgagcgcctttgttgttgtggcgggtatttttggcatgaatattcacattgagctatttgatgaccagaaagcggggatgacgcaattcctctggactgttggtggtagcactgcagggaccatattcttgtatgtggttgccattgcctggtgtaagcacaaacgcttgctagagtaa

SEQ ID NO: 104784 - DNA, 1942 bp, Glycine max
  Peptide Sequence Number=SeqID_221562
atgagttattacaaccagcagcaacaaccgccgccagtcggagttccaccgccgcaagccggaggggtacggaaaggaaggctatccaccgccaggatacccgccgccgggatacccaccgccgggatatctgccgcaacaaggctatcctccgccgccctacccggcgcaggggagtctgtgattttggaggttacaatttctggtgtttctgaaatccttaatgacgttattcatggggcagaacttttaaggagtgctcttggcagctccttacccaccagttggtcgcttgaggcagatattagttatattggatacaatgtgggcagtgacacagggcatcaggaatgcagtgatgagaagagggatactgtttctgctgaggcggacgggagtgcgaatgcgatgatgaagggaaagggaaccgaagacgatcgtccatggcaatcttaccacactgtttacacaaccgccaaagcaggaatggaattggttgacaaggagaaagttcaaagggtagtttatgaaatgagcaaaggatccaaatattttcaaaacgaggaacgcaaggaagcttttattaagcagaaaattgataacctgcgaattcagtgtgcaaacctcacacaagaagacttggcccattatcaaaaggttgctgatagaagaattgttgagctggaagcttcgcgtgacctttcaaggatttggttacatgtagatatggatgctttctatgctgcagttgagactttaagtaaccctacattaaagggcaagccaatggctgttgggagcatgtccatgttatccactgccaactatgaggttcactatgaccttgacattgtttctgtattatctgctgccatgcctggcttcattgcacgtaagctatgtccagaattaatctttgtcccaacagatttcaaaaagtatacttactacagtgatttgaccagaaaagtttttgggaggtatgatcccaatttcattgctggtagcctggatgaagcataccttgatataactgaagtttgcagagaaaggaatgtcaaaagtgaagaaattgcccaagaactcagagctggggtttatgaagagactggtctcacatgcagtgctggagtggcaccaaatcgcttacttgctaaggtttgttcagacataaacaagccaaatggacagtatgttttgccaaatgaccgtatggctgttatgacctttgtatcctcccttcctatcagaaagggagtttttggaattaacacatgtgagcagatgctggagaagagtagctacatttgtgcatttttctctcagtcaacagcagaggagcttgctgaaatgctatcagctgacatgcaaaaagagggtctgtctgggcgaacattgactcttaaactaaaaactgcttcttttgagaagtacatcagctcaagtgaggatattttgaagcatgctaaaaagttgctacaagctgaacttcctatttcagtaagattgataggccttcgagtatcacagttcaatggagacaagtgtagtgctaagtctgatcctacacagaagaccattaccaatttcattacttcgggagatgtcaatagaaattgtagttcttttccagatgttgcagatcatgactttgtcagtaatgcagaaactgatatgtccattgacagtaggcagacaggtcaacttgattggagagatccttttgacggtaattatttgtcagatgtagactaccaaagctgcactgtccagaaaagtgatggtgtagaggaggtgcaaacatctagtaatgatgctacaagttctcactacagtggacttacagaagtactgggatcaacttcttacctggggcaggttgaaggcataaatgtgaagaatggatctaatctcctggaggatgagagacttgattcttgct

SEQ ID NO: 104785 - DNA, 666 bp, Glycine max
  Peptide Sequence Number=SeqID_221563
atgaatgcattggcttcacaatgcagtagtgggtgtgagtctggctggactctatacctggagcactctttccagctgaaccacaatgcctcttcacatacaacttcgcagttgttcaaagacaaacagaccaaaaagctggaggaggctgaggaagaggacttgtccatggtttctgatgcttcttctgggcctccacacttacacttgccagatgcacaagataatgggagcttttattctgcatctaaggcggcaaaacttggcaagaaaagtaaaaagaggcagaaagttaaggaaaaccaacacttgccttctttgcttgatgatactgctagctctccggtctttgacttctccatggtgactttcaccttccttgcattgccctatctcctttttctaaacaatttcactgtgaccaaacaacaaacttccgcagagagcatgctagattactcacaaggcttctctgctacttattatgagaccactttgagtttttacagcaatctcaatcagaaaatggagttcgtaacaacaagtaagcaaatgtttcttctgtacactgataagttctatttctacggatggctaccgcagctatacaacttgttgcagtggaagatactgaagatcgatgaagatggtgtggaaggaatctga

SEQ ID NO: 104786 - DNA, 318 bp, Glycine max
  Peptide Sequence Number=SeqID_221564
atgattaccaacataaccggtaaagaggatacaaaatctgcgcatcgtttgagcaaaaacctttctatctttacaagttccgccaccaaggagtttatttcttccacttcctatgaagatgcttttagacttcctactaagtctaggagagtgctttttgcgagatatctggagaagaaaaagaagaaactagcacgtgttttgccatttggaggacaaggtattgcccccctcaaagcttcagtggcttcaggcgaggaccactcttcaaataaagcgtatattccaaacgcaataaacttcaactatgacaaatag

SEQ ID NO: 104787 - DNA, 153 bp, Glycine max
  Peptide Sequence Number=SeqID_221565
atggaggacttagtggttacgtttgtgtttgagaccgattatgttatggatcagtgcagtgcttccgtagcaatgccaaggaaattggcttcattaagtatcgctgaaggattagtgtccaactgccccattcggtttggattcttgcattag

SEQ ID NO: 104788 - DNA, 1824 bp, Glycine max
  Peptide Sequence Number=SeqID_221566
atgaaggtttggagatggttgatgagtttgtggtttgtggggttagtgttggtgcctgtgtcaataatgggtcgattcgtggtggagaagaacagcctgagagtgacatcgccggagaaaataagagggacacacgacagtgccattggcaacttcggaatacctcaatacggtggtagcatggcagggaacgtcctttaccctaaggataacaaaaaaggttgcaaagagtttgatgactttgggatttccttcaaatcatcccccggtgctcttcccaccattgttctactcgatcgcggaagttgcttctttgctttgaaggtctggaatgcccagaaggctggtgcttctgctgttcttgttgccgatgatgttgaggagcccttaattactatggacacccctgaagaggatggctcttctgccaagtacgttgagaacattactataccctctgctcttgttggaaaaagttttgctcaaaaactaaaggatgccattattgttggcgatatggtcaacgtaaacctcgattggcgagaggctgttcctcacccagatgatcgcgtcgagtatgagttgtggaccaacagcaatgatgagtgtggtcttaagtgtgatatgctcatgcaatttgtcaaggatttcaagggtgctgcacagattctagacaaaggcggttacacccagtttacaccccactatataacttggtactgtcctcatgcattcacattgagcaagcagtgcaagtctcagtgcataaatcatggtagatattgcgctcccgatcctgagcaagacttctccacaggttatgatggcaaagatgtcgttgttgaaaatttaaggcagttatgtgttttcaaggtggcaaatgaaactcaaaagccttgggtgtggtgggattatgtcactgattttcaaattagatgccccatgaaggacaacaagtacaataaggaatgtgcaaatgctgttattaaatcactgggccttaatatcgaaaagattgaaaagtgcatgggagatccagatgccgatactgataatcctgttttaaaagaagagcaagatgcccaaattggaaagggatcgcgaggtgatgttaccatattgcctactcttgttgtcaataatcgacaatatcgagatgtggagacaaatgagtgcttgacaaacaatggtggttgctggcaggataaagcagctaacatcactgcttgcaaggatacattccgtgggagagtatgtgaatgccctctcgttgatggtgtacaattcaaaggagatggctatatgacttgtgaagcaagtggacttgggcgttgcaagataaacaatggaggctgttggcatgatacccggaatggacatgcattttctgcttgtttggataatggaggagtcaaatgccagtgtcccacagggtttagaggtgatggtgtaaaaaattgtgaaggagaaacatattacagtctcaatattgatgaatgcaaagagaagaaggcttgtcagtgccctgaatgtagctgcaagaatacgtggggaagctatgactgcagttgtagtggagatcttctgtatatgagggaccacgatacctgcataagtaaaactggcagtcagggaagatctacttgggctgctttttggttgattttacttggcgtagttatgattgctggtggggcattccttgtgtacaagtacagaataaggcaatacatggattccgaaattagagcaatcatggcgcaatatatgcccttggacagccaagcagaagttccaaatcatgtcaatgatcaaagagcatga

SEQ ID NO: 104789 - DNA, 678 bp, Glycine max
  Peptide Sequence Number=SeqID_221567
atgtctagtttggtttttgtatttgcgttatttgtatttctccaacgtcctctctcgtgcttgtcaaactcccaagttgacgctctgtctgctttgagaagccgtctttctgacccgaagaacgtactggagagctgggacacttctctcgttgatccttgtacttggttccatgttacctgcgactccaacaacaacgtcattcgcttagatttgggccacaatgatttatctggaactttggccccagaacttgcccagctatcctccctccagtaccttgagctctatgggaatcaaataagtgggaccattcctgagcaacttggtaacttgaagagccttattagtatggatttgtatgataacctattggaagggaatatcccaaactcatttggcaacttaaagtcactcaaattcctacgcctaaacaacaacaagctaacaggatctatcccaaaagaggtcattgatcttaatctccaagtcctcaagatagggcagagaataaagcacgccagaattactgctccactcacaaagaacgttcgcaaagaagccaagcacataacaagaataagcaataaggcaggaggcgaacaaaaaatgttgacagtggaactctgtaaggtctataaagctgcaaactcaagaaggcattcctacagcatataa

SEQ ID NO: 104790 - DNA, 2228 bp, Glycine max
  Peptide Sequence Number=SeqID_221568
ttcccgacaccgcatcagtctgggcaagtccttggaccccaaccgcggcaagccctggtctcctcaccgcctttctcccacagctagacctagaccatgttcttcgtccccttttgctttcggaccatccccatcctgcttccgatattttgggcataatcaaggccttaggctttagcaacaaatgcgaccttgccttggccgtcttccactgggttcgaaccaacaactccaacaccaaccttttcagctcttctgcaatccccgtcatcatcaaaattctcggcaaagctggtcgggtctcatccgccgcctctttgctcctcgccctccaaaacgacggcgttcatattgacgtctatgcctacacttgtctgataaatgcctattccagtagcggtcggtacagggacgccgtcaacctcttcaacaagatgcagcaagacggctgtaatcccaccttaatcacttacaacgtcgttttgaatgtttacggcaaaatgggcatgccttggtccaacgttacggctctcgttgaagccatgaggtcgcgtggggtcgcccccgatttgtatacttacaatactctcataagttgctgtcgccgcggttctctctatgaagaagctgttcacttgtttcagcagatgaagctggagggattcacacctgacaaggttacctataatgccttgttggatgtttttggtaagtccagacgcccccaggaggctatgaaggtcctccaagagatggaagccaatggcttctctcccaccagtgttacttataattccctgatatctgcttatgctaaaggtggtttgctggaggaggctttggaccttaaaacccaaatggtccacaaagggattaagcctgacgtctttacctacaccacccttttgtccggattcgagaaggccggtaaagatgactttgccatccaagtttttctggaaatgagagctgtgggatgcaagcccaatatttgcaccttcaatgcccttattaagatgcatggcaaccgaggaaagtttgccgagatgatgaaagtttttgatgatatcaagctctgcaattgctcccctgatattgttacttggaatacccttttggctgtctttggacagaatggaatggactctcaggtctctggaatatttaaggaaatgaagagagcaggctttgtggccgagagggacaccttcaacactctaattagtgcctacagcaggtgtggttcctttgaccaggctatggctgtttacaagagcatgcttgaagccggtgtcgtaccagatctttccacgtacaatgctgttttagcagctttggctcgaggaggtctttgggaacaatctgagaaagtccttgctgaaatggaggacggtcgctgtaaacctaatgagctgtcatattcctctttgcttcatgcttatgccaatggtaaggagattgaaaggatgaatgcttttgccgaggagatttactctggctccgttgaaactcatgctgttcttttgaagactcttgttctagtgaacagcaagagtgatctcctaatagaaacagaacgtgcctttttggagttaaggagaagaggaatttcgcccgacataactactctgaatgcaatgctttcgatatatgggaggaagcagatggtggccaaagcccacgagattttgaacttcatgcacgagacgcgatttactccgagtttgactacatataatagcttgatgtatatgtacagccgttctgaaaacttccaaaaatcagaagaaatcttgagggaagttctggagaaaggtatgaaacctgatagaatttcatacaatactgttatttatgcatattgcagaaatggtaggatgaaggaagcttctcggatattttctgaaatgaaagattctgcacttgttcctgatgttgtaacttacaacacatttattgcaacttatgctgctgactcgatgtttgctgaggctattgacgtagttcgatacatgatcaagcaaggatgtaagccagaccagaatacttataactccattgttgattggtattgtaagctcgaccagcggcatgaggccaacagttttgttaaaaaccttagtaatcttgacccacatgtttctaaagaggaggaaaaaaaaggcagcagtaaatgtctccgcatggatgcttgcaggtgcggctgtacagagagatggggaaaatga

SEQ ID NO: 104791 - DNA, 495 bp, Glycine max
  Peptide Sequence Number=SeqID_221569
atgtctagtttggttttgttgtccgtgttatttctccttctccaacgtcctctctcatccttctcagccaactccgaaggaaacgctcttcatgctttgagaagcaggctttctgaccccagcaacgtgcttcagagctgggacccaaatctcgttaatgcttgtacttggtttcatgttacctgcgactccaacaatcacgtcattcgcttagacttgggcaattctaagctctccggaactttgggaccagaacttgcccagctaccccacctccaatacctgtttgtatctgtctcttttgtttctcccaacccaacaatccatcatgctaatttgaaacctccactgtgcagtgatgtttctaataatgacctctgtggaacaataccagtagatggcaactttgaatccttcccgatggaaagttttgagaataacaaactcagcggcccagagctgaaaggattggttccttatgattttggatgctga

SEQ ID NO: 104792 - DNA, 339 bp, Glycine max
  Peptide Sequence Number=SeqID_221570
atggaagacctcgtcggcgctcccgagatggctcgaacccaagtcctcaaacggatttgggcttacattaaggacaacaatcttcaggcttatgttagtatgctgcttcactggcttactaatgagactctatccttcttgtacaagtgcagtgaccctacagacaagaggactataaattgtgatgagaagctgaagaaggtgtttgcagggaaagatcaagttgagatgctagagattgctcgcttgattagccctcacttccttaaaagtgaaagaattaccggtggggtcgagagtagggctgaaaagggtggcagtgtgaattgcaagttctga

SEQ ID NO: 104793 - DNA, 207 bp, Glycine max
  Peptide Sequence Number=SeqID_221571
atggagagggaaatgataacaatgatagtggacacgttaccggtgttctactatgagaagatggtgggatacatgccttcgagttttgcagatttagtgtttgctggcgagaggatcgaagtgggtttgagaggaggcaaagttgattatgttgcttcaatgaatagaaagcctggggcaaatggagagaataagaaggagggataa

SEQ ID NO: 104794 - DNA, 309 bp, Glycine max
  Peptide Sequence Number=SeqID_221572
atggatgagttgattaacaaaacacaactctctcccaaaataatcccaacgtcatcacgtcggctcagtggctccacaaaagaatctcacttctcgtactctactactgtcattctactcccacgaacaaaggttcgcgatcatcataggtaccaaccacacgatacaaaaattgtgagggggatatccaacaaggtcactgcaccccccgtgtacatacataacatacatcttcacagtgcattttcaacatcagcattgtctcatctcaatgacattatcaacaacaacaacatcatctcacattaa

SEQ ID NO: 104795 - DNA, 495 bp, Glycine max
  Peptide Sequence Number=SeqID_221573
atgagagcattggaggcaagaaagactgcattcaaagagtgtgttcttcaagtgaggggtattaatgctaaggtgggtttgagaatggatgtagccagtagatggaattccacctatgttatgcttgcaagtgaaattaagtaccaatgtgcttttggttgtttagttatctgttatagaaacgatgttcattgtccatcaaatgatgattggaaaagggttaaaaaaattgatgatccaatgattaaagagatgaatttgaaaatgtttgccaagtttaccaagtattggcacgagtattttgagattctttctattggagacattcttgatccacaattgaagttcaaagttattcggtttgcttatactaagattgatcattctacttgtgaagaaaagattaccgatttaaggaaaaatattgaaaatttgtttgacgaatatgtgaaagcaaaatcaagtgagtcaaactcaaatgcttcaacttcttaa

SEQ ID NO: 104796 - DNA, 747 bp, Glycine max
  Peptide Sequence Number=SeqID_221574
gaatttgatgctaatctctacaactctgagggtccttcaccaaagcaagccagggttagggggcacctggtgaagatagacgccgacagcctcaacacatatcttgagactcctgtagttctagaagaggcggagactttacccacctactctaggtactacaggttgcccatagatcacagagagatagaggttgctctctacatacttgggagggggttcattttgaatggtaaaggccatccggggaggattctcgggaaggatctgactaccttggcccaggtgtggagtgttctgtcttactccaacctggcccctacatctcatacattaaatctcactatggatagagccaggttgatctttggcctggtctctcatatggatatgaacatcgacgctctcatctcaagacagatgacttctattgcccaatctaactcttgcagacttgggtttcctgctttgatcaccgccttatgccgagcccaaggggttgtctctgacagcctcacatttgagtgcctgagcctggccattaacttggcctacatcaggaagaactgttggaacattgatgatctaacagttgctttccaggggactaggagggcgaggccaacgaatattccatcttcttctacagctccagcacatactccaacatctacttttgcagctccttcaattccagctcatgttgactcgcagcgctttgaagctatgcttcaaagtatccattag

SEQ ID NO: 104797 - DNA, 216 bp, Glycine max
  Peptide Sequence Number=SeqID_221575
atggggacattaacttttaaaagcggggtcattttgatgatgaccctaaagaaggaagaggattatttccactcttcccttgttatgtttgtgtatgtgcacatgatggaggatacttatagttggggacttcatgaggatcaacatgcattacgaggaaaggatgaaagaacaaagttgcatggttgtgttagagttagagtgattattgtgtga

SEQ ID NO: 104798 - DNA, 151 bp, Glycine max
  Peptide Sequence Number=SeqID_221576
gggggagtggaagctggtggtggagactgagagggtggaggtgaagagggaacaggtggcggagaagactggacgggaggtggagatgcttggggtgtgggaggcgcaggagagcttaaccaagatgatccaagaagagaatataggatga

SEQ ID NO: 104799 - DNA, 309 bp, Glycine max
  Peptide Sequence Number=SeqID_221577
atggtggaggtttttgcggtaagagtaaagcgtagttggagtctcacaatggtggctacttgcatggttgaggacaaggtgaagttgcagaggtttacagaggatcaaaaacaaagaataccattaatggagttggatctaaagaaaaatctgcgagtccgaagacagagatcgatgtctagaacaacatggacagcaaagcacatccgaatactaagctcccaatcatcttctgaaaggaccacaagttttgagccccactctgcaatgccacaaattaagttcgttaatttagcagcttacttttaa

SEQ ID NO: 104800 - DNA, 579 bp, Glycine max
  Peptide Sequence Number=SeqID_221578
atggaaagtggagggaactcccttccatcagggtcagatggtgtgaagagaaaggtttcatatttctatgatccagaggttggaaactattattatgggcagggacacccaatgaaacctcataggattcgaatgacacatgctcttttagcccactatggattgcttcaacacatgcaggtcctgaagcctacggctgctaaagatagggacctttgcaagttccatgctgatgattatgtggcctttttgagaggcatcacccctgaaacgcagcaagatcaattgagacagctgaagaggtttaatgttggcgaagactgccctgtatttgatggtctttactccttctgccagacatatgcaggaggttctgttggtggtgctctaaaattgaaccacggagcatgcgatgtcgcaataaattgggctggtggtctacatcatgcaaagaagtgtgaggcttctgggttttgctatgttaatgacattgtgctggctattttggaacttctcaaaatacatgagtcaatagcggcggagtggagtggcccctatccgcgacgggcacctctgtag

SEQ ID NO: 104801 - DNA, 1314 bp, Glycine max
  Peptide Sequence Number=SeqID_221579
atgggaaccaggtacatgtgcgctttattaatattgtctttattgcttcattcatttatgtttattggggcagaggaaggggtgggcggaagggaaactataagagcaagtggccacgtgcaaggcggttatttttacggctctccacctccacctcccccgaagtgtcacccaccgcctccacctccaccaccagtaaggttggagagagctcgcagagcgcttgaaaaattcactcgtttagtggatgacccaaatgggtatacgagtaactggaagggtagcgacgcttgtaagttcaggggggtgagatgtgcgaaatatccagacggacagcaagcagttgcgggactagatctgaatggagctggcctctctggaaaaaaatgtacagctctcatgctctccggcctcttggacaggataccagagctcacattcttccacgtcaactccaacaacttcagcggtgccatcccaaccgacatcaccaagtacaaatttttcttcgagttagacctcagtaacaacaaattggagggcgagttcccaaaggaagtgctccagcccaagcccaaggaccagcagctggtgttcctcgacctcaggttcaaccgtctctccggcccaattccaccccaactctttgacttggatctcgatgtgattttcatcaacaacaatgaattcactggcaatctccccgataactttggctccactcctgccaggtacctcacttttgccaacaaccagctcactggtccaatccccccaagcatcggcaaagcttccaaaaccctcaccgaagtcctcttcttgggcaaccacttccagggctgcttgcccttccaaattggctacctcgttaaggccaccgtctttgatgtcagcaaaaactccttaacgggtcccatcccacactcctttgcctgcttggcaagcatccagttcctcaacttggagcacaaccagttttacggagaagttccggagatgctttgtcagctcccaggactccgcaacaatgggagcctgtctttatccgacaactatttcactcaggttggccctgcatgcaggaacctcataaaaaacaaagtgctggacgtgagcaacaattgcatcctgggtcttccaaatcaaaggcctcacggacaatgcacagaatttttctccaagatcaagccctgcccaaatccaaagaatctccattacgtcccttgtaagggatactacccgcacacccaccccgccgccgccgctcctccgctaacttacaactctctcaaccctcatcatcttcatcgctag

SEQ ID NO: 104802 - DNA, 399 bp, Glycine max
  Peptide Sequence Number=SeqID_221580
atgtcgtcgataacgggcatccaggggcaacctcttgaggttacggggatgtatgattttgaatttatggatggcagtggtttcgtgctccaagttgaaggacacagaatggatttcaagacaagatcctcgttgacccacgacgaccttgaccttccagacggcggaaaaaacccggtattccaagagaagttcatctttcccctcattgaaggccttcgggagctcaatgtccttgtttggaacagcaatactctcaccttcgacgattttataggaagcggaaagtatgatactatagccctatgcctctttcttccatctattatcctctcatttctcctcttcttcgatcttcaggattcaattgcacaaggttctctctcaaggcttcgatga

SEQ ID NO: 104803 - DNA, 405 bp, Glycine max
  Peptide Sequence Number=SeqID_221581
atgagaacaaaaagaggagataaaggaaaaagatcaaaaggagaagaggaggcggtgtttggagacagtgaggatgacagcgaagtggtcggaggggagcaatccgagcatggtggaaatggtctgcttcatggattctctggcggcgggggacacacctttcgagatggcagagttgtcaaggggctagatgcggcggaggatggcggtgatcacggtgaagccgcggtcgaagttgcgcgtggagacaatgtaatcggagaggcaggaggggatgaagccgccgcggcagcgcatgaaggggaggaggacggagggtggcgaaggaggagggaaagggggaggcttcgaagtagcggtgcgaaaaacagctccaaaacctgcgccgctccagccgcgacatga

SEQ ID NO: 104804 - DNA, 705 bp, Glycine max
  Peptide Sequence Number=SeqID_221582
atgggaccctgcagtgcagtgttcaaaaaggcagcagatagtgccaagaactcttcttttcagcaactacaaatggttcaccttgagacaaggaggattggggcctttgggcattggggaggtgcagaccctcaaaattctgcttgtgctgtggtgttctcagaaactagagatgatttcaaactaactaggcaattgtttaggatgttttctttccatattgcttatttcaacaatctgcgtgttctgtatgtggacattgatatccaccatggtgatggtgtagaggaggccttttacaccactgacagggtcatgactgtttcgtttcataagtttggggattactttcctggaacaggtgatattcgcgatattggatatggtaaagggaaatattattcactaaatgttcccttggatgatggaattgatgatgagagctatcagtccttgtttaagccaataatgggaaaggttatggagatttttaggcctggtgctgttgtattacaatgtggtgccgactctttatctggggacagattaggttgtttcaatctttccataaaaggtcatgcagagtgtgtcagacatatgagatcttttaatgttccccttctattgctcgggggaggtggctatacaataagaaatgtggcacgttgttggtgttacgaggtaatgtgcggtgtgatcactcat

SEQ ID NO: 104805 - DNA, 327 bp, Glycine max
  Peptide Sequence Number=SeqID_221583
atggcggtacaaaaatgggaggtggtctggcagccatggaagcttcgtttggcgagtagtgtgggtggtggtagtgggaggtggtctggcagccatggaagacaatcggggaggctccgtatgacgagtggtgtgggttgtggtagtggaggttggaaattaaagagctggtttcgaggttaccaatgcctccaaaacaaagaggaagaaaagaacacttggaatttgaggaccaagttgcctccaagaactaagagaaaaaggaaagagaattctgcaatttctcatattctctggaagcgccattacaacagatatatatattag

SEQ ID NO: 104806 - DNA, 207 bp, Glycine max
  Peptide Sequence Number=SeqID_221584
atgggtagcctggcccaggactcagcctcccctcacagggaggacgaaggtctcaccgctcaggtagcagacccctccactccagaggatcagactacaccagtcctgtctccgaacacctctcctccagctacccctgtgcttcacttaacaaatgaggaggatgttcagacacaggatactcaggacagatcacaggatttttaa

SEQ ID NO: 104807 - DNA, 1680 bp, Glycine max
  Peptide Sequence Number=SeqID_221585
ggaattgatatttactatgataagctggcctatccaacatcgaattttgttgttttatcagtaaactattatgattcttatccgcgtgatgctccttccgttattcctgaaaaaattcttgaccagtatgttttattagcaacatttggaaccggtaatacaacttctaccaaaagtttgaaaacagcttcttatctaaaaaatatagaagatgataaatggaccaaaacatatcattattatgatttcaaaggaaggcagattgctacaaaaactactaatcatttagaaggttacaccaataaggagtctaaacttgatttttcaggattagcaacagaaagttatacttatcataaaagaactccaactgaaacagaagttaagataaaagaacgttttgtttatgataatggaaacaggcttttaaagcaataccatcaggtagatagtaaacctgaagaattgctcgtagaaaatacgtataatgaaattggtcagctcatcaataagaaaaccgggaacaccacaggaaccccattacagtctatagatctaacatataatatcaggggttggcttactaaagtcaataatccggcaaacttaaacgggaagctttttggctatgaaatcagataccagaatcctatctattccagcgtttctaccggaaagtacaacggtaatattgctgagatggattggtcaaatgccaataatggaatattcagacgttataactataagtatgatgggttggataggctaaaagacggtatttattcagaacccaatacaacgacaccgcagaataactactataatgaatcaatgacttatgatgtaaacggcaatattcaatccctgaagagaaatatgttgattcagaatttagggactcaggtaatggatgacttaagctatatttacgcaggaaacaggcttagttctgtaaaggaatccgctggaaattacattggctatccggattcttcccaaaacccaatatcatatgacgataacggaaatatgacagaccatgtggatagagggatcctgaagatagattacaattaccttaatctgcccgattatgtcaagttcgacaaaacctacctacctcgagacctgaatccgggagtgctggattataatgtgaatacaagatacttatataacgcagagggggttaaactgagaaaagtatatacttatggatctggtagaggccaaatggaaacggttgaaaaaacggattatcttgatggctttcaatataccaatgataaactgagttttgtgcctacttcagaagggtattttgatttcgttcagaataagtatatttacaactatacagatcaggtaggaaacatcagactggcgtattacaaagatgcttccggaaacccgaaaattgatcgggtaaccgattattatccattcggattggagtttggagattatttaggaacttctctttcaatatcacccaactataagtactcttcacaaggacaagaaaaacaaatggaaacaggatggagttcttataaatggagaaattatgactctgcgatggggagattcttaaatgttgacccattaagtgaaaagtatgcttatcagtcacattataatttctctgagaatagagttataatgcaagagagttag

SEQ ID NO: 104808 - DNA, 210 bp, Glycine max
  Peptide Sequence Number=SeqID_221586
atgaagttgttcctagaatctaaagatgttgatttgtgggacattataaagattgattcttacaaaccaacaagaagaaatcaagctagagttgagataaacaaacccaaagctgagtggacccaagaagaaaaaccaagagttcttttgaactctagagcaatgttcttcttgaaatgtgctcttagcgaatctgagtatgacaaatag

SEQ ID NO: 104809 - DNA, 258 bp, Glycine max
  Peptide Sequence Number=SeqID_221587
atggatgaacttgttgactccttgaaagttcatgaaaaagagttgatggatgagctacaattacctaagggaaatgctatagcactcaagaatagtgatgatgagctttctaaagaagaagaagaattggcctttctgaccaaaagggttcaatattttttagaaggagaaaagggacaagaaggaacttcttcaaaagatactttcaacaaggagaaacctctaggcaagtcagatgctttgaatgaacaagcctag

SEQ ID NO: 104810 - DNA, 471 bp, Glycine max
  Peptide Sequence Number=SeqID_221588
atggacaaggtgaaggacaatagaaaacaaaatagctccaaccatgttgagggctctcaaacccctttaggattcatacctcaaacaacaacccatgtgccacctcctttgcctcaagcccaggaaaggcataggaaacatatttatgcccaaaatccaaaatgtaagcatcctaggaaagaccctttgaaatctgtaccttatggtcccaatagtcgcctaggatcagacaaagttgttggaaagaaaccaatttcccctcctcaggacccgagtgcacaaccctatcaccctaaggggtctaccctcaaagatgatgggcccttatcttcaaagagccccaacctgcaatatgtccccacattgactattcaaaagtctactcatacattgccaacctcaaatgagataaatgacaacacaactatgatggagacaacacctaagcatgatcctggcccacaacagtaa

SEQ ID NO: 104811 - DNA, 309 bp, Glycine max
  Peptide Sequence Number=SeqID_221589
atgaggttgcctatagctgaggtcaaaggtgccactttttaccaagctagggctaacaagtttctggagttcgttcattattgttccttgttagatattgaagctgaggggagcaagtttgcctggtttcacaaggatcaaaatggtaccaacaaggccaaaaagttggatagggtcttggtagattccacatggaaccatgcttttcctggagcttatgctatcaatctgcctagaatatactctaaccattgtcccatcattctctatctaagggataatggtacttctaaaagaggtcgaccttga

SEQ ID NO: 104812 - DNA, 165 bp, Glycine max
  Peptide Sequence Number=SeqID_221590
atgggttcaaaaatctaccctaaggattgcatcagtcttgaggtggaagatgtcatgggtgtgaaagatggagagggagatgacagggtagtggcggagagaggtgacagagcaagtggcaaaactgtagaggaggattttgtcaatggaggccttcaactgtag

SEQ ID NO: 104813 - DNA, 473 bp, Glycine max
  Peptide Sequence Number=SeqID_221591
atggtagaagtctctgtggaagcaattgcatcccttactcagtattatgatcagccgctaaggtgcttcacgtttagggacttccagctggtaccaattgtggaagaatttgaagagatcatgggatgtccactgggaggaagaaagccatatctcttttcgaggttctacccctccatggaaaaagtagtcaaggtagttaaaatctcgatacaagagttggaccatgtgaagcaaaataggaacggggtagtcgaaataccaaggaagcatttggaggaaaaggcaaaggcattggcagatcaaggggaatgggcttcgtttattgacatcttgacactattgatatttggcttcgtcctctttccaaatgtggatggattagtggacctagaagcaattgatgccttccttgcttatcaccatagcaaggaaagcccgatcattgctattttggccgatgtctatgacat

SEQ ID NO: 104814 - DNA, 267 bp, Glycine max
  Peptide Sequence Number=SeqID_221592
atgggtataagaattggtggaggagaagggataaaagaagggaacaagagaatgatgagagagaagagagaatttcctaaggaagaattctcaggctttagatttgggtctgcgtactcatgcttagcgtgctctgctcgcttagcacaggtgccagttttcgcgcttagcgcagagataagcaagttcgagccaggtcatgatatgcttagaataacgagattgagtgttgctggaggaatgtgctgggcatctatttacatatag

SEQ ID NO: 104815 - DNA, 1086 bp, Glycine max
  Peptide Sequence Number=SeqID_221593
atggagtggtctttctccatatccgtggtgttgtttcttacccttctcattcaaatacatggaagtggttatcttgatcacaagcaagcaagaggctttgcagagaattatggttgtaatttgttccaaggaagctgggtttatgatgattcataccctctttatgaaacctctcagtgtccctttatagagagggaatttgattgtcaaaacaatggtagaccagataagttttatctcaagtatagatggcagcccgcagggtgtaacttaacaagattcaatggtgaagatttcctaacaagacttagagggaagagtatcatgtttgtgggagactctttgggtttgaaccaatggcaatcactcacttgcatgcttcacatagctatgccacaagccccatacaacttagcaaggaatggagatgtctccattttcacctttttgacctatgatgttaaggtaatgttctcgcgcaatgcattacttgtggacattgttggtgagagtatcggtcgagtattgaaactagattcaattcaagctggccaaacgtggaaaggaatagaagtaatgatatttgactcttggcattggtggattcacacaggaagaaaacaaccatgggatttgattcaagtagggaatcatacatatagagacatggatcgcttggttgcatatgagatagcattgaatacatgggccaaatgggttgattacaatattgatcctacccgaacaagggtgttcttccaaggagtctctccagatcatcaaaatccagcgcaatggggtgagccaagagcaaacttatgtgaagggcaaactaggccaatattgggattcaggtacccaggaggaccactcccagcagagttggtattggagaaagtgctaagagccatgcaaaagcctgtgtatttgctggacattactaccctatcccaactaaggatagatggccacccgtctgtttatggctttggagggcatttggacccggattgtagccactggtgcctagctggtgttcctgatacttggaatgagcttctgtatgctagtctcgttaaaaattaa

SEQ ID NO: 104816 - DNA, 153 bp, Glycine max
  Peptide Sequence Number=SeqID_221594
atggcattgaacgagaaattaggggcaagtggtaacgagaaagaacaactcaccagtgacgacgacgttggggtgatactccggcgaaaggcggcgagggagctgaggctacggttccacggcggcggcgggggaggttctttgaacctttaa

SEQ ID NO: 104817 - DNA, 906 bp, Glycine max
  Peptide Sequence Number=SeqID_221595
atggtcttcagttcaagtcttgttattgagaagagtttctttcacatggtaattttagcagcttcaacatcattacttcttgcatgtaaacatatgaacaaccacaccacgaagggtgtgaggctcagacttgaaagggcatttagtggaatacacttgcaaggtagcaatcatcagagagagggggatattgaggaccaagctatagaagtaaaaacattagaacaagatggttccagacagttatataagaccaactttcagaagttcgatgaagaaggaggagaggttgaggcaagactctttcagaagcttgatgaagagctcaacaaggtcaatgcattttacaaggatcaggtggaagcagcccagcatgaagtaacccttttgagtaaacaaatggaggccttggttgcactaagggtaaagattatctcctcacctgaagagactatggatgaaagtcatcagcaaaaagattctatggttggacctgaagataatgctcttcaacaggccaatagaaatactcatcatgaggagcaagcagaagcaaacaataattacatcacaaaagatcccttggaaatcctacaacacgtaaaggttgataatgttcctcaatctccaatatcaacaattaaaaaagcttttactgattccagtgataatgaattgagcttcagcaaagaagagctgagaaaagttgaagagcaactgagacttgtgtttgttgagttctatcagaaactcctccatctcaaagattacagttttatgaacctctcagcattttccaagatcatgaagaagtacgaaaagcatacatcaagggcagcatctgcagcatacataacagtagtggataactcctatgtgggcagttctgatgagcttcaatcatga

SEQ ID NO: 104818 - DNA, 270 bp, Glycine max
  Peptide Sequence Number=SeqID_221596
atggatattattattggcatttttttttctggattggaagccacacatcacgagcttggaccacagacagaaaagaaagggaagaagcctgcggtaagtaagtgcaaagataagttccctttgaatcctattcctaaaagtaaaagctaccttgaagtaatttcataccaggtggaagccttgagttcattacatgatcttggaaaatggaaaggttctggcttctccacgcctttatttcgtgccaagagtttgatctcaagtctttag

SEQ ID NO: 104819 - DNA, 267 bp, Glycine max
  Peptide Sequence Number=SeqID_221597
atgggttttgaaaggccatctgcaccactaacaaacactccgacgaagcctggtttctttggaagtggagttttaagaattgatttcttgctcactgcattcttttcaggtggtagtgatacaaaaattgagactgaggagggtaaagaatccacacaacaacaaacttccatctggggaaaaaacgggggaaggatgttgatagtgagcggcaatcaaaagttgctaaggccaagggagatgtgtctgtgggcagtgcaatgttag

SEQ ID NO: 104820 - DNA, 600 bp, Glycine max
  Peptide Sequence Number=SeqID_221598
atggaactgaatggacttctttatactggtggggaggaccgaaatatcacagcatgggacattaagactggaaaaattgcatattgcttggaagaagcacatactgcccgtgtgaaaggtattgttgcactcacagagagtgatggtgctacaggggatgatgacccttacctagtggcatctgcgtcatctgatggcattatacgagtctgggatgttcgaatggctgctagagagaagccactaactgaacataacacgcggtcaagactgacgtgccttgctggatcatctttgaaattcaaacgacaacgaccccaggatggaaaaagtaaatcgaaggtggtcaaacaacagcgtgccctgtctggaaagagtaaatcaaaggattatgatactgataaccctccctatcccttgctcccctcattacacccaactactatatgttgcttggcttgggataccaacacaaaacttgcaagcccatcagctctcatacttagttttgcaagccttgacatgccaaaatccttccaaacttgtgtctaccttaatggtacttccattcagcttcatttggtgtcttggcaagtgtga

SEQ ID NO: 104821 - DNA, 441 bp, Glycine max
  Peptide Sequence Number=SeqID_221599
atggctgatccacgcatgaacacattttctcctatggccaaaatcgcttatgtgcatctctttcttgctatggctgccattcaacagtggcaatttcactacctggacatcaaaatgccttcttacatgtcagcttctcgtgcatggtttgaccgttttagctttgccttgcttcagtttggaatgacatgttgtgaggctgatcactcggtgtttttcatccattctctatctagtcgttgcatatactttattgtctatgttgatgatattgccattactggcaatgattctgagggtattcttcgcctcaaatctcatctccgtagtcaatttcagactaaagacacgggtccgctcaattacttcttagggattgaagttgttggatcgtcctctagcattgccatttcccaacaaaagtatgctctgatatcttaa

SEQ ID NO: 104822 - DNA, 120 bp, Glycine max
  Peptide Sequence Number=SeqID_221600
atggaaatcgttggaacttctagcaatggcagtgaggtcatcatagtaggaaatggtcatcagagaaagtttgtgataggagttgaggggaatttgttagtgaaggtgaaggtggtgtga

SEQ ID NO: 104823 - DNA, 303 bp, Glycine max
  Peptide Sequence Number=SeqID_221601
atgggaatgtcaagtatatgtgacactgatgaagggacagttggagcagaatatgattctagagaattaggagatggcaccactagtggaagttgtggacgtctgtggttagcggaggtgtaccaggagcaacaattgggttggcacaataggtggaacactagggtgaacctccaaaggaatatcttcaacagtggaactagagagggaaaaatgcataatctcaaagaagttaaggacaacaacaacaataacctttttgaagatgagagtaataaaagaaaagacactttatggacctaa

SEQ ID NO: 104824 - DNA, 339 bp, Glycine max
  Peptide Sequence Number=SeqID_221602
atggaaatgctgacttgcatgacaacgatggtgtggtcgtggtcgctggtgaacatggtttttgaaggcttcactacatcggaaagggaaggcggggtaaacggaatgaagtacatagagcctcatgatagtccttatccgtgtgtaccgatcccaccttcacagcacaaagtccccttttcctctggggtacaatgcggtagagaagggttgcgccggaaccttcagcatgcgcatgtttgcacgccccttacggaacaagatcaaactgaaactattaatgcggatagaaatggcatggacaactctcttgagctaatcaaggtaaataagggataa

SEQ ID NO: 104825 - DNA, 552 bp, Glycine max
  Peptide Sequence Number=SeqID_221603
atggcaaacccaacactacaagtcccgtcgtcgtttattgccccacatgccattgcattccctgcacgtgatgctcatgcgtcttcactagatcgacgcgtgatgccgatttcgacatacacattagcaatcctcctcgccacccttcctatactccggctaaggttgtgctggtcacttgacaacttaggtgaaggatattcccacctcagaacaatcccgtgggaagcaattgattcttcattgtgtaattttctctggttcactcttggtcctaatcttcaacaacaatttcaggcttttcttacttgttatgagatatggaataaggctaagaagttagtgaacaactacttcgcttctccactctgcgcgcctttgaatcatcctttgcacaaactggagattcctttactcttgtctcccattcttctaatcgtggtggatgagacaaaggttgtggtggtcaacgacattctattcgttgcaattattgcaacatttatggtcatattgaagccgaatgtcacaacaaggcttgtgatcaagtga

SEQ ID NO: 104826 - DNA, 648 bp, Glycine max
  Peptide Sequence Number=SeqID_221604
atgaaggtagctcccatcgtggttttcttgttcagagacacagagggtttcgcctccgccatctcacaagctctccatgccaacccttcctcctccttcacccgccaagaggacttcttcgagctctcattggaggcttatggaatcaaacatctcaaaacatctgggagcgtttctcacttcgttgatgatcacggtgcttacaaggtgacaattgtggctatggagcattatgagccaccagtactagcttgtgctcttaatgaggttaaagggcacagtaaatccctaagatcagatgaaagcaaacctttaatatttggtacaaagattggtcaaaatacagacataatgcaggccttactcaacaaaacccaggagccaccatcttctttgggggttcaacatgaaacttttgcatgttttcttcactttgttcatgtaatgcagttaccaaccttttttctaattggacaagctagtcaatatttggacaataaatccaccaagcagcatgagatacttcatgcaataggtgagattttggctagcactacaggtctgcagttttcagaagatagagtggtctggaatccgaaaaaggcatcaggggaaagcaaggagccatggcgtgcattatacggttga

SEQ ID NO: 104827 - DNA, 210 bp, Glycine max
  Peptide Sequence Number=SeqID_221605
atgagagtacaggttgggtttttaaattttcttggttttcaatttttaaaacttgttgacaattttgttattatcacggtggaagagtgttacctttccccaaataacaacacaacaccagcagcttcattaccgtccaattctgaaacttgtttgcaattacacggaggttggttctgtggcagcaacaatggcctcacgggagactaa

SEQ ID NO: 104828 - DNA, 252 bp, Glycine max
  Peptide Sequence Number=SeqID_221606
atgaggatcaaaaggtcttttaaggttgtaatggggccaaggacaaggctcatttggctagaggcttataagaacaaaatgcctaaatcatctcccaacatgcatgtgaagcaagaagtatcaacaagagtaaagccaaggctattgtgcaagcaatcaatggggcaaaacacaccgaataaaatagataatgatggctcaaattctcacaagggtaaatctatcactttcaattcgagctttcaaaactaa

SEQ ID NO: 104829 - DNA, 264 bp, Glycine max
  Peptide Sequence Number=SeqID_221607
atggttgaaattaactctcgtgatgcaatctgctttcaattgttcaacagctgggaatccgtgtttgaagaatgtcaaaagtgtcactttgacattgtccaagggaagtactatatacgagtgaaggatatgggaaatgaagaggccccttcagtccaagacgtgacagtcacgactaaatgcagctcccgcatcgttggatcagaagcagaccaccttaattatgtacatgggctgagtgccgacatcatcgatcgatcttaa

SEQ ID NO: 104830 - DNA, 928 bp, Glycine max
  Peptide Sequence Number=SeqID_221608
gtattacaggacaagctcgatcatccgtggtcggtggcgtttctgcccgaccagcaaaccctgctgattaccgaacgttccggacagctgcgcagctggcagccgggccgggggctatcgcagccgattagcggcgtaccggacgtgtgggccaaccgccagggcggtctgctggatgtggtgctggcgccggacttcgcgcaaagccgtcgggtgtggctcagttataccaccgccgatgacaccggccgcgcgggcggcgtagtgggttacggcacgctcagcgcagatctccgtcagctgcaggattttaaggtggtgctggagcaaacgccgaaactctccggcggtgccaacatcggcacgcggctggcgtttgatcgccagggctatctgtacatcgcgttcggcgataactttgccagccgcagcgcgcagcagctggacaaactgtcgggcaagattgtccgtctgacgcaggacggcaaggtgccggcggataatccgtttaaccatcgtcagggcgcacgcgcggagatctggtcttacggcgtgcgcaacccgcaggggctggcgctcaatccgtggacgcagcagatgtgggagagtgaacacggcccgcgcggcggcgatgaggtgaatctggcggcgaagggcaaaaattacggctggccgctggcgacgtatggcattgattacagtgggcagaaagtgccggaagcgcagggcagcgccgttgccggcactgagcagccgctgttttactggcagcaatcgccggccatcagcggcatggcgttttacaatagcgcgcgctttccccagtggaaaaactcgctgtttatcggtgcgctgaaagataaaagtctgatccgtctgcgcgttaacggcgagaaggttgaagaggcgcagcggctgctgagcgacc

SEQ ID NO: 104831 - DNA, 540 bp, Glycine max
  Peptide Sequence Number=SeqID_221609
atggcggatgaggggtgtcccgggagtcatattgttacaatgctctcatggatgagggagggctgcgagcagacggtttatacgtttactatacttatcagtgagcttttcaaggagaggaggaatgaggaggcgctcaagctgtgggatgagatgattgacaaaggtgtcacgccaaatttggcgtgttttagggctctttcgattggcctgtgtctttcgggcaaggttgcgagggcctgcaaggtgttggacgagctggcccccatggggattgttttggattcagcatatgaggacatgattgctgtgctctgcaaggctggtcgcgtgaaggaggcctgcaagttggctgatggaattgttgataggggtagggaaataccgggaaagattcggactgtgttgattaatgctttgaggaaagctggtaatgcagatttggcgataaagctgatgcatagcaagattggtattgggtatgaccgaatgcgtagtgttaagaagcgagtgaagttccaaacccttgttgatagttga

SEQ ID NO: 104832 - DNA, 2448 bp, Glycine max
  Peptide Sequence Number=SeqID_221610
atgcgtggcgatctggacagccgtccgattggcgcggtacttgatgaagctaaacgtctggtggaagccggcgtaaaagagctgctggtgatctcgcaggacacctccgcgtacggcgtcgatgttaaacaccgtaccggtttctggaacggttcgccggtgaaaaccagcatggtcagcctgtgtgagcagctggcaaaactcggcgtctgggtgcgtctgcactacgtttatccgtatccgcacgtggatgacgtgatcccgctgatggccgaaggcaaaatcctgccttacctcgatattccactgcagcacgccagtccgcgcatcctgaagctgatgaagcgtccgggcgcggttgagcgcacgctggagcgcatcaaacgctggcgtgaaatctgtccggagctgacgctgcgttccaccttcatcgtgggtttcccgggcgaaaccgaagaagatttccagatgctgctcgacttcctgcgtgaagcgcgcctcgatcgcgttggctgcttccagtacagcccggttgaaggcgccacggctaaccagctgccggatcaggttccggacgacgtcaagcaggcgcgttttgaccgcttcatgcagttgcagcagcagatctccgcagagcgtctgcaggagaaaatcggtcgcgagattatggtgatcattgatgaagtggatgaagaaggcgcggtcggccgcagcatggccgacgccccggaaatcgacggtgcggtctatctgaatggcgatcgccaggtgaaggtcggcgaggtgataatcgttatcggcgcgcagccggtcccagcacgctttgaatacggccgccgcagcggccttttctttttctaccgtccgcggcagctctttgccgtcagcaccgtatttccgtccgccctgatgattgctgtagcggcgcgcgcggctcgacggtgcgaaagcgccagtgcggcagaatttcgctcttataaggttccaccatcagcaccccctgctcgccgcgcccgacctgatacagctccggatgctgacggaaatgctcacatgttcaacaagatgaaaattgtgaccgccattgtggttattctggtggtattcacagccatgcaagccatatccggctcgctctttttctcctcgctgcgtgcgggacaacataatttcaccgccagcaatcagttgtctcatcagcagcgcgagctgggcgacggctggcaaacgctggtgaaaacccgcgtcaccatcaaccgcgtggcgatccgtattctgaaaaatcagaccgacgagcagtcgctggcggcgattaacaagctgctgctggcagccggtgcctcgctggaagcggcgcagcagcacttcaatcagtatagaagctatccgcgcatcgacggccagagtgcgtcgaccgccgatctgatcgacaataaattcaaagcgtttgccgcgctgctgcagcagtccgcggtgtttctgaaagccaataactacgcggcctacggcaatctcgatgcgcagcaggcgcaggatgaactggaacaggcttatcagcagtggcgcgatgaaaacatgcagctgatcaatcagcgcagcctgcaaaatgacagcaactatcagcaggtgctaatcatgattgccgtcatcgcgctggtggtggtgctgatggtggcggcggtatggacgctggtacgccgcgtgctgctggcaccgatgcagcaggtgcagcagcagatcgagcgctttgccgaaggcgatttgtcagccagcctgcaggtggcaggccgcagtgaaatggcggccattgccgccagcctgaatcatatgcagcaggcgctgctcggtaccatcaacaacgtgcgcgacagcgcggatgccatttttggcagcgccagcgccatcgccaacggtaataacgatctctcggcgcggaccgaacagcaggctgcttcactggaagagaccgccgccagtatggaacagctgaccgcgaccgtgaagcagaacgctgacaacgcgcgtcaggctacgcagctggcgaaaaccgcgtcggacaccgccgataaaggcggtaacgtggtggaaggcgtggtgaaaaccatgcgcgacattgcggacagctcgaagaaaatcgccgacattaccagcgtcatcgacggtatcgctttccagaccaacattctggcgcttaacgccgcggtagaagcggcgcgtgccggcgagcaggggcgtggctttgcagtggtggcgggcgaagtgcgcaacctggcccagcgcagcgcgcaggcggcgaaagagatcaaactgctgattgaaaactccgtgcagcgcgtggacctcggttcgcagcaggtcagcagcgctggcgataccatgcaggagattgtcagcgcggtgacgcgcgtcaccgatatcatgggtgagattgcctcggcttccgattag

SEQ ID NO: 104833 - DNA, 303 bp, Glycine max
  Peptide Sequence Number=SeqID_221611
atgacggcttcttcattgtcgacaacaacctcatgtgtctttgccatggagtctgattcaacaagctctaggttcaaatatattgtcgaggatcccgtgaaactggttgaaaaggacgatgcactgacaaccattgatagtgtagagtgtggtgacgatgccaaggtccaagtacaagatttggtagacagtggtgatggcacttgcgattatggcaatcaaaggcgtttcgaattagatttgatcgcttatggtggtttggtggtggtggtggacggccaacacacaatgggtcttgattag

SEQ ID NO: 104834 - DNA, 1719 bp, Glycine max
  Peptide Sequence Number=SeqID_221612
atgaaggcctcttccttcaatgggttttggattttgctgctcctcttccccgtgtcactgtttctaagctctgtttcagctttttctccaactgggtcgattcgccatcccgtcaagtttatcataggttcgtgtctctcattcgttgttatttctgaatatgctgatgggttatgtgtggatcttgggaaaggagaagaagaggagaatttgggttcatggaagagtgaactcacacaagtggctccagcaccggggcctaaaggtgaggatgttcttattctggcggcaaacaggaccaataggcctgacattctgcgaggattccaacgctatcgaggtggttgggatattgcagatcagcattattgggcttcagttggattcactggtgcagctggtttcattcttgctgtcctgtggtttatctcatttggcttggcgcttatgattcatctgtgctgtggatggggaattaacatcaaggacaaaggatcaaatcattcacagaggatttgtcttatacttcttatatcattcacttttgctgccgcgactggatgtatcctcctttctgttgcgcaggataaattccatggtcaagccttggataccctccattattttgtcaatcagtctgattatacagtgcagactctaagaaatgtcacagagtatctctcccttgcaaaaactatcaatgtcacccagattcttcttccatctgatgtcatggatggtattgacaagctaaatgtggatctaaattctgcagcagacacactttccgagaagacaaatgaaaattcagttaaaattcgaagagtattcaatgacgtgcgtctagctttgtatgttgtggcagctgtaatgcttcttctggctcttgttggacttgttctgtctgtccttggatatcgacatgcaatcctcatatttgttatcactggatggttactggttgcaaccacattcattctttgtggagtattcattatccttaataacgcaatttctgatacctgtatggctatgggagaatgggtagcaaatccacgcactgaatctgcactaagtaatgtcctcccatgtgttgatcagagaaccacaaacaaaacactctttcaaagtaaacaagtgatcaacaatattgcaagtgttgtcaatacattcatctttgccactgcaaacataaatgaaacacaaggtagtcctggctattacaatcagtctgggcctagaatgccatctttatgctacccttttgactctcagtttcaagagcgtcaatgtacagatcaagaagtttcttctgccaatgcttcaagggtttggaagaactatgaatgtgaggtatctgaatctggcatttgcaccacagttggcagggtgaccccccagatttatttgcagatagtagctgcggtgaatgaaagctatgcattagaacattacactccacctttacttagccttcagaattgcaattttgtcagggatgcattcacaaaaatcacttcaagctactgtcctccattaaaccattacctcaagattatcaatgtaggacttggcctcatttcggttggtgttctgctatgccttgttctctggatactctatgcaaaccgcccccgaaggagggaagtgtttgagaagtcatccttaccagaaaccaccacaaatttaccgttgtcaaatgcaaatagtgaagtatag

SEQ ID NO: 104835 - DNA, 357 bp, Glycine max
  Peptide Sequence Number=SeqID_221613
atggcttgctctctatcatctttctgcgccttaaaccaagctttttgcagggataagcgcatcaaataccccaaaataagatcccaaagctttaatgatgacaatgggaagcgagcaaacattgttgatgcaaacctgaacatcctaagggaaagaattcaacaagtgagaaagagagagaggctgatacatacacaagagtggaattataagcgtagttatgaccgtaagtacaagagagattcaatgatatcacaatcttctgaggttataggtttgtcatgcggtgcaattgggcttgtctttctcgttggttctcttagcatcttccttctgtccctccttgtatgcatgtga

SEQ ID NO: 104836 - DNA, 300 bp, Glycine max
  Peptide Sequence Number=SeqID_221614
atgccaaaacccgacatagaagactatggcgattttatgagggggaggaagaagaagcctaaagcacgtaaaaacacgttgctccaccggtttaggaacaagagaggcttgttcgtcactgatgttaccaagacagaatggtgtgaaaggcaaatggagttttttcttttctctgaagagtggaagaacattgaagccaagaaaatggattttggaggaggaaggaggaacaatgaagccatcaaagctggtagagatcgacatgttcaacttgaacaagaggttcacgctagcgtgtag

SEQ ID NO: 104837 - DNA, 387 bp, Glycine max
  Peptide Sequence Number=SeqID_221615
atgaagtttctggagtgttctgctttagatcggcttaacgatttcttgggtaatttgaatctgggagaacgtactatcaaaggatgccttgaagcctatagttgtaaggaggaacaaattcttgattatcttgggaaatcatccgacactgattcctcctcaccagatcaaaccttattaaccagaaacagccgaaagacattggtttacctggttcttaccctgtatcacatgtatcccgattatgacttcagaacattatataatgcaaaatacaccgcgtgttcattcttccctttaccctcttcatcacccatctaccgcagagagttttacagaacttgtttgtggatttgctatacacatgggatgccaagaggtgcctaa

SEQ ID NO: 104838 - DNA, 900 bp, Glycine max
  Peptide Sequence Number=SeqID_221616
atgggggatcactttgagttgctggttgatcgattgcttactgagtccacattagaagctgcacttgaaagcagaaataggtcaatactggctgcatcctctgcggggaatgatgcaaaaattgatctcaatttgatgaagatgggtgtggatgatatcaaatttccagggaaggtggtagaatgcaggatatgtcatgatgatgatgaagattccaatatggagacaccctgctcttgtcgtggtagtttgaagtacgcccaccgcagatgtatacaacgatggtgtaatgagaagggtgacaccacatgtgagatatgccaccagcaattcaagcctggctatactgctcctccaccactatttcagtttggacgtattccaatgagttttaggggaaattgggagatttcaagaagagatttgaatagtactcatttgttcatggttcttctgattttaagacatacacttccccttgtaatcagtggaaacaaggagtattctttcccactctttttgctgatgttatttcggactgcgggagttgttcttcctatatacttcatggttagagcagttgcattaatccagcggcatcggagacaaaatcgagagcatcttaatgcctcggccagttcatctgacgatgaaagtgagcaagcagatttgcagtctcagcctcagcctcatgtcatacatatggggacaacttccccgagaacctcgagtttgctaagggatggggacactgaaatccagatgtgcaacagttgttgtagctctcataagaggcattgcatgccacttgtgttaccaagtccctttgctataacctactcttcgggaagtcttggcagcagcaagttatacatttacatttctgtttctgcttactga

SEQ ID NO: 104839 - DNA, 1020 bp, Glycine max
  Peptide Sequence Number=SeqID_221617
atggcgtactcagtcccgctcctcctcctcatcctcccgttcatcttcttctctttcggtcgagctcttccgcgcgaagccatattcgacgccgccgacgttctctccgattcggggtacgtttccatggccctcacgctcgaaatcgtcgccgaaacccttcttgagcagtccccttccgccaccgtcttcgccccctccgattccgccttcaagaaatccggccagccctccctcgatctcctccgcttccacctttccccgctccctctcccgccggcgagcctccgtctcctcaccgccggctccaaaatcccgacgatgctccccggccagactctcaccgtcaccacttcctcctccgatcgcgtaacctcgttcaacaacatcaagctcaccggatctcccatctacgacgacggtattctcttagtctacggaatcgataggttctttgaccctacctttcagttcaacagtcaaagacctagtgataattccgatacctcttgttccgcgaagaaccacaccgcgagtgcctccgattccttcgatcaagccatccaaaccctaaaaaccgggggatactccgccatggcttcgtttctcgggatgcagctctccggcgtggcggatcagagcgggatcacggtgttcgctccgacggacgacacggtgatgagccgcatcggcgatttcggtgagtatccttcgttctttcggcgccacgtcgtgccgtgccggctcctgtggaacgatctggtgaatttcggcgacggatcggagctgccgacgttcttggatggattcgccatcaacatcaccagatcggacggcgttttgattctcaacggagttccggtgttcttccccgacgtgttcttcaatgacagggtggttgttcacggcgttagtgatgtgctggctgcacaagacagcgccattaaggacaacgcgcttcgcattgatgatgatgatgatgatgatgatgaaatcctgtttgacccttctgaattttga

SEQ ID NO: 104840 - DNA, 1231 bp, Glycine max
  Peptide Sequence Number=SeqID_221618
caccgcgcagaaggtattgcagtttacccagcagcagctggcgcaggtaggcgtgaaggtaaaagtcacggcgatggatgccggccagcgcgcggcggaagtggagagtaaagggcagaaagagagcggggtgcgcatgttctacaccggctggtcagcctccaccggcgaagccgactgggcgctgacgccgctgttcgctaccagctcgtggccaccggcgatcttcaacaccgcgttctacagcaacccgcaggtggataaagacctggcggatgcgctgaagaccaccgatcgcgaccagaaagccagactgtataaagacgcgcaggaccgcatctggaacgatcacccgtggattccgctggtggtggagcagctgctgtctgcgaacaataaaaacctgaccggtttttacgtcatgcccgatacctcattcaattttgatgaggcggagctgaatgctggtgttcctgttcgtgcatctgctgccgggcgatccggcgcgcctgattgccggaccggaagcggatgcctcagtggtggcgctggtgcgtcaggagctgggactcgatcagccgctgattcagcagttctggcactttatcctcaatgctttgcaggcatggtgtgggcggtggtgtttggcatggcgatcggcatcgtttcggcggtatggcgcaatcgctggccggaccgcatcggcatgacgctggcggtttccggcatctcttttccggcgtttgcgctgggcatgctgctgatgcaggtcttttcggtcgagctcggctggctgccaacggtgggcgccgacagctggcagcactacattctgccgtcaattacgctcggtgccgccgtggccgcggtgatggcgcgctttacccgcgcttcgttcgttgaggtgatgcaggaagattatatgcgcaccgcgcgtgccaaaggggtgcgcgaatcgctggtggtggtcaaacacgggctgcgcaatgccatgattccggtggtcaccatgatggggctgcagttcggctttctgctcggcggctcgattgtggtggaagtggtgtttaactggcccggactgggccgtctgctggtggattcggtggagatgcgcgattacccggtgattcaggccgaggtgctgctgttctcgctggagttcattctgattaacctgatcgtcgatatgctttacgcggcgatcaacccggctattcgctacaggtaa

SEQ ID NO: 104841 - DNA, 1294 bp, Glycine max
  Peptide Sequence Number=SeqID_221619
cgtcaaaacgcgtccattggatccatcaacgcacgccaaaaatctcgtctttttgcgtttccgttggtggcaccgacattgggtaacagtgtgatggtgaaatcggagattgagaagaagggttgcagcacaagacaatggctttggctggtgatggctctcgtcgctgtttttgttgccatggccatgtcttccaaaacctctccaaaagctctgtttggagccattgatagagcttgtccgtgtgctcggggcacaccgaagtacagtggcatggtggaggattgttgttgtgattatgaaactgtggatcgtcttaatgaagaagtgttgcacccttccctccaggagctcgtgaagacccctttctttcgatattttaaggcatttcagctactttctaagtgtggcgtggatgttgagtgcgtcactggtcgctggtggacactaccgtacaagcatcatgcagttgctgatgaggcaaccaaggatgagcatcatgcagtgcctgccataagctcttacctcttagtgaagttatggtgtgactgccctttctggcctgatgatggcatgtgtcggttgcgggactgtagtgtgtgtgaatgccctgaaaatgaattccccgaatcatttaagaagcctgaccgtcgcctttcaatgactgatcttgtttgtcaagaaggaaaacctcaggcagccgttgaccgtactttagacagtaaagctttcagaggatggacagaaatagacaatccatggacaaatgatgatgagactgacaatgatgagatgacatacgtgaatcttcaactgaatccggaaagatatactggttacactggtccatctgcaagaaggatatgggatgctgtctactctgagaactgccccaaatattatctggaacaggcagagtatgatactggtaaccccaatgaggaccttacaacacaatccttgataaaacagctactttacaaccccaagcttcaagctgcatgtccaattccatttgatgaagctaatttgtggaaagggcaaagtggacctgagctaaaacagaaaattcaacaacaattcagaaacatcagtgcattgatggattgtgtaggatgtgagaaatgtcgattatggggtaagcttcaggttcttggtcttggaactgcattaaagattctcttctctgttgatggtcaagaaaactcgagtcatacagagaaacttgaggaatctcaagaaattgctagagatgttgttatcactgtcggagcatacgtgaacctgcttagag

SEQ ID NO: 104842 - DNA, 219 bp, Glycine max
  Peptide Sequence Number=SeqID_221620
atgagcctattagattgcccacaaaaaattgatatgggcttaatgagcggaaaccagtttggcctattaggggataatgggaaccctaataggttaaaacctaaggcatggttatggttcccaatacaccaaatcaagaaacagtttctcctctccccatctgaagaaaatgaaggtcccataaaggaagaaggtgatttggttgaggaaggtcattaa

SEQ ID NO: 104843 - DNA, 586 bp, Glycine max
  Peptide Sequence Number=SeqID_221621
atggtatatatgctttttgaagatgataaagtctttgtggaagaggtgagagttgagacaagaaataatggaaagttagagatatgcagattggagacaagccttggatgggaacacgtggattttgcccaagtacaaagtttctacacagccttaaaaaaacttcgtaccccattgcccagagactcttcgctatgcgaaggtggtatgggagagggatgttgtacgcagccttacccttgcatatgcaaagaggctgtttccggattcgaacccatgaccaacaggtcaccaaggcacaactttaccgctgcaccaaggctcgccctcaaaactgacctgggggaatggaatcgaggagttgaagagcaagatcggattcgtgttgcaacttggagattctgtcatcgggattgggtgggaaataagtgtctcgaagatggtaaagatcttctgctgctcttgcagctctggataacggttcttcttctctgggattactcatctcactcactcactgaagaagaagaagaagaagtagaagacagtgatggatgcaattgcaaatgcacccgtgtgtactatg

SEQ ID NO: 104844 - DNA, 1395 bp, Glycine max
  Peptide Sequence Number=SeqID_221622
atggaattagatgaaattagatggcttgcccaattaaaagaggcagaagaaagatttaaagaaaagaatcaaatcttaactcccaagatccaaagggtacctcttttgttgcgacaaaacaagaagtttactaagtactgctcgccaaagctgatatcacttggtcccatccatcacaaccacaaccacaacaatgaaagcctgaagctaggagaggattataagcttttatggacatcaaagtttgtcacgaaataccatgaaaacatcaatgaagataccaaccaagtggcccaatttttgcttaaaaggataaaagatgatatcaaagaattgaaaaacttgtttgatgaggatacaatattattaggatggaagagcaatgacaattacctcgcttggatgttatttgtggacggatgttctttgctctatttcatggagaatattgacatgcagcatccagaagcactaaaccttgagcttgaccaattgatgcaaatgtggagagatatgtggctgttggagaatcaacttccgagaaaattgcttgaaatgctaagcaaaaagaaagggagtgacttggatgatttgttcctcaatttttgtgtcttgggtgaatccaaacgatatggaaacgtggtggtctcaattcacaatcataaagcaattcacatacttgattattatcgctcaatattgattagcccacataatcacatggaggtaaatactatatccccataccaagatgaagggaataatgaacagcaccatgatgttggttggtatacttacaaaaacatacgagatttgaaaagaatagggattcaagtaaagcctcctaattcccctaggggaaactcaattgcatggagtaatattcgtttcaactctaaatggaatggaggagaattgaggcttccaatattgatgttcaatgacgttacaccttatatatttcggaacctcatagcgtacgagatgtgtccagatgtgcattgcagatttgaatgttgttcgttcttttccttcatggactcattgattgacaatgcggaagatgtgaaggaacttaggttaagtggtgtaatacaaaacatgctgagaagtgacgaagacttggccaatctcattaacgaattgggcaatgatttgccaactaacctgttctttgacaaattccactcccgtgccgtgacctttagcgagaaatatattaaggtgaagacccaaattgaaaagcattactcaaacagatggaggagatggttagctacaggctacaatacttatttcagcaccccgtggtctataattgcctttttggctgcattacttgcattagttctctcttttctccaaacttggttcaccatacatcccaataaatga

SEQ ID NO: 104845 - DNA, 897 bp, Glycine max
  Peptide Sequence Number=SeqID_221623
atggattcattgatcgacactgctgaagatgtgaaggagctccgactaaatggtgtatttcaaaacttgctcgggagcgacgaagccttggccaatttctttaatgaattgggtgatgatttgccaactaaaatgtactgtaacaatatctccactgatgtcgtggccttcagcaagaaatatattgcagttaagcatcaaattcaaaagcattatagaactagatggaagacatggttggctgaagtttacaacactcatttcaataccccatgggacattattgccgtttcggctgcgtcactcattaaccctcacttttatccaaacctggttcgccatacatcccaaatgattgataatgcaaaaggaatagtctcagataatgacaacagaaagaatattatctttatcctacaagatgtatggatgaacactattgctgcttatagtagccactttggtgaggcggagggtatggagatggaatggtataaggaggccgaggaacagaaccaggttgttgtgcttgtgcattgtagtatggaccacgccatccgggatatgctggttggccatactcatggtttggcggtggctgatgatgaacctgagcgggtgggtatggcgcagttgatgatggtggaatgtggtatggaggtggaggctgatgatgttgtgcaggactaccatatgggggagggggatgatggccataggtgggaattggtggctgctcaactggctgctgctgataataaggtgtttggggacgaggaggatctggtgagagcaggagatggcagacaacaaggatgtaaggaaggggtgcagaggagaagggagaatgcaagggacttaagtttaggggtgttcacgggtatgggtcatccgtaa

SEQ ID NO: 104846 - DNA, 828 bp, Glycine max
  Peptide Sequence Number=SeqID_221624
atggtatcagagcctgttctacccggtggtgtggatagtgccgctagccctcgctttgtggtgacgagtcctggctcgagggagtgtgttgcaagtcccacatcgggtgataatcttggaaatgcatgccttacaagtttttttgtcaccggagcttgggatcataccaaacttttacattctttaaaagcatatcaaaatgctgagaaagatgaaagcatgaagtccaatccagatttattttttaatggtgctactgttaacaaatatctagagaactaccagagggcccttagtggatttgaggctgctgctttaaaggatccaggtctcaatgctgtagaggaggttcagaagatagtcaatttacttgacaaggtggacaatcttttgaagggacatgtaagagctaagcgaatggcatctttggcatcatcattggttgctgttgatttgaaatcatcatacagaagagttaccatagaccttttatcagagggtccaaatagagctcttgcacttgaagggaaagtttttttctttgttaggagtgagagcgttgctcccctatactatttgctttgtgattcaaatcaatcttgctttgtactctcgatttatggtgtacgtactgatgtgattaaagaaggagatcagctaacattgcttgacccttattttcgtgatgttgatttgtcctggaaggagaagcgttaccagttcaaatctatacgcctggatttctatgaacaagtgcttgtaaatggaaaagctttgactcctcaacaagctattcgtacctcaatatatgctcaacataaaccctga

SEQ ID NO: 104847 - DNA, 207 bp, Glycine max
  Peptide Sequence Number=SeqID_221625
atgagggccatatttctccccaagaaaagtgaatatgcgatttatggagacaacaaacaaaggccacttgatcaacaaccccaacaagtaatatcaaatgataccaacagaagttattggaagttgaaagttaaaaatggaagttggaagttggaagtggaagttactggaagttggaagttggaaatgaaagttattggaagttga

SEQ ID NO: 104848 - DNA, 615 bp, Glycine max
  Peptide Sequence Number=SeqID_221626
atggggtttatgaactttcaaagaacgcactcacgagcaagggaagcgactagtgagcgagtagagtttctgcttctactttacaagattacaatttacaaggttttacgctctctccctttgtttgtcacgcacaccaacgagctcagttacatttcagcaagtcaaaatttcctccagaaagttgctcgtgtaatggatataatctctcagttacaagaacaagttaatttgattgcacatttggcttttaatacagttgggacattgcaaagggatgcccctcctaatcggctgtcgccaaattatcctgaaccacctgcgcatgctacagaggatgggtcaaatttttcagaacagccaaagctgatgagtactactttggtgaaggctgctaagcagtttgatgcattggttgcggcgcttccaatatccgagtcaggtgaagaagcacagcttaagaggatttcagaactacaagctgaaaatgatgcaataggcctagaacttcagaaacagttggaagctgcagagaaggaattgaatcaggttcaggagctgtttaggcaagcatcagataattgtttgaacttgaagaaaccagatgacagttag

SEQ ID NO: 104849 - DNA, 1734 bp, Glycine max
  Peptide Sequence Number=SeqID_221627
atgaagtcaaagaaggcaaatcctaaggaactgaatccatatctgaaggataatggaagtggttacccggaagaaagtggagctaaagttggtgctgaccaacttctatcttcttcccttgttggggatggaggagcaagttggagacttaaagccttaaagcgtgcacaagagcaagcagctcgagaaggacggagattcaacgaggttgtggaagaaaggtggagttctcttggtgagttgactgcagctgttgcatctcatgcagctgccccagctcgtgctcatctgcgtgctataaaaaatagacaaagagggataactgaagaaaattcacaagattctgataagcttggtcgaagggattctaaaagggactacttaaaggatgtttctgttcggcaccatgaaatgaaagcacctaaagttcaagattctttgtcttggggaaagcgaaagagccaacaagtggtagctgagggtgccggggtcatctctgctgcagtatctagcctaaataagtttgccaatgatggaaactttatgcatgattttggtagcaagatgagtaataattctgatggctctgttttagaaagtagtgaattagaaaaggtttcgttggaagcaaacacacctggagaaagaagtgtggtagtcaagaatgagatgagtgaaaaccagttggcagctaaggttatgcaacttcgtttgaagggaaagcatgaagaagctgacaaactgatgcaagaagcaaaagttatgaacacaaagcaaggaaatcaagatcattcaattagatcaggaactgagggaagttctagcaggtatgctatgcagaagatatcttctgagcagaagaaaggagaggatgatggtgatatgcatcttgctcacaagatcatgcagaacaagcagtttagggcttctactcaggctgatgatgaatatgactttgaggatggtccaagcagaaagagtagaaagaagcaaggaggtgatgatcacaagagtatccaaaagaagacaaatcgattcttgactcagcaagagcgctgcctattttgtttagaaaatccaaatcggcctatgcatcttgttgtttcaatcgcaaatttcacatatcttatgttgccaaagtggcagcctgtggtgcctggtcattgctgcattttacctattcagcatgaatcagctacaagaactgtagacgataatgtctggacagaaattcgaaacttcaagaagtgcctaattatgatgtttgctaagcaagagaaggaggtggtgtttcttgagactgtgatgggattggcacagcaacgaaggcattgtatggttgagtgcattcccttacccgaagatattgccaaagaggctcctttgtactttaaaaaggcgattgatgaagctgaagatgagtggagccagcacaatgcaaagaaacttattgatacaagtcaaaagggactgcgcaattcaatacctaagcactttccatattttcacgttgaatttggtctaaacaagggttttgtccatgttattgatgatgaaaagcagtttaacatcagccttggcttgaatgtcataagaggcatgctacatttggcagaggaggacatgtacaggcgacggcgctacgaggctgtggaggtacaaaagcaagcagttgaaagcttttccaaagagtggaaacattttgactggacaaaacagcttcatgaaacttaa

SEQ ID NO: 104850 - DNA, 216 bp, Glycine max
  Peptide Sequence Number=SeqID_221628
atgccagccagtccagtttataacattgaagccaggccaacccatgggtatgggtatctttgctttatcttggatggcaaccatcaccagctgacaaggactaatccctctgcctcctatgtgtgtcagagtaatcttccaccctcctatgatatggagaacgagatcgtcctcgccggtcccttgaatggtaacctctatcctgccatcgcttag

SEQ ID NO: 104851 - DNA, 330 bp, Glycine max
  Peptide Sequence Number=SeqID_221629
atgagctttgaaacaaggcttgggaggtacgtattgcacgccatgaagaaagctaagaattgcaggctgagatgcttgatactcagcaaagtcaatgaaataattatggagtatcaaaaaatgatacaacagtgctcaaaaatccattttggtcagaagttcttcaatatcttatcagcggatactccatcagcaacaagaattgatgtcacttcctgcaacaatatattcaagggtcatgcattggaaccacgagataaagaaaacgctagcaacacaatatttgacgttctgttgctgagtgaaaccgcatttgacctcactaattaa

SEQ ID NO: 104852 - DNA, 414 bp, Glycine max
  Peptide Sequence Number=SeqID_221630
atggaaaacatagcaaacgccatcgacgatcagaatctaaaaggtcatagaaagcaccagaaacatcacaagcgatcacataatgtggagctgaggtcatctgattctgattatcatcacagtcatggtcaaagaagcagatcaaagtcattggaagaaaattctgaagatgaaagcaaaagatcaatgcataagaagtctgatcgccaccaccaccatcatcgccaccaccaccatcatcatcacaaacatcggcaccacctggatgatgagagaaatcacatgcaacaacactcccctaaattcaatggaaagcatgatgagaagttagacaaaactgaaaccgataaaaaggatggtggtcatcatgaaagtagagctatggtcgagaataatgatggtcaaattgtttga

SEQ ID NO: 104853 - DNA, 1326 bp, Glycine max
  Peptide Sequence Number=SeqID_221631
atgaattcaccgcggaagggcacgatcaggcaggtctgccaggtcattggtgtcgtcatcaatgtcagattcgacgagggtttgccttcgatgatgaccacgctagagtgtttgcattctattcaggttccagttggtagggctacccttggccgtatcataaatgtcattggagagcctattgatgccaagggagaaatcaatactgagcattatttgcccattcatagagaagctcctgcttttgttgagcaagaaactgcacagcagattcttgttactggaatcaaggttgttgacctgcttgcaccatatcaaagaggaggaaagattgggttgtttggtggtgctggtgtaggaaaaactgtgcttattatggaacttattaacaatgttgcaaaagctcatggtggtttctctgtgtttgctggtgttggagaacgaacccgagagggtaatgacttgtacagagaaatgattgagagtggtgtcattaagcttgatgataagcagagtgaaagcaagtgtgctcttgtgtatggtcaaatgaatgagccccctggtgcccgtgcccgtgttggtcttactgggcttactgtggctgaacacttccgtgatgctgaagggcaagatgtgcttcttttcgtagacaacattttccgttttacccaagctaactcagaggtgtctgctttgcttggtcgtatcccatctgctgttggttaccaaccaaccttgtctactgatcttggagctcttcaagagcgtattacaacaaccaagaagggttcaattacctctgtccaagctatctatgtgcctgctgatgacttgacagatcctgctcctgctaccacttttgctcacttggatgccacaacagtgttgtcacgacagatctccgagcttggtatctatcctgctgttgatcccttggattctacatctcgtatgctttccccccttattttgggtgcggatcactacgaaactgctcgtggtgtacagaaagtgcttcagaactacaagaatcttcaagatatcattgctattttgggaatggatgagctcagtgaagatgataaattgactgttgcccgtgcccgtaagattcagcgattcttaagccagcctttccatgttgctgaagtcttcactggtgccccaggaaaatatgttgagttgaaggagaacgttgccagcttccagggtgtgttggatggaaaatacgatgaccttccagagcagtcgttttacatggttggcggtattgaggaggtcattgcaaaggccgagaaaattgctaaggaatctgcagcgtcttaa

SEQ ID NO: 104854 - DNA, 535 bp, Glycine max
  Peptide Sequence Number=SeqID_221632
atgacgataaaagataattttattttctcaatcgctgaatgtgatgtcctctgcaaaaacaccaaggtttttactttctactttaatgatgcaaaatcttatagctctatgttgttaacttgttctgctaggtctgcttcgccttctcctgttagaagccgtcgaagtcgatcaaagtcattatcaaggtccaggagaagtcgttccaggagtcaagattctgctgatgtggagaatcctggaaataatttgtatgttacaggcttgtccacaaggataactgacagtgatcttcacaagtatttcagtaaagagggaaaggttgtcgactgccacttagtaaaagatcctcatacaaaagaatctcgtggatttggttttgtaactatggaaactaatgatgatgctgagtgctgtatcaagtatttgaaccgctctgtttttgaaggtcggctgataactgtggaaaaggcaaagagaaatcgtggcaggactccaactcctggcaaatactgtggtccaagagataagcggg

SEQ ID NO: 104855 - DNA, 519 bp, Glycine max
  Peptide Sequence Number=SeqID_221633
atggagtttaagagtagacttcttgagaatgtcactagtaacttgatggttaatggcagaaattggtgtatgatttttgctgtggctttgaactacatttggagatatagaaacaaaggaatctttgataataattccttgttacagctgattgatattgcaaatcagattttgctccaggttgatgctatctcaattgttaatcctgtgactagctctagcattcagtggttccctcctccaacaaatcagttcaaattgaactgtgatccagctgttcatacagcttcgagaaagccagcagctggaggagtccttcgtgatcacactggattggttttattccccttcgttgcggacattggttgctgttctgttttggcagccgaactttgggcaatttttcttggcttgcagcttgcttggagtcgtggattcaaggagttcatagttgagtcagcttgctggtcattgagcttattaaggagtgtcccgatactcatccttgtttcatgttga

SEQ ID NO: 104856 - DNA, 1437 bp, Glycine max
  Peptide Sequence Number=SeqID_221634
atggaagaaaatctaataataacaaaacaaagtgagaagcagagagttacatgggatggtttgggtgaagaaatgaagaggatcattcgagtagcagggcctatggtgtttgtgtatgcttcccagaatctgttgcaggttgtgtccatcatgatgattggtcatctcaatgacgagctttttctttccggcgccgccttagccatctctcttgccaccgtcactggtttcagccttcttacgggaatggctagtggacttgaaactatatgtggacaagcttacggagctcgacaatatcaaaaaactggagtgcaaacatacactgctatattctctctcacatgtgtttgtcttcccctgactataatttggatcagcttggaaaatatactagttttcataggccaagaccctctcattgcacacgaagcaggaaactttataatttggcttcttccagcactttttgcatatgcaattctgcagccgttagttcgatattttcaaatgcaaagtctgcttcttcccatgcttgcaacttcttgtgtcactctttgtctccacatacccctttgttgggctttggtgttcaagactgaactgagtaatgttggtggagcattagcaatgagcatttcaatatggttaaatgtgatttttctcgtattatacatgagatactctcctgcatgtgaaaaaacccgtgcaccagtgtctatggagctgttccaaggaatttgggagttttttcgctttgctatcccttctgcagtgatgatttgccttgaatggtggtcatttgagctgcttatcttactgtctgggttgttaccaaatccacaacttgaaacttcagttctatccatttgtctcaacaccatttccacactctatgcaatagcttttggaattgctgctgcagcaagcacaaggatttcaaatgaattaggtgcagggaatccacattctgcccgtgttgctgtgttggcttcaatgtcttttgcaatcatggaggcaactataattagcggaatcctctttgtctgtcgccatgttttcggttatactttcagtaacaagaaggaagttgttgattatgtcactgttatggctcctctggtttgcatatctgttatactggacaatatacaaggtgttctcgcagggattgctagaggttgtggatggcaacacataggggtttatgtgaatctaggggcattctacctctgcgggattcctgttgctgcatcattggcatttttggctaaaatgagtggaaaaggactttggattggtttacaagtcggtgcctttgttcaatgtgctctactttctaccgtaacaagttgcacaaactgggaacaacaggcaatgaaggcaagaaagcggttatttgatagtgaaatttcagcagaaaatatactggtatga

SEQ ID NO: 104857 - DNA, 534 bp, Glycine max
  Peptide Sequence Number=SeqID_221635
atggcttcacgcaggctcgtatcttctctgattcgatcctcccttcgtagatctcaatcgaagccctcaatttccgcatcgacatcgaggctcacgtcatccaaccgtgcctcaccgcacggatacttgctgaaccgcgtcgccgagtacgccaccgccgcggctgctgctaccactcctccctctcctcctcctccggggaagaaggagctcggcggcggcgggaagatcaccgatgaattcaccgggaagggcgcgatcgggcaggtctgccaggtcattggtgccgtcgtcgatgtcagattcgacgagggtttgcctccgatcatgaccgcgctggaggttctggatcactcgtcgaggcttgtgttggaggtggcgcagcatttgggtgaaggcgttgtccgaaccattgctatggatgccaccgaaggtgtcgttagaggctggcgcgttctcaacatctggctcccctattaccgtaaatacctaataacttgttttttattattagctcaaccttgcatttggtga

SEQ ID NO: 104858 - DNA, 1191 bp, Glycine max
  Peptide Sequence Number=SeqID_221636
atggctagtggactggaaactatttgtggacaggcttatggagctcagcaatatgaaaaagttggagtgcaaacatacactgctatattctctctcacagtcgtttgtcttcccctaactttcatttggatcagcatggaaaagatcctagttttcataggccaggaccctctaattgcacaagaagcaggaaaattcttaatctggcttgttcccgcactttttgcacatgcaattatgcagccgtttgttcgatattttcaaatgcaaagtctgcttcttcccatgcttataagttcttgtgtcactctttgtatccatatacccctttgttgggctttggtgttccagactggaatgaataatattggtggagcattagcaatgagcatttcaatatggttaaatgtgacttttcttggattatacatgagatactctcctgcttgtgcaaaaacccgtgcacccatttctatggagctgttccaaggaatttgggagttctttcgctttgctatcccttctgcagtgatgatttgccttgaatggtggtcgtttgagctgcttatcttgctgtctgggctgctaccgaatccacaacttgaaacatcagttctatccatttgtctcaacaccattagcactctcttttcaataccttttggaattgctgctgctgcaagcacaaggatttcaaatgaattaggagcagggaatccacatgctgcccatgttgctgtgttggctgcaatgtcttttgcaatcatggagacagctatagttagcggaaccctctttgtctgtcgccatgattttggttatattttcagcaatgagaaggaagttgttgattatgtcactgtcatggctcctctgatttgcatatctgttatactggacagcatacaaggcgttctcgctggggttgctagaggttgtggatggcaacacataggggtttatgtgaatctaggggcattctatctttgtgggattcctgttgctgccacactggcatttttggctaaaatgagaggaaaaggactttggattggtgtacaagtcggtgcttttgttcaatgtattctattttctaccataacaagttgcataaattgggaacaacaggctatcaaggcaagaaaaaggttatttgatagcgaaatttcagcagacaatagactcgtataa

SEQ ID NO: 104859 - DNA, 504 bp, Glycine max
  Peptide Sequence Number=SeqID_221637
atgtcttttacaatcacggaggcaactatagttagcggaaccctctttgcctgtcgccatgtttttggttatattttcagcaatgagaagaaagttgtagattatgtcactgtcatggctcctctaatttgcatatctgttatactggacagcatacaaggtgttctcgcaggggttgctagaggttgtggatggcaacacataggggtttatgtcaatctagtggcctactatctctgtgggattcctgttgctgcctctctggcatttttggaaaaaatgagaggaaaaggactttggattggtgtacaagtcggtgcttttgttcaatgtgttctactttctatcataacaagttgcataaattgggaacagcagctaattcttagtcttgctaccattttgattttgcttaataaagttgaatgccctgttgaggaggcaatcaaggcaagaaagaggttatttgatagtgaatttccagcggacaatagactggtatga

SEQ ID NO: 104860 - DNA, 1326 bp, Glycine max
  Peptide Sequence Number=SeqID_221638
atggagctgttcaaaggaatgtgggagttctttcgtttcgctatcccttcagcagtaatggactcttaccaaatccacaacttgaaacttcagttctgtccgtttggtatcctcaacaccattgcaactctctatacgataccctttggaattggtgcagcagcaagcacaagggtttcaaatgaattaggagctgggaattcacatgctgcacgtgttgccgtgttagcagcaatgtctcttgcagtaattgagacaagtatagtaagtgcaacactcttcgcctgccgcaatgtttttggttatattttcagcaatgagaaggaagttgttgattatgtcactgccatggctcctctggtatgtatatctgttatactagacagcatacaaggtgttctaacagggattgctagaggttgtggatggcaacatttaggggtttatgtcaatctaggggccttctacctttgtgggattccaatggctgccttattagcatttttggtgcgattgggaggaaaaggactatggattggcatacaaagtgccttgaatggtggtcatttgagttactattcttgctttctggtcttctaccaaatccagaacttgaaacttcagtcttatccatatgtcaccacaacaatctacacaatcccagaagcaattggctcagcagcaagcactagagtttcaaatgcattaggtggtggaagtccacaattggcacaagtgtctgtttctgctgctatgactcttgcagcatccgcggccattctggtgagctcaatcatatttgcttgcaggcaggttgtaggttatgcatttagcaatgagctggacgtggtggattatttcacagaaatggttcctcttttaagtatatctgttatactggacaccttacatgataccctctcaggtattgctagaggatgtgggtggcagcacagaggagcatatgtaaaccttgacgcttattatgttgtgggaattccaattgctgctatattgggtttctgcctacaattaagaggaaaaggcctttggattggaatactgactggtgccttctgccaaacagttatggtatccctcattacaagttgtacaaactgggaaaaacaggcaattaaagcatgggaaaggatatttcagagaaattttgctgtagaagatggattagttttagcaaatggagaagattccttaaatctgtcagcttcttttgttggtattggtaaatcgtttagctttggtggcagaaaagatcaaattttagagttagaggaggaaaaggttctcatgacaagacatttgtaa

SEQ ID NO: 104861 - DNA, 177 bp, Glycine max
  Peptide Sequence Number=SeqID_221639
atgagtctccctatatatggctatggtcggagacagatgaaggaaggagacgagttacaggcgccagtcgtcaccgaagaagcagaaacatatctcctctctcacggcggcagtgccacggttgtcggagaagcagcagttctcacgattcagggctactgcaataataaggcttag

SEQ ID NO: 104862 - DNA, 1170 bp, Glycine max
  Peptide Sequence Number=SeqID_221640
atgggattgataagcaccagtgttcccacgaacatcgttcctcaattcgggtctctccgaacatccatccgggtcggaaacccaaacccttccgggttgagtttcccacggaagaggaataacagttttgtttgcttggccgtcgatgacgagctgagacagaagcagcaagacttgagtactagcgccactgggctgggctccgcccttgaagaaaggcccgaaaatgcagatctttttgagagtacagctgaagaaacgcagggaaattttgggcaagatggtgaccgaggtgctatctatgattttctttatcctgataaagagcttcttcccgatgacaaagaaatgagcatatttgatcatcttgaagagctgcgacagagaatctttgtatcagtcctggcagttggagcaagcattttgggatgctttgcattttcaaaagaactaataatgattcttgaagctcctgttaaaacacagggtgtaagatttcttcagctagctcctggtgaatttttcttcacaactttaaaggaatgtacgaagctctgccgtaattcttatgtccgcctcataactagttcccagatcatagtgtctgggtactgtggccttctcttgggaagtcctgtcatcctctatgaagtcatagcttttgtacttccaggacttacaaaatctgaaagaaggtttctagggccaattgttttaggctcatcagttcttttctatgccggaataactttctcctacttagttctgacacctgcagcattaaatttctttgttacctacgctgaaggtgctgttgaatcattatggtccatcgatcaatactttgaatttgttctggtgcttatgttcagtacaggcttatctttccagctgacaccaattcacgccatgaggccattgtccattgacctaattgcttgtcttctgctcccaaaatatgtacctgtcatacaatttctattgggacaacttggactggtgtctggagaccagatgctatcaatttggaggtatgttgtggttggtgccgtagtggcagctgctatagttacgccatctactgatcctctcactcaaattcttctagcggcacccttattgggtctttacttaggtggcgcatggatggtcaagcttactggacggtga

SEQ ID NO: 104863 - DNA, 291 bp, Glycine max
  Peptide Sequence Number=SeqID_221641
atggagcaagagaatcacaaaatcaaagcagtgagtttgcttcgaagcagaatctgtgatcccaaattcatcttcatcagtgaatctccagaaagcaactacagcaagctgaaattcatgatatcgagttcggtaacggaagcatgcaacaattctattcttcttctcggtccccgcggctccggcaagaatgcgcttgtcattcaagatttgctgcaagagtatccggactcggtctcagtgataaggttgaatgggcttttacatagtgatgacatctctgcgttcaag

SEQ ID NO: 104864 - DNA, 993 bp, Glycine max
  Peptide Sequence Number=SeqID_221642
atgggcgtaagattgaagaaagagaaagaacagctgaatcttctccttggttcccacctcactactatccatgaaaccctctcttcatctgaatctctttcttaccctcccaaagtcacctgggacgatgtgattaagattacagtaggtgccggccctaccttgtcttcctctgttcattcatctctcaagcaagtcgttgatgaaggaaacggtctcttcatacggctgactagatcatcatgcttcaacccactactcgacacctttagtcctgactggtcccattctaaagacctgaaaatatcagtaccacatttggttggtgctgtctgggaagcctgttctgcccttaaaaagactccttccacaaatattacagcaattgggcgaggaatgacacaagtagctgtttcagtgaaggatgttcttcgtgagatgaaagaattgaaacctgtttcatgtgatgatcaagttgatgaagctgctggtgagggttgtgcagaagcagcatctgagccacatgatgataattcaagtgaaggtgatctagggaatgacctgtcaccagaagagatgaaagtggctgaaagagcaattgaggttgtctctaatacgctttcagttagaaaagtacttattcactccatcataggcttgcttaagctggaaaaaccaaatgacaacagcggttttataaattcgctggagaagttgttgcagttgtgtcaggaacttggtcgacagattgatgagattggagcttgtctttatcccccacaagagattcctgccataaatgcagctttggaggaaattcacagcattattgatgctgtgcaagttgaggtaggagaacttctaggcgcatcagatgtatttctggaggcatgcaatgatttgaggagttcactgagacagcttgcatctgaactaagaaactctagtactgctgatatagaagccagagtggaaaatataacattaacctaa

SEQ ID NO: 104865 - DNA, 507 bp, Glycine max
  Peptide Sequence Number=SeqID_221643
atggttgccactttctcatatccagcctctacctattttgtaaggtgttgttccgtgagagaaaaccatgaccaggttaagctgcaagtgaacagcagcatcagaactaatgggagttttaggtccccagttaaagttgagtcactcaaacaaacagtttcaactaccaccactcttggtcaagctgttacaattgatgaaaatggtcttcgccaaaacattccaacaaagaagcaattggttgatcctcatcgtcaagggctcatcattgaaggtggagttggttatagacagactgttgtcattaggtcctatgaagttggagctgataaaacagccacacttgagagcatcctcaatcttcttcaggaaactgcattaaaccatgtttggatgtctggactgctgagtgatgggtttggagcaacacatggaatggtgaggaacgatctcatttgggttgtctcaagaatgcaagttctggttgattactatcccatctggtaa

SEQ ID NO: 104866 - DNA, 345 bp, Glycine max
  Peptide Sequence Number=SeqID_221644
atgaagagattggaagttaaagagcaaagtttatgcaacttcaattctgtgatgaaagagtatataagcaccctgacttctgaacgttatgcaagacatgtctgcttaagggcatttgaacaccttatacatcgtgaattgatatgtttcacagacaatagaggacaaagtttgtctgttgaattccgtcctgtaaagcttttaatttcatctgctgaactacatcaaggactaagagcaaatacttcatgccctttttctttgtacttaacttcttccattcatccattacacgtcatatctgtggagcctaagcttctaaaattaatggatcgtgaaggctaa

SEQ ID NO: 104867 - DNA, 612 bp, Glycine max
  Peptide Sequence Number=SeqID_221645
atgggttggagcatcaggcaagaatggaatgcggcgggattggctgataagaagccaagtcacaggccgcatttttgcacgtgcaacaaggtaagagcagaagtttcaccttggtttatagagaagcaagcaataaaggaagatgatgttcaagaaaaaatagtcaaattagacaaagaggcaaaatacatgaattctgacttgaagcccaagagaagtgatttggacatgaaccaacatgttaataatgtgaagtatgtaagatggatgctagagaccatcccagaccaaattctggaggggcaccaattatctggtatcacactagagtacagaagggaatgtggaagctcggatatagtacaatcactatgtgaacctgaagaggatgaaatacttcatggtgtggtggaaccagattactgcacaaatcttctcaatgggttatcatcagatattataaatggtagtggtgtccttacttgccttgagaagaggccattaaggtatacacacctgctacaaaccaaaggagagaaacaaaacgacgaaattgtcagaggaaggactacatggaagaggaagatttctacaatgccattttccacttag

SEQ ID NO: 104868 - DNA, 252 bp, Glycine max
  Peptide Sequence Number=SeqID_221646
atgtcaggagaggtagtagtagattcgaagcacagtctcaaaagaatgcataacggagtacgcgtagagagcgaaaaagcgggttataataaaggcttttgttttgcagaggcagagagagaggaagaaagatacttacgtagagagagaaagttgggaagagtctgcaacagcggcgaaaaggcgaagggtgatgatgagccaaaattaaaaagagtacgacggtcaaagatagatttgaagatgttttag

SEQ ID NO: 104869 - DNA, 147 bp, Glycine max
  Peptide Sequence Number=SeqID_221647
atggttcataaagcttggtcacaagaatccttgtccccatacattactacctacttctatgatgcatccatagaacattggttacacagaaaattggtgatccacaccaagtttggccaaagcatgtccggtgtgaagatcgtgtaa

SEQ ID NO: 104870 - DNA, 252 bp, Glycine max
  Peptide Sequence Number=SeqID_221648
atgcgaaaatgcaggaagaagaagcggaaaggttgtgaggaagaagagaagaaaaccgcaggaagaagaagcggaaacgcaagcggggcgggagagatagagtctcgcctcatggagtgttttataagtcaagctaacactatacacctcattcggttcttgttcccaccaccacccatccttcttatctttggacttctagaccgtccgcctccaagacctccaccaactcctttttcccattcaaactaa

SEQ ID NO: 104871 - DNA, 2039 bp, Glycine max
  Peptide Sequence Number=SeqID_221649
atggaagactcggattcagttgctacactgatagattctactacttctaagatacaacagctgcagaaggcatttgctgaacttgaaagttatcgggctgttactcttaacttgaaatggaaagaactagaggaacatttccatggtcttgagaaatccttgaagaggcgctttgatgaattggaagaccaagagaaagagtttgaaaacaaaacgaggaaggctcgtgagatactggagaagcgggaagcagctgtttttgctaaggagcaagattcgttgcagaggcttcaagagaaaagagatgctgcttcatttgccattgtaaatgctcgagaaaagcagaggaagatttcatcacgtgaattggctactttctctaatggtggtaaaggagggatgccaggagtggaggagaaaccagtggatactttgtccactgcagctgaaggtaatgtggaagatgtaaaacttcctgataatggaaatgtggagttggtatcttatccagagttggtaaaactatgcaaagagatggatgctgctggacttcacaaattcatatctgataaccgtaagaaccttgctgctgtaagggatgaaataccaaatgctttaagagctgctcctaatgctgcctgtttagttttagattctctggaaggattttactgtacagaagtgtcaaatcaggacgtaaagaaggatgctaacttattgggtcttcgccgaacctgtatcatgctgatggaatgtctctgtgatttcctgagcagctcaggttttgtttctaatgtgatttcagaagatatcaaggacagggcaaaagcagttgctgaagaatggaaacccaggctggatgctcttgacatggatgctagcaatgggaattccttggaggctcatgcatttttacaacttcttgctagttttggaattgcctctggttttgatgaggaggagttatctagattgattccaatggtgtctcggcgccgccaaactgctgatttatgtcgttttcttgggctgtcagaaaagatgcctggtgtaattgaggttttggtgaacagtgggcgacaaattgatgctgttaacttggcttttgcatttgatcttactgaacagttttgtcctgtttctttactgaagtcttacttgaaagatgctagaaaagcttcttctcctgttagaagtgctcactcttctcccactgcacagattgaggtgaatgaacgagagctggttgcacttaaggctgtaatcaagtgcattgaagaacataaacttgatgagcagtatcctctggatcctctccagaaacgattggtgcagctagagaaggccaaagcagacaagaagagggaaactgaagcaacaaagcctcaacccaagagacctcgtgcaaatggtgtgggatacggtccacgtgtcactaacattctttcggataaaacttgctatgctagagttgctgacaggtatccacaatacgtgtatgaccgaccaccttacatgtaccctgcacccactgagaatcattgcccccctctcatgaccactgcaacatataacatctctcccagccatggcaactactttggaaatggtgctctagggttgacagatggattagcaaatgattcgactctgaaagcaatgccaaggcaattacttcctgcacctcccatattgttggggagaatttgtgtggggtcaaatctaaggatgttgggagggggaggtgttgaagtggaagtcttggtggagtttgaatgggaaaaaggagttggtggaggtcttggaggcggacggtctagaagtccaaagataagaaggatgggtggtggtgggaacaagaaccgaatgagaggaggttgcgggaagaggttcttcttcttcttctttgttgaggagcttgccaccattgttgccgtgaataggaggttgccgtggtgcattgaggaggctttcgggaagagcaatgccaccgtcctccgtccaccgttgagggagctttgtcaccgtccaccgtcgag

SEQ ID NO: 104872 - DNA, 1032 bp, Glycine max
  Peptide Sequence Number=SeqID_221650
atgtgtgttaaaagccaggaggagaagccaagacagaaattgagaggggctgccaaagggaaaaagggtattcaggatcacttctgccgagagaggagtgaggaggtagagatggtggaagggtatttatgggggacaggacaatttggtatgtttcactctggtatacacctgctacaggaaatgaaaatcttgagatgttggtccatcttgaaaacgcttaatcatttgagggctacatggaaggtgtcagagatatcatcacttatggcacttgtccaaggcaagcagtttctatgttggttaccacagagatgggcttttgatgatccaatatatttgtcccatgttttctcttctgttaggagagacctcaatttcattgatcacactggtgaccttggatggaaagagtatgaaactactgctaattctagctgctactttttggcacttattcagagcgataggttccagcctattgtagttgacccgggactatatttagcaaggaaaagttcaccatggctcatcttgagccggccctttctggagttctgcatttttggttgggacaatttacctcggaccctactgatgtattttacaaatgtgaagttatctcaagaaggctactttcactcagtcgtttgcaatgcgccagaatttaagaacacaacagtaaatggtgacttacgatatatgatctgggacaatcctccaaagatggagcctcacttccttaacgcctctgtttacaatcagatggcagaaagtggggctgcttttgcaagacagtttcaacttaataatcctgtgctggacatgattgatgaaaggatcctccaacgcggtcgccatcgagttactccaggggcatggtgcactgggcggaggagctggtgggtggatccatgctcccaatggggtgatgtcaatactgtgaaaccaggtcctcgggctaagaagcttgaagggtctgtgtctaaccttcttgatgactggaactcacagaccaatcagtgcaaatga

SEQ ID NO: 104873 - DNA, 2406 bp, Glycine max
  Peptide Sequence Number=SeqID_221651
atgttaggttcattaccaatattgccactccctgctcctccctctgatggaaatctaggtcctctccctgagtctcaagtgattgataatgaggagcagaacaaatcaaattctgtttctgttccagcgccggcaacagttgccacccacaccagaacgattggaattatacatccgcctccggacattaggaccattgttgataaaacctcccagttcgtcgccaagaatggtccagaatttgaaaagaggatcattgcaaataacacaggaaatgtcaagttcaatttcttgaactcatcagatccctatcacgcttattatcaacaccggttgtccgaatttcgcgctcagaatcagtcttcagggctgcaacctccttcccagcctgcagactcggctgtccctgaatcagccccgtctgatagcaacggcgtagcagcagcagcagaaaagatcgacgtttctgcccagtttaaagctgtaaggaaagtgcttgaaccccctgaagctgaacagtatacagttcggcttcctgaaggaattacaggggaagagctggatattataaagcttacagcacaattcgtggctcgaaatgggaaatcttttttgacagggttgactagtagggaagttaataatccccagttccattttcttaaaccgacccacagcatgtttacgttttttacttccctcgcggatgcatattctaaggttttgatgcctccaaaaggtttgccggagaagctaaagaagagcgtgtctgatatgactactgtccttgaaaggtgtgtgaataggctggagtgggagcgttcgcaagagcaagctaggcaaaaggctgaggatgagatagaacaggaaagaatacaaatggctatgattgattggcatgattttgcggtggttgaaacaatagattttgctgatgatgaggatgaagagttacctcctccaatgactattgaggaggttataaggagaagcaaggtgacagccatggaagaagaagatattgttgagcctggaaaggagattgaaatggaaatggatgaggaagaggcccagcttgtcgaggagggtatgagagctgctagtttggaagaccgtgatgacgtgaagcagaatgaagtcagggttactgaagaccctgaaccaccgatgagaattgttaagaactggaagagaccagaggagaggatttctgctgaaagagattcaaccaagtttgttgtttctcctatcactggcgagttaattcctattagtgagatgtcagaacatatgcggatttctctcattgatcccaagtacaaagaacaaaaggaaagaatgtttgccaaaattcgagagacaactttggctgcggatgatgaaatttcaagaaacattgttggacttgctcggacccgtcctgatatattcggtactacagaagaagaggtctccaatgctgtcaaggcagagattgagaagataaatgatgagcaaccaaagcaggttatatgggatggtcacactggtagcattggacgtactgcaaaccaagccatgtcacaaactattggaagcgaggatcaaaatgatgcttttaataatgaagccaagaaccttctgggtcctgctgcacctcctccaagacctggtatgccttcaattcgtcctcttccgcctccacctggactggcattgaatcttccccgtgttcccgtccaatattctgttccccatagtggtgcccttccaatgcctccacctagacccatgatgccatctattcggcctgctcctcctcctccaatgtcgatgaatagtggacagcagtcagttatggcgggccaacctcacccaatgcatccatcaattcatatgaataaccaaggaattcccatacccccaccaccgggatctcagttcactcctgttccagttccgcgaccttttgttcctctttctgttccaccatcagttatgcctatgatgcacccaccacctttgcctcaaggagtgccaccgccaccgccaccagaggaggctcctcctccactcccagaagaaccagaaccaaagaggcagaaacttgatgattctgctctgatacctgaagatcaatttctggctcaacatcctgggcctgtttgcatttgtgtatctgttcctaatgttgatgaaggaaatcttaagggacaagttctggaaattacagtgcaatctttgtctgaaactgttggtagtctgaaggaaaaaattgctggggagatccagctccctgctaataagcagaaattgagtggaaagcctggctttctcaaggataatatgtcacttgcccattacaatgttggtggaggtgaaacacttaccctcacgttaagagagcgtggtggtagaaagagatga

SEQ ID NO: 104874 - DNA, 1524 bp, Glycine max
  Peptide Sequence Number=SeqID_221652
atggcacttttccggtcattcaaaagattcaccactcttaaccttgcaaaatcttcttcaacatcccttccaccttcgccaacttcagttttcgaccaccatcactccaatgggccttcaaaaacccacactttggccttccacacggcccaacctcggcccacccccgacgccgaagcaatctgcagaatcctatccaccacccccgcttccaccgtcgacgcctgtctcgccgccgttccggccaagccctcgccggagctcgtcctcgaggtccttaacaaactcagcaacgccggcgtcctcgcgctctcgttctttcgttgggccgagaagcaaagcgagttcaaacacaccacagaagccttccacgcgttgatcgaagcactgggtaagatcagacagttcaagatgatttggactctggtcaacgacatgaagcaacgaaagttgcttacttctgacactttttctctcgttgctcgacgatacgcgagagcacggaaggccaaggaagcaatcaagacattcgagaagatggagcactatggtttgaagccgcatgtgtcggatttcaacaagttggtcgatgttttatgtaaatccaagtctgtggaggaggcacatgaggtgtttgacaaaatgcggaagttaaggttggaccctgatatcaagtcctacaccattttattagaagggtggagtcagcagcagaacttgatcaaagtcaatgaggtgtgtcgggagatggaggataaagggtttcagcttgatgtcgttgcatatgggataatcatgaatgcgcattgcaaggctaagaaatttgatgaagctattgggttgtaccatgagatgaaagctcggggtgtgagacctagtccccatgtgtattgcactttgattaatggtttgggttctgataagagattggacgaagctcttgagttttttgaggtatcaaaggctagtggttttgtgccggaggctcccacttacaatgctgttgttggggcttattgctggtctttgcggatggatgatgcgtataggatggttggtgagatgaagaaatgtgggataggtccgaattctcgaacgtttgatattgtacttcatcatcttataaagggtcgtaggattgaagaagctagctcggttttccggagaatgaatggtggtgagtttgggtgtgagccaagcgtgagcacgtatgagatcatggtgaggatgttttgtaatgaagagctgttggatatggcggtggcggtttgggatgagatgaaagggaagggaattcttccaggaatgcatatgttctccacgttggtctgtgccttgtgccatgaaagtaagttggatgaagcgtgtaagtactttcaagaaatgttggatgtgggcattcgacctcctgccaaaatgtttagtaccttgaaggaagctctggttgatgctgggatggagcatgttgccatgcatttcactttgaaaattgataaactcaggaaatctccattagttgcttga

SEQ ID NO: 104875 - DNA, 534 bp, Glycine max
  Peptide Sequence Number=SeqID_221653
atgggagctgagaggaaatggcttttcactctattgagtgcagcattcctatctctcatgcttcttttgatgtcctctttctctgcctttagcaccccaaaggttttcccttcccttgttcagcatggttctcactaccctccagcttttgcatactttatctctggtggaaaccaggacaaggaccggatcttgcggttgttgctggcagtttaccatcctaggaataggtacctcctccatcttgggagggatgccagggatgaggagaggcaggccctggctgctgccgtgagggcggtgccggtcattcgcgctttcgggaacgttgatgtggttggcaaggctgattatgtcacctacttgggatcttccaatgttgccattattcttcgggctgccgccattatgctcaaattggatagtgggtggaattggttcattaccttgagtgcacgggattatcctctcatcactcaggatgtgtatgcttggggtggagttttggagggaaaggaaagggagagcaaatag

SEQ ID NO: 104876 - DNA, 550 bp, Glycine max
  Peptide Sequence Number=SeqID_221654
gtttgcttatgtgagacaggaggatctctttttctcgcagctcacagtgcgggagacattgtctcttgctacagaactccagcttcccaacatatcttctgcagaagagagggatgaattcgtgaacaatctccttttcaaactaggcttgtcctatgttactgatactccctgtggcatctgtatgctttttcttcaaaaggttagctgtgctgataccaatgttggtgatgcaaaagttcgtggaattagtggtggtgaaaagaaacgcttatccatggcatgtgaactgcttgcaagcccatctgttatatttgctgatgaacccacaacaggacttgatgccttccaggctgagaaagtcatggaaactctccaacaacttgcacaagatggtcatactgtaatttgttctatacatcagccaagagggtcagtgtatagtaaatttgacgacatcatcttgctaacagagggttcacttgtttatgctggtcctgctcgtgatgaaccactggcatacttctcaaaatttgggttatcatcttaa

SEQ ID NO: 104877 - DNA, 513 bp, Glycine max
  Peptide Sequence Number=SeqID_221655
atggcggttcatgattggatagcggtgtaccaatgtccagatcatataaatcctgctgaatttttggctgatcttatatccatagactacagttctgctgatagtgtctatacctctcaaaaaaggattgatggtcttgttgagtcattctcacaaagacaatctgcagttatatatgcaactccaattactataaatgatctctcgaacagtagaaaaaaaatcagccagagggctgtagtaaagaagaaaggagtttggtggaagcaattttggttgctccttaaaagagcatggatgcaggcttcccgtgatgcaccaacaaacaaagttcgggcaaggatgtcaattgcatcggcaattatctttgggtcagtattttggagaatgggaaattctcagacttcaatacaagacagaatgggattacttcaggtttgtgatgttcttgattcctgtatgcttctttctcatattggcttgctgctaacatacattgcagaacaactatga

SEQ ID NO: 104878 - DNA, 438 bp, Glycine max
  Peptide Sequence Number=SeqID_221656
atggagataatatcgaccaattatacaccaaaccaaatccaacgtggtgatcgtagttcaccacacaagttgttcagtgatggcaccaccactcgtaggagtttaatctatgcatcaaaaagagacccttttgggcaccattatgatggaaatttggtggatgagaacatgatccttcttagaatgcgaattcgtgagattgagatggtggaaatgaagggtaaagctacttcggattggagcgtatgggagaagaagtattttgctgagaattatggttcggatgtatgtgaagcagttggattgttgcaaagagtgttaatgaacaccagaccttcttttgcattgggtatgctagctcttgtcatgctaagcatgtccatgtcaacgttgcaagttgggtttcatttaatagaatttgccaagggaatcatatga

SEQ ID NO: 104879 - DNA, 303 bp, Glycine max
  Peptide Sequence Number=SeqID_221657
atggccctcattattggaaaaccatttggtggtgggcatactcggaaaggtcttccagccaccataccccaagtgggccccaacgttaagaccaatccgctacccagtcatggaggacctagcgtaaacgccatcaaagagaataggccatcaaggtcaaagaaattagaagatgtggccgcatccagaagattcatctaccagtcgctacaagcagcatgcatggtctctcgtggcagaggcaaaagcgatacatgtctgtttcatctcggggaattacgcgacatggaaacatgccccgtg

SEQ ID NO: 104880 - DNA, 339 bp, Glycine max
  Peptide Sequence Number=SeqID_221658
atgggatcggatgccgaacacaagaacgagatcgatccggccgtattcgccagagtgcgctatgtcgcggacaggcttacgcagacccgcattctcggcgaattgcatcacgcgattgccgcgggttacgtcgagcgggatcagccattcgccgagcttggagaggtgatcgccggcaagtcacagggccgcctctcgaacgaagacatcacctttgccgatctgaccggcaccggcgtgcaggacacagccatcgccaatctcgcctttgcccgcgccaaagacgcaggcagcggccaaatcatcgaaaacagcgtaaaaatgggagacgcagcgtga

SEQ ID NO: 104881 - DNA, 507 bp, Glycine max
  Peptide Sequence Number=SeqID_221659
atggtctgcaatgaccaggctggtataaccgaaagattacttgttgggtcattaactttcgattgtcgcatcatgcattatatcattgttcgtattttgcttccccggtcttcaaaccttgcccaagcctctgaggagaatttgattctgatatgggcttttcaaactggtcatcagatcgactgggcccatctagttcggtaccggatgcataaggcattatgggccaatgcacctctgccttatccccaccttgttactctttttcttcatcatttcaatattcctttggatgatgaaccatttgtcaaggtaaagaggtctttctctattagtgctggtgcggttgcctcctttggtttccgaagggatgttgatggtcagtgggttcgcaaacaggacttgccaccgcctattcccgatgaacgtaccccatctcctccaccacaaagggttgattctacttctcttctgattgaagtactcacagagctccgcgacctttga

SEQ ID NO: 104882 - DNA, 153 bp, Glycine max
  Peptide Sequence Number=SeqID_221660
atggcgaggatcgccttgactgttaaagtgggcaccttacctcacgttgctagaccctgcaaccgacggcgtaaagtgccgcacctcctccgtgaaggtgtccttcctttgttgcgtcatcaatgtgctgctaatgcacctggggttttgtag

SEQ ID NO: 104883 - DNA, 2028 bp, Glycine max
  Peptide Sequence Number=SeqID_221661
atgaagcacctgctcagaaagcttcacatcggtggtggcgctgccaccattaaccctagcaccaatcacaacgcattgtcgtcgcacgctcacaatcacactccctctccctccacttccacgctcccttcccccaccgtcgtttcggatcggagccccgtctccgtcgaggcccaaaacgaagtcgccgatttcaatttgttgcaggaggaggagtttcagatgcaactcgcgctcgcaatcagcgcctccgactccgatcgccgcgacaccgccgaatccgcgcagatcgacgccgccaaacagatcagcctcggttactctgcttccctcactgacactcatgccctagttcagtttcaatcccttcgatattggaactacaatgtgattggctatgatgagaaagtgatggatgggttttatgatgtttatggagttacctcgaatttggttgagcgggggaagatgccgttgttgttggatctgcagacggcttctgtcttcggagatgttgattgtgaggtgattttggtgaaccatgtggttgatcttgagctcaatcatcttgagaggaaggcgtgtagtttggtcgaggagtgttgtgtttctgaactgggactggttttgagtggcttgcttcagaagcttgcagatgctgttgttaatagaatgggtggaccggttgttaatgctgagaaacttacaaagaggtgggctatgaggagtcgtgagttacgggattctatgcagaccattgttcttccccttggctgtcttgatgtcggactttcacgtcaccgagccctactttttaaggtacttgctgataggattaacgttccctgcaagctggtaaaagggagctattatactggaactgatgatggggctgtgaatttgattaaagcagatgatggaagtgaatacattattgatatgatgggtgctcctggcactcttatacctgctgaggtacccagcagccagctcggaaacaacagttttgctgttaggggttgttcagaggttgtagtactaccaaacaagacacattcaatggtagatgatggaactggtgttctgggagtcttttctgatcgtggtagaatttcaacaatggaaagggtccagacagaagaattattagttatgggcagtcaaacaaagccagatgaaaaaaatatttttaaagtaaacgagacaaggagatttgaacatacagaatcatatgaatgctcatctcatacagaaccatcacctgcagagaatatgcgtgtaaaaaatgtctctaagtatgttctcagtgcagcaaaggacccagaatttgcccaaaaactgcataatgttctagtagagagtggtgccttacctcctcctgatcttttttcagatataaatccccaagataggggtgtagataaagtaaatgaaaacattgttgattctgttcaagctgacaactctctcataccctcacatggggtgggctctgccagtgatactaagttatgtcaatcagctgactggttagcggaacagcaaaaagaattgcataggaatgttgaattttacaatttttcacagggtagtaatacaaggaatgggtttgtaaatgtttatgatagagataatgacatagagcaatctaacacaatcaatgttgttttggcttctatccattcacataagatatgtaaagaaaagcgtcctgaatcttccttgcccaaggcagctctttcctgcaaaatgcataatggggttgactgtttctgtgaagatgaagaaaatggctttagaaacaatgttgaagcttctttaaataacagtgaattacggaaagattcagccattctaataaatgagatgggggtcaatggagattgttatgatggtagaaacaaggaagttaacccagttcttggcgaaagctcagaatgggaaattcaatgggaggatcttgatattggtgagcgtattggtattggttcttatggtgaagtttatcgtgctgattgcaatggcact

SEQ ID NO: 104884 - DNA, 552 bp, Glycine max
  Peptide Sequence Number=SeqID_221662
atgcaaggatcatgcatgagcgaacatgaaaacaaaagtgccccatgtgtgcagtttaagaaggtgatatggatcttccggcttcccatgacaaaagatgagaccaacatacaacgcggacctacacgggagaaaccaaaaggccttttaatgataattcccaaggtggtcatatctctcttgatggtctctagaggtatcatccccttcgaagaacatattgcggcagtagggactactagcaacaatatgttatcaaagagaaaaactctagatgagggttcacttccccagcggagttgccaactgtcgcaacctacccttcggcgggagggcgacgcgagggctcacgggtgcgtcttccaagaaaggaaaatgcacggagttgccaccaacgtttattcaaggaaaacgtcggataaatcggaaacgtgtggtctacgaactttaatcgtgaaaggttcgggagttgtatttacgcacggggaaggtattagcaccccaagcgtccgtcacaagggtcgccatcttcaatcaagtgtgcaaatatga

SEQ ID NO: 104885 - DNA, 295 bp, Glycine max
  Peptide Sequence Number=SeqID_221663
atgggagatcgcttggaggatatgatttgtgaccttggacaagagtcttttcagcaagcacatgcccttatgtataaaggatttcaaagtgattcaaagaagcctttgtatacgaggtgcaagaattccttgtcgctgttgttggcggtgttaagtctggttaatgtcaaggccagatatgggtggagtgagaaaagctttagttcactacttcaagtagtgcacaatctgcttctagaggagaacatgttgcctaaaagttggtatcaggccaagaagatattatgtccgatgg

SEQ ID NO: 104886 - DNA, 348 bp, Glycine max
  Peptide Sequence Number=SeqID_221664
gacacgcttttacggcgcccttaccgaactcgtgctaaagctagagtaatgggtgaagtagaggaggtgcaagagaagatgaagggccgacatggaggccatgaaagagcaaatggccgcaatgatggaggccatgatgatcatgaagaagataatggaaagccagtgcagttgcagttgctgctaccagcactgttactaagtatgggcggcccccatgatgtgcaaattcaaaacaagcacgccttcccaccatatggcttgcctcccaactatacaccatccaatgtagcgtacactcccagtgagaatgtcaataactccactcccatactcattgagagctga

SEQ ID NO: 104887 - DNA, 219 bp, Glycine max
  Peptide Sequence Number=SeqID_221665
atgctgacatctccggaaagggtgcagatgaccacattggcttctgcttgtcaatcgaacttggggtctctgaatgacgggactctcgggtcactggatagcaaagggtgtgtgcgggttaccgtcaggtgtctccgcatgccaccggactcttgggtcacggtaacaaaaggtggggtggtcgacaaaagcagagcttttgctcctacgtatccataa

SEQ ID NO: 104888 - DNA, 1377 bp, Glycine max
  Peptide Sequence Number=SeqID_221666
atgtgggaagcactttctcaggttttgtatttaaacctctctcgtaatcatatccatggtgagattgggactacattaaagaatccaatatctatcccaactattgatctaagctcaaatcacttgtgtggtaaattaccctatctttcaagtgatgtgcttcagttagatctttcaagcaattcactctctgaatccatgaatgactttttatgtaacgatcaggacaagccaatgcaattacaatttctgaatcttgcatcaaataatttgtcaggagagatacctgattgctggatgaattggacatctcttgtggatgtaaatttacaaagcaaccattttgttgggaacttaccccaatccatgggttccttggcagacctgcagtctttacaaattcgtaacaacacactctcagggatatttccaaccagtgtgaagaagaataaccaattgatatccttggaccttggggaaaataatctttcaggaactattccaacatgggttggagaaaagctcttaaatgtgaaaatcctccgccttcgatcaaacagatttggcggccacattccaaatgaaatatgtcagatgagtcatcttcaggttttagaccttgcacaaaacaatctgtctggcaatataccgagctgtttcagtaacttgagtgccatgacactaaagaaccaaagtacagatcctcgtatctattctcaaggacattatggtacgttttactcttcgatggaaagtttagttattgtgctactatggctgaaaggaagagaagatgagtaccgaaacattctgggtttggtaacaagcattgatctgtcaagtaacaaattattaggagaaatacctcgagaaatcacaagtctaaatggattgaactttttgaacttatcccacaaccaagtgattggtcatattccacaaggcattggtaatatgggatctttacagtccgttgatttttcgaggaatcaactttctggtgaaatccctccaaccattgcaaatttgagctttctgagcatgctagacttgtcttacaatcatttgaagggaaatattccaacaggaactcaattgcaaacttttgatgcctccagcttcatcggcaacaatctatgtggtccaccactgcccataaactgcagctccaatgggaaaacccatagttatgaaggaagtcatgggcatggagtgaattggttttttgtcagtatgacaattggatttattgtgggattctggatagtgattgctcctttgctgatttgtagatcatggcggtatgcctattttcatttccttgatcatgtgtggttcaaacttcaatcttttcgcttaggtagtatcactgtttag

SEQ ID NO: 104889 - DNA, 402 bp, Glycine max
  Peptide Sequence Number=SeqID_221667
atgtcaaatcaagaagcagttagtgctatcaaagatgttaaggatgctaggtctgcaacaaagataaagattccaacaaatcctacctggaattggaaatttaagttgcaagaaactcatggaagagcgaaatccctctcactcaacaaacttaaaatacaactcgaccacattgattatcctagcaagagcttgtctacttgcaccattgacatcaaaatgaacattgctcatggaagacgtggccgcatatggaagatcatcgtcaatggggttgataggttcgtagcagatcgaacaaatgatgccggtgaagtcaccgtcgtggtctaccctcacttttggtgggtagcaccatttctggaaaactcatctcttgatgatgcttctttctccgcttag

SEQ ID NO: 104890 - DNA, 333 bp, Glycine max
  Peptide Sequence Number=SeqID_221668
atggaagctgtgactgacaagttcaaagataaggaagaaaaagttttgggatcatctgatcccgattcaggtaaaggaaagagcaagatgaagaagcacataactcatggctttcacttggtaaagggaagatcaggtcatgccatggaagactatcttgttgctcaatttaagcaagttgacaacaaagagttgggtttatttgcaatatttgatggccactctggtcacagtgtacctgattacttgaagtctcatttgtttgataatatcttgaaagaggtaatgagggttcgtaatcttttccagttacttaatctatatgtgagctga

SEQ ID NO: 104891 - DNA, 267 bp, Glycine max
  Peptide Sequence Number=SeqID_221669
atggcatcagacattcttaacaaggtccaagtggagaaggatgaaggcctagagaagtggcgtcatctgaactctgtgacctgtatcaagcgatccactcctaacaaggttcacatcaagttgaaagtgtcaagggcatttggtcataaaagcctgaagatacatttgagctcaaaaccatatgtaactgtggagatgatagaagatgatgcaaagtttcttatactagcaagtgatgggttatggaagctaacatttgaaaaatga

SEQ ID NO: 104892 - DNA, 345 bp, Glycine max
  Peptide Sequence Number=SeqID_221670
atggcgaaggagaaagcattaataattcaaaagcaggatgataagttattggccatgctccacgacagcgacttgtatatagtggtggtggtggtggtgttctggcgcggcggccgaaggagcggcatggcagcaacgagggaggagagcgccttcttggcggggcggacctggccgtcaccgaggggggtttgtttgagggccgcgacggcgatctcggcgaggcgctggaggttcttgatggcgtcaaggccgaggctgatggcattgcagacatcgagggacttgacgacgcggtcgaggagctccgggaggaccttgtcgagcggtggcttcgtgatctga

SEQ ID NO: 104893 - DNA, 1197 bp, Glycine max
  Peptide Sequence Number=SeqID_221671
atgattacacagcacggcaagatcgtcgcgaaagtatgcgaaaacctatttagccatggacccctcactttggatcagttggttcgctacaccgaccttactaaggaccaagtcagaaactccctacttgtcttagttcaacacaattgtgcccaagcacttgtttctgctcctcaagatgatgatgatgatgcagacagactgagagttagaactcagtacctggtgttgtttgataacataatccatcggctgaggtttcccaaattcttggagattgtgttgcggaagcttgatgaagaatttgtgaagctgcttgtcggattgcttcaggatggtaggcttaccctcaaacaaatggttgacagagaaagtcaaggaaaaggcaagtgttttatgatgcatgaaactacttctaggaagctgggtgccaagtctgtgaaggttaatagtgctcggatagcagactctatccattacgggtgtattcctgctttggttgcttttatcactcctaggactagaattgcaactattaagaaaagtttgattgatcccatgggcaatctgaggaactggaattcgggtgacctgtgcatggcaaactggacaggggtttggcgctctgatagggaggaggctgatggttacttccatgaaaaaaacagtatcagaggagatggcacggggagggcctcacttcatgcaccccagaggaggccaaagtacaagagcggtcctcttggaccccctggtgttgcatatcattctatgtattcgctggctgcaccagtgtttgaagtggagaatggggggagttttatggcaggttctccattttcaggtgatgggttaacaatctgctccggtggccatggtggagctctttcggcgagaacaaaaccttgcatggcattcttagcgagtgtccacggatgctctaagatacagaatgataagtttggtgggttcaaagatgtgggcaccaatgtgtcttgtgttgtttcaaggagggacatggcaacccagatgagcccacaggggccttattcactggctgaggctcagaacaagtcaaaagctggaaaaaagaaaaaggcaaaaagtgaggaagccaaaatctctgcatgggagaacttgcaaaaggcaaaagcggaggcagcaatacggaaactagaggttacttctagtgaatag

SEQ ID NO: 104894 - DNA, 573 bp, Glycine max
  Peptide Sequence Number=SeqID_221672
atggaaggtaggagagtggagaggaagaaaacattgtttgagagggtgagaaagaatagcacagtggatgaggaagtggaaaatgaaggggaggaggaggatgaaagtggtgttaatattactgaagaagagaagaagataggggttagtagtggtggtgggagaagagggtcaagtgggggtggtggaggggtttctccaccttcatgtcaagcagagaggtgtggtgctgatttaactgatgcaaagaggtaccatcgccgccacaaggtgtgtgagtttcattccaaggcacctgttgtggtggttgcaggactgaggcagaggttttgtcagcaatgtagcaggttccatgatctggcggagtttgacgaatccaagagaagctgccgcagacggttggctggacacaacgaacggcgcaggaaaaccaacccggaagctgccaatgagggcaacagcaaaggccaacaccctaaggaaacaacacattgcaggcttgcagatgagagggggagaattcagatgaacctaacagggagttctgaatacaagtctttcaacatcagatga

SEQ ID NO: 104895 - DNA, 753 bp, Glycine max
  Peptide Sequence Number=SeqID_221673
gaagttgcccaatccgggagcactaacacaatcgttgatcctccatctcccattaggcgacacgtgaagtggaagatcacacgcacgaagaaaactagtcaaatgaggtctaaggcgataaaggaaatttcagacaggattgcctcacagggaagctttgtcacccacagacgtcaggatgtaatgactgttcccattgggcaactagagcacccggtcgtgtccgtgttgttggatccattgtatatgcaatcacagggactcgcactacctcctgaggttgaggttggtccttctactgctcgtgtcagcacaaaggagagttttgtcaatccctcaggagtttatgaggggttcacgaatgtccacaacattcctttgggaaatgatcaagtgaaggttggtgttaaggaagtccgagatgctgatggcctgttcccactcaagagtgcacattggcaaatgatcctcattttgcccaaggacaatgttgtcatctgtactttgaagagattcaacaacagtcaaggaagtaagtccaaggctgctactagatggatccaagaaggaagcactaagtgcgggtactacgtaatgtattggatgtcaatgatagtcctacaaggtttcaaggataactgggaaacgtattttactgatcatagatcattggaaccagagagaatgaaggcaattcgcattgagtgggcaagatattatttgaaagttaaagatcaaacactaggagtttaa

SEQ ID NO: 104896 - DNA, 222 bp, Glycine max
  Peptide Sequence Number=SeqID_221674
atggaacaattgctcgatccccaagtactaaaaaacaatcatcagaaagtaacgtccataggtttacgacctcgtgtaaatcccaaagctattagacaacgactagctgagacaaaactagtgcaatcctccctaggaagggaccagccactagagccacaagcaagaggctccaagaggattgggctagagctgctgaagaaggccctagggttctcatga

SEQ ID NO: 104897 - DNA, 392 bp, Glycine max
  Peptide Sequence Number=SeqID_221675
atgggctcagaaatctaccctaaggttcatgagaaccctagggccttcttcagcagctctagcccaatcctcttggagcctcttgcttgtggctctagtggctggtcccttcctagggaggattgcactagttttgtctcagctagtcgttgtctaatagctttgggatttacacgagtacttggggatcgagcaattgttccattacttttgtactacgagtcaagtgttaaagcacttgttttcttaggactagacgctgggggactcgggcacgagtacccatgtggatttgatgttttttctgagaaagtaatgcgcttgagagatgtacaagcaggtgtgaactcgtggtggaatgctgagatattcttcaacagagacgcgttaag

SEQ ID NO: 104898 - DNA, 438 bp, Glycine max
  Peptide Sequence Number=SeqID_221676
atggctgcaagtgatcatgcaatcttgcatgatcggacgcacatccctactaaaagaagcctgctagagctctcatctcagaacgcattattggcacaaaacaagttgttgtccaagcagcttgaaacattgactgaaacattaagtaagtcgctaaaccaatttaatgttaatcaaccttcacattccactgttttgcaggttggaggttgcagcatttgtgggggagcccacaagtttggacgttgtattcccttagatgacacaactcaagaggtgaattacatgggaggaaatcagcccagacccaattttcatgcaggcggatattcaggttttcaacgtggtttgaactataatcagcaacaagggcaatggaggtcccatccgggaaatcaattcaacaaggaccagggtggaccatctaataggccttag

SEQ ID NO: 104899 - DNA, 483 bp, Glycine max
  Peptide Sequence Number=SeqID_221677
atgcacgtggctcaactggtctctgatgccatctactgtttgcagggatcacacccgcaagacacccaatggacccgaagaagtccaacagggccctggagttctagctctgattacgggcctccgtcagttctacggagtgaccaccacttcgatctccccctgccgaagtgtcaactggtttatgccatcatgacacagggatcgcgcctacaagacactcagtgggcccgaagaagtccaacagggtcttggagctctgattacgagcctccgtcagttctacggggtgcccgtcgcccccagcagggtcatcaggcccctattaacagggctttcatcgagaaatactgcagccctaggcaggcaacaaacgcaccgccaccacctccagagttcacctcagctcatccacaaaaaggctggagcattgcctacgacacatggccgaccagcaggcggccaagtccaaagcaaaggtaa

SEQ ID NO: 104900 - DNA, 405 bp, Glycine max
  Peptide Sequence Number=SeqID_221678
atggcgcctttcgtatacgacgacgtttcacttaaacgccgcgtttgtagctttggtggaactaatctaagacgtcatcccagcgacgactccgtcgtgcccaccgtgacattgccttttcgaccaccaagaacaaaaaccctagccattgttctgaccaccaccacgtatccgatctcgtgccctttggagtggtgtcgcgaccttgctagtgtgaagataaagagggaaatatccaccttgaagctgctgaagcatccgaacgtgaggaacttagatcaattggaagacttactcaacaaggttaaattgaagaccataaggacggaaccaccttctgcatctattgctggcacaaggtactttttgattattaattttgattgtgcgtttacaaatgattaa

SEQ ID NO: 104901 - DNA, 264 bp, Glycine max
  Peptide Sequence Number=SeqID_221679
atggtggcgctgacaaatggtggtggcaacggtggtgtggtggtggtggacgtggcaaagacaaggtgcaatgataatggcgttggcgaaatgaccggatgtggtggtggtgatggtgacaatgacgatgacgatggtagtgattatgatggaatggtgacgatgaagacgacaataatagtggtagtagcagtaagaacactgggtagtagcagtaagaacactggcgatgataaaatgatggtgatagtgataatacggtga

SEQ ID NO: 104902 - DNA, 405 bp, Glycine max
  Peptide Sequence Number=SeqID_221680
atgttactgccacatgccaaggctattgaattataccgcaagcactttcaggttgggggaaagaggattaaattccaagatgggagtttaattagtaaactactcatgctaatccaggcaaaacaaaggggaaccattggcattgttgcattttcctccatgtgtgacccacttagagatgaagaatgtgataggcaagcagtgagtaggggcttggcttttgacatagcctgggtcttagatcccttagtttttggtgaatacccacccgagatgcgctctatccttgggagtaagatgccagtgttctctcctatggagatgagtctcataaaaggaagcctagacttcattggcatgataggagtaccagattacaatttgcacattatatctgccatgtaa

SEQ ID NO: 104903 - DNA, 468 bp, Glycine max
  Peptide Sequence Number=SeqID_221681
atgaccaggccttgcttgaaagctttcaatctcaactacaaaattgtgcgttttgatagcagaccggtgaaggaagtttcagcttgtatatgcttacatataattggcctcaccaagccaacccccggtactacatttgttcaaggtgatggtctttcaatcttgagggcagaacttaaaagtctgaagaagcaagttaaacatttgaaaaaacaaagtcactctggtccagaagtttggaggagaaagtctatccttttaagatgtgtggaagcaatgacttccaagattattttgatgatgccaaagaatcaagagttaagcaagttccaaaataccaggagtcaaaaagcttcaagaatcaagtttcaagattcaagattcaagaacaatcaagtttcaagaatcaagattcaagaacaatcaagatcaagatttaagaatcaagagaagactcaatcaagataa

SEQ ID NO: 104904 - DNA, 585 bp, Glycine max
  Peptide Sequence Number=SeqID_221682
atggcctcaaggaaaggaagagcttccacctttagacctcaggagccttatgacacatctcggtttgtgtttgaggtcgcctgggagcgatacgagcagaacatgcacaaccagaacatcctcccaaagaggaatgtggagctcacattttcacactacgatgagtacctccgggagctcgagaggtgcaggtggcatagggccttgaacaggcagccaaataatcatatagacttaccccaggtcaaggaattctatgccaacctctatgatcttgaggaccttttccttaggcaatgtaaggtacgggggaagttgataaagtttgatgttgcgactcttaatgagtttttggagatcccagtggtcctagagctagaggagagagggggccccatggaagctgctcaggaaggaccttgtaaaattttgatgatgaaaaagatgatgacaaaaagcccaaagaatgatttcaagattgagccaacaagttcaagatcaagtttaatttcaagcttcaaaagaagaaatcaagaagattcaagaatcaagagaagtttgatttcaagattcaagaaaagatga

SEQ ID NO: 104905 - DNA, 237 bp, Glycine max
  Peptide Sequence Number=SeqID_221683
atgttcaatgacattgtgtcggatgagctcgaatctaaggttcctaaaatggccagaatctttgactctcgctcgaagtatgagatcgggagagacttatatggaatacttaaggatgaagtaaaaaggaaagatgaggaggaagggatgagtgtgaagaagaagggttgctatggtgacgccgacgaggacgaagaggagtcgctgctcactgagcatgtagtgaatcactattaa

SEQ ID NO: 104906 - DNA, 4467 bp, Glycine max
  Peptide Sequence Number=SeqID_221684
atgtatctttatgacattgacatcaatgatcgtttgactttgacagagttcaaaagtctgttttggacttcatggcagcccttagaatcaacatgcttgttggagcatattattttacctgtggaacttggtttcttagtgatcttgttattccaactcctaagaaaatatgtgagccagttcagcaagcaaaccaaggttgttcattcatcacagctattgctgatgctcaataatgagactcaatgcacctcaaaacttcaggccttcacatcagagatagttcaagtgctatcatggtcaattagtcttatagcaatatggaagatatcaaaatcacacacatatttcccttggattctgagggcttggtggctttgcagtttcattttgtgtatcataaccacagcccttcatgcccatttcagtgtcatcaacaatggtcagattggtttaagagaatgtgcagatttccttggtttgcttgcttcgacatgccttttggttatttccacaagagggaagacaggcactgtccttcttgccacaaatggtgcatctgaaccacttcttggagagaaagctgagaggcattcagagtgtctaaaggaatctccatatggaaaagccacacttctccaactcataaatttctcttggctcaaccccttgtttgcagtagggtataagaaaccccttgagcagaatgacattcctgatgttgacatcaatgactctgctgagtttctaacatgctcctttgatgagagccttaggcaagtcaaagagaaagatggcactgctaatccatctatctacaagtcaatctacttgtttgctaggaagaaagcggcaatcaatgcattgtttgcagtggtaaatgcttcagcatcatatgttggtccatacttgataactgactttgtggatttcctaggagaaaagggatcgcgcggcttgaagagcggataccttctgtcactggcttttctgtgtgccaaaatggttgagaccatagctcagaggcaatggattttcggtgccagacaattaggccttcgccttagagcggcattgatatcgcatatatatcagaagggcttacatctttcaagtagatcgcggcaaagtcacacgggcggtgagataatgaattacatgagtgtagatgtgcagagaatcacagattttgtttggtatgtgaatgtgatatggatgctgcctattcaaatttctttggcagtgttcattttgcatacaaatctaggactaggttcattggctgcattagctgctacattggcagtgatgactttgaacattcctcttacaaagatacagaaaagataccaagccaagatcatggacgccaaggacaacaggatgaaagccacttcagaaatcctcagaaacatgaggactttgaaacttcaagcatgggacagacaattttctcaaaggatagaagcacttaggcagatagagtacaattggttaatgaagtcattgaggcaagcagcattttctgctttcatcttttgggggtcacctacattcatttctgtgataactttttgggcatgcatgttcatggggattgaactgacagcaggaagggtcttgtctgcatttgccacgttccgaatgttgcaggatcctatatttagcctgcctgacttgctcaatgccattgctcaaggaaaagtttcagtcgataggatcgcttccttcctccgcgaggaagaaatccagcatgatgtcattgaaaatgttgcaaaggacaaaacagaatttgacatagttattgagaaagggagattcagctgggatcctgaatcaaaaactccaaccattgatgaaatagagttgaaagttaagaggggaatgaaggtagcagtttgtggatctgtaggttcaggaaagtctagtttgctatcaggccttttgggagaaatatataaacaatctgggactgtgaagatcagtggaacaaaggcttacgtgccacaatcagcatggatactgactggaaacataaaggacaacattacctttggaaaagagtacaatggtgataagtatgagaagactattgaggcatgtgcattgaaaaaggactttgagctattctcatgtggtgacatgacagagattggagagagagggattaacatgagtgggggacagaagcaaaggatacagattgctagagcagtttaccaggatgctgacatttacctttttgatgaccctttcagtgctgttgatgctcacactggcacccacctctttaaggagtgccttatggggattctcaaagagaaaactataatttttgttacacaccaagttgagtttcttccagcagcagacctcattctggtgatgcaaaatggaaggatagcacaagctggaaaatttgaagatcttctaaagcaaaatataggatttgaagttttagttggtgctcacagcaaagctctagagtcaattattgtggctgaaaattcaagtagaacaaatttaaattcaatagctgaagaaggggaatctaacttcagctccaagccaagtcatcaacatgtgcaaacacagcatgactcagtgcaagacaatcctccagagggcaaaggaaatgatggaaagttggtgcaagaagaggaaagagaaacaggaagcatagcaaaagaagtttactgggaatatttgaccactgtcaaagggggaattctggttcctctcattctcttggcacagtcttcattccaaatacttcagattgctagtaactattggatggcttgggtttgtcccacaagtagtgatgctaagcctatatttgacatgaatttcatactacttatttatatggcactctcagttgctggttcattttgtgttttgctgcgagccatgatggtgttaaatgctggactttggacagcacagacacttttcacaaagatgttgcatagtgtgctccgtgcccccatggcattttttgattctacaccaactggaagaatattgaacagggcttccacagatcaaagtgtgctagacttggaaatggcaaacagaataggatggtgtgctttctcaataatacagattctaggcactattgcagtgatgtgtcaggtggcatggcaagtatttgtcatcttcattccagtaactgcagtctgcatatggtaccaacgatattatacgccaacagcaagagaactggctcgcttagcacagatacaaatcactccaattctccaccatttttcagaatcattagcaggagcagcatcaatacgagctttcgatcaggaaggccgtttcatatacacaaatcttctccttgtggatggcttctcaaggccatggtttcataatgtgtctgcaatggaatggctttctttcagattgaatttactttcaaattttgtttttgccttctcactagtcatgctagtgagcctccctgaaggaataatcaatccaagtattgctgggttggcagtaacatatgggatcaatctgaatgtgttgcaagcttcagttatatggaacatatgcaatgcagaaaacaagatgatatcagttgaaaggatccttcaatatacaaatataacaagtgaagcacctcttgtgattgaagacagcagaccacctagcaactggccagaaactggaacaatatgtttcaaaaatttgcagatacgttatgctgaacatctgccatctgtgttgaaaaacatcacttgcacatttcctggaaggaagaaagttggtgttgtagggcgtaccgggagtggaaaatcaactctcatacaggccattttcaggattgttgaaccaagagaaggaagcattataattgacaatgtggacatatgcaagataggtctccatgacttaaggtcaaggcttagcattattccacaagaccctgccttgtttgaaggcactgttagaggaaacctggacccattgcagcaatactctgacattgaagtgtgggaggctctagataaatgtcagctaggtcacctagtaagggccaaggaagagaagttggaattcccagtggttgaaaatggtgataactggagtgtgggccaaaggcaattattttgccttggaagagccctgctgaagagaagcagcatattagtactagatgaagcaacagcctcagtggattctgcaactgatggggtgatacagaacatcataagccaagagttcaaagataggactgttgtcacaatagctcatagaatccacacagttattgatagcgatttggttttggtgctcagtgatggaagagttgctgagtatgatgaaccatcaaagttactagagaaagaagattccttcttctttaaacttataaaggagtattctggaagatcacataacttcagcaacttggcaactcaacatgtccaaagcagggagcaattatag

SEQ ID NO: 104907 - DNA, 528 bp, Glycine max
  Peptide Sequence Number=SeqID_221685
atgattgtgattagtgtcaataatgagaagtatctggcctgtgctgcttctgttatacttgattaccttgccagcaagactatttgttcagatgatttggtagttgtctcaccagatgttggtggtgttgccagagcacgtgcttttgctaaaaaattatctgatgctcctttagctattgttgataaaaggcgccatgggcataatgttgctgaggtgatgaatttgattggtgatgtaaggggaaaggtagcagttatggttgatgacatgattgatactgctgggactattgccaaaggtgcagctctgttgcatcaagaaggggcaagagaagtctatgcatgcactacacatgctgttttcagtcctcctgctattgagagattgtcaagcggtttgttccaagaagttatcataactaatacaattccagtggcagaacagaactatttcccccaattaactgtcctgtcggtggcaaaccttttgggcgagactgtttggcgtgttcatgatgattgctca

SEQ ID NO: 104908 - DNA, 285 bp, Glycine max
  Peptide Sequence Number=SeqID_221686
atggatgtactaaacgatgaccgtaactccaaaaccatgctgacacaattctttgctattaactatagagatctacaagctaggaaccatttgtatagagagattccagagcattatttttggcacaaagggaataaggaatggcaccaaagaagagatccagctagttgggagtacctactttcacccggtgagacttgtttgcccacattcaaaaaaacggttaagcattggagctttttagaaagtgacaatagtcttcgtgaatgcttagttgaagtataa

SEQ ID NO: 104909 - DNA, 477 bp, Glycine max
  Peptide Sequence Number=SeqID_221687
atgcatcacaatttattcatatttctccccaagataagtggatatgtgatttatgaagacaacaaacaaagaccacatctctccccaagacaagtgaatctcaagaaaagtgaatatgtgatttatggagacaacaaagttgagggcccctatgagccttcatgccttgaggcaagtcgcaggttgacgcttggagcgggtcgcccttcaagtctgctagatctaccttcagttttgttaaccatcgaggctactactgctattgatgttgttgctactctcgcttctccaccttctcctactactggagttaatatgccaactacttcagctagttatgttgtgacatctacatccaccattgccacgcccttgccgagtgccagtgtagcaaccactagtgctcctatgatgccgcatcctccttctttggctcccccgattccaccctttgctgtgttgctagtggcgccttga

SEQ ID NO: 104910 - DNA, 270 bp, Glycine max
  Peptide Sequence Number=SeqID_221688
atgagggatgccctaacgtccccaccgcttttccttgctccctcaaaagcagaacagggaagcatcatcgtgatcgaaatacgctccctaaccgaggaagcaacgaaaggtcatgtcattccgtggaggcgagaggtgcctccaccaatacaacacaaagccctcaacctctttaaggaagaggaatcactatcgaaggcaccacggcgagtatcctccgaggaggaaccgccaatggaaatgacctcccagtccattaggggttgctaa

SEQ ID NO: 104911 - DNA, 261 bp, Glycine max
  Peptide Sequence Number=SeqID_221689
atgccaccgaggaagctctccgcaaagagatctaggagggacgccgcggccaaaggaaccagcgccgctcctgagtatgacagccatcgtttcaggagcgcagagcaccaacaacgtttcgaggccatcaaaggatggtcgttccaccgagagagacgcgtccagctcagggacgatgagtacacaaattttcaggaagagatagctcgccggcgttggacgtcgctagtcactcccatggctaagtttgacccggatatt

SEQ ID NO: 104912 - DNA, 261 bp, Glycine max
  Peptide Sequence Number=SeqID_221690
atgacggaagcccctattttggccacaccatatttcacaatccccttccccttggagacagatgctttgggcatgaccatgggtgttgatctccttcaaattttgcaccctattgcttattacaacaaagcgttctgccctcgtctccaatgggtctccacttatgtttatgagctccaagtgatcacatccgcggtttgcaatggtgtcattacttgctgggccatcccttcgtcatcttcacagatcaccgctgcctga

SEQ ID NO: 104913 - DNA, 360 bp, Glycine max
  Peptide Sequence Number=SeqID_221691
atggcccttttcaggttgaggatcgcattggtcaggtggcctactgccttaagttgtctgcttcttcccggattcatccgggaccacccccaactcttccaaatcaccttcccccctaggagttggacaactatcctatcatcgaaccatactcggtgttggactggaagtgggatccttcttcctcatcaccaaccaaactcgtcttggttcaatggtcgagcttgtcccccgaagacaccatgtgggagaattgggaacagttgcaagattcttacgaccttggggacaaggtcgttttaccagatggggggaatgatagcaactccaacaccacaatatccactagcagacccataa

SEQ ID NO: 104914 - DNA, 192 bp, Glycine max
  Peptide Sequence Number=SeqID_221692
gggcagggtttcgctccttttgcatgtcctactccagagcaatttggggctgaggtcgcatggcccggagactggctcgaggcccaagcaagggaggagcccgcaggatcccctggtgaggcagaggaggcccacatggatgaagaaatgaatgacttgctcgatttcttgggaggaagcggagccacgtga

SEQ ID NO: 104915 - DNA, 1815 bp, Glycine max
  Peptide Sequence Number=SeqID_221693
atggtggagggaatgtccctaatatcaaatgattgcaaaagggaaggccacaccaaaaagtattatcctgaaagacagaaaaccaatggtgggagtgacaggcaaaagtacctgggagatgctgccattgttcatgataactatgagacatcaaaagttttggtgtctaatagcagcagtctagaaacagaatggatcatggactctggatatttttgtgaacaagctgaaggatttgtgctctttggtgacaacaagtcttgtaagattgctgctttcaatgatttctgtaaagctaatggcattgctagacacaagattgtagttggctcacctcaacaaaatggtcttgctgaaagattcaacagaactagtttggaaagggtgagatgcatgttgctgagtgcatatctacctaagacattttgggcagaaactgttgcgactgcaacctatctaactaatagatgtctttccacaactcttgacatggaaacaccagaagagatttggtcaaaccaccctccaaagttggatcagcttaaagtgtttggttgtgttgcatgtgctcatattaggcaggataagttggatcctagagtagtaaagtgtatgttcttgggttatccaaaaggtgtgaaaggctacaaactatggtgtctagaacctggacataagaaatgccttataagtcgtggtgttgtgctcaatgagaatatcatagcatatcaagacaaatttgatctcacaaaaccaagcacaagtgatacagacaagactgaatctaagagagtcaactttgaggtagagcagataagcaagggtggtcaagctacagagaattacttgttatctgatgaagatgatgatgaatctgagcaacagacatcagagctagacaattatcaattagctcgtgatagagtcagaagagaaactaaagctcatgagaggtatggatatgctgatttgatagcttttgcactcttttttgcaagtgaggttctggaagaagaaccaaaatcatatgaagaggtgcttgctagcaaagaaaagggaaagtggttgagaaccatgaatgaagagattaagtatcttcatgacaacaacacttgggagctgattagaaagcctcccgactcaaagttggttagctgcaaatggatctataaaaggaaggaaggaatttttggtgttgaacctgaaagattcgaggctaggttagttgctcgaggtttcactcagaaggaacgaattgactacaatgagcctgaaggatttatagtgaaaggcaaagaggattatgtctgcaaacttaagaattcactctatgacctaaaacaatctcctatgcagtggaacaaaagattaccagctgtgggaacatttgtgattttattgttgtatgttgatgacattctgattgctaacaattccaagcttgaaattaacaaggtcaaaggtgaattgaatagagaatttgagatgaaggacttaggggcaataagtaaaatcttgggcatggaaattaagagaaacagaagaaaaggaactctcaagctgtctcaggaatcatatctgaagaaggtgctggagaagtttggaatgacaaagttgaaaccagtcatcacttcacagtctcaacagttcaagttgagtgcaaatcaagcccttaagacagcagaagaagtgaattatatggatagtgttcaatatgcaaatttagtaggtctcttatgtgtgttatggaagtctctcacaggatacattttcgctgcttttggcactgtcatcaattggaagacatggttgtag

SEQ ID NO: 104916 - DNA, 483 bp, Glycine max
  Peptide Sequence Number=SeqID_221694
atgttgttgctagaaaaggataggtacatgaactacagcagacaactcagcaccgcaagtgtgaattggagtcaaaatatgactgatttgaggcccaaaaatgagatacaaagattctgcagaacccttcaatgtcttgcattagagtattggagaaggggctggattttgttactgtggttggttaccactgcttgcctatttgcctggaaattttacctgtatagaaacagatcaactttccaagtgatgagctactgcataccaatagctaagggtgctgcagagacactgaagctcaacatggctcttattctcttaccagtttgtaggaacacattgacatggcttcgttccacaggagccaggaaatttgtcccttttgatgacaacattaatttccacaaggaagtgcaacctttctacttaggtttctctaactctcttaagtgtcaagtaagacatcctaggtgggatacatag

SEQ ID NO: 104917 - DNA, 222 bp, Glycine max
  Peptide Sequence Number=SeqID_221695
atggagatcaaaaaccaaccttgtatgaagaaagtgtgtgatctgaatcaagagagaatgaaggtcgtagccaccgtgaaagtgtgcgatctgaacgaggtaatagccatcgagttgtgcaatccaaacaaagattgtcgtgactatgagagagtgagaacgagggtctcgaagtcgcaagggagagtgtgtgggaggagaggagtgagtgagagcaagtga

SEQ ID NO: 104918 - DNA, 750 bp, Glycine max
  Peptide Sequence Number=SeqID_221696
atggcttcttcttactgttgttcccgtttgttgttgcaatcacagagttggcgactaatgttacgattctcaccctttctcgccacttcccctccttcttcttccctttctttctcctccaattgccacgtgtcctcttccgctcaactaacaacacttcaacaacaacaacagccccttccgcgaagctcacagctggtggcattggaatatgcagacctcaacctctctcacaacttggatctgggtcacgtcaggataaggcagcatgttaaccccctcagctcttctctctcggttcctgcacaagtaccagaatggaaccatgcctttgcagacccaacattgccactcatggtggacattggatgtggtaacctgaatctcaatgataatttatttgatgcattttgtgtgtctgttaaggactgggacagatcatgcagtggcaggtttctaatgtggcttgctaaaagaactcctaaagagagaaattttttgggattggaaatacggcaaaagatagtgaagcgtgctgagtcatgggcaaaggatctggctcttgataacgtgctatcatctacattgttttttagtactaggctggtaggccctattgagcaacctaaggctgttcaacaggagggggggagtgctttcgggggcaattcagacccctatggagcactgcaaggaaagaaaaggtgccactgggctaaaggcttgttggcgacattgttattactttaa

SEQ ID NO: 104919 - DNA, 1668 bp, Glycine max
  Peptide Sequence Number=SeqID_221697
atgggcgggggtccccgcacgtaccctgggggcgtgtcaaagtgggtgtggaagcgcatgcaggcgaagaaggccaagcagcttatgaaggcgcgcctctgccgggagcggcagatatacgagatgcggaagcgggcggagctcaaggccgcggtgtcggagctggagcggccgtgggaggtggtcgagagggaggaggcgacggccgcgccgaacttgttttcaattaaggcggatgagcaggtgaaggtgcttgctgacaggttccagaggccaggcgggtttgacttgtggagtgagagggatggaccagtgttgtttgagagccctgatgagcttccctctgctaggtttttccccaaaggggttgtgcatagtgtgaagccttatagaagggttgatgggtatgggctggtgaaggatgggggtggggatggagatggaattggggagaggggtttgttgaagggaaatgattttggtggaggtttgagggaattgggtgatggggggatggagattgagtttggtggggatttgagtggatttaaggatgttgatgggtttgaattggaagatgatgatgaagaatgttcatcttctgatgtgagttatgggagtgatggtggattgagaaggaatgggaatggggggaggtttttgcctgatgatgttggtaggtctagcaaccgagggcgagggcgatcttctcaattgaattatgggaggaatgtagtggatggtgatgccaggatgaggaagaatgggaaggggaggaggtttttgtccaataatgttgatcggtctagtggtggagagcggtctccccctttgaattatgggggggaaggagtggatggtgatggtagattgaggagaaatggcaatggaaggagggctttgtctgatgatgatggtagcgatggcaagcagtcttctcatttgagttatgggaggaatggagtggatggtgatgatagattgagaaggaatgggactgggtggagctttttgtcatctggcgatggagggcgatcttctcatttgaattatgggagggatggagtggatggtgatggtagattgagaaggaatggggatgagaatggaaggagggttttgtctgatgatgatggtaggtctagagatggagggtggtcttctcgtttgaataatgggaggaggaatggattaaatgctgatggaagaatgaggaggaatgagaatggaagtaagtatgtttcacagggtgttgatgagactgatggtggagagagttcacctcgttcttcgagttctgggaggtatggagcaagttttgatggcaggttgaggagtaagcatagtggaaggagggttttatccaaggatgttgataggtttggtgatggcagattgaggagtaaggaaaatggaaggaggtttatgtcaaaggatgttgatgggtctaatgggttgtattcaggggaagttggttctgtcaggaaacagagagggggttattccattggtggtagaagtcgaggaaagtatactaacaggacttcagactatgcttcaccaagaggtagagatacaaattctgaagtttatgatatgaatttgcaacgagatgggagttatgggttcctgaagaagcgtgagcaacctgattctacaagttggtag

SEQ ID NO: 104920 - DNA, 210 bp, Glycine max
  Peptide Sequence Number=SeqID_221698
atggggttgtgctttggttgcctcgacggaggcaacaagcgtatgacaaaagaagaagagagattggcctctgaagaagcgcgtgctagagctgctgaagccgcccagaaaaagctagagcaacaaggagaggcaaagcaaccagaaacggtaaaggaacctgaaaactccagcaatggcgaagcctttgtaaagtggcagatggattga

SEQ ID NO: 104921 - DNA, 1740 bp, Glycine max
  Peptide Sequence Number=SeqID_221699
atgttgtgcgcttgttcttccggggagcaattcatattcgaagagccgccgcactcgccggagtccctcgccaccagggatttctccgccagcggactctcttccaggaccggagaatgggaacctaaattcgatgaaactcaagtagaagaagctgaatctattcttaaagaagctctttccttaaactacgaggaggctagggctttgttggggaggcttgaataccagagagggaacttcgatgctgcacttcaagtatttcagggtatagacatcaagggtttggccccaagaatgatcaaggctattgccgaaagaaccaagcaaagaaaaccgcgttccaaggcagatatcatggttccgaatgtgatgtcattgcattcggttagcctgcttctagaagcaattttgcttaaagcaagatcgttggaggaacttgggcaatgcattggttggtttcgggtgcccattctgattagtttagtgctttctcatttgctagaggctgcaaaggagtgcagaataattctggatacggttgaatctgcccttcctaatggaatgcctgagggtattggtgaagattgtaagttgcaagagatgtttcatatagcattggagttgtttccaagcctttggatcaaggcagggtttctagatgaagctgtcactgcatatcatcgtgctcttgtcaagccatggaatttggagccaagaaggttggctgctgtacaaaaagatttagctatgatactactctatggtggtgttgaagtaagcctaccctctcagttgcaggtgtggagtaaaactgcacccaagagtagtgttgaagaagcaatacttatgctattaatactcatgagcaaggtggcaattcgggaaatagactgggatgctgaaataatggatcatcttacttttgcactttcagtgacggggatgtttgagttattggcagatcatgtagagcagatccttccagttatttatagtcgagctgagaggtggtactttcttgctctgtgttatagtgcagcaggacatgatgaggtagcattgaaccttttgaggaaagcttgcggcagttctgaagcaaaccatagaccccattttccttcatttttgtttggagcaaaactctgttccttagaccctcaccatgctcatgaaggcattaacttttcacgtgaagttattgatctagctaagcaccaaaatgagcattttcttagtcaaggccataaatttcttggcatctgctatggggctgccgctagaatttctgtactggattctgaaagaagtatatttcaaagagagtctttggactctctaaactatgctgctgtaagtgaaaatgatgacctggaagtgatattcagccttggactggaaaatgcaattcaaaggaatctggatgcagcttacaacaacataatgatgtcctcagacatgactgttggcagttcaagaggttggcagctattagcactcatagtatctgcacagcagcgatttaaggatgctgaaactatagttgattgtgctttagatgagtctggtgggatggatcaacttgaacttctaagattgaaagcagtacttcaaattgctcagcggcaacccaagcaagcaatagagacatataggatcttgctagcgctaattcaggcaaaaaaggagcttttgattcaagataacaacattgatcaaggacaaacattcaggcatgag

SEQ ID NO: 104922 - DNA, 180 bp, Glycine max
  Peptide Sequence Number=SeqID_221700
atgtggttttggagggaggagagaacgcctctaccattggtagtgataatttggagaaaacacttcttgagggatcaaggggaagcaaagcaaatgaattcattggagcctagagaatgcagtgatcaaaaggaagcaaagtcgttcttgttctacgaactatatcctttttgtctataa

SEQ ID NO: 104923 - DNA, 153 bp, Glycine max
  Peptide Sequence Number=SeqID_221701
atggatgactttaagttgggtaattttataggaccctcatacatgaatagggaagcacaatgggttgctcaaaccaccaagttgagtgattcttgtcttgttggaaagcttataagaagttttacaattttgtgtctcacaagcttagactga

SEQ ID NO: 104924 - DNA, 228 bp, Glycine max
  Peptide Sequence Number=SeqID_221702
atgaaattcaagcttcaaccaagaggagatggtctatgccaagtgttgtccaaaatcggtgataattcatacaaatatatatcagcactacaaggacttggtagaccaatgacaaaggcaaatgccaagaaagcaacagaagccttaaaccaaatggtgacaactctcattgaagcagattcacatctagaaggattaaagcctaagttgatcaactacatacaataa

SEQ ID NO: 104925 - DNA, 1353 bp, Glycine max
  Peptide Sequence Number=SeqID_221703
atgcataagcaaacgcataggcatgtgtggaagcggatcagagacagggaagctgggaaattgcgtgcaaaccatttcgcgaaccgcataaaatccaatcgcatttcgcaactccagttgtccaatcacaaagacattgtctcacctcacaaaggcgccatcaactcccttcaggttgattcgacagagggaagatatttgctatccgctgcctccgatgcctcggtagcagtgtacgacgtccaacgacccaccgtttacgaagcaggcggcggcggcggcggcggcatatcgaaacacagctccatatttgtcgttgacaagcagcatcagcaaggccataaatatgcggtgtccacagctatttggtatcccattgacactggcttgttcgtcactggctcttacgatcatcacattaatgtttgggataccaataccacccaggtggtggtgaatttcaaaatgcctggaaaggttcatagggctgcaatgtccaatttgtcaacgtctcacatgcttattgctgctgccactgaggatgtccaagttcgcctttgtgatattgcttccggggcttttgctcacactttgtccggtcaccgtgatggagttatgactgttgaatggtctaattcaagtgaatgggtcttggttactgggggatgtgatggtgcaatacgattttgggacatcagacgcgctggctgtttccaagttttagatcaatctcagactcagcttggaagacgcccacctatactcaaacgctccatgataactaaggattcaagtacaaaattgcgtgctgctcagaagaaacatgctaatggaagtggtagcagacaacaaccaattggcagagttccatccaagggaccaatgaagcagagattacatccaggaatgttgtctactcaggatcgtgcgactgctcattatggtgctgtgacagggttaaaagcgactgaggatggcatgtatctactaagtgcagggtctgattctagattgaggttgtgggatgttgaatctagctgcaacacacttgtgaactttgaaacagttcgtctgcaaataaacaaacctcttcaactagccaccactcaagattcagcccttgtttttgttccatgcatgagatctgtgaaagcatttgacatgtggtctgggaacacatacacgatattgcgtggtcactatgaatgtgtgaactcttgctggtttaatcaacatgatcaggaactgtacactggtggaaatgatagacaaattcttgtctggtcacctgctagatcaatcgctgatgaaatggaaggaactgctgaggatcaggataactggagtagctga

SEQ ID NO: 104926 - DNA, 1206 bp, Glycine max
  Peptide Sequence Number=SeqID_221704
atgggaaaacgtaattctcaacgcaaaagtgctgcgatgttcgatagcgatgacgatagtagcgtgacttcgtcgtcaactgctctttctgatttgatgtcggtgtctggggctgaagatgttcaatttgttcaagattcctttctcgaccaagctctcgatgcattagatgagaaaaggggttccacgagggagaaagctttgtcatcgatcattgacgctttcaatagcaacatgcagcatgagtttgtggagaagaaatttgctaccttactacatcaatgtcttgcttcaataaaaaagggatctaaaaaggcatctgctaaggagatagctttggcatctcatgccattggttgtttggccttgactgttggatgcggtgacaatgcccgcgagatatttgaggaatccattcgtcctttggatgaatctctcacatctaggatagatgtttcaaagacaccatcatgtttggctataatcacttttgttggagggaacgatcaagaagaaacagaacgatcaatggacatgatgtggcgagtgattaatcccaaattaggttccaatgtagacaaggaagataggtctgtacgaattgctgctggtgaagcactggctctaatttttgaaattggagttatagataaattttctgccaagtcagacagtgcaagtgatacaacgcaagaagggagtaaaccacttgaaagctacatatttttacaaggattgaaaggaaaggtgataaatcaatgcaaaaatctttctatagaggctggtggaaaaggttctgccaagaaagatcttaatagtcagaggaacttgtttcgagatatcttggatttttttgagtatggttactccccggatatttcaatgaagattggtggtgattccctgcaggcatcatcatggtctgaaatgatacagttgaattttatcaagcattttcttgggggaggattcattaagcatatgcaggaaaatgagttcttacatgaagtctttggtttctcaccgaagagaaagtatcttaataccaacgaacacagaatgtctggtggtgaaaagagaatgtttaagtctccaaattcggttttgaacaaggctaggacacaatcacttaataagcagcggatattatctgagggcagaaacttcggccactacgctgtcggtatggttgacgaggaggcatga

SEQ ID NO: 104927 - DNA, 441 bp, Glycine max
  Peptide Sequence Number=SeqID_221705
atggatcaaaggaacctgggggatgtcgagtggcttcacttgacattcttaactagagcagagccatatccatggttggattcgatgtcgagcacaccgttgaatcctctattcttcattgatgccatcgagatgtggtggaagcatgacaatatgcttcatgtggacaatttctatagtttcttccgctatcgtagtgtgccaatgggcgcactagattataggtcctatatagttgatttctacgtttggtggacccaacctatgccatcttactaccattttgtcatgcttgtgccagagatcgtcattacatctgagtctcactcattgtctttggatgactctatgtcctctgccagatctaattcttcatctgaggacactaatgttatttcctctacaccgatgtctccacgatcaatgttacctgagtcttag

SEQ ID NO: 104928 - DNA, 156 bp, Glycine max
  Peptide Sequence Number=SeqID_221706
atgttaactgtcaggttaaggatggctcgcattccagacaagatacaggacataaatggatccaaagaaacgctgaaacttgctgtcaggataactgatctttggtttgtgggaacgctggataagtcgaagcaagctgatagacctgacatttga

SEQ ID NO: 104929 - DNA, 249 bp, Glycine max
  Peptide Sequence Number=SeqID_221707
atgtatgaactccttcattgtcttcccctcttcatcgacatcgctatcgttggaaaccctacttgccacctccaactcgtgcaccatacatactcaatagtgatgatggatggggaagagcatgaattgaaaaaaatgcaccattttggaggtaaggttgttgtaattggagatggtgaggaggctagcgtggtggccatgaatgatggcctcaaggaactgttgtggattttgaaattagatatatga

SEQ ID NO: 104930 - DNA, 234 bp, Glycine max
  Peptide Sequence Number=SeqID_221708
atgaatgtttgcccacacacaaagctcaagttgggggataattgcttcaggaatgcaattcagagcattgccaccgtgaaggccttcgatagtgctatggtgtgtcgtaacgtggagaattgggagcacatgccaaagtgcttcgagttgggaaaccatgacgatgccaccttacagatggtacaatgggggaagtggttgcgagggagaaagggaagtggtccagtggggtaa

SEQ ID NO: 104931 - DNA, 456 bp, Glycine max
  Peptide Sequence Number=SeqID_221709
atggcttggtttctgaatctgccgacatcccagatgaccaagctccaagtaatggtgggcaacagtagcatattggattgtgacacctcttcttcgcaggtacccatttttgtccaaggacacacattcaccctttatctatttcatctacccctcagtggtgcagaaattgttttaggggtgcaatggctaaaactcttgagctcagtgactatagattatgctactttgaccatgtccttctcgtatttgggccaacccatcactcttcacgctgacatgctcatgtccccctcctcttctttggatcaacaattaaaacgctttgctcagacccaaagcattgttgctttgttccatttagcgcaaatcccaacccaagaccacacttcgtcttccccacaacaccccctcgaccagcctacccctcctgtaatcacttccatcatcaactag

SEQ ID NO: 104932 - DNA, 576 bp, Glycine max
  Peptide Sequence Number=SeqID_221710
atgggttggaggagtaaccgtggtagggtgagtaatcatcctcatttgcaattaggaggtgaaggcacaacttgcatctgtgatcgaggatccatttctcgtcacaatgatagcaggggcctttgtctcattgaacagtgcgacggagcggggaccgctgcatcgatcattgagcttgtcttcctggagtttggcccgggcagccgcttggggcagagaataatgattgaagagcctgaacttcccaaagattgtcgtagaatgaaggagcaaagcaggactctaaggcctggagcattgtcgaccacaatgaacttcgagctttatgtgaggccgagactgtcaggtcggatttggtgtttgtggagattttggggatgtgggggtggtggtgatgggtacgaggaggttagtggtggtttttctgttgttttggttgggcatggtggttggggagtaaaagtagaggcagtccttgaggtggttaggcctcttagtgatccttatggctctgctagtggatatcgtggtgttgaagttgctatcaacttctctttatacactttctttctctag

SEQ ID NO: 104933 - DNA, 393 bp, Glycine max
  Peptide Sequence Number=SeqID_221711
atggatgcgacattgcagctcatctactacaatatgatcccttccctcacaacgcctttccttccccatgctgccacaacaacctcctccacctctagtggcgcatcttcattgtctccattgagccaaaacccgccatcagtagagaaaattcgaggcttttccttcgagtggagtcgtcaacgaaggttttgggttttggtcgagaaaggtgttggctttgaccttgaggcacatatgtttatggtgcttttcaaggtagcacaaagggatgacttttcttggtttgttgaggacttctttgacgacgtgggcgcattgcttataacacttgtcgtactctatggctcggttcaatgttgggtccttatgccacactactttgaggcttga

SEQ ID NO: 104934 - DNA, 639 bp, Glycine max
  Peptide Sequence Number=SeqID_221712
atgaatgcaagtcgcatgagccctgcatatgaggaaggcattgaagagttcttgtcatttgcctctgaaagaagtcgactcgataaggatggaaaatatttttgtccttgtataaactgtttgaatgcgagacggcaagtactagacgacatatgggaacatcttctgtgtgaagggattaagaagaattatacaacatggataaggcatggtgaattgatagacatgaagatggggtctaaaactaaaccgattgatgtagaaatgggagatcgattagaggatatgatttgtgatcttggacaagattcatttgagcaagaacacgcccttatgtgtgatacattggaaagtgattcgaagaagcctttgtatcaggaatgcaagaaatctctgaccctgttgtcagcggtgttaagtctggttaatgttaaggccagatataggtggagtgacaaaaagttcacttcactgcttcaggtagtgcaggttatgtttccaaaggagaacacgttgccaaaaagttattatcaagcaaagaagatattgtgtctgatgggtatggagtatcaggaaatacatgcatgccctaatgattgtatattgtatagacaagagcccaagacaaccaagaaatga

SEQ ID NO: 104935 - DNA, 390 bp, Glycine max
  Peptide Sequence Number=SeqID_221713
atggtgaagcattggagcttgacgcaggaggtgatggaggagacccatgtctatgaggaatgtcacgtgccacggcttgaatgtcagcaccagaggtggttgatggagcagcagcagcagctaggtattgacgtaagtctatggccctctgttgcatggcccatgaagtttggcccagtggatcaaaaagtgaagacaaatcataggtggtggccggcactgccgcaactgtggccggcggtaggtcggcaattgagaaaccggagggtggtgctgccgttgtttgcggtggtggaggaggtggtgatggttgaggtaactccatttgagcaaggtggccatgtaggtaagagagttctgcttgtaagcttaccagctgtagaacaatga

SEQ ID NO: 104936 - DNA, 111 bp, Glycine max
  Peptide Sequence Number=SeqID_221714
atgaatgcttttaagggaaggtctcaaacaaccaaacgaatctggatggctagatgtgctggcaatgagccagctgcaaataagccacttttgaatcatggttgctattaa

SEQ ID NO: 104937 - DNA, 174 bp, Glycine max
  Peptide Sequence Number=SeqID_221715
atgaaaagatcgatgtatagggtagtgaaactgtggcaagggaaaagatataatggaataagtcataggagacaggaagaccagcaaggaccattaggttatcaatccctttacatgatgctcaataatttttgcctctaccaacttcattatgcttttctaagattgggatag

SEQ ID NO: 104938 - DNA, 102 bp, Glycine max
  Peptide Sequence Number=SeqID_221716
atgattcaaaagtggcttatttgcagctggctcattgccagcacatctagccatccagattcgtttggttgtttgagacctgaaaacaagcatatacatcag

SEQ ID NO: 104939 - DNA, 216 bp, Glycine max
  Peptide Sequence Number=SeqID_221717
atggaagggagtaacaccattgtgccgagtattgttgtctatgtcattgttcccaacaaagaagcaggtaagaagttgactggaagcatcgtcaaagagaagcttgctgcttgtgtgaacagggtattggatcagtgtaccagtgagagggaaagatttgtgttgcaaactgtgaagcacactctaacatggactcggacactccaacacaactaa

SEQ ID NO: 104940 - DNA, 3774 bp, Glycine max
  Peptide Sequence Number=SeqID_221718
atgcaaaaggtttacgtaactctctctctctctctatatttccttaggaggctgccttccctcgaagtagggcccattctcccccttctcttctttccccactcccctctgctcttatcactggtccgacctgccgccgctacgtctgccatggccgaccacgcgactaggaaaaccactaccgataggctcgaggaggccattaatcgtctctccaacagccaagccactcttctagataaacatgccgacctctttgataaatactcagaactctccggcaaggtcgacacgctcctcgatcatctccacctacggtctccagcaagggaacaccatgggtcttcctctcatttccaccagcgcaactctgtcaagctggacgttcctaggttcgatggccgtgatcctatggggtggatcttcaagatctctcagcttttcgagtaccaaaacactccggaagaagaacgaataatagttgcctccttttaccttgatggtgccgcgttgagctggtaccaatggatgttcaggaatggttttattacttcatggtccggcttcctacaggccctcgagtccaggttcgcaccctcctattatgatgacccaaaaggagctttattcaagcttacgcaacgaggcacagtcaatgagtacttaacggagtttgaacggttagctaaccgtgttattggcttaccaccacctttcctgttaagttgttttgtttcaggcttaacacaggacatacggagagaagttctggctctccaacccatttcactcccacaagcaatggctttagccaagttgcaagaagataagcttcgtgatcgccgacaagctccaccacgaaaccacaatactccgtcagcatcatacgctcctcctacccgaaaaccacactctacgtatgttcagagaaccccagatgaaatggctctccgtcgggaaaagggtctctgttacaattgtgaggaaaaatggagctccacccacagatgtaaaggacgtgtccttctgttcatcgccgataacctttctccgacatcagatgaacccatctctgaaccccccttactcccactcccagaaccaacaccagcatgtccccctgaccttgactcaacctcagaattaactcctcctcacgtgagccttcacgccctctccggccttccctcctccgagacttttcggcttgtcggaatcatcaaccactctcccctcaccattctcatagatagcggaagtactcataacttccttcagccccgacttgcccagttccttcgactaaagactcaaccaacaaacccactaaatgtcctagtaggtaatggatctgtcctcaagtgtgaccaagtttgccatgatatttcactcctcttacaggaccatcactttctggtcacgttccatttgctgcctatcagtggggccgatgtcgtattgggcatagaatggttaaagcagtttgggcccatcattactgattacaccacgttttccatgaagttcacccatatgggccagcccattgaattacacgctgatgtctctactgggccaacaccaatctcagcccctcaagtaaaacggttactacaaaccggagccgcttcagcactttttcatttaaaggtgatacccaacccacaacccgacccactacttcatcttccccacccgataccagcagtccaggctcttctcacccagttccataaccttttccagcaaccctcctcccttcctcccccgcgatcaatcgtccaccacataacacttctccctaacacccccccaatcaatgtacggccctatcgttacccacagttccagaaatcggagattgaaaagcaagtctcggagctcctcgaatccggcttaatccaacctagcatgagtccctactcatcaccggtactactagttaaaaaaaaagacggaacctggagaatgtgtgtcgattaccgagctttaaacgcagctacagttcgtgatcgttttccgattcccacgatcgacgagcttctggatgagttaggaagtgcgacttggttttctaaactcgacctccggcaagggtttcatcaaatacttatgcatggcccagatgtggaaaagactgcgttccggacacaccaagggcactacgaatatcgtgtgatgccctttggattgtgtaatgcaccgtccacctttcaggcagcaatgaataccttgctaacgccatttttgcgaaaatttgcagctgtatttttttatgatatattgatatatagcagaacgttagccttacatctacaccatctcgagctcgtcttccgaacgctactacagggccagtattacctcaaaaagacgaaatgcctttttgctcagaagcaaatagagtatctagggcacatcgtatcgggccaaggagtcaagccggaaccgtccaaaatccaagccatggtgcagtggcctacaccgtcatcagctaaggaactcaggtccttcctaggacttacaggtttttatagaaaattcattcaaaactatgctatgatcgcggcccctctcacttctctcttcaccaaagatgctttcgaatggtctctggacgctcaatctgcatttgagaaactgaagacagcaatgacatctgcccccgtcctcgcattactcgatttcaatgaaccatttacgatagaaaccgacgcctccggtaccggcatgggagcagttctaatgcagaagggccatcctcttgcattcttcagtaaacaatttggcccacgaatgattcatgcctccgcttacgtcagagaacttcatgcaatagtggcagcagtccgcaaatggcgccagtaccttctgggccatcccttcaccatttttaccgatcatcaaagcctccgcgagctcatgtctcaggtgatccaaacacctgagcaacactactatctttctaagctcctaggcttcgactacacgatacagtacaagaaaggatcttcaaacgcagtcgcggatgccctatcccggtcatctccctccggccagttcctcctattatcagttcctcaccttgacttcatgcatgacttacgcaacactctcctttccagcaacgcattccaggaactgctcactaaggtccgtgacaaacctcatgactatcctgactatcgtattcaccagggactcatcctcttcaagaatcgcatttggctcaataatgatcacccatcaatacccaacctcatgctcgagtttcactccactccgttaggaggacatcttggggtgactaaaaccactcaccgattagagtccaacttcttctggccctcactacgaaaggatattaagcgcttcgttaaggaatgcaccatttgtcaacaaacaaagtccaccacacaacgccctgccggacttcttcaacctcttccaccacccaccggagtctgggaagacatctcgatggatttcataacccaactaccctcctctcacggttatactgttattctggttgttgtagacagatattcgaagggggtccaccttggcgctctcccgacaaaccattctaccttcaaggttgcttccttgttcatagatatcgtctgtaagcaccacgggttcccaaagagtattgtttccgatagggacccgatcttcctaagctctttctggcgtgagctttttcgactcagtgggacacgactccgcatgagtacggcttaccatccccaatccgatggtcaaaccgag

SEQ ID NO: 104941 - DNA, 1578 bp, Glycine max
  Peptide Sequence Number=SeqID_221719
atggcagttggaaatcgggaagtgctagaacaggggctgttgataatgcctgttttagcttctcaaatgctacctgagcctgagtggattgcggaaccgaccactgagttacggcagctactttggcagctacaagctgaacccccctccgagacactacatgccccaagtattccacctacgtatgtcatcaaagaagacgatggcaaaacgacggaggtaaggactgaatatggagttcatggtcgcctgaaaagaggaaggggcattacacagcccgaagggcatgaccttgaactcaagatcgagcttggagaagtagtgagcacctcccaattcatcaaggagttcgtcaatcatcggaatgggaaatctatccttgacgcccgtgttgaagcatggaatctacttgtaattcaatctcacgtttctgaaagtgaggatatcgatatgggcgtacgttcaccggcgtggattggggaagaagatgaatgtgatgatcagtgggtcgtgatggcggaaggtcagtatggggttgaaacagggcctcaaaacgagtcaaaagagtttgaattggggcaggtaagctctcaacatgagaagtggatgggtcctccggcaggattgcaacatggaagtaactgccaagttcttgtgtcttacatagacggtgaaattgggttaccgataacagactcagaccagcttcccagtatccttgaaggggtgagtggtgcaacatgggaggcccaactgggtcacaagctgttgttggataaagttgtgagtacttcctccatcaacaaggaggaggaaagggtggccgacaatgtggcccatcaggcagagagtttccaatgcgacatggtccgccagagaattgagggaaatttgggttgggtacaaatttgtgggatcggatgggtcaggggatggtgtatcgggtgggtcagatataattatattagaaggggttgggtttgggttgtcatcatctgccacgatgaggagaaaaaccctaaaggcacaatggtgacctctgtgttcgggcatggggtggttgcaagaggggtggaaggggttgcgaaggtgggccaaaccggcggcctggaccaaggtcataggctggtgcgcttgcacctcgcgccatatcttagggggcagtccaatgattctattagcaaggttctcgaactcggagagagcgttgaggaacgccgggcaagaggtgaactagccgttggtgttcatccattggaatcacgcgagggcgtggccctctatgtaaaacgacacaatggtgtgggtgtcggtgaaggcaaaggtgaaggattaggtgaagtttgtgatggggcagggcccaaacactggataagttcttcgattttaagggtcatggtgttgactgattcgcccagatcatgcattctctcaatgaaagcaccaaatggtaggggtgctaatgtgcagactggtttcgaggtgaccagctcctccaaaaatagcagaaaggagaggaagggcacagaaagagaggggaatatttctataacagaattgggtggggatgactcctag

SEQ ID NO: 104942 - DNA, 687 bp, Glycine max
  Peptide Sequence Number=SeqID_221720
atgggcattgccaagaccatcgcgcgtctctcagaaaacttcaactggaccgggcttcgagaggatgtgacccagtttgttgccaattgcattgaatgccagttcacgaaatatgaaacgaagaatgttgtaggtctcctctaccctctgccggtacccttccgtctgtgggaagacctatccttagacttcatcatcggccttccaccagatcacgacaaaatggttctcctagtcattgttgaccgatttttaaaaggaacttggggaaagttcctaccatgggttgaattatcccacaacacatcctggaatctagccacggggaacacaccttacgagattacattcagacgcaagcccttcagcattcctgaatatctttccggcagctcgaagatagacgttgtggacgaaatgttgacccactgggagaaggtgttccagagcattcgaaagaagttactaaaagcccaagcctccatgaagctccaagcaaacgcaaaacgcagggaggttcaccaccaagtaggagattgggttctcttgaggctgagaccatatcggcagacttctgtcaagaatctcccgactgtccctgccaaactagccaagcgatactatgggcccttccaaatcattgagtgtattggtcccgtggcttatcgtctccaacttccccaatga

SEQ ID NO: 104943 - DNA, 588 bp, Glycine max
  Peptide Sequence Number=SeqID_221721
atgaagaaggcggcagacaaacaccgccgtgacgtcaactacaatgtcggccaatgggtctatgttaaattgcgccccttcaggcaacgcttcgtagcaggtcccatacacccaaaactatctaagaggtactttgggccattccagataattgaacgcgtaggacacgtctcgtataagctggaactacccgaggcggcaaggatccaccccgtcttccactattcgttactacgcgagcatcacggccctccaccaccccggcaagatacttggccattagaattcataacccatcagcctgtcccacgtcccttgtgtattctggactctaaactcgatacatcatcatctccgccaaacaaactcgtcctcgtacagtggacgggccaaccccctgaggacactacctgggagccatggtcagaagtacgtaacaattaccacctcgaggacgaggtggtcctcgcgggcgacggtattgataacagtagccaggaagataccaagaatgagcccacaactacaaagacaaagcccaaacgtaccacatcaagaccctgctacttgaatgactacgagacatga

SEQ ID NO: 104944 - DNA, 249 bp, Glycine max
  Peptide Sequence Number=SeqID_221722
atggataagagcttgaagatagagaagatgaatggagggagagggtcggggagaggcccatgggctcataatttgcctatgggcacaaaatctaccctaaggctcatgagaaccctagggtcttctcctacacccctggcccaatcttcctggagtctgctagccatggctttggtgaaaggtgccctccttaggaggattgcatcagttcagcccactaatccaagattctccactaagtgtgcttag

SEQ ID NO: 104945 - DNA, 220 bp, Glycine max
  Peptide Sequence Number=SeqID_221723
gccaaacaactactttaagggaataattaacagtgctttaaaaggtcttgatgatgctccacaacctaagtcaaaggctcctactaggtggattgtcgtcaaggcagctgtgtctccgacaaaaccacctcaaaagccagatccggaggtcgatgatccgctttatctgatgacatcgaccatcacaaagcttttcctgaggctttaccaggttacatag

SEQ ID NO: 104946 - DNA, 447 bp, Glycine max
  Peptide Sequence Number=SeqID_221724
atgttgcatgaccgagatgttatgaaccaccacgtcttggtcgtccccgaaaacaatctgcgccagaagagtagtcttctcaacatcgatagttgcagaagggtttttccaaaagaggaaaagctgcaacaagaacaaagtactcctgacagtgtagttaatagagatcaaaacaccatacctacaaatccaactactgctcctaggcattttgtaaactttgtctatgacacgaaatttgagaggacgggtattcccatttaccccatctcagattattcaaaccaccatcaccaccaccatcagaaatattctagcaagggttcttcacaccgtcacaagagggaccaaggccacctccctgtcaacaccctccacaaggttgccatcaaggctgtcgatgttctcaccgtcatggccatccgagtcgagctctctccctcgtga

SEQ ID NO: 104947 - DNA, 366 bp, Glycine max
  Peptide Sequence Number=SeqID_221725
atggccctatcaataagcccttcattcatcctatactcattgaaaagcttgacacaggagaagttgatgttcaacacattgcagtttaacatgtctgtgcctacaacatatgtttttatgaaaaggttcctaaaggcagctcaagcagatagaaaggaacatgctgcttcagcagttctcaacttcagtgaggactgcacacctcatatgttaacgccatacttggatggaatagttagcaaactacttaatggtaagcagatggtgcaagaaggtgccttaactgctttggcatcaattgttgattattctcaggaacctaacacagagatttgtgcaagcatgttggattcattaattgaatga

SEQ ID NO: 104948 - DNA, 276 bp, Glycine max
  Peptide Sequence Number=SeqID_221726
atgaatcatgacaatgtgccaagtactggtttgagcatgcttttcatggaaactattcatatgtccatctgttttgaaggactaatatttggtcaaaaaggttacagacaaaaggtgaaggacattgttcaaggtgctttattccctgaagctggtctagataatagagttggtcatgctgggggagtaggtggactcgtgattgttcgagatcttgacttgttatcctattgtgagtcctgcttgcttcatatgtacttattttcaaaatattaa

SEQ ID NO: 104949 - DNA, 372 bp, Glycine max
  Peptide Sequence Number=SeqID_221727
atggtgcctttgaaaatcatggtggaaaaaggggaaagcagccttcaaaaacagtgttttctaccaccgtcggtgttgaagaacatggtaattacaaaaatgtcaccgataaagcaacaacgacgggttttgaacaccgatgtagaaggatctcattcttttggtccaaatccttcctccattgatgttgaatctgtcacaatgtctcattatgatttacttgaatcatacgttggaagcaccggaaaggcccaagaagcaatcttttattcttacaagagatatattaatggttttgctgcaatacttaatgaagatgaagcagcgaatgtttcaagtacaattaatcaaacacttgggacatatgtatga

SEQ ID NO: 104950 - DNA, 258 bp, Glycine max
  Peptide Sequence Number=SeqID_221728
atgtatgcttgtagtaacaacatactctcggtcacattgctttcttatatttttccatataaatcaacaggaagaaatgttacaaataatatggttagacaccaacgagcatgggaactttgcagcatgacctggaacggggattcaagtcgcagtgaaaatcctcaatccaaatggatttcagggtcacaaggaatggcttgtaaaactataaatgacattcacattagttcagacaaatttgttgtgaggctttga

SEQ ID NO: 104951 - DNA, 366 bp, Glycine max
  Peptide Sequence Number=SeqID_221729
atgcctcctcttctcacgacgtgcatccacttctcacagacctccgtcgaactgtcaaccctctcccattgcgatgcagccaccaaggacgtagatcttgccgtggaggactcctgcggtggcgaattcgcagctgacgcacatggagggactgcggagccagcggttgaagtggcagtcaatgagccagatgttgggggaggggaggtcgtggatggagccgccgaggacatagatggtggggccgaggatggcgtaggcggagccgacggcgggggaggggatcgagggaaggggagcgaggagggtgttattagggtttgtggggtggagcgtgaagcattggaggagaaaggagtcacgtga

SEQ ID NO: 104952 - DNA, 558 bp, Glycine max
  Peptide Sequence Number=SeqID_221730
atggccccgaggaagcttgcctcaaagaggtccaggaaggacaaggcggccgaaggaactagttccgctccggagtacgacagtcaccgctttaggagcgctgtacaccagcagcgcttcgaggccatcaagggatggtcgtttctccgggagcgacgcgtccagctcagggacgacgagtatactgatttccaggaggaaatagggcgccggcggtgggcatcactggttactcccatggccaagttcgatctagaaatagtccttgagttttatgccaatgcttggccaacagaggagggcgtgcgtgacatgagatcctgggtaaggggtcagtggatcccgtttgatgccgacgctatcggccagctcctaggatatccgttggtgttggaagagggccaggaatgtgagtatggccagaggaggaaccggtctgatgggttcgatgaggaggccatcgcccagctgctatgtataccggggcaggattttgcccggactgctgcagatatggatgacgttggtcctcagcaacatcctgcccagcgatcataa

SEQ ID NO: 104953 - DNA, 333 bp, Glycine max
  Peptide Sequence Number=SeqID_221731
atggatacctcagagccctacactagggtaatgaaagacaccatgcataaacctcaagcgaacctaggggcagatcataaattctcacccaataggttccctgctacaaagtttcctacatctaatgtccaatcttttgaatttgggatgaccggccctttcgatgcgtcaatctcttactttctcataaggttggacccttgggtactagtacctattgcctttagaggactacacatcctcgactttagagggctacacgtcctcaccttcagaggactaccggtcctcaccttcagagtgcttcacgtcctcgcctttagaggactgtag

SEQ ID NO: 104954 - DNA, 297 bp, Glycine max
  Peptide Sequence Number=SeqID_221732
atgaggaagagcgtaatgtcggagacgaatttcggagggagtgttctgttgattaaagggggaaaagggaatagtcactttccctcctcgtgccttcctcaccggtcacgttgttgtattggcaccgaggtgactgtttggattattgtgagtggcttgacccgacggaaccatagcttgaatctgtgtataggcaatcatattatttttgttcagcaattgtgctttaacaactgtgaggggaaccaagatgggttgtgttttggagcaatgaaggaaggaggatgtggtgcttga

SEQ ID NO: 104955 - DNA, 225 bp, Glycine max
  Peptide Sequence Number=SeqID_221733
atgcaagacaaatcgaaagttcagaaagcaagcccaaaggagagaaagagtgaacggagtgagaatgggaatagaagagaagaagaaatgaaaaaaaaaactcaggagagaaagagtgaacggagtaagaatgggaaggggaaaagcaaaaaagcaaaaacgggcaggacaggtggattgaagatagacaacaggcagtcagagccttgtttgtatataagatag

SEQ ID NO: 104956 - DNA, 1854 bp, Glycine max
  Peptide Sequence Number=SeqID_221734
atggaaaacaacgtcacaatattactctttcttcccctcttcaccattctcacaaccgttgcagcttctaattcctcctcctcatcatgccccatcaacttcacctacgttgaaaccttcccatggaacacttcatcttgcacaaacccaatcaacaaacaaccttgttgcatagcattaaacaccatcttccacataggcctcacccaacacctcaaagaaacctcattgtttcaacttcccaatgaaaacacttcctcaacttgcttatcagatttccaaaccaagctaaaagccttgtcaatagacctttctttggtccctttttgcttccctaacccctcacaatttgttaccaactcttccacatgtgcaggtattataaccacacaagattgggaacaaaaagtggactcggttaggcttggtccattatactcttactgcaaagaaagccttgatgacgaaactcggtgtcaaaattgcattgcatcaagttttaaagtggcttttcagcttactagtactaaccaaaatgctagtgtcaaagaatgtttttcctttgcatcactatatgctgcagcagttgttaatccacaaggtgcaagtgatgcaaccacgattggttgcatattgagggtgccactgaatggtgaagtaacaacaaaagggtcatcaaagaagagaagaaaagttgtgaagctggtttttgcggtattgggtggcatggttggtgttgttgtcattgcttttgtggtgatggttgtgtacaggaagtgggataggagaaggaaggaaagggtttattatcatagggaaattgaaaacggtgtgaggaacagtgttttgcctaacactggtgcaaaatggtttcacatatcggagcttgaacgtgccactgatagattttcaaggaggaacatgcttggccaaggtggtgatggggttgtgtacaaagggaagctttcagatggcactttggttgcaattaaggagaattttaatttggagagtaaaggggatgaagagttctgctatgaagtggagatcataagcaagataaagcataggaaccttcttgctctcaagggttgttgcattgcaagtgatgatttgaaaggtaagaggaggtttttggtttatgatttcatgcctaatggaagcttatgttaccaattatctcttaatgtggccaataggttaacatggccacaaagaaagaacataatcattgatgtggcaaaagggcttgcttatttgcactatgaaatcaagcctcctatttatcatcgtgacattaaggctaccaacattcttttggactccaaaatgagtgctaaattatcagattttgggttggcaaaagaaggtagtgaggaggaacaatctcatgtaactacaaaagttgctggcacatatggttatgtggcaccagaatatgctctatatggacaactaactgagaaaagtgatgtgtatagttttggtattgtgattcttgaaatcatgagtggtagaaaagtgcttgataatttgaattcatcagcggatgccatcactgattgggtgtggacacttgtggaatcaggaaagatggtggaagtttttgatgagtcaataagagaagggccagaaaaagttatggaaaggtttgttcatgttggaatgctgtgtgctcatgctgtggtggctttaaggcctactattgctgaggctcttaagatgttagagggtgacactgatgttcccaaattaccagataggccggtgcctttgggtcatgcttcttttcaatcttctctgttgcatggtttgcaaggaagtggaagatctaaggcacatgtttcatcttaa

SEQ ID NO: 104957 - DNA, 198 bp, Glycine max
  Peptide Sequence Number=SeqID_221735
atgtcggatacaatgtccaggacatcctgcccgaaaacactggaggtgctgtacaatattttcaggaagaatgatagatctcctccagcacaagccgttgcagcccagaaacgcacattgctatataaacatgaaggctgcacgagttctgtaccaagtccgggattgaagagttattttgtgaggtttgggacttga

SEQ ID NO: 104958 - DNA, 102 bp, Glycine max
  Peptide Sequence Number=SeqID_221736
atggcgtatgtgggttttcactggtggagtgtcctcccttctttcattagaaaggacctcttccgtaatagatgcggtttgcctttctacagttttagatag

SEQ ID NO: 104959 - DNA, 1842 bp, Glycine max
  Peptide Sequence Number=SeqID_221737
atggataagcaaattttgtttcttcttccccttctcatcatgtccctcttcactgtttcaatagccgctgaatcttccagctcatgccccatggatctcaactatgttgagacctttccatgggactcttcatcctgcagagaccctgttgacaagaaccactgctgccaagtcttgctaagtgtaattggcataggactttcccaacatctcaaacaaacttccttgtttcaacttcccaatgaaaccatttcctccaattgcttatccaatttccaagccaaactcacagccttgtcaattgacccatctttggtcaattcttgttttcccaactcctcccagtttgtcactaattcctccacttgtgcaggtattataaccattgatgattggaagcaaaaagtggggttgattagccccttagacacttcttgcaatggggacctgagtgatcaaactcgttgtagcatatgctctgatgctggcctcaaagtgacatcagggctcaacagtaactccacaagatgtttctacttcacaattctgtatgctgcagctattgttaaccagtttggtccaacaaatttaggcacggcaagttgcatactaggcatgccactttctgtaaaagggtcatcaaatagaggactagtgttgaagcttgttattgggctattgggtgcttttgttggtgttctgcttgcttttgtgttgattgttgtctatagaaagtgggataagagaaggaaggaagatatgcatcacagggaaattgaaagcggtgtgaggaacagtgttttgcctaacactggtgccaaatggtttcacatatcggagcttgagcgagccacaagtaaattttctcagaggaacatgctaggccaaggtggtgatggtgttgtgtacaaagggactctttcggatggcaccgtggtcgcggttaaggagatttttggtttggagactaaaggggatgaagatttcacctatgaggtggagatcataagcaagataaagcacaggaatcttcttgctcttcgcggttgttgcatttcaagtgataatgtgaagggtaagaggaggtttttggtttatgacttcatgcctaatggaagcctcagtcaccaattgtcaattgctggtgctaataggctaacatggccacaaagaaagaacataatccttgatgtggctaagggtcttgcttatttgcattatgaaatcaaacccccaatttatcaccgtgacattaaggctaccaacatacttttggattccaaaatgaaagccaaagtttctgattttggtttggccaagcaaggtaatgagggacaatctcatctcaccacaagggttgctggcacatatggttatttggcaccagagtatgctctatatggccaactaactgaaaaaagtgatgtgtatagtttcggcattgtgattcttgagatcatgagtgggagaaaagtgcttgacacaatgaattcatcggttgttttgatcacggattgggcatggacacttgcaaaatcagggaacatggaagatatttttgaccaatcaataagagaagaaggaccagagaaggtcatggaaaggtttgttcttgtggggatactttgtgctcatgcaatggtggcattaaggcctaccattgctgaagcacttaaaatgttagagggtgatattgacattcctcaattgcctgataggccagtgccacttggtcatgagtcttttccatcttctttgttgcaaggtttacaaagtggaagatcaacggcatatttttcatcatatctttcatctttttcaacaaggatgagcacagtatag

SEQ ID NO: 104960 - DNA, 222 bp, Glycine max
  Peptide Sequence Number=SeqID_221738
atggctaatgcaaactgtccgcaagaatcattgcattcagtttcaaacgggaatctaagttgtgagactagtcataataatacaagcaaaagcaagatggatcctatgccgtatgagactagtcccacattagaagtatgggattctagtgtgggtagtaaaagagaaatccctcccactggtagtgagaaggtggtctccaaaaactctcttggcaactaa

SEQ ID NO: 104961 - DNA, 417 bp, Glycine max
  Peptide Sequence Number=SeqID_221739
atggcatcaaatggtattaatttgtttaaggaattgaggcatggccctatatatcagaagacaattcctagcaaagtactagatagagtagacttatggaatggaaatcatcttggaatctccaaagaggatatgaaaaagcatgtagtgccatatttgaaggatcacatattcgtacaagatagtatcaataaggctaggttcaggatgcaaggagttaatcagaaagttattcaaagtaatatgatggagcaatctcaaaaggaggaggtggaaccatcatcctcccaattacttgatggatcattgtcatactggtggcctacaccaaggaaactgctgcaaatacagcataatatggtgaaggaaggttgtgctaaaggttttctactcggggctgggattcagtcattctaa

SEQ ID NO: 104962 - DNA, 1139 bp, Glycine max
  Peptide Sequence Number=SeqID_221740
aaatacgacataagcaaggaaaaatgggcccagttttgccaaactcgcagagacccttcttgggaggatgtgcgcaaaaaggcacaagtcatccaaaaacagaacactgccccccacgttttgtctcgtgggggttatgaatatttggagctaaagctcctggctgagaagaccaagaagaagctggaggaagctgcacagtcaggaagcgttgatggcgtcatcgaccctccatccccggtcagacgccatatgaagtggaagatggcccgcacgaagaaaacgagggagatgacgactgaggccgcaaaggaaatcactgagaagatccaccctggatgtgtccgtgctgttggagctggtgtcaccatcaagcaatactttggatcggctccatggacgtctcacagctcttcctccctgcctcctgaagaattacaacagctggcccaacaaatcagggaccagctagaggagtctatcacagaaaaaactcagtcccagaagcaatctcaaggacttgcactgcctcccgagcctctagttggtccctcagttcctcgagtaagcacaaaggggagttgtgttgatccctcaggaaacgatcctaagacgggtgactcagataggtgcgccttgtacatcgaagcagatcctgcccgcctggttgccttggggagagtttatgagggatccaatgttgttcataacactcctttgttgcctggccaagtaaaggtgggtgtggaagaggttacagatgcagatgctccagttcctgtacccagtgatgaggttacatgggatgccaccgtgttcggggtctttaatccagacttctcgctctacataaagcacgaagacctctccgaaattgcacacggtggtcaatgtctcagcatatcaatcggacactggcagatggtggtcattatgcccaacgaacacctagttgtctggttttattcattgcataacaggccagacaactaccttaaggggattattagcagcttaaatcaaaggctcctgctaggtggattgtcgtcaagacaaaaaggaatactgagtgcggctactatgtcatgcactggatgtccaccatcattttatgaagttttaggaataactgggaagcg

SEQ ID NO: 104963 - DNA, 219 bp, Glycine max
  Peptide Sequence Number=SeqID_221741
atgttgaaacctagtttagttggtgtggtgatccgtaaacagcctagcaacttcccgatagcggtttccgccatcgccggcaacaatggtggaaaaaacaaaactcgaagaagaagcagaaacgcgaagaagaagcagacccacaccttcctcttaatcacggcaacaatggcggctggggaggttcacttgggaggcgaagaagaagaagaagaatga

SEQ ID NO: 104964 - DNA, 1062 bp, Glycine max
  Peptide Sequence Number=SeqID_221742
atggctgaatcgatgaaaaagcgaaagggctcttccaccaccgccgccgctgctggccatcgacgccacgaaccatctaaagcacccacaacaccagttcctccttccttaatcatatcagaccctaagtacctagacatagctttctttgatgatgagacatttgactgctatcaagtatttcaaaactctggcatagttgagtttatgtctttaaagttgcctcattatcctgaactagttacagtcttttacaataacttaagaattcaggatagtacactttactctgaggtgcatggtattccttttgtcattgatcaatctctgtttttctcattggctaaattacccagtcaatatgttccttttgagggcactgttgttgatgactggaagtttgattattcgagtcatgatgctcgtcgtatggtctgtaatgaccaggctgatatgaccaacaaattgtttgtcgggtcattagcctttgattgccgcatcatgcactacatcattgttagaattttgttaccccattcttctaatcttgctcaagcctctaaggaggacttgattttgatgtgggcttttcttaccgattgtcagatcaactgggccgacttggttaagtaccgtatgcataaggcattacggacgaatgcacctcttccgtatcctcagttagtcactctttttcttcgtcactttcaaattcctctcgatgatgaaccttttgttcaagtcaagagatcttttgccattggtgttggagcggtaacttcttttgggtaccgtaaggatattgatggatactggattaggaaacaagattcaccaccaccggttcctgatgagcgtactctgtctcctctgccacaaagagatgcttcctctactcttatgcatgaagtcctttctgaactacgtggccttcgagcattcgtaggtgactgtttggatgccatggatgctcattttaaaggcatggatacacggattactcagcttgaagatgacatgggtttcattcatcgttgcttcgatccacctgctgccccatag

SEQ ID NO: 104965 - DNA, 1065 bp, Glycine max
  Peptide Sequence Number=SeqID_221743
atgaggaatccatcatcaacaacaacaacagcagcaacaacaacaaccaagaccaaggtgaagaacaatagtaacaacaacattggtagcaacaactctccatgttgtaacaaggttgggttgaagcgaggtccatggacgccagaagaagacgaggtattagcgaattacatcaagaaagaaggagaaggacggtggagaacgctccccaagcgcgccggacttctccgctgcggcaagagctgccgccttcgctggatgaactacctccgcccctccgttaagcggggccacatcgcccccgacgaggaagatctcatcctccgcctccaccgcctcctcggcaaccggtggtctttgatagctgggaggattcctggaagaacagataatgaaataaaaaactattggaacacccatctaagtaaaaagcttattagccaagggattgatccaagaactcataagcctcttaacccagcatccattaatgttccttcttcttccactacttcttctaaacctcttccaatgatcattaccaacaaccatattaaccctgttcatcacgatctcaccaacatgtttaatcaaggagttcatcaagttcatcatctgggtcaacatcaccaccaacctccagcttctaatccctatgataaccataacccagtacctgctgctgccaccggtgatgtttctgcaatggctttcatggacaacaacaacgaggattgcaacgatgatatcaacatcaattattactccgacgatgttttttcttccttcctcaactctttgatcaacgatgatgcttttgcggcgcaacagcatcacgtgcaaacggaaatccccacacccagtgagcgtagcatcatgaatccacttccatgtgatgatcgtgttggtggtcatctgggttcaatcgccactgcttctgcagcgcaaggttacgatgatgaacttggggttctgtgggaatcgccactcgtgaatgctgctactttcagccaacacgttgacgatcacatcaccaagagggttcatgatcaccacaatcaatag

SEQ ID NO: 104966 - DNA, 492 bp, Glycine max
  Peptide Sequence Number=SeqID_221744
atggatgccacctccactcttccggcaccggcatcaccgacattgctttgcactcctccaggatcaagtcagaaaaaggaatatacaccggacatatctggactttgtgcaatgtcgcactgctttccatttccaccacgaggatatacaaacaacggatatgaaaagaaggctacaacagaggacgtggaattactgacaaagagttgggcagcattggtggagaaagttagattggtgctcaatgagtatccacaactcaggctaacccaagggagaaaagtgctagagatctgtgtaaccatcaaatgggacaagggcaaggctcttgaatttttgttagaatcattagggtacgagaattcgaatgatgtatttccaatctatattggtgatgatcgaactgatgaggatgcttttagggacaggattcaaggacttcacaccccaaactctcattgtataagttttgtgcagcttgaattgccatag

SEQ ID NO: 104967 - DNA, 2866 bp, Glycine max
  Peptide Sequence Number=SeqID_221745
atgctttctgtgttggacttgaatcaggagggagagaccctgatggactctttggagtgtaggccttggggtcacccgaatttgccgaaagatgtcgccgaggatgaactgcgggaattcttttctggaaaaggaggaataatcaccgatgccaagcttatgcgcaccaaagatggtaagagtcgccaatttgcttttattggatatcgtactgaagatgaagctcaggaagccattcgatatttcaataaaaatttccttcggacatctagaattatttgtgaggtggctcgaaaacatggggatgaaaatcttcctcgtccatggagtcgacattcgaagaagaaagacgataaagtgactgccccagatgtggagaaacctgctagagctaataagggacaaggagagaattcaaagggcagtgttggtgatgatgttgatgacccgcagcttcaggattttcttcaggtcatgcagcctcgggttaagtctaaaatgtgggcgaatgatacatcaattgcaactaatgttgacaacaggcaggcaatgccaaataaggataacgacggggcatcggttgcaagtgatcagagtggctcattagaagatggttttctggaggattctgaacccaagaacaagtcacatgagcctgaacgcgataaagtcatttctgatatggattatttcaagagtagggtgacgacagagtggtctgattctgaaagtagtgatggtgaagatgatgatgatgacaatgattcctcatgcattgacagtgatagagatgatcatagtaatgctggtaaagatgaagacaattgtgattcaagaaatggtgctcgagaggtagatgtagatctagagggcaaagaagatactagtggagagaatgttaccaatggaaagactcaagtgaacgtgactgagcaaggggggcaattatcaaaatcagaagacgagaaaggagtttttgattcctgtcggttgtttgtccgtaatctgccatatacgaccactgaggaggaactggaagaacatttcagtcgctttggaagtgtctcacaggttcatctagttgttaataaagatacaaagcgatccaaaggaatagcatacattctttatacagccccaaatattgcagccagggctcaagaagagttagacaattcaatctttcaaggaagattattgcatgtaatgccagccttacaaagacattctgataatcaagagaacaatgttttgaaggaccaaagctcgaaaaccctcaaacaacagagacaggaaaaaaggcaagcagatgaagctagcggagatactagagcatggaatagtctgttcatgcgctctgatactgttgtggaaaacattgcccggaaatttggtgttagtaaaagtgatttacttgaccgagaagctgatgatcttgctgtacgtattgctttgggagagactcaagtgatttcagagacaaaaaaggcatttaaaaatgctggagtgaatgtggaggctttggaggaacttgctaataataaaacagatgaattaaaaagaagcaatcatgtgcttttagtgaagaacttgccatatggttctacagaaaatgaacttgcaaagatgtttgggaaatttggtagtttggataaaataattctccctccaacaaagacattggcgctggttgttttcctcgaaccagtggaagctcgagcagcttttagaggtttagcttacaagcgtttcaattgtgccttggtgacttgttggtcatcggttcgaatccggaaacagcctctttgcatatgcaagggtaagactgcgtacaacatccctccctcataccttcgcatagcgaagagcctctgggcaatgagagatgctccattatacttggagtgggctccttccaatattcttagccaaagttcaacatctaaaaataatgaaataaatggtgcaattggtgaaaatgaagccaagaggcagatattggagcaacaagtggaaagaataacagatgtggatattgattcagacagagtacaggcccggtccctgtttgtcaagaacctaaatttcaagactatagatgaaagtctgaggaaacatttaactgaacacatgaaagagggaagcattttgagtgtcaaggtgaagaagcatttgaaaaatgggaaaaatgtttctatggggtttggatttgttgagtttgactcccctgaaactgctacaaatgtttgcaaagatttacaggggacagttttggacagccatgctcttattttacaaccttgtaatgtcaagaatgatgggcaaaaacaaaagacacttgagaaggataggagttcaacaaaattgctcataaaaaatgttgcttttgaggcaacagagaaggacctgagacgattgtttagcccattcggccaggtattgagtgagtataggtactcatcggataataagggtacaggtattgaggttgcttcccatgtgaatatgggtaagattaagagcttaaggttgccaatgaagtttggaaaccatagaggctttgcttttgtagagtatgttactcagcaggaggcacaaaatgccctcaaagcactttcaagcacccatctctatgggaggcatctggtgatagagagagcgaaagaagctgagagcttggaagaactgcgggctcgaacagctgcccaatttagtgatgaacagaatggatttcaaagtgctatgaaattttccaagaaaaggaagcaggttgacttcttggatgaagggaagatgaacttgcgttatggtgactatttgcctgatgcaaatgttggggattttgaagttgttatatgcagggctg

SEQ ID NO: 104968 - DNA, 273 bp, Glycine max
  Peptide Sequence Number=SeqID_221746
atgccttatcttcccttcattttcgtttttctctcttctcttcccaaagccctttcttttgctcgtaacccaccaaacttgtttcagaaaaactacggtctcgaactcattcaccgttggaccgttgtcaaatttgagcaccacggagagaaaaaggaattgcacgaagatagtaaaaatggaggcttcaaccccttctccgtctctttgacgtttgggaactctatcgaagcagtcggaggaaaaactggagaaatctcggggaaccgctag

SEQ ID NO: 104969 - DNA, 237 bp, Glycine max
  Peptide Sequence Number=SeqID_221747
agtcatgttcaaacaggaaattacgagtgtggatgctatgttatgcaatggatatggtgcatcgtaagtggtggattgaaggatgactggattcacggtggtggtgacaaggactacaaggaggtacccccacctcctttgtttaaacctgcagggggacacatcaaccaagctgtgaccttcaacagatcttattacaaggtaatcagttcaatgaaaaaatggttgagtcactag

SEQ ID NO: 104970 - DNA, 759 bp, Glycine max
  Peptide Sequence Number=SeqID_221748
atggagcagttccagcaaacttggttgcaggacacgacataccaggcccttctccaacaagtattacgaagccctgctgatcatcctgggtttacagtcaagcaaaatatgcttattttccacgacaagctttggcttcctcttggccacatcctttcaaaagtgctcctcgacgagtttcaccttactccgataggcggccatatgggggtcgagaaaacccttcatcgcatccagcagcatttttattggcccaagatgcgtcaagacattcgccattatatcgctgaatgtgtcacatgtcaacaaatcaagttggaaactcgcaaacccattggtctcttgcaactgctaccaatttcgtcctccgtatgggttgacctgtccatggattttattactggacttccgacttcacagggctacaacaccatcatgcagtggttcaaattcctatctttagccgagtggtcttataatacctcagtccacagcggcacttgttactcaccattcgaggttatgtatggaaagcgaccaccagttcttcctctttattctgccagaaagtctcctgttgaatctgttgatgctatcctaacctctcgggccactatacatcacaccctcactcgcagacttcaaaagtaccaggacaagatgaagagtatggctgactcacaccgacgcgatgtcaacttcagtgttggtgattgggtttacgtgtgtctcagaccgtaccgccagacttcactctaa

SEQ ID NO: 104971 - DNA, 201 bp, Glycine max
  Peptide Sequence Number=SeqID_221749
gggcaggatcatcttgagctaccttctggggtggggacaaaacatgaacagcagaaaccagtcaaggaacggatgcaagtgaggatggagtcacgaccgacggatcgttgtcccttctctgcgctaagcaggcagagaacgtcgctgcaaggcagccccgtatcctttgtattcgcagttttcttttactatttgttttaa

SEQ ID NO: 104972 - DNA, 456 bp, Glycine max
  Peptide Sequence Number=SeqID_221750
atgaaaactaaggctaaaatcaacttacaaatcaagctttgtccgcaaaaatcgcttgaagccattttaaggtccaacaccttaaacagtgacgaagaactacataagtctgatttcctcatcacaattaagctgttgtaccttgagacggacatgtggggtgctaatactttcctcagggacctagatgacctagtccaactttgcataagggtagagcaacaacttaaaaggaaccctacttcaaaatcttatggctcccactcttatccaaagaaagaccaaggtcaaggcatcttgtgggctgcaccttctaagcccaaagatgataagggaaagacagtagaaaagaaaccccctaaggcgagcatgcaagagaagactcgctctataaagtgctttaaatgtcttggaagaggagacattgcttctcaatgccccaataacaaaccatga

SEQ ID NO: 104973 - DNA, 935 bp, Glycine max
  Peptide Sequence Number=SeqID_221751
aggccatgaaagagaaaatggccacaatgatggaggccatgatgagtatcaaaaagataatgaaagtcaacgcggctacagtcgccgctgctagcgctgttgctagggtggactcgactcccccatcaggcctcaaccaaataaatcatccagcctcgaatgtggatggcccccattttgtgcaaattcacaacaagcatgccttcccgccatatggcttgcctcccaactatacaccacccaatgtggtgtacactcctggtgaggatgacaataactccgctaccatactcattgaaagccgacaacctcaaactgatcatgcacatgtctctcaacccatgggggagatgcatgaaataccctaccgcaatctagtcgacttcgagcctcgcctcggatatgccactgaagggaaagcagttggtgcgggtaaaatcccacctgttatggcaaaaatgagaaagttggatcatctagaggaaaggctcagggccattgaagaaggcaaagattatgcctttgctgacatagaagagttgttcctagcacccaacatggtcattcctccgaagttcaaagtgctgaagttcgataagtacacgacaactacttgccccaagaatcatttgaaaatgtactatcgaaaaatgggggtgtacgcgaaagatgaaaagctgctgatgcatttgtttcaggagagccttattggggcggttgtcacatggtacactaatcttgaaccctcccgagtccattcttggaaggacccaatggtttccttcgttaggcagtatcagcacaactctaagtacaactctggtatgacttcggataggatgcaactacagaacatgtgcaaaaggagcacgaatccttcaaggaatatgcccaaaggtggagggatctggcagctcaagtggcacctccaatga

SEQ ID NO: 104974 - DNA, 438 bp, Glycine max
  Peptide Sequence Number=SeqID_221752
atgccacttcaaggagaagatgaatcaagaataacctcacgaccattggaagccatggataagagcttgaagctatggtttagcccactaatccaagatcaagtccaagattctccactaaatgtgcttaggtgtcatgaggcatcccatggaccgaaaatctaccctaaggcttatgagaaccctaaggtcttgtcttgcatctctggcccaatcttcttggagtcttctatccaatgcccttggggggtacgattgcatcaccacccatatctggccttgacattaaccagactttacactgctgacaacaacgtcaaagacttattcaccctggatacaaagctggtttggtcaaggtatattgtcgtggtggttcatttgcatttcgcggttgacgtcgtattgggtgttgcggtgcaatggcagaggagttaa

SEQ ID NO: 104975 - DNA, 204 bp, Glycine max
  Peptide Sequence Number=SeqID_221753
atgcctaaaggtgatggacttgcagagaaatgggaagcctcacaaagtgctgacacttctaattgcaaacctcaagaactctcttcatcagataggtattttgacctcactgatgactcttcattgttagtccaagccatggaactctcaggccctaggaagcagaaggaaaaaaatatgtatctgcataagtatcttacataa

SEQ ID NO: 104976 - DNA, 1086 bp, Glycine max
  Peptide Sequence Number=SeqID_221754
cctggaggctctggcacaggtccgagatggactcaaccagggcggtgcagcagcgctgctggaagacttggcatagttagtgcggttgaagcggtagacggggaggaaggagagggctcgttgttggtggcagtggggcagttgttgcagaaccagactagggaggcgcaacggcaatggagagtccgtgtcacggttgtgggggaactgatggggagagagaggagagtgaggctactgcaagtggaggttttgcggtggaaagtggcgagggagaaagatgttaggtttcaactgataaagaaggaagttattgagatgattaagatgcaggccccaaccatagaatccaagctacagcagcaagctgcagcatctggggaacaagaattaggtcctgatgggaaaccaataactaaaaagaattttagtatggacactgcattggaagacaagatttgtgatctctatgacctctttgttgatgggttagatgaaaattcgggtccgcaaatcagaaagttgtatgctgagcttgcagagttatggccaaatggttacatggacaaccatgggatcaagcgtgcaatttgcaggtcaaaagagaggcgcagagcactgtacagcagacataaggagaaaatcaagaggaaaaagttgttggcacctcgaccagaggagaatgttcaagttgatcctagtccaattactttgcaacagcccttgcgagaaagattagctacagactctagtggtcatcctcatgcttcagtaaacaagacagtttctaatacagtcaccaccgcacgggttcacaatcctgtcaatggtccaaaacaagaaaaagcaaagggaagttcaggtggttctctggatgatgtcaagggtgctgatggtgttttaataaagaagaaggtaaagagaaagctagaacagggtttggaaggaactcactttcgccctgagaagataggagcttctctgcaaggagaagaaaaaacaagatccctaaagcagtctgcaggtgttcccccgaaatcaaaccttcagccaacttctctacctggtcttgagcagtcaagctaa

SEQ ID NO: 104977 - DNA, 1254 bp, Glycine max
  Peptide Sequence Number=SeqID_221755
atggagattgaagaacagggtgcacctcagacaaaccgtttcagtgctgtaatagagaagattgaacgcctttacatgggtaaggacagcagtgatgaggaggatgcacttgatgttcctgatgatcaatatgatacagacgactctttcattgatgatgctgaattggatgagtattttgaggttgataattcttcaatcaaacatgatggattctttgtaaatagggggaaattggaacgcatggctagccttggtgcaacactaaggctgctgccttgtggccttgaggtcaccagtttgagtcctggaaatagcctctttacttctggggccaagtctgtgtacatcttccctcctcaaatcccattaggttggaacctcatgcactggcaagcaaagaaaaggcgccgaaaagatgtaccgaagaatcctggagaacatattgatagtcatgtatcaaataaacatgtaaaagtgggcaagactgctgctggaaagactgcatcgttacctgtgaaaaatacgattagttcctcccataatttgggtgtacctggtgaacattatgaagacatgacatttcagaatcaattggatgtgtctggaattagtttgaaaaggaaaactgctgacacaagaccaatgttggatcctcctgtttgttcgaaagtatcaactaatgctcctgctgctgcagaagatgctgaaaaacagaagactagagtacttcaatctaagaacacaagtgataaatataaagatgcaagtggcttgcttgatacttctcgtcagaagtaccatgaaaaaagtgcatctgcaaaatccaaatcccagcctggaaaaatctcaattagtgttgacaatctagaaaaggctggtcggtcaaaagataaaaatgacatccatgaactgccagatcttaacttgtatgtcggaaaatctgctatacaagcaccaaaatctgaaaatgtgctcaagaaagatggttctagtgctaggcctaaaactacaacacttgagaaagctattcgagagttggagaagatagttgcagaatcaaggccgccaactatggaaaaccaggaggttgataccacacctcagggtgtcaaacggagattgcctagagaaataaagctgaaacttgctaaagttgccagattagcggcaagccaagggaaagtatcaaaggagttacttaaccgtcttatgagtattcttgggcatctgattcagctcagaacgctaaag

SEQ ID NO: 104978 - DNA, 237 bp, Glycine max
  Peptide Sequence Number=SeqID_221756
atggcctcaacaaatttcttattctcagaaggaaattccatcaataggcctcatatctttaatggagagggttaccactattggaaaacttgtatgcaaatcttcattgaagcaatagatttaaacatttgggaagccatagaaataagaccttatgcacccaccatagtagatgcaagcacgacaacagaaaaacctagaaatcaatggtctgaagaagatagaagaagattttaa

SEQ ID NO: 104979 - DNA, 459 bp, Glycine max
  Peptide Sequence Number=SeqID_221757
atgtttctggaagccttctttgttgctgctaaggttgataccaacaacttcactttgaaggccactctaaagggggtcccttctgatagtgaaagactttatgatgattggttggaagtcaaggggctcagaaagaagaaaatccaaggaaaacttctagagggtgaggaggaagatttcaagtcaaaatcgttaacttcttttggtaggataatagttcattggatcaacatgttttttgtgttgctgagggttggtaccttccaacaatccacttccaatgtcccctatgtgatgctcatgactttgatttttagacactatggagtgtctatggaggaggaatgcaaagataatgaaggactctcttggggtgccaagaatgttgttgccttaaggttgaaccctcgacctaggatggagactatctacacttgttttaatgaggaagattcctag

SEQ ID NO: 104980 - DNA, 210 bp, Glycine max
  Peptide Sequence Number=SeqID_221758
atggattcatacattcacagatgtggtgaaggaaattgtttcttctccaattgtcggagcatctacctcaaaagggagatatcttatcagattaagaagactactggagaaacaaaacatcattctaaggcaaaacataaggatgaagaagaccattttgagcttgtgaatgaggagtgtgaagttgatgctagtgatcaacctgcttag

SEQ ID NO: 104981 - DNA, 306 bp, Glycine max
  Peptide Sequence Number=SeqID_221759
atgtcaattgatgccttgaaacaagctattgaaaacaatattagtttaccaaatgggtcaaatcaagactcaaaagttattttattggcttcatttgtggaagcaatgatttccaagattatttttatgatgtcaaagaatcaagagttaagcaagctccaaagaatcaggagtgaaaaagcttcaagaatcaagtttcaaagaatcaagattcaagaacaatcaagtttcaagattcaagattcaagagcaatcaagactcaagattcaagaatcaagagaagactcaatcaagataagtactaa

SEQ ID NO: 104982 - DNA, 249 bp, Glycine max
  Peptide Sequence Number=SeqID_221760
atgaagaagagggatccctttgtggtggtggagagggtgtgcgttcatcacaagcatttggcggaaggtcttgtttacgaacccattaatcatccatatccttccgatatccaaaggatgcaacaacgacaactccaatggcaaaagaacgaaaacagagttagagagcatggtgaggaaagagagggattgggtggtgttggagggtcaccgaaagtgtcatggactcgtgccgacattggtctgtag

SEQ ID NO: 104983 - DNA, 204 bp, Glycine max
  Peptide Sequence Number=SeqID_221761
atgaagcttcaagattgggaacaagtaagagaactcagcttggaaggaagtttgagcacttcatctaattttcatttcactgttagttttgctctaaattttgaatggcaagttaaagaggaagttgcaagtcattacctaggtcagggtggtattggtctggtttcaagctatgttgcttattctcctaagattgcaagttga

SEQ ID NO: 104984 - DNA, 885 bp, Glycine max
  Peptide Sequence Number=SeqID_221762
atggctagaggtttcaaggagaaattgggtggaggaggctatggcattgtattcaagggaaagttgcatagtgggccttctgtggcaattaaaatgctacataaagcaaaaggctcaaaacgtgcccttgtttatgaattcatgcccaatggatctcttgacaaatttatttttcccaaagatggaaatatacatttaacatatgacgaaatatataatatagcaattggagtagctcgtgggattgcttatctccatcatgggtgtgagatgaaaattttgcattttgatatcaaaccccataacatccttcttgatgaaacattcaccccaaaggtctctgactttggattggcaaaactatatccaatagataatagcattgtgactaggacagaggcaagagggacaattggatatatggctccagaattattttatggaaatattggaggaatatcccacaaggctgatgtttatagctttgggatgcttttgatagatatgacaaataagaggaagaacccaaatccccatgcagatgatcattcaagtcaactttactttcctacttggatttataatcaacttggaaaagagacagatatagaaatggaaggtgtcacagaggaggaaaagaagatgatcattgtttcactttggtgtatacagttgaaaccaagcgatcgcccctcaatgaacaaagtagtggaaatgcttgaaggagatattgaaagcctggaaatacctccaaagccttctctatatccacatgatacaatggaaaatgatcaaagcatctactctagtcaaacaatgtcaacggacttcattagttcttctagttattccaaggaaattgtgactaatcctttggtagaggat

SEQ ID NO: 104985 - DNA, 534 bp, Glycine max
  Peptide Sequence Number=SeqID_221763
gtgagcgagaaacagtttgagcgtcatgtggagacagagagctttattggtgttcgtgttattactagcgacccaaaaggttgcggtgacaaatggtatgagctagcttgtgaaaataatgttacggtgttatatttgtactctggaaaatatcatgtgcaggctatcaactacaacaatttcacaatccgtgtggtggatccggtgattgacaatgagaagtatgtggaaactgatccttgcatcaagtggcacttctccaaagggtacatatacgctattgctggtgacttaatagcaaaggactttgaagttggttgtgaggtaaagctggttgctcccacatcatggtggggtttggatacaaataattcttcatacactcagatgcacagagcgcttctctatggatttgagctttcatggatcaatctcgcctgtgacgatcagtgtggaaattccaactgcgcatttcacgcttccagtcacatgcttcaatgcacccaaaatatgaatggtacaaaagcttactga

SEQ ID NO: 104986 - DNA, 285 bp, Glycine max
  Peptide Sequence Number=SeqID_221764
atgaatggaagtatacctcatcctaataatctcatatttcaggaaagtgaaagggttgtcagcaaaaaggaaggaatagactttgctagggaatatggttgtctgtatactgaatgcagtgcaaaaaccagagtcaatgttacacagtgttttgatgagcttgtgatgaagattttggagacaccaagcctcttggctgagggctcatctggtgtgaaaaagaacatcttcaagcagaaacccccactgtctgatgcatcaagtagtggctgctgctcatggtaa

SEQ ID NO: 104987 - DNA, 396 bp, Glycine max
  Peptide Sequence Number=SeqID_221765
atgaaatgggaaggaaaggaaaggaaaggaaaggggtcacgaggaagtggaggctttacagttctgatgcgcaatattgtatttcacgggaagtactttttcgcgggaggaaacagttttttaagcgctttggtgtgtcccagtgacagtgagaaaaatggaataatgaggggattggctttcggagtgtatgttccacctttgatgggcttcgaggatcctggaaaggataacttttctgttattctgtggctggagctgaaggcagaggaaaagaattgccacaaaaagaaaacaggtcctaccgggagtcgaacccaggtcgctggattcaaagtccagagtgctaaccactacaccatagaaccattggatgttttaggaaataaattttaa

SEQ ID NO: 104988 - DNA, 864 bp, Glycine max
  Peptide Sequence Number=SeqID_221766
atggctgtcttcgctctgctctttgggagtgaattgtttgaggactacatagggcatctagctgtggcatcaatggcttcctctgagctagctgatggaactgaggatcctgataaactcaatgagaagctaaaggcaagaatggattatcttggtcaatatgtccggggtgacaaaaaaggattcttccaacgcgcagaatcagaagcaagacggctttctcgtgctgcatttggagtagatatgttacataccatcggctacatatattcaagacaggcagcacaagaactaggtaaaaaagccatttatctaggagtgccatttctggctgaatgggtacgcaacaaagggcatttctggaaatcacaattcacagctgctaaaggtgcttatcagttgcttcagctccaagatgacatccgcaagcaatttaaaatggatggtagtagtgtcccggaaaatgatgttgactctcacattcgcctcaataaggatacattgatgaattccttgtggaagttaaatgttgtggatatagaagtaaccctcgtacatgtgtgtcaaatggtactaaaggaaaataacgttaagaaagaggaacttagacttcgggctactgctcttaaaattcttgggaagatatttcaggacaagtatccaaaaggagaaactttgaagaagaagattgctgctgattctgatgatgaagaaagcagttctgattcttcagatgatgaatcgcctagagcaatttcctatcgaactccctttttcacgcagggtctgggtaggctcttcaaatgcctctgtaatccagcatttgatgtggatgatgaagagatagtttacaaaagcaaatga

SEQ ID NO: 104989 - DNA, 273 bp, Glycine max
  Peptide Sequence Number=SeqID_221767
atggcaccagatcaacacaaatatagagtgcgttcaaggaaatgtctagggtgtggtgagctttgggtcgaggtgtggtggttgcaacacaaaccagattgcaaaagttggttcatcgaggaagagcacgatgaggtcatgaatgatatcgattctgatggagatgtagtggcgttcaccaccagagacgctccagtggctctcatcatcaatggcggcgacaaagggccttccttaccccaattagccaaagttcctcaacctagaaactga

SEQ ID NO: 104990 - DNA, 510 bp, Glycine max
  Peptide Sequence Number=SeqID_221768
atggcttgtttccatttcctgtcagattatgcttcagatacagaggaagaaagtgttaccttatgtaacgatgttgggttggattcttggacatgcacagatcctggaatggccttttctcttctggaatatgtcatattctttccaaatttcctactattaggtgcgggttcagatgcaggtcctgctgttccgagttcaggtgcaggttctactactgattcaggtgcttattctgattcaacaacacgatgttctactactgattcagatatgagagtgactcttggtaggctgattgggatcatccatgtagtaaaggccattccattttctagcataaatcacattggtggacagtttagggacatgaaggacatgttttactccttgtcctgttgctgttataagggttccatctgctgtgaaaatttccttgttgctaggacatggagaatatgtggagtatttagggagtggtgtcatatggtcagtggctctagagtctag

SEQ ID NO: 104991 - DNA, 533 bp, Glycine max
  Peptide Sequence Number=SeqID_221769
gtgtcgcaaaaataagtgcaaaacttcagctttcccgcccggcttcaaatacgccacctcagagtgtgaccttgtccgcaaaacctgtggatgatgatggagtgacttcaactgcaacaacggtcattactactgcaggcattcccttccgatatggtcggctggcaatgactccagctcacggttcagagctcttacctttatctgtccccattgaagcccagtattggaatggcagtactgcatatattcgaagtacgaatgatagttgtacgacagtggatcccaaagcagtcactatgaaaaattacaaggcgccaaagataggttcagatggcaagcccaatacgggtagcgttgatcttgaaatcaacattaatagtgcatcaggggaacaaacatgccaaagctctggtgggtcaatcagctcgatagtggatagtaaaccttggtttggcaatattgaacctggtgctcgcgcaaccttcggcatctacaaagcccccatcatttacatgcgggaaaacttctaa

SEQ ID NO: 104992 - DNA, 1710 bp, Glycine max
  Peptide Sequence Number=SeqID_221770
atggaatggttcaaacgacaaaagaataagcagcaggtcggtatcagctacactgatatgcatgtgagtactgtcgccttgacgccaccttctgaaggtgccaaacctgtggtgtcatttgccgctgttgagcaggtgccattgcatgccacctccacattacgtcactttgtgacaaaaaatgaccttaagtccttgccatgtaatttggtgctgaatgttgatcaatacaatattgtgcaaattgataagcccaatatgccggacaatgaagtgaaaccagcgctgcgctggaaactaaaaggattactggattattcagtggagcaggcagtggttgacggtattgatgtgccggttgatcctgcttatgccaaccgccagccgttgatgctggcgatttgtgccaaaaaagccaccgtttctgaagttggaaatcagctcaccgaagccggtttcaatgttaaatcggtcgatgtgcatgcgctggtgcagcgcaatatcgcgcatttactggagcacgaagaccgcgcgctggtgatgctgagtattttgccacgcggttgcttgctaacttttacagctaaaggcgagctctatcatgcgcgcttgatagagttggatcgtgattttcttaatgacagagacgagatattcagaaccaattttgacaagctggtgctggagttgcagcgttcattagacagttttgaccgtcagtttccttatctaagcctgaaccgtttggtggtggcgccagtggctcaccgtgattacctgcctggaaaaacaagccatgctgttgccagccctgggtgctgccttgcgtcaggagatggcagcatgagtcagcaaattaacctgtttgaaggcggactggttagatccaaggactggttcactttgcccgtggtcggtgggatatatgcattcgctgcaggcgtgatgttttatctggggacgggccttgaggcggagagtgcacagttgcaggtgcaacgtagccaggcgatggcacagtacgaaaacatccagaaaaaagtggatgaactttcccagcgtgtagttccagttgataacagcaagctggaaaccgagctaaaaaatctgaaagccagatttgacatgcagtcacaaattctggcgattttccagcaatccatttctgatacggcgagtcatcttgttgattacatgcgcgccttaacggctcggcaacaaccaggattatggttgaccggttttaaaatcgaaccggctgcacagcatgtgaccctgaacgggcaggcattgcagtctggagatatccctttatacctggatttgttatcaagccagcctatttttgaaggcacgcagttttcagggattcagttcaagcaagtggagctgcataagacgcaaccggcgacgcctgcaccagcgcctgcaaatgcagtcccactggtagcctcctcagtgagcgagcaaccaacttctggtaaaggagcctctgagccatcaagcgcttctgcagcgccagccgtgactacggcagcagctgtggccccggcagcgccagctcaagaagttaccttgaaagtgtatgactttgaagtcaaaggccaggacttgcaaaaccgggcgaagcgcgacaatgctgtaagttgggatgagtttgtacgccagaccacacagtcacagcctgcacagcagcccaggaaagaatga

SEQ ID NO: 104993 - DNA, 472 bp, Glycine max
  Peptide Sequence Number=SeqID_221771
gaatcatcccaaccttagatggtcgaatccttcacaacagcagcaacaacaacaacagccttattttcaaaatgatactggcccaagcagaccatacgttcctccaccaatccagcagcagaaacaacaaatagttgaggcccctcttgccttgaaagcgataaaacgagatagccatgacgcttccatatgctatcgaactcgatcatccttgcctagcggagaagaatcttgcgcgttgtcggacttgaatgtgcgaataaccataaggtatctctgcatgtcctcggactcgccgtctctggatgacaaaggtgcagatgatgagataaccataagttatctccgcatgtcattggactcgccttctctggatgacaaaggtgcagatgacaacgtgcggataaccataaggtatctccgcatgtcatcggactcgccgtctctggatgacaaaggtgcagatgacgac

SEQ ID NO: 104994 - DNA, 399 bp, Glycine max
  Peptide Sequence Number=SeqID_221772
atgacgaccagtttcactttgtgctcgcattcgccttctagagatcactcctcgcattctctcattctcatagtctcgcattcttttcagactcttgcatacaaaatcgtatccattcaagattatcaacctatgattcctttctactctcagaatatagaaccaagacctcacaaaaaattagaatacagaggaagaagggaaactcactcgtggaactcacacgaggaagcacagtcccaagggactgaatgttgttcttccactgagtgtcatgaagcttcaagattgggaacaagtaagagaactcagcttggaaggaaggtgaggagtaaagacaccgattcttgtaacagatatgcaattgtgttaaagaggaagttgcaagtcattacctag

SEQ ID NO: 104995 - DNA, 777 bp, Glycine max
  Peptide Sequence Number=SeqID_221773
atgactcttctctcaaccattgagcctaaaaacattgaggaagcactaagtgaagattcttgggtgatagccatggaggaagaactaagtcagttcaccaagaacacagtttggaatcttgttcctcctcctatgaatcattcagtgattggaaataagtgggtgctcaaaaacaagctcaatgaagaaggagaagtggttaaaaacaaggctagactggcttgtcccctgcatcccgacagcatcaaccaaggaggattcgcagtgccaaaatcaccctcagatatagtcattgagaccttgtcatgtgtttatggtttgaaacaagctctaagagcttggtatgaaaggctaagttcatttctagtttcaaatggattcaccagaggaataacggaccccgcactattcagaaaggctcaaaaaggaaaccttcttattattcatatctatgttgatgacataatctttggtgcaacctcaaaaaggatgtgcaaggagttttttgagttaatgaaggatggatttgaaacgagtatgaaaggtgagctaaagttcctcctaggacttcaaatcattcagaaagtttatgggatttttatccatcaagagaaatatacaaagtcccatctaaaaaggttcagaatggatgaagccaaacctatggcaacccctatgcatcgttccacaatcattgacaaggatgagaaaggatattgtgatgtttattttgctggtgataaagtagaaaggaagagcactagtagaaatggatga

SEQ ID NO: 104996 - DNA, 1854 bp, Glycine max
  Peptide Sequence Number=SeqID_221774
atgctccaagggaattccatattgatcacactgttactaatgctacttcttatcagaaatggcaacggtcagaacaagggcaataaggaattgtcttgtggacctggcgaaccccttattagatttcccttccaactggtgaaggggatcaaagatgaatgtgctaatcccgggttttgtttatattgtactaaaaaaaatgaaaccatggttgtgctctctacaatagaattccgtgtctattccatagactacgaatttaacttctttaggttgaaggacccggaaaattgccttccgaacaagtttctacaaatcaacaatttttttcttcagcataaccaacttgaactaggatttcctggacatgaaggaacaaacaacttgagcttctttaactgttcttcagttgggtatacatacctcagaagatttgtttatggtccttactgtttggattttagtcaacaagatatgatctcctgtccgatttacgtttctagttcttacgacagcgtcctcgatttggatctaacatcctgtaccaggatgtttgacctcatttcgccagctgaggcagacgacctgcagtggaattctttgaatatgagatggtccataccaaattgtacaaagtgcgaagcaaaaggcaagagatgtaaatggaagaacaacagcaacacagaaggagacattgaatgttttggctacaaacggaaaagaatccatgttccccaatcttttattttcgctactacaggctcaatttttttggggctggtggtcattgttgtctttaagatagcactctattttagacagaaagaagacgaccaagcaagagtggccaagtttttagaggattacagggcagaaaagcctgcaagatttacctatgctgatttgaaaagaatcaccggtggctttaaagaaaagttaggggaaggagctcacggggctgtattcagaggaaaactttcaaatgagattctagtggctgtgaagatcctcaataatacagagggagaagggaaggagttcattaatgaagtgggaatcatgggaaaaattcatcacatcaacgtggttcgtttgcttggcttctgtgcagaaggatttcatcgtgctcttgtctacaatttgtttccaaacggatccttacaacgaattatagttccaccggacgacaaggaccatttccttggctgggagaagctgcaacagattgctcttggtatagctaaagggattgagtatcttcatcaaggttgtaatcaacccattattcattttgacatcaatcctcacaatgtgctacttgatgacaacttcactccaaaaatttctgattttggcttagccaaattgtgttccaagaatcctagtttggtgtccatgacagctgcaagaggaaccgtgggatacattgcacctgaagttttctccagaaactttgggaatgtgtcttataagtctgatatttacagttatggaatgttattgttagaaatggttggaggaagaaagaatgtagacatgtcttctgcccaagatttccatgttttgtatccggattggatccataacctgattgatggagatgtacatatccatgttgaggatgaagttgatattaaaattgcaaagaaattagcaattgttggactttggtgcattcagtggcagccagtgaatcgtccatctataaaatctgtcatacaaatgttagaaactggagaggaaaaccagttaaatgtgcctcctaatccattcaactcaaccacttcaactattactagtggacacactagagttacaagacgacctttggagttagaagttattcaagaatga

SEQ ID NO: 104997 - DNA, 903 bp, Glycine max
  Peptide Sequence Number=SeqID_221775
atggctagaggtttcaaagacaaattgggtgaaggaggctatggctttgtattcaagggaaagttgcgtagtgggccttctgtggcaattaaaatgctacataaatcaaaaggctcaaaacgtgcccttgtttatgaattcatgcccaatggatctcttgacaaatttatttttaccaaagatggaaatatacatttaacatatgacaaaatatataatatagcaattggagtagctcgtgggattgcttatctccatcatgggtgcgagatgcaaattttgcattttgatatcaaaccccataacatccttcttgatgaaacattcaccccaaaggtctctgactttggattggcaaaactatatccaatagataatagcattgtgactatgacagcggcaagagggacaattgggtatatggctccagaattattttataaaaatattggaggaatatcccacaaggctgatgtttatagctttggaatgcttttgatggagatggcaagtaagaggaagaacctaaatccccatgcagatcattcaagtcaactttactttcccttttggatttataatcaacttggaaaagagacagatatagaaatggaaggtgtcacagaggaggaaaataaaatagcaaaaaagatgatcattgtttcactttggtgtatacagttgaaaccaagcgatcgtccctcaatgaacaaagtagtggaaatgcttgaaggagacattgaaagcctggaaatacctccaaagccttctctatatccacatgagacaatggaaaatgatcaaagcatctactctagtcaaacaatgtcaatggacttcattagttcttctagttattccaaggaaattgtgactaatcctttggtagaggatgctatttga

SEQ ID NO: 104998 - DNA, 312 bp, Glycine max
  Peptide Sequence Number=SeqID_221776
atgcgccactttcccaagttgaacaatcccggaagtgggagagagacaaagagtgattttgctctgggttccaaaagcaccaaatcaattatcctgtatgcagctagtggcaccgaatcaaatgcgctagaaggtaaaggactgcttagatttagagcaattccacatacgggttcatctcacttaaccaacggactgtgcagatttggtccgcgaggtctgcgggttgctcgaaaagaagatgaagatgtggagatggagatggctcaagctacttcaaatatgaaatcatttgttgttggagatgtttaa

SEQ ID NO: 104999 - DNA, 570 bp, Glycine max
  Peptide Sequence Number=SeqID_221777
gtgagcgagaaacagtttgagcgtcatgtggagacagagagctttattggtgttcctgctatcaactacaacaatttcacaatccgtgtggtggatccgggtgttcaacagccatattgctcctccattcctcgctacttcttgtctccaaccaatttcagtgcaattgatgaagggcatgcagtgattgacaatgagaagtatgtggaaactgatccttgcatcaagtggcactccaaagggtacatatacgctattgctggtgacttaatagcaaaggactttgaagttggttgtgaggtaaagctggttgctcccacatcatggcggggtttggatacaaataattcttcatacactcagatgcacagagcgcttctctatggatttgagctttcatggatcaatttcgcctgtggcgatcagtgtggatatttttattccgactgcgcatttgacgcttccattcagaagcttcaatgcccctgccgcaatttcctggggggacagctgttccagcttcaatgtgctaaaggttgtaaaaattatatatttacaaatcatcaatag

SEQ ID NO: 105000 - DNA, 743 bp, Glycine max
  Peptide Sequence Number=SeqID_221778
atgtggagacagagcgctttattggtgttcctgttattactagtccaccaaatttgtgcaaccaatgagcaagagcatgcttgccccccttcttcctgtggcaaaatcaccaacataacttatccatttcgattaagaggcgacccaaaaggttgcggtgacaacaggtatgagctagcttgtgaaaacaatgttacggtgttatattcgtactctggaaaatatcatgtgcaggctatcaactacaacaatttcacaatccgtgtggtggatccgggtgttcaacagccaaattgctcctcccttcctcgctacttcttgtctccaaccaatttcagtgatagtgataatttttacttggatcgataccaaattcaaaatcgatgttatccttggaagcgcgctttccagaagcatataattttcttaaattgtaggcatgcagtgattgacaatgagaagtatgtggaaactgatccttgcatcaagtggcactccaaagggtacatatacgctattgctggtgacttaatagcaaaggactttgaagttggttgtgaggtaaagctggttgctcccacatcatggtggggtttggatacaaataattcttcatacactcagatgcacagagcgcttctctatggatttgagctttcatggatcaatctcgcctgtgtcgatcagtgtggaaatcccgactgcgcatttgacgcttacagtcagaagcttcaatgctccat

SEQ ID NO: 105001 - DNA, 327 bp, Glycine max
  Peptide Sequence Number=SeqID_221779
atggatgcttcatcttcctcgtcgagtcaacctgaattcgattacttgttcaagcttctcttgattggggattctggggttggcaaaagcaccctgcttttgagcttcacctccgataccttcgaggatctttctcccaccatcggtgtagatttcaaagttaaatatgttacaattggagggaaaaagttaaaacttgctatttgggacacagctgggcaggaaaggtttagaacacttactagttcatattacagaggagcacaaggaataattatggaatataacaacatagtcttgtgcatgaagcatcattctgttaaataa

SEQ ID NO: 105002 - DNA, 467 bp, Glycine max
  Peptide Sequence Number=SeqID_221780
tggcctataaactgcaactgcctgatcagtccaaaatccaccctatatttcatgtttcattgcttaagaaggctgtaggggaatatcatgtgcagaatgagttgcctaaagatcttgaagtaatcatggatgaggaaatttatcctgttagagtgctgggtactagaatcattatgaagaatggcagttcagttcctcagagtcttattcaatggaaagacaagtctattgatgatgtgacatgggaagatgatgttgttattaggggacagtttccgaaatttaaccttgaggacaaggttcttattgaagagggtggtattgataggaatgctgatgagctagtgggcattgatgagggcccaagacctaaggtatggagagtctaccaaagaaagaataagaagggtattatggggaacgttggcaacagaaagaatgattacgtggaagggaatattgtgtga

SEQ ID NO: 105003 - DNA, 675 bp, Glycine max
  Peptide Sequence Number=SeqID_221781
atgggattgtcgaatgcttctgaggatttgtcatcagagatggaggttgatgcctttagacgcctttttccacttcgatattttgagcgtcatcttgctgaatctataaggccagatggtagaccacttggaaaagctagagaaacaagtgctgttgcgtctgctaatgggtcggctcttgtgaagattggatcaactactatgttgactgctattaaaatggaagtcatgactccctccttggagtctccagatgagggctgtctagctattgatttccacatgcctccaatttgttctccgattgttaggcctggcaggcctgctgaagcatcaccggtggtatcaaagcagttgtctgacaccatttcaaggcatattataatcttcgctgtcactttttctagaatgattgatttgaaagaattgtccttggttggtggaaaagctgcatggatggcttacctggatatctattgtttggatgctgatggtgctctttttgatgctgcattaatttctgcagttgctgccttatctcattgtaagaacaaaaagaagaaaaaaccagctgatgatatgtcagccaagggggctattacctcttgttacgtagcactggctaaggatatgatggtatcaacaaaaacaggaaatgaaacagtaaattactag

SEQ ID NO: 105004 - DNA, 750 bp, Glycine max
  Peptide Sequence Number=SeqID_221782
atggctagaggtttcaaagacatattgggtgaaggaggctatggctttgtattcaaggggaagttgcgtacaattggagtagctcgtgggattgcttatctccatcatgggtgcgagatgcaaattttgcattttgatatcaaaccccataacatccttcttgatgaaacattcaccccaaaggtctctgactttggattggcaaaactatatccaatagataatagcattgtgactatggcaacggcaagaggaacaattgggtatatggctctagaattattttataaaaatattggaggaatatcccacaaggctgatgtttatagctttgggatgcttttgatagagatggcaagtaagaggaagaacctaaatccccatgcagatcattcaagtcgactttactttcccttttggatttataatcaacttggaaaagagacagatatagaaatggaaggtgtcacagaggaggaaaataaaatagcaaaaaagatgatcattgtttcactttggtgtgtacagttgaaaccaagcgatcgtccctcaatgaacaaagtagtggaaatgcttgaaggagacattgaaagcctggaaatacctccaaagccttctctatatccacatgagacaatggaaaatgatcaaagcatctactctagtcaaacaatgtcaacagacttcattagttcttctagttattccaaggaaattgtgactaatcctttggtagaggatgctatttga

SEQ ID NO: 105005 - DNA, 537 bp, Glycine max
  Peptide Sequence Number=SeqID_221783
atgtaccctttcttgttctcagttacaacaacccaagtagatgtaccctctacttgtaccacaaaggatgtaccctccaatgtgttaagacaaagttttgaggcagttagtcctttgaaactttgtgaagggaaaacaaaagatatatcaggcgatacactggtaattgattaccaatatattgaaatcgattacaccattcaaaaaacaattggaacgttgcaaatccagttaaaagcttttgaaatcaaactttgccactgcatgcaccagagccccagcatcagcatcagaggctcctcttcctcctcaacctccttctcagccttcctctcagggatcgatccctccacttgcatccacttcagcacccctacatatgcatggacagatgctcaggtccctgtatcagggccagcaaatcattattcaagacctgcatcgattgtccttacatatgaagatggatccgcccctcacaactccaaaggcctatattcagtaggtcgcatgaccaagagcccaaccctttactga

SEQ ID NO: 105006 - DNA, 792 bp, Glycine max
  Peptide Sequence Number=SeqID_221784
atggtggaagttgataagtcatcctatggaatatatgctaactttgcaagtgaaggtggtcaagcaatggcaagagctactccattcgaagttgaagattcattctatgtgaataacaagccaacatatgcgagccttatggcttacatagccgataataagaaacaaatggctactgtgattgttgaaattaggaaaatggctaccccggctgttgaaattggaaaaacagctactgtgatcattgaaatcgaaaaaatggctattacaactatcgaaattggaaaatcgattaatgcggttgtcaaaattggaaaagcgattactacggttgtcgaaaagaaggagaagatggatattgatgccattaatgaaaaaaggaaggagatggatatagacgccatcgaagaaaagaagaaaaagatggatactgatgccatttttcataccctaatttcgtctggggacgatcatttgcaaacatttagattcttgccagccgaattaagctgtataacactaattgccgcacattccgtaagatttttcgacgtttcaaaaggaaatgtgaaaattactcaaaaagagggcaaaagggatgaagttattagctcacctcgggtctctaagttcccagaggtccaaagagaagaagaaagaatagaaaggaagaagaaagaagagaaaacaaggctgaaacgcttccgaatcgcatctgtgatcaattcctacaccgtttgtcgtttgttcttcggtcgttcatcgttcatgcttcgttcttcattcgattag

SEQ ID NO: 105007 - DNA, 213 bp, Glycine max
  Peptide Sequence Number=SeqID_221785
atgcaaaaagcaagagaaaagctgaagaaaagaagaaagttggaagcaggctcagtccagtacacactaagcgggcataagcgaggcgttaagcacgaagacgcaggatccgttacgcgcgccaagcacacgatccaacataagcacacgctaagcctgcaacacgcgttaagcgcacaatctaaacatgctaagcatgaggtgtcgtgctaa

SEQ ID NO: 105008 - DNA, 429 bp, Glycine max
  Peptide Sequence Number=SeqID_221786
atgtcactcccagagctaatggttgaagaaaataccatcacggtggattcaaatcttgaccattttttgaactatgaaactgagcaacacactccggttgcaggagaggaacttgggttcatagatcctactgataaaatatttaaggagaggcaaatccaattgatgttcatgcctttgtatttatcgacatttgatttttttgattcaatgccatccaaagcttctgaatctagctataataggccatttacacactttgatgaagctgaggcaaagtttcgaaggcttgctttcgatcaatctctcaaagactctctttccaatccaaattacaagcctcaacttcaacaatcaatcaatgaggttttcaaatttcaaaacttggtggttgatgagattcaaaaggaaaatggaatctttccttaa

SEQ ID NO: 105009 - DNA, 393 bp, Glycine max
  Peptide Sequence Number=SeqID_221787
atgagggaagtatattacaactttttggaagttgtaatatactttgctaggcctatttcaggcagaatgatcccaagatctagcaatagcaacagtgctagttcctccaatgaagatacggttcttcagcaatcagcacctgacaaaattcccgactggtttgatggtgatggtgttgctaactatggtgggggtagtgatgaggatggagaggaaaatgatgagagtgattccaagcttcctccacatgagtttattgcccaaaggcttgaaaggagtaagatatcctcattttctattttagaaggtgctgggagaaccctcaaaggtagggatcttagcaaagtgaggaatgctgtactctcaaaaactggtttcctcgaatcactataa

SEQ ID NO: 105010 - DNA, 864 bp, Glycine max
  Peptide Sequence Number=SeqID_221788
atgcaatttcttgggttctttggcatctacaaagaagcctccaagatcatactttcatggaggagaatcttcacccaaatcacctcaacactaatcctccctctctccttcatcttcctcatccacatggaaatctccaacctcctcttcaggaagattctcatcaacgaaatagtcatggacgaaacaaagcctaacacacctcaatacaacaagctcgatcacatgatctcttcagaaatggtcactcttgtggtcttcaaaatcgcatacttcactctgctcctcatattctccctcctctccacctcggcagtggtctacaccatcgcctccatctacaccgcaaaagacgtgacattcaagagggtcatgagtgttgtccctaaggtgtggaagaggctcatgttgacctttctatgtgcctttgctgctttcttcgcttacaatatcatgactgcgctagttatgttcttgtccatagtcacaattgggttaagtagtggtgggcttgcggttttggtttcgataacggttttgtacttcattgggtttgtgtacctcaccgtggtgtggcaactagccagcgttgtcactgtgttggaggactcgtggggggttcgagccatggcgaagagcaaggagttgataagggggaagatggttttgtccatattcatctttttcacccttgtggcttcttttgtttccattagggttttgttcaaggtgatggtggtggatggatggaggtcctatcaccatgagaatattgacaaatcggctttggcagatcatcttgaagggtatcgtggagagtatgtgccattgacggctaaggatgttcagctggagcagtaccaa

SEQ ID NO: 105011 - DNA, 516 bp, Glycine max
  Peptide Sequence Number=SeqID_221789
atggaggtttggttgggaaaatggttgaggtgcttcggtgaagatgagcaacgaggttgtgttggcaagaggatgaacgaatgtgtcaaagcttcttcctgttcttgttcctctcatttctccaacccttcttcctcccatgaattcaaaaacctcaaaaccaaaacctcttcttcttgtgctctcgtcaaggccaaaccctcaaacaccgccaaggtggaccacaccttcaccaccatggttaagaagttcatggacaggaaacccaaattctcctcctcgactgtcgccaccaccactaggtggcttattccctccaatttgctcgcaaaggatttgaagaaggatgtgaagaaagtggtggggttctccgtgctgcagaagaagctcattggaaagggcgcttcagagaagaaggagaaggtgaaggccttgaccgaggtgaagaacaacactaggacattggccatggtgctcaagagcgagaaggagtttctcaacatcaacaaagagtaa

SEQ ID NO: 105012 - DNA, 231 bp, Glycine max
  Peptide Sequence Number=SeqID_221790
atggaattgcttagatggatcgaaaattggatgaatgaaagtcgcatgatcccagaatatgaggatggcgttgagcagttcttgcaatttgcttcagaaagagaaatgggagatcgcttggaggacatgattcgtgaccttggacaagagtctttccagcaagcacatgcccctgcgtatgaaggattgcagagtgattcaaagaagcctttgtatacggggatcctctag

SEQ ID NO: 105013 - DNA, 138 bp, Glycine max
  Peptide Sequence Number=SeqID_221791
atgtgggtgcaagccattggtctgtttgctcaagcgacctgtgctcctgagtttggacttccaagaccgctcaatcagagattactcgtcttgcacgttggtgggggtgccgtaaaacaacaagttttaaaaatttga

SEQ ID NO: 105014 - DNA, 207 bp, Glycine max
  Peptide Sequence Number=SeqID_221792
atgaagggaggagagcataaatatgggtttaacaacaataaacgtgagaaggcagagaaggtaagggtggtggatgatgaaactggtgaacatgagctgtatgaagtcctaaggatgccatctagatgtgtatgcaatagcttgtacttctcatctcaacatctaaacataccaaaagatcagcaggtcttctatgttgagttttag

SEQ ID NO: 105015 - DNA, 360 bp, Glycine max
  Peptide Sequence Number=SeqID_221793
atgttaggattcacaagcgattctcctcaaatttcagctagcctgcatcaattagacttgacaccttatgctttagggccctgcaatgctcaatggaatgccccggaactcctccatgatatgcacacgtcgcgttcgagtcgtatcctcggaaaaatggaggtggtggataaggagaatggttgttattggctgagtaatgacattgttggattggtgggtgtcgcaacatgccctttcgcgggcgagcgaggcgaggctcacgggtgcgctttccaaaggaggaaagatgcgcggagtcgccaccaacgtttatttgtgggaaacgtcggaaaaaccaaaggaaaccggtcaaaatga

SEQ ID NO: 105016 - DNA, 369 bp, Glycine max
  Peptide Sequence Number=SeqID_221794
atggaaggtgcaggaagcaatttccaaccaggaattagacgggtcacaccaggtgcattgtttacggtggttcgtcggcaagtggtggttgtgacggtggttggtttagccattaacgacggagcttcatatggattaccaattcgtaagaagcttatggattgccaatccatatatttcttacggattgccaatccgagttttttgtttgtcattgaaatttttgaatgttttgttaagatggacgaagatcagtggatgtatgacaatataatgactgaagaagttgatatgaatgaccaaaatgaaggcgaagttggtgtgaatgaagagcatgttgattgttttgatgcgttcaatgcgtattag

SEQ ID NO: 105017 - DNA, 234 bp, Glycine max
  Peptide Sequence Number=SeqID_221795
atggttaataatttgtcatatctatctttaccactagattctgactatttagtcataaagtgtgatggttgtgaacaacgatggggaaccatcctaaagaaaaagaaaaataaatatgaaaaaattcatgatgaagaaatctgtaggtatacttcaagaaaataccacacaaaaccacagggatacaacaagatgaagccttctaaggtctcttatcaaaatataaaaaagtaa

SEQ ID NO: 105018 - DNA, 1431 bp, Glycine max
  Peptide Sequence Number=SeqID_221796
atgctccaagggaattccatattgatcacactgttactaatgctacttcttatcagaaatggcaactgtcagaacaagtgcaataaggaattgtcttgtgggcctgacgaaccccttattagattccccttccaactggtgaaggggatgaaagatgaatgtgctaatcccgggttttgtttatattgtactcaaaaaaatgaaaccatggttgtgctctctacaatagaattccatgtccttttcataaactacaaacgtaactactttaggttgagggacccagaaaattgtcttccgaacaagtttctacaaatcaacaatttttttcttcagcacaaccaacttgaactaggatttcctggacatgaaggaacaaacaacttgagcttctttaactgttcttcagttgggcatagatacctcacaagatgggtttgttatagtgaatacgttgttggtcaacaagatatgatctcctgtccgattcacgtgtctagatattacgacagtgtcctcgaatgggatctaacatcctgtaccaagatgttcgacaccatttcgccagttgaggcatacgacctgcagtcgaattctttgaatatgagatggtccataccaaattgtactaagtgcgaagcaaaaggcaagagatgtaaatggaagaacaacaacacagaaggagacattgaatgttttgactgcaaaccgaaaagaatccatgttccccaatcttttattttcgctactacaggctcaatttttttggggctggtggtcattgttgtctttaagatagccctctattttagacagaaagaagacgaccaagcaagagtggccaagtttttagaggattacagggcagaaaagcctgcaagatttacctatgctgatttgaaaagaatcactggtggctttaaagaaaagttaggggaaggagctcatggagctgtattcagaggaaaactttcaaatgagattctagtggctgtgaagatcctcaataataaagagggagaagggaaggagttcattaatgaagtgggaatcatgggaaaaattcatcacatcaacgtggttcgtttgcttggcttctgtgcagaaggatttcatcgtgctcttgtctacaatttgtttccaaacggatccttacaacgatttatagttccaccggacaacaaggaccatttccttggctgggagaagctgcaaaagattgctcttggtatagctaaagggattgagtatcttcatcaaggttgtaatcaacccattattcattttgacatcaatcctcacaatgtgctacttgatgacaacttcactccaaaaatttctgattttggcttagccaaattgtgttccaagaatcctagtttggtgtccatgacaggctgcaagaggaaccttgggatacattgcacctga

SEQ ID NO: 105019 - DNA, 525 bp, Glycine max
  Peptide Sequence Number=SeqID_221797
atgcttgagcagaaaatgatggataagtttcttctacgcatcaaatgtataatcgatgggcttggattgtgtggagatcatgttctttcgcatgaacacctcgacctggttcttgaaagcctactaaaggagtacggtccaatgatctcagtgatcgagagtaagtttgagccgcttctgattggagaagtagatgcattattgcttgcacatgaggcatgcatgaaaaaaattcataagtgctttgcagattcacctttaattaatgttgctcaagaaatcgtggtggcttatatcacggaggtggctacagttgtggaggtaatgattatgaccgcagcggtggctacagttgtggaggcaatgattcttgtcgtggttgaggttgtcgtagtggcgacaaaggccgtggttgttatgcaaattttaagtgccaagtttgcttcaaatttgctcacacagcacgggtatgtcatttccgctatgattttgaatttctgccaaacgcctctctcactctgctga

SEQ ID NO: 105020 - DNA, 471 bp, Glycine max
  Peptide Sequence Number=SeqID_221798
atgtccagcaaatttgtgctaccagtgagcaagagcatgcttgccccccttcttcctgtgatcaccaacataacttatccatttcgattgaaaggcgacccaaaaggttgcggtgacaacaggtatgagctagcttgtgaaaataatgttacggtgttatatttgtactctggaaaatatcatgtgcaggctatcaactacaacaatttcacaatccgtgtggtggatccgggtgttcaacagccatattgctcctccattcctcgctacttcttgtctcaatcaaatttcagtgcaattgaaggggatccatacctagcctttctaaagcgagcttattcctgggagcacgttttccagcatatagttttcttaaattgtagccatgcagtgattaacaatgagaagtatgtggatactgatccttgcatcaagtggcattcccaagtggaattccgagtgcgcatttga

SEQ ID NO: 105021 - DNA, 1032 bp, Glycine max
  Peptide Sequence Number=SeqID_221799
atggcatcgcaacactcgccccccgttgaggccctagatatacaagtattagctgcacgtgtgagctccaaggggagctatgccaaagctactacaaatccattaggtgaaaagccttctgctgttgatgtggctactatgggcttgtacgtagtaggtgatcaatgtacacggctaatggccttgggaaaagtgtatgacagtgtgaccaccatacacaatgtcccttatgcagatgatgttgttagggattcacacaattgtgtgccgaaactggttgtagctgttgaaaggtctaatacaattgttggagttgatctattgggagaattgattaagaacttgtttgttgtttaccagaagcctattgaattgtcatgggatgggacaaaatttaggattcctaatgtacaaggatccttcttcatcacacatgcagatttaactgaaataatatcaggtgacaaatgtttgaacatatctatactacagttgtggatgattgcaatgaagaccttaaccactagtttggaaggtgatggtgatgaattttatcatgaattaatagaccatggctaccctgatggaaatgaaaaggctttatggacaaaggtgctagaatcatgtaagtcctcatctgcagtcaagttaccactaaaaaatgtatacatgccagttgaaaatgaaaattcagtatcttttgcaagaaggataccagttttgaactcgaaaaatagtcagtggcttaacttcaacggtaataattctgaaaattgtatgatttactttcacctagttaacttaacaacatctttggcatattttggtgtttattcaacttctgattcccctcccatgttagcagttgttttctcacaacctcaaggtgttgatgaagtcaaatttcctgcctattcttctatggtggaaatacaagtaattaattatgactactatcagacattgtttgaccaaagccaaattgcagcacctccagttgcaaattcaagcttgactgttgcacaaaaataa

SEQ ID NO: 105022 - DNA, 1161 bp, Glycine max
  Peptide Sequence Number=SeqID_221800
atgatatcaggtgcacctgcatcgggcaaaggcacgcaatgtgaattgattgtccaaaagtttggattggtgcatatatcaacaggggatttgctaagagcagaggtagcggctgggactgaaattggaaataaagcaaaggagttcatgaacacgggtcaattggttcctgatgaaattgtgacagcgatggtggcagcacgattggctcgtgaagatgttaggcataaagggtggcttcttgatgggtaccctcggagttttggccaagcccagagtctggagaaaatgcagatacggcctgatgtgtatatcgtattagatgttcctgatgaaattctgatcgacagatgtgttggtagaaggctagacccagtgacagggaagatatatcatctaaagttttttccaccggatacagaagaaattaaagcaaggctgataactcggcctgatgacactgaggagaaggtcaaatctcgcctaaacatatacaagcaaaatgcagaagcagcatcttcctcttactccagcataacacataagattgatggaagtcattcaaaagaagcagttttcaaagaaattgaatctttattatctcaattgcaacaggataaagtgaaaataattgaatcaggagaaaaaccaattcctgatacaaagaaaggacggacatctttgagccaggataagtggagagggattcctactagactaaataacattccacattctcgagaaatcaggaaatatttctatgatgatgtgctacaagctacacagagggctattagtgatggaaaaactagggtgaaggttgacatcaacattcctgaactgaacccggaaatggatgtttatcgaataggtaccttgatggaacttgttcgagctcttgccctttcttttgctgatgatggaaaacgggttaaggtttgtgtacaagggtcaatgggagaaggtgctctcgctggaatgccattgcagcttgctggaactcgtaagattttagagttcatggattggggtgattatggagcaaaaggaaccttcatcaatattggttctatagcttttgatttagttccccttgtatttcccagttgcacacctttagatttttatatcccagattccagcttaaatcttaatatctaa

SEQ ID NO: 105023 - DNA, 300 bp, Glycine max
  Peptide Sequence Number=SeqID_221801
atgattgaaaggttcgatttcgggaacttaccggttgaagaccgaagaacgaccaagaacgaacgaagaacgatgaagaacggtggaaaaccttcacgaaatcgcccacggaaacgtctcggaagcgttacagaagcgcctcggcttggattttcttcacggaaacaatttttctcactaattttaagtgattctcagataccaggagggggaaaagagggtggtggttgccgcccagctcgcccaggcgagctaggttgcttccaccagaaggcaccgccttctgttggaacatcctag

SEQ ID NO: 105024 - DNA, 213 bp, Glycine max
  Peptide Sequence Number=SeqID_221802
atggtgcctgcttgtgatatcccactgagtcaactcccagtgccttgcatcaacgaagatgctattgctgttactatacttaaggaggagtacaaggaaggtttggaggagtgcaagaataacttgaatgggagaattattctttcaatgggtgatcaaccatctaggtttcaaaacttggggccaagctatcaactttatagaaattgctag

SEQ ID NO: 105025 - DNA, 342 bp, Glycine max
  Peptide Sequence Number=SeqID_221803
atggagaaaaccaataataaagtactatggattgtcttgaaccggagaatcatgttgatggtagttaacatgttgatggagatcttagcaattattgttacgaacccctacacactgagtctccttagggtgaaaaggataatgttgaagaatatgtttgttgttccctgtataataacgagaacgaagaggttggataataatttgggaactatctcacttgaaaaggatggggcagtcaacaacaatgagtttgtttctcctattgttcaacaagacttgagaattgtgtctcgactttgggttaatgaggttgaagaggaggatataggcacttcttag

SEQ ID NO: 105026 - DNA, 1416 bp, Glycine max
  Peptide Sequence Number=SeqID_221804
atggctaagaagggttggtttagcatgtttaagaagctttttttatgggatacacattcctcgcaagagaaggagaaaagaagggcttggatatttgggagagttaagaccaagagattgccttcaattacagctccaccaccaccttcaaaagaaacaagactaagtgaagttgaggaagaacacagcaagcatgctttaacagtggccattgcttcagctgctgctgctgaagctgctattactgctgctcaagttgctgttgaggttgttaagctccaatctgctgctcatcaacaacttaaagaaaaacaagaacaacttcaacctgttaaaactagccatgatgttcctcattccacacaccaatgccagaggaagattcaagaatcttcagccatcaaaattcaaatagcatttagaggttacctaattcttgcacaccattcactaactggtaagagtttacaggcaaggaaagcttcgagagcattgaagggaatagttaagcttcaagctatcattcgtggaagagctgtgagacgccaagctttgaatactctaaagtgcttggagtcaatagtaagtatccagtcacaggtctttgcaaggaaactccaaatggttgaaggaagatgggattgtggtgaacatgaagagatgcaaggttcaagagacaagataataaggatggactcaaacagtgagagaaggtgggatgacagcattttgttgaaggaagaggtaaaagcctcttgcataagcaagaaagaagcagttcttaagagagagaaagtaaaagaatactcatttaaccacagaaggtcagctgaatcagaaagaaataaaataaatggaagatggagatactggatggagcagtgggtagacacacaactttctaagggtaaagaacttgaagatttagactcagttttcagctcacattattctagaccaggggaggaatgtgaaaggagtcaactaaagcttagaaatgttcatagacaaaatcaggttgaagcattcgattctccaccacttgcttcaaggaactcttttccccacaggagccaaacttcagaggcagaagatcactcagttccaagctctcctgcaattcctacatacatggctgcaacaaaatcaacacaagcaaaagcaagatcaacaagctccccaagagcaaggataggagggagttttgacatcaactctgatagctattcactatgcaagaaaaagttgcctattgtgacttctattaatggtgaagtgtttagtaatggtaggatgggcaaactcagtagtaatcagcaaagatctcctagcttaaagggccttccaagtcctgtaaaattgagtcagacattgagggatctcagcattaattcagattgctcagtgccaatttga

SEQ ID NO: 105027 - DNA, 474 bp, Glycine max
  Peptide Sequence Number=SeqID_221805
atgtggtgcccatttggttttaaggtggtgaaaccagcaattagactaaccttacaagatttgcctggttctagtggtattatgcaaacaattgggagggaccagagactcaagtatgcagcatcatttgaaagttgctacttctttaggcttctgtattatgcaggaacccagtatcccataatgggagctatcaggatgacttatccataccaatatgatctgtacaagagggtagatgaatcgcctggaaaggagaaatatgtaattttgtctacctttccagagaggcctactacagatgaaattaatgatgcttttcaaggaaaaccaagcaaggatcctaggaaaacctcagggatttgttcttacccctttatgatagtatcaaagtcagagcttgtagttcaacttgctggtggtggagcagcttgtttaaaattgagtgtagatgactgggaaatgatgatttga

SEQ ID NO: 105028 - DNA, 279 bp, Glycine max
  Peptide Sequence Number=SeqID_221806
atggcatcagatccaggtcagattcgagatcttgtgtggcggcagattcagccctttcacgaacacaaccatggtgtctccgctgagggaagcctcgtacgccaccttgttccaagattgagtcgtttggttcatcaaaacgcccaaattctgatgatccacctcgttgcgccgccgccaaaggagtttgtttgggtgaactggaagaggaagcgctggggtggagcatgtagaagacacactctagttcgtggtgcttttgttgttgagagttggtga

SEQ ID NO: 105029 - DNA, 234 bp, Glycine max
  Peptide Sequence Number=SeqID_221807
atgctccccatcatctcctctctacgtcgctcagagacctctctcattcacgttcatcagtctaaacatagtgatgaggacacaactaaaggcaaggaccatgaagcacttaaagggcccatgaccagaggcagacttaaacaagcccaacacagtgatgaggacacaactaagggcaaggaccatgaagcacttgaagagcccatgaccagaggcagacttaaacaggcctaa

SEQ ID NO: 105030 - DNA, 876 bp, Glycine max
  Peptide Sequence Number=SeqID_221808
atgagtttccatccccctcctgatcctatgtacgatcttgatttcaacaacctcgctccaagctatgattcacaaatcacatactgtatttcattgcagttcatcccaaagaaagctggtaccccaaagaaaaacgagattgtgttcactgcaccaacaggagaggagatcaataacaggaagcagctggaaaaatatttgaaagcacaccctggtggtccagctgtatcagaatttgactggggcactggtgagaccccaagaagatctacaagaatcagtgagaaggcaaaagcagctcctccaatagaaagcgagcccccaaagaaacgtactaaaagatcatcagcttcacaaaaggaaacttcccaggaagaaaaagaagagaagacaaaggaagcggaaatgcaagaagctgattacaccactaaggatgataatgatatagagaaggaaaaggatgttgtaatggaaaatcaagatgtcaagagtgtggaagatacagatgtcaacaaatccactcattctggagaagctaaagctggagaaaatgttgaggtacctattgaaaaggacaaaggaattgaggtctctgaagtttttctgagaaaggatgaagaaaagattgagcaaccacaggaagagacaaaagaatatcgtggatctggggagccagagaaattggaaacatgcactattgctgacaaaaaggttgaagtggaaggagtgaataaagaggaaaacatcaaaagtactcgtgaatttgaagctgaggaaatagaaggaacaaaagtgaatagtgaagaatatcacaagcttgatgagataaacaaggctgaagcagagttgaccatgaatggcaatcatgggagctga

SEQ ID NO: 105031 - DNA, 561 bp, Glycine max
  Peptide Sequence Number=SeqID_221809
atgaagaacagtggaaaaccttcgcgaaatcgcccatggaaacttctcggaagcgttacggaagcgcctcggcttggattttcttcacggaaacaatttttctcactaattttaagtgattctcagataccaggagggttgaacgaatttgttctgccttccttccccggggaaaagaggaagtcacgaaaccttacggattacgcaatcatcccctttttggcttccggaatgttagggaactttacggattgcgcattaacacttcctttcaactcccgacatgttgcggaatttcacggattgtctaacgatgggtgccaagaggaggaagagctttgtgaagaaccaagtattataagcacttccacctcatcacctaacctcgaagtcaatttcccttctctgacatcaatcaaggcccctcgagtgtttaggaaaggtcatcccaaaatgattgggacttcttcatcctcctccatgtccaggattacaaagtcaatgggaaagatgaactttccgactttcaccaaaaaattctccattattccccccgggtaa

SEQ ID NO: 105032 - DNA, 486 bp, Glycine max
  Peptide Sequence Number=SeqID_221810
atggtgaggatcactaccaatattgtgctcccttacactggggaccaaaattcaaaatctgagcaactggtaagagaaattgagaattttgctcaatatgagcaagagtccttatcaaaaacttgggacaatttaagggattgcaaaagagttgtgcataccatggctactcaccatagaggccagtccacattttctagggaggccaacaaaactggaccgggccctgatgttgttataggggaaaacctcgtgcataaattaactaatgtagcagtagaaattattgaggccatggcttcaaatgcctgtaaaaatacaggagatagaaggattctcaagaggccaattggagtgcaccaagtggaagccagttcatctaacacaactattcatcaaaagttggatgttctggcaaagcatatagaaaccttaatgaaggcactgattcaaatgatgacacctgctcccttaccctgtctgtga

SEQ ID NO: 105033 - DNA, 1950 bp, Glycine max
  Peptide Sequence Number=SeqID_221811
atggctagcgcggttgttgaagaaaacaacaatgttgagtacgatagtgacccggaagaggcaaagagaccgttaacaatgcggaggcgtgaagccagcgatgacgaagaagaagccgaagccgaaggagaagaagaagtcactcataagaggcaagatcataaggtagaggttccctctgatgatgtagatgacgaaggaggtgttgaagactatgatgatgatgatgttgttgttgaagaagaagaagaggaggaggaagtggaagttgaagaagaggtgtacgagaaaaagggtggtgcaagtggtggggttgaggttgatgttgaaggttcagtggatgtggttaaggaacctggtgatgatgatgtcagaccccctttagaagattctgttgaggaccattcggaggagaaaaaggagaacgaaccatttgcggtgcccacagctggagctttttacatgcacgatgaccgttttagggataatgctggtgcctgccaaaggcagatacatgggggaaggagtctgtgggaggccaaagacaacaggaaatggggacatgataaatatgaggaaattactttgcacgaaaagcattatgaagagaggaggccttctaagggtaattatcgcagccgaggtaaaagtcgaggcaattatcacggaggacatgttcgaggaaacaggacaggatataatgacagtagcaatcaaaatcaggtgcctaagagggttgtgagagggagaggcccccaaaagtatgaacgtaccaataaaagcaatgcggcatcttcccaagtgcaaaataaacattcggggaggacttccacacatgctgccaaggcagaatctggccctgtgcctgctaaaaatcaagtggttgcttcaaatttgaactcagcatccctgccattttacccttcaggctcttccaacaaagataataatttggcacaaagaagggaggtgcaaacaggtggcagtagcaggaacattagtcctgttgttgtggatgagggttttccagttcaacaaaacaatgcacagcttcggggaaagaatgttgttgattccattagcatggcaaagttgtatattgatgaatccatccctcctccatctgttggaaagcctggatattctgcagtcagtgcttctcaatctcctcatctcagggcttctgggactgggaggggtgtatcaatcccagtacagacgaattatcagcgtgctcactcactgaataaagtttctccatctcaattccaggctattcagacaagttctgcaccagggtggaattcaacttctgtgcaagctactgccccacagttgggcaataggcctggcagtgggtctcaatcatcatctccccccagaacatccacgccagtgaattcacatgattctggagaaatggattcagcatcagaatcaggtaaagccaaaggtgcttcggttgggaagggaaggggaggttcccaaggtgcaggaaggggctctttcgtttatggtggggcacaggtaatgggcaccactggaaatgtggctgttagtcatggagatccaaacttcccagccttcttgccagtcatgcaatttgggggccagcatcctggtggtatgggagttcctgctgttggcatggcattccctggatacgttggtcagcctcaacttggtttgggaaagtctgaaatgacatggctaccagtgttggctggtcctgcaggagctttaggggctacatacccattccttcctgttgatggtgcaagcagtcgacaatctggacaggcctctgcaatgggtacttcaagcaaggaacataatgataaagctaataatgaattgaagccacctcagagatctgagcttgcaagtgatgagtttggacagcggcagaataaaccccgaaggcaagttggattgcaaaatcaccattga

SEQ ID NO: 105034 - DNA, 429 bp, Glycine max
  Peptide Sequence Number=SeqID_221812
atggcagagaagagaacacagacagagatgacaatggctgtctggcaacagtgcaaacaagatgagcagatgcaaaacaccatgattagcgccacaaatggcagcgcaatggccaggcactctgaaacaagtgcctcaagagcagtggggggccgttccactccaccaccccgtaattacagtatgattgactactatgcaaactggacccatatttctgtttctactcgcaggggatcgttgatcccacaattgagcaatgaagattgcaatgccactgagatcccactccttcacaatctgtggcatgaattagcaaggaagggggctcctgatgtatatgagatcgtgcaattacaggatctaaatcgtgatcttaacaacagttgcttggagtctaacctcaccaatttgaaagagaaaatctag

SEQ ID NO: 105035 - DNA, 243 bp, Glycine max
  Peptide Sequence Number=SeqID_221813
atggaagagatgactaatttcaaagaacaggttcacatagaagcacctaagaaagcggttgaacaagagaaagctgaaagtagtcaaagtatagggaattgggctaagcgcgcacccaccgctaagcacagcttcagcgcgcttagcgtgacagaagaatctggcaaagcatcaatatcagggccgcacgctaagcgcaagatcagtgtgctaagcgcaacaattgtcttcagccaggcttag

SEQ ID NO: 105036 - DNA, 1113 bp, Glycine max
  Peptide Sequence Number=SeqID_221814
atgaaacaatacattgaacatttccccgctggtgcaagtcaagttgcttggtggattatggaaaaccgacgagagtactttgatcgggcaaaggatgtgttgcagagagtgaatacattggtttttctgtctgaatcacaatctaggcaatggcaaaaatggtgtgaagaagaaggcataaaactgagctctcagcttgcaattgttccattgtctgttaatgatgaactagcttttgtagctggcattccctctacacttaatgctctatccttcagtgctgcaaaaatggatgagaggaggaagttgttgcgagattctgtccgaagagaaatggcattgaatgataatgatatgcttgttatgactctgagtagcatcaaccgtgggaagggtcagctattgcttctcgaatcagcacactcaatagtagaacatggaccattgcaagatgatgataagaaaatgcaaaagtcatcagatgatggagaatacctatctaccttggctagaagacatcattttagaaacttgttgaaggataacagtgtagccttgaacaatatctcaagcaattttataaacagaacaaggaaagtgttctcccagaacaatggaacaatagcacaatctctcaaaattctcattggttctgtgggatctaagagtaacaaggtggattatgttaaaggtcttctaagttttttagcacggcattcaaacttgtcaaagtcagttttgtggacctcagccacaatacgtgttgccgcactttactttgcagcagatgtttatgtcataaactctcagggattgggagaaacatttggacgggtgactatagaagccatggcatttggtcttccggtgcttggaacagatgctggtggaacacaagaaattgttgagcataatgtgacaggtcttcttcatcctattggacgcgcggggaatcatgtccttgcacagaatctccggtttttacttgaaaaccggttgacaagagaacaaatgggaatggaaggaagaaaaaaggtgcagaggatgttcttgaagcagcacatgtatgagaaatttgtagaggttcttgtcatgtgcatgagaaggatataa

SEQ ID NO: 105037 - DNA, 162 bp, Glycine max
  Peptide Sequence Number=SeqID_221815
atggcgagctcagtggagaaggagggtggcgcgagcgaggaaactttctctgtggagcttcctgctccacctggttggaagaagctgttttgggggactgtggttagctttcaaaagaggagaaaagaagagaagttacaaaaatttggagatccaacgtaa

SEQ ID NO: 105038 - DNA, 204 bp, Glycine max
  Peptide Sequence Number=SeqID_221816
atgggtcggaaatcgggaaccgaattcgaagagcccgatagatcgagctcagagagagaggaacgtgacgagttaaggcacggatttacgatattgccactgggaaatgaagacgatgtaatggacggcgtagatctaatcatacacatgaattactgtgataaaattatatgggaatttctcgtgactcgtgagtctgtgtaa

SEQ ID NO: 105039 - DNA, 1105 bp, Glycine max
  Peptide Sequence Number=SeqID_221817
atggataggcaagtgatgcagatgctcctttttctcatgtccctcttcaccattttcgcaccttggattactgcatctttctcatgccccatagatctcagctatgttgacaccattccatggaacacttcaacatgcaaagacccaattgacaaagaaccatgctgcgacatacttctcagtgtctttgccattggccttgccgaactcctcaaagacactaaaacattttaccttcccaatgaaagcacttcctcctcttgcttacatgacttcaatctcaggcttcaagccttgtcaattccaccaaagatggtccctttatgcttccctaactcaacaaggtttgttttcaatgcttcagcttgtgcaggcattagaaccacgcttgattggacgcaacgggttggcatggttagcccagtagacactttttgcaatggagacctcaaagacaaaactcgttgcaaaacttgcactgaagctgcataccaagtcacttctcagctcacaactattgacccaaatgctaacacaacaaaatgtttttactacatagtgttgtatgctgctgctgttgtgaatcagtttggtacaaccgatgtaagcaccacatcttgcatactaggcctgaggcaaccctctagtggggtaatagaagaggggtcaagtaatacagaagaagtgttgaaattgggttttagtttgttgggtgttattattggtgttgtgcttgctttgttgacgatagttatgtacaaaaagtgggataagagaaggaaggaacatgtttatcacagggagattgagaacaaggtgagggctggtgttttgcctaatgctggtgctaaatggtttgatgtatcagagcttaagtgtgccacaaacaaattttcgccgaggaatgtggttggtcaaggtggtgatggggttgtgtacaaagggattctttctgatggtgctgtggttgctgttaaggagatttttgatttggaagctaaaggggatgaagatttctgctatgaggtggagatcataagcaagatcaagcacaggaatcttcttgctcttcggggttgttgcgttgctagtgataatttgaatg

SEQ ID NO: 105040 - DNA, 147 bp, Glycine max
  Peptide Sequence Number=SeqID_221818
atggcatgtacctcttggcaacaaggattgaaattccaaattatgtccccaaaagctccggatgttagagacggcaaccttgggaggcattcgagaagcgcaacgaaagacagaggtactagcttagctgattcaacagcacagtaa

SEQ ID NO: 105041 - DNA, 1200 bp, Glycine max
  Peptide Sequence Number=SeqID_221819
atgggtgtgaactcttactccaacagtagagttgagcacctagcttgcaacaacaatggtagtaacaataacatgaagatccaagctgagatacaaatgccacccttggaaattcacaaggttcggttgccaccagaacgcaccaccttgcagaaactcagacacagactctctgagatcttcttcccagatgatccactccacaggttcaagaaccaaacatgcctcatgaagctcctccttgcacttcaatatttcttccccatttttcaatgggcccctcactacaacctctcccttctccgctccgacatcatctccggtctcaccattgctagcctcgccattcctcagggaatcagctatgctaagtttgcaaacttgcctcctattcttggattatattccagttttgtgcctccactgatatattccctgcttggaagttctagacatcttggtgttggtccagtttcaattgcatctttggtcatgggatcaatgttaagcgagacggtttcctttagtcaagatccaattctctatcttaagttggctttcactgccactttttttgccggtttgttccaatcttctctgggtatattaagcaacttgaaggctatatatatattgattggtatttggttaggctttgtaattgattttctctcaaaggcaacactggtgggttttatggctggtgcagcgattattgtatcactgcaacagctgaaagggttgcttggaatagttcatttcaccaacaagatgcaaataacacctgtactgatttctgttttcaagcaaagagacgagagcttgaagaagccaaaactattctgggtttcagcagctgccccattgacatcagttattctgtcaaccatttttgtatttattctgagaaataagacacataaaattgctattattggtgaattgccaaagggacttaatcccccatcatcaaatatgttatacttcaatggtccttatttggctcttgctatcaaaacaggacttgtcactgggatcttatctctcactgaaggaattgcagtaggaagaacatttgctgcacttaagaactaccaggtggatggaaacaaagaaatgatggccattggtcttatgaacatagctggctcttgttcttcatgctatgtcacaacaggcaatgattcttctctcttttga

SEQ ID NO: 105042 - DNA, 2559 bp, Glycine max
  Peptide Sequence Number=SeqID_221820
atgagcgtggtgggattcgatttcggtaacgagagttgcattgttgcggttgcgaggcagagagggattgacgttgtgctcaatgatgagtccaagcgtgaaacgcccgccattgtgtgcttcggtgacaagcaacgcttcattggcactgctggtgctgcctccactatgatgaaccctaagaattcaatctcccagtttaagagactcattggtaggaaattctctgatcccgaattgcagcgggatcttaagtcgttgccgtttcttgtcaccgaggggagtgatgggtacccgttgattcatgcgcggtacatgggtgagtccaagacgtttacgcctacccaagtgtttggaatgatgctgtcgaatcttaaggaaattgcggagaagaatcttactacagcggttgtggattgttgcattggaatcccggtttattttactgatctgcagagaagggcggtgctggatgcggccacgattgctggtctgcacccacttcggttgattcaggaaatgactgccactgccttggcctatgggatttataaaacggaccttccagaaaacgatcagctgaatgttgcgtttgttgatgttgggcatgctagcatgcaagtgtgcattgctggattcaagaaggggcagctgaaagtgttggctcattcatatgataggtctctcggcggtagggattttgacgaggttttgttccatcactttgctgggaagtttaaggaggagtacaagattgatgttttccagaatgccagggcttgcatcaggctcaggactgcctgtgagaagatcaagaagatgcttagtgcgaatcctgtggcgcctctcaacattgagtgcttgatggatgagaaggatgtccggggcttcatcaagcgagatgagtttgagcaactaagtcttccaattttggaacgtgtgaagggacctctggagaaggcacttgctgaagcaggtcttaccgttgaaaatgtacacacagttgaggtggttggttcaggttctcgggtaccggccattaacaaaatattgacagagtttttcaaaaaggagcctaggcggacaatgaatgctagtgagtgtgttgctaggggctgtgcgttggaatgcgcaattcttagtccaacgttcaaagtacgagaatttcaggtcaacgaaagccttcctttctcgatttctctttcatggaaaggttctggtccagatgcacaggacaatggatcagaaaatcagcagagttcccttgtttttcctaagggtaatcccataccaagtatcaaggcactgacattctgcagggcaggaacattctctgttgatgtattatatgatgatgcaagtgggctgcaaacacctgctaagatcagcacatatactattggtcctttccaaactacaaatggtgaaagggcaaaagttaaagtgaaagttcgtctgaatctgcacggaattgtatcccttgagtctgcaacactcctggaagaggaaaaagttggggttccagttaccaaagaggcagcaggggaaaatactaagatggacattgatgaagtccctgctgaggctgctgcacctcccgcctccaatgacactggtgctaatatggaaggtgcaaaggctagtactgatgcctctggggttgaaaatggcatccctgagggtggagataagcctttgcaaaaggatactgataccaaggttcaggctccaaagaaaaaggttaagaaaacaaacattcctgtagcagagttagtttatggagcaatggtgcctgtggatgtccagaaagcactagaaaaggagtttgaaatggctttgcaagatcgtgtgatggaagaaacaaaagacaagaaaaatgcagttgaggcttatgtttatgacatgagaaacaagcttaatgacgaataccaagagtttgtcactgcttcagagagagatgattttactgctaaacttcaggaagtggaagattggctttatgatgagggtgaagatgaaactaaaggtgtatatattgccaagcttgaagaactcaaaaagcaaggtgatccaattgatgggcgatacgaagaattcacggagaggggtactataattgaacagttcgtgtattgtataaatagttacagacaagttgcaatgtcaaatgatcctagatttgagcacattgacattaacgagaaacagaaggtcataaataaatgtgttgaagctgagaagtggtttaatgagaagcagcagcagcagagctcacttccaaaatatgccaaccctgtactcttgtcagctgaaatgagaaagaaagctgaagatgtcgataggttctgcaagccgattatgacaacacagaagccaacaaaggcagttactccagcaggaccagcaaccccatcttctcagagtgatgagcaacagcaaccccagggggattctgatgtcaacagtaatgagaatgctgggaatagcagtagtcaggctgcaccagcatctaccgaaccaatggagactgaaaagtctgagaacacaggctctgcctaa

SEQ ID NO: 105043 - DNA, 555 bp, Glycine max
  Peptide Sequence Number=SeqID_221821
atgtgtcataaatttgcatttgaggcactagataaaagtcttaaagaaatcatgcaaaacaatctgccttttggagggaaaattatggtttttggtggagatttccgacagatcttgccaattgttccaaaaggtaatcgctcagacatcgtccatgcaactataaatgcatcatacatttgggaccattgccaaattcttaaacttacaaaaaacatgagattgctatcaaatgctccccaacagcccaacaatgaagaactcaaacaattttcacattggctacttgacataggagatggaaaaattggacaatataatgaaggattttcagaaatcactattccatatgagtttcttataaaaaattatgatgatcctatccatgctattgttgaagccacctatcctaacttgatagataactatagtgacacagattacttgcaaaaaagagttgttcttgcctctaaaaaagaaattgttgacaaaataaatgattatgtcctatcacttataacccaatcacgaaaaagagtattgcagcgcagatag

SEQ ID NO: 105044 - DNA, 509 bp, Glycine max
  Peptide Sequence Number=SeqID_221822
ggaatgccgatggtgtaaaaacggaagacacaccaacgttgctacttttggaagagagtgaaaaagctaagagaaggtttttggtttgtgatttcatgcctaatggcagcctcatttatcaattgtctcttgctggggctaataggctaacgtggccacaaagaaagaacataatccttgatgtggctaaggggcttgcttatttgcattatgaaatcaaacccccaatttatcaccgtgacataaaggctaccaacatacttttggattccaaaatgaatgctaaattggcggattttagcttggccaaacaaggtagtgaaatccaatctcatctcaccacaagggttgctggcacatatggttacttggcaccaaagtatgctctttatggacaactaacagagaagagtgatgtatacagttttggtattgtcatcctggaaaccataagtagtagaaaagtgtttgataatctgaattcatctatggattcaatcacagattgg

SEQ ID NO: 105045 - DNA, 141 bp, Glycine max
  Peptide Sequence Number=SeqID_221823
atggtttgggaattgtggagcattgaatgttccgttcaaagattggacgtgaattggcagaatgataagtgtgaaagactgtggtggtggaggcagatgaatgacctgtctaatgctgaagtcgataatgatcaggcatag

SEQ ID NO: 105046 - DNA, 300 bp, Glycine max
  Peptide Sequence Number=SeqID_221824
atggttatttggcaccaaaatccaatccatgattgggtatggacacttgtggaatcaggcaagatggaggaagttttttatgaatcaataatagaagcgcaagtaaaatttatggaaaagtttgttcttgttggaatactatgtgctcatggggtggtggatttaaggcctagtattgttgaggcccttaagatgttagaaggtgacactgaaattcctaaattacctgagaggccaatggcactagttcatgtgtcctttcaatcttctttgttacatggtttgcaaagaagtagttga

SEQ ID NO: 105047 - DNA, 754 bp, Glycine max
  Peptide Sequence Number=SeqID_221825
atggaaatgggcgtagatattggcgggatttctgccgtggtgatgaataacgtcccgccgcaccccgctaactatttacagcgtgccgggcgtgccgggcgtagcaaagagtcccgcgctatttcttacacgttgtgcaaaggcaacccgcacgatcggcaggtttttgctaaccctctctggccttttgaaacggtgatccctgcgccgatggtggcaatgaattctgagcgtctggtacagcgccacgtcaattctctgctgctgtcagactatttgtgccatgtcatcggtgaaaccgaaaaagaacgcaccagccttaatagtcagtggttctttggtgaagagcttgaacagtcggtgtgtaaccgtttcaaagcctggctggagcgtccgacgctcagcattgacgcggctttggttcgtttggttaaaggcaccgcgcttcatggcgttgcggcagaaaagctgcgggataaaacgtgcgacgcgattgcggcgctgcagaagcgctggctgggaatttatcgcgatcttgttaagcaggaaagtgaatcgcagcccaatacgccgtatcgcaaacgtctggagctggagaaaaaacggcactgcggcgagtatctgctgcgcgacttggcggccagaaccttcctgcctggatatggcttcccaacggatgttgtcacttttgataacttcactatggaagattatatccgcgagaaaacgtacaaagtccgtgataagagcgatc

SEQ ID NO: 105048 - DNA, 168 bp, Glycine max
  Peptide Sequence Number=SeqID_221826
atgggagatgaagcctcaagaaaaagatgttggtctcccaagatatatgtttggatggatcaatgggacgcaccacgatggccacatattctaaagattatatattactattatgttaggagcgtgttccagaagcaattgccacttgcaatgattgtagtattatga

SEQ ID NO: 105049 - DNA, 294 bp, Glycine max
  Peptide Sequence Number=SeqID_221827
atgttagcggacatcgaccgtttcctctttgaaaatttcaagtccctgttcctcaatgatcttgaagaacccgccaacagagtagaaaagtctccagaacctgggcccccatcccatcagctccgccacgtcggaaagcgagatcgcggaggagcagacggtgattccgggaaattgtgtggtggtgctggcgaactcagtgaaccccagcaaggatttccagcgatccatggagagcgttgtggaagcgaggagcttttgttctgtcacatgaacctgaacaacaagaagtag

SEQ ID NO: 105050 - DNA, 243 bp, Glycine max
  Peptide Sequence Number=SeqID_221828
atgaagggcaagcactttctaggttccaatggtgggaaatgggaattatgttcagagatgagtcactcttgggcagagtttcaaacagttgtgattaggacattccaaccctcaatgatgcagaagccatacaagttgtgttcgaaacaagttaaaggaagaaggaacaaaatgaagttgcacacactagaacttttaccagaaatgatggattatgcttggcaaatcactgagaagaactga

SEQ ID NO: 105051 - DNA, 987 bp, Glycine max
  Peptide Sequence Number=SeqID_221829
atggcgagcaacgatggaggaggaaaagaagaaagaagaagaagaattgcagagagaggttcagatcgcatggccttaataacgggtcgaatcaatgcgcttcctccgacaccaccctcttccgcgtcatccccaacccaccgcaacattcctcgtcacgcgcaatccatgtcggtcgcagctttcgactccaactcagatgatcagcagcagcatcatcttccccctcgccaccagcgccctcagtcgttgtctgcattcaccgattaccatgaagatctcaccgtaaaacatcaaggagaatctattttgataatgataagtgaaattaacactgaccttccttgcggtgctgaaaataaacgtagtgtctctctttcttcagcaaggctaaaacatcagggcggatttaggtactcaaacatggaaagtttcgacttcaaccctgaagaggaacctcttatacaggattctgatactattacagaagccaataatcaagtgtctgagggtaatgttgccaaaatgaaaccaccttctgtcccgtcaaacacaaaaaatccagcacatgacacacaacagctaaagcaacctctcaggcataataaggatacttttttctcttcaagagagctgaatatctgcattttagcttctgagcccacacgcgccctcagttctctgataatagcattgctggtagttttttattacatgatttcagagagagttttggcctcaaggcctctttacatactcttgttaactgatgttacaattgtgcttgctcgcctatatggtggaaaggcaagtgtcttggaagaagctgagggagaaaaagttaaagctactggagatggacacaattggggtgatgcagtaaagcttatggaaaggggtttggtgacctaccaggccattagaggacttttcatagattgcagtatttatctagtggtggttgtatgtggtacctccttgatgtag

SEQ ID NO: 105052 - DNA, 216 bp, Glycine max
  Peptide Sequence Number=SeqID_221830
atgggggagggatgttgtacgcagccttacccttgcgtatgcaaagaggctgtttccggattcgaacccatgaccaacaagtcaccaaggcacaactttaccgctgcaccagggctcgccctcatggtgaagaagccccacacaccattgctgaaggttaaatcatatgcggacaacttcaaatggaagggaccacccaaatctggtgaagagtga

SEQ ID NO: 105053 - DNA, 886 bp, Glycine max
  Peptide Sequence Number=SeqID_221831
atggtgggcaagttgattggtattggcatgagccagccagatggtttgagttttgccgtgaacccgccagcgattcgtggtctgggttctgcgggtggttttgaagtctatgtgcaaagtaagggtgatacggatccaatcaagttggcgcaggtcatgaataacttcatggatgcaatgcgtgcagactctaaattgaccggtattaacagcttcttccgcccaacggttccacaactctttattgaagtggatgaagccaaggcgctgtcacagaatgtcaagatttctgacatctatgccacgctgcaaagcaccatgggctcactctacgtgaacgactttaaccgtagcggccgtacctatcgcgtgcagttgcaggctgaagccgaataccgcatgaaacctgaagacctgggcaaagtgtatgtacgcagccagccaacggcagataatccggatggcaatatgatcccaatgtctgcattggctaaagtcagcaatattgtcggtgccgagcagttggagcggtacaacggcctgttgtctgccaaagtctttggtagtggcgcggctggcgtgagctcgggtgatgcgatcaagctggtggagaaaattgccaaggaaagcttgcctgatggataccagattgcatggacaggccaggcttaccaggagaaacgtaccggttctgctgcattggtagcgtttggttttgcgaccattatggtgttcctgatcctggctgcgcaatttgaaacctgggccttgccactggcagtgattatggcgattccgtttgccatgaccggtgccttgattgcagtgctcacacgcggcatgaacaatgatatttacttccagattggcctgattacgctgatcg

SEQ ID NO: 105054 - DNA, 291 bp, Glycine max
  Peptide Sequence Number=SeqID_221832
atgcaggctacatgtgcaggctacgtgctgcagcagggcacaggcttggcgcagagggaagaactcgtcattggtgtagacgagatgcagctttggatcagggaagaactcgtcattttgactggcgagttgaggttcaaaattttttttataaaacgcgagatatgtggctcccatatgcatgctttcttcttctgcttgtatcttcctcactgcattcctttcttctcatattgctgcttccattgcattgtttcttctcttggtattacgtgttcttatgttgattag

SEQ ID NO: 105055 - DNA, 378 bp, Glycine max
  Peptide Sequence Number=SeqID_221833
atggcgaataccctacaacgcgccctacgcgccaccatggcccggcggttctccaccgacgcattggccgaaattaaacgaggcgagatcggaatggtttctggaattcctcaagagcaccttcgtaggagggttgtaatttactctcctgctagaactgcatctcaacagggatctgggaaggttggaaaatggaagatcaacttcttatctacccaaaagtgggaaaatccactgatgggctggacatccactggggacccctactctcatgttggtgattctgccttgacttttgatagtgaagaagcagcaaaagcatttgcagagaaacatggttgggagtattcggtatgtcttgctctattgggtcactga

SEQ ID NO: 105056 - DNA, 141 bp, Glycine max
  Peptide Sequence Number=SeqID_221834
atgttatcggccagcgtttgcaaaaacaattgcgcaatgtcggctgaaaatatcagtcgaggaaatgttcgatcggcgtcatccgatgatgcttccattttaaacctcgatcgcttaactttcctggccgacgtcggctag

SEQ ID NO: 105057 - DNA, 354 bp, Glycine max
  Peptide Sequence Number=SeqID_221835
atgggtaaagggtcattaaaggcttctagaaccttccagcagaccaaggcaccgacaatctcccattggtattggaagaataaagcaactttaagggagcttaagggggtcaatactaaacaaagcaaccttgcactcaattttcttatactttttccacaaatccctcctaagcttcacaaggcccaacgaatgtctgtcttcaagcctcctatccacaccttccatccttgccaacaaacgctttttagtatgaaaaaattcccaaaagattggttgttccaagatgaggccttgcccttgaaggaagaaacaacctcatcccaacaaaggcgccctcccaagcatctctga

SEQ ID NO: 105058 - DNA, 225 bp, Glycine max
  Peptide Sequence Number=SeqID_221836
atgggtttgaatgaaggagaaagagggataaagttagacaatattttgatagtgggtagatgtgaagtatatgaggttgatggctttaagcttgacctccatgtcattgagcatgacatggcttttgctctctatttgaaattttatttgctccacaactttgattatgaacgcatattggcattttcaattgctaacccttgcaacattgtgattcaatcttaa

SEQ ID NO: 105059 - DNA, 909 bp, Glycine max
  Peptide Sequence Number=SeqID_221837
atgaagactcggctagagatcatacagaagaagaagaaagcagagcagaagtttatgaagagtgacatcgccgagcttcttaggagtggccttgactatgatgcatatataagggctaaaggacttctgttggagcaaaatatgttatcctgctatgaactcattgaaaagtttgttggatgcttatcagatcatgttgaagacctaactaagcagaaggattgccctgatgagtgcaaggaagctgtgtcatcattgatgtatgctgctgcaagatttgctgatctgccagaattgcgtgacctcagaacattatttactgagacatttgggaattctcttgaaccatatataaataaagagtttgttgagaagctgaggcaagatccgcctacgagagaaatgaagattggactattatatgatatagcacaagagttctctgtagagtgggacgacaatgctctgagacaaagactttatacagaatcgtcattatgtgaagagaggcctaatcccaggagagacttgatcacatccaaaggaaaagaaagagacacagacaccctacctcttggaaggaaagatttcaatgatgtctcattgatacaccaaaatagtagtgatgatgaaacaagtacagaactgtcatcccatgatggcagaaagggtagtagttcaaattcattgggaagcttttctgaggatgaagtagaaactaagaggccaatttcttcctatttgctcattccacccccatacctcaaacaaaagaccaacacaggtgaaagcaattcaaagagaacaacacattctgaggctgcaggcaaaggaaaacgttatccttctcaacaacaagaacatgatactggcgaaaacagaaggcttagaacatcacatgtcagatga

SEQ ID NO: 105060 - DNA, 489 bp, Glycine max
  Peptide Sequence Number=SeqID_221838
atggtgaaggcattctcatcaaactgcgtggttttgagacggttttgctgcctgaaatggacggtgtttgtggtggtgtctctggcgggcgtgttggtgttatggccgtgggagccagagttgaagatcgagagaatgaacgtgaagcgcgtgaaggtgcaccctataccgccggtgagcgcggacgtgtggatatcgctgtcggtgagggtacagaaccgctgcatgtactggatggagctgacggacgttgacgtaggggtgaagtacagggggaagaagatgggtcacgtggagtcggaggggtggcacgtgagggggtgggcgtcgacgaaggtggacggcgtgcttgagttcagtggccttccatcgtcggaggtggcgcatttgctgcaggaccttgccatgggtaagatctacttccataccgttatcaaggtctacggccaacttggctttctcttgtttcgcatccctcattttctccag

SEQ ID NO: 105061 - DNA, 1461 bp, Glycine max
  Peptide Sequence Number=SeqID_221839
atggaatctcttcatctgcatcttcagggtcaccccgtggcccaattccggccgaacaccgacaaaatccgcctcagactcatcgaaaagggtgtccaaccagccccaaagatcgtccacaccctccgcaagaaggaaatccaaaaacacaaccgaaagctgaaggcccggcccgctcctcccctcaccccggcccaggcccaggccgcggcggaggagcagcacttcgagaccattaaacgcgagttccgaagagtcatggcggggaagccctgggaggggattcagaaggtcgagttcttggagaaggcgaggccggaaagggagtgcagaggaggagtaaagcttagaagagagagcttgaatgagctgaaggagatgtttgaggcgcggaagatggatgagttgaagtgggtttttgactctgaccttgagattgatgaggtttggcttgatgaagggtatggggtaaggggcaagactcggaaccgcagcgagggtgaggttataaggtttctcgttgatagtctgagtgatagggagattattatgaaggattggaagttttcgaggatgatgaagatgtcaggattgccatttactgaggaacagttattgaggattgtggagctgcttggttttaaacattgttggaagcaagctctttctgtggttcaatgggtctacaactataaggatcacaggaagtttcaaagcaggtttgtatatacaaaacttctttcagttcttgggaaggcaggcaggccaaaggaggcccttcaaattttcaatatgatgcgcgaaaacatccatatatatcctgatatcgctgcatatcacagcattgctgttacgcttggtcaagctggtcttctgaaagagttgctaaatactgtggaatgcatgagacagaaacccaaagcatttatgcatcgcaagaactgggatccagttcttgaacctgatctggttatatacaacgctgtgcttaatgcttgtgttccatcaaagcagtggaaaggtgtgtcatgggtgtttaagcaactgaggaaaagtggtctgaaacctaacggagtaacttatggacttgcaatggaggtaatgctggaatcgggcaattatgaccttgtccatgagttttttggaaagatgaagagaagtggggaagttcaaaagcccttacttataaaggtagttctttacttcgttgtgttggtgagaaccttctggaaggaaggtaaagttgatgaagctgtgaaagccgtcagggacatggaaagaagaggagttattggaacagccagtgtatattatgaactagcttgttgcctttgcaacaatgggaggtggcaagatgctattctggaggtactgtgtttaatctcttcgagtaaaccgccaaatctggctttgagaaatttggtggtggacatattaggttctgggcacattagtccctag

SEQ ID NO: 105062 - DNA, 156 bp, Glycine max
  Peptide Sequence Number=SeqID_221840
atggtcataagtcgcgccttaaagggtttcatggatgataaggccttagtcacttcctccaacaagataggtttgggattggaaatacctgaaggcttattgaaggatagcctcaacggggcagaaaaggccattaggaagagccaatccctttaa

SEQ ID NO: 105063 - DNA, 336 bp, Glycine max
  Peptide Sequence Number=SeqID_221841
atgaaggatagtttcttgatcagagttaactcctctctttcccatagaccagccaggaaaagaggggagttaacttcaagagcagtcaaggcatacttaatccaatcacaagagatgtttgttgagaagaaggcaagatcattgcaaccaagcttcatccatatagagaatagaatggtggcagatcaaccagataacaaattttatcttcttagaagctccaatgtttcaaacccagttccaggaggtagtgttcataaggttccttctttgctcaagcaaccacccataaccatctttgttggagtagtcacccctcaaattatactgtcatag

SEQ ID NO: 105064 - DNA, 360 bp, Glycine max
  Peptide Sequence Number=SeqID_221842
atgaagcttggttgcaatgatcttggcttcttctcaacaaacatctcttgtgattggattaagtatgccttggctgctcctgaagttaactcccctcttttcctggctggtctatgggaagtttggaagttcaataataaacatgttttttataatactaccatcccacaacatacagtcttggctaatatttgtactctagcggaggtagtttggcatcgtgatcatgaggagggagccattcttaatgttgacggtagttgtctgaccaactcgggaaaagtgaggtttggaagaattttgagaaaccatgaaggagtttggatgaaagcttttctatggttttgctggctatattga

SEQ ID NO: 105065 - DNA, 2091 bp, Glycine max
  Peptide Sequence Number=SeqID_221843
atgaaccggcaagcccagagatccggtgcgacgggggtgcaccataaccgccaatactccgaacactatctcgacgcctcttccaagtggtttaatgactcttcctccaatcacattcctcctcttcaggactacaatttgtacggtggcggaggtggaagaatgtatcggagcaacgcgcagaggagcttcaatgagtattgttttgatccggccacgcctcctcggagttacgccattaagaaaaacgccaacggttacggcgacgaagactattctcctcgtgatttcagccccggcctcttggatctccattcttttgatacggagcttcttcctcagattacgtcctcgaatttgtatgattccgagccttacattttcggcaaacaaactgtcagagctcgcgcttccgaaaacaatgtctccaatagtcttgctgctgcggacaatgcgaaatctagcaatgtggctaaaattaaagtcgtggttcgcaagagaccgcttaataagaaggaggtagctaagcaggaggaggatattatagacacagtttcagattcattgacagtgcacgagactaaacttaaggttgacctaactcagtatgtagagaggcatgaatttgtttttgatgccgtcttgaatgaagaggttacaaatgatgaggtgtattgtgaaacagtggagcccatagttccaataatatttcaacgcacgaaggcaacttgctttgcatatggccaaacaggaagtggaaaaacttacacaatgaagccactgcctcttaaagcatcaagggacatcttgagattgatgcaccatacctataggaatcagggatttcagttgtttgtgagtttctttgaaatatatggtgggaagctttttgatctccttaatggtcgaaaaaaactgtgcatgagggaggatggtaagcaacaagtttgcattgttggtttgcaagagtaccgggtatcagatgtagagaccatcaaggaactgattgagcaaggaaatgccacaagaagtactggcaccacaggtgcaaatgaggagtcttcacggtcacatgcaatacttcagcttgctatcaagagatcagttgagggaaatgtatccaaacctcctcgtgttgttgggaagctgtccttcatagatcttgctggaagtgaacgtggagcggataccacagataatgacaaacagacaagattttctcttcttagccttaatgaatttgtttgtttggacggtgttccaaattacatggaatgcagaatagaaggtgccgagatcaataagagcttgcttgccttaaaggagtgcataagagctttagataatgaccaaggacacatcccattcagaggcagtaaattgactgaagttctgagggattcatttgttggtaattcccgcactgttatgatatcatgcatatcaccaagttcgggttcatgtgaacatactctgaatacattaagatatgctgacagggtgaaaagcttatcaaaagggaacaattctaagaaggatgttttatcttcaaactttaaccttaaagaatcaactactatttccttgtcttccgctaatacatatacctacgaggatcgcgcagctgatgcatggcctgaagaaaatggtggggatgaatttagttctcctgaagattactgtgaaccggtgaaaccatcatggaagaaaaatgaaaaggtagagcaatatagtgcaacagatgaaaaatttaagaaacccaatcatcagatcaaatggaaggacatcccaaaagttgaacctaaaacagtacattcagatgatgatttgactgccctcttacaggaagaagaagaccttgtaaatacgcaccggaaacaagtagaggagaccatgagtattgttagagaggaaatgaacctcttggttgaagcagataaaccaggtaatcagctggatgattatatagcaaaactaaatgccattctgtctcagaaggcagctagcatcatgcagttacaaacccgtttagctcatttccagaaacgtttaaaggagcataacgttttggcttcatctgctggttactaa

SEQ ID NO: 105066 - DNA, 429 bp, Glycine max
  Peptide Sequence Number=SeqID_221844
atggccatggctttggtgagcctcagcaccattctcacaccgccttcttcttcttcttcttcgttttcttctccaaaaccttcttcttcctccatcgttcggtttcgccctctcactccccttcctcgctttcggaggcacctcgttcgtatggctcccgatgaggagaagatgactcgtcgctcccctctcgatttccccatcgtagaatcagttcataatctggtggatctgacagagtgggaaaggcctaaacctggacgaaggccggatatattccctcaatttagtcctatgaagacacctttgccgcctccgttgcccgcagatcctccagaagaggatgaagaggaggaagaaaagaaagaggaagaggaagaacctgaaaaggaggagccagataagccagacaagccagaaaagcaatag

SEQ ID NO: 105067 - DNA, 504 bp, Glycine max
  Peptide Sequence Number=SeqID_221845
atgctgctaagagaaacatttcgcaagaccaaggttttctttagcaaaagcttccaaaaattttggtctttcttctttggagagtaccaaaagcttcccagatctctttccttcaatccattcctttctagagttggcaatgcaagaactcacacaagcgaccaactttacaatgatatgctgcagtctgaccttggcagaacaaagatgtatggtaacaacatgtccatgacagcaatggaagatgctcaaaagagcatccatgaggagagagcacaagagaagaagaacaaaggtaaaaaagagtacttaagttcacaaaacatgaacaagaaagctcatgttttagcacaaaagatgaaggcaatggatatgatggatgctggcgatctagagcatgtgctagacatagaagaggttctccactattattcgcgccttaagagcccagtctatttagatattgtggacaagtttttcaaggacatgcaatcagagttatag

SEQ ID NO: 105068 - DNA, 249 bp, Glycine max
  Peptide Sequence Number=SeqID_221846
atggatttctggccagaatttcttgcaagcggttcgggaagagagtttgtagcaggttatccacttgatactcttcgaatcagattacaaaactcgaaaaatggctctgcattcacaatccttagacaaatggtgtctagggaaggaccaacttctttgtaccgtggcatgggcgcaccattagcctccgttacttttcaggtgcattgggccatagcaatagggccattcaaggctattggaacttga

SEQ ID NO: 105069 - DNA, 672 bp, Glycine max
  Peptide Sequence Number=SeqID_221847
atggttttccaaacgtacgcagttctgtcaagggtatttgactcatctgtttttgctaaagaccctccttcctacaagggtgttgctttaggaggaacgggtgccggggttctccaaagtctattaatatcccctgtggagttgaccaaagttcaacttcagctgcaaaacggaggcaagatgacagaatctgtaaaaggttctttgacactcgccaaaaatatatggagaaaagaaggcctcagaggaatctatcgcggacttggtctcacagtgatgagggatggaccttctcatggtttatacttctggacatacgaatacatgagggaacagcttcacccaggttgcagaaaaagtggtgaagagagtttggataccatgttgatagcaggaggattagcaggggtgacgagttggattagttgctacccttttgatgttgtaaagacaagactacaggctcaaacaccctcttctataaagtacaaaggcattatagattgtttcaaaaagagtgttaacgcagaaggatacggtgtgctatggcggggtttaggaactacagttgccagagcgttcctcgtaaatgctgccgtattttctgcttatgagatttcactaagattattgtttaacaatgggagtattcaaatgcaggaaacactatag

SEQ ID NO: 105070 - DNA, 327 bp, Glycine max
  Peptide Sequence Number=SeqID_221848
atgggactaaaagcgcttgggtcgtgcccgcgtcaggggcactaccagtcgcgtccagcggcagggcgctaccagacgcgcccgcgtcaggggcgctaccctgctgctacctcgtgcgccgcgttgtgccacgtgtcgcgtgctccatggaagcgccttcctggggggcgctttgtaataaaaaaacagaccccccagaaacaagtgctcctaaaagtattagctggtggtttggataagagtataagccacttgatgttcaaaagggaatttactgacctcgctaataatccatttaataagagctttctcgcaatcgacagataa

SEQ ID NO: 105071 - DNA, 540 bp, Glycine max
  Peptide Sequence Number=SeqID_221849
atggccccacttggagctctcgattccatgggcgcggctcaacaggagcagccgcaccgtcctaccctatttaaaagtttgacaataggtcgagggcgttgcgccccccgatgccctctaatcattggctttaccccgatagaactcgccccgcgggctcccagctatcctgagggaaacttcggagggaacccagctactagacggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 105072 - DNA, 192 bp, Glycine max
  Peptide Sequence Number=SeqID_221850
atgaaccggaagctgggttacggtgcccaactgcgcgctaacctagaccccacagagggtgttggtcgattaagacagcaggacggtggtcatggaagtcgagggacgggggaagcccgtctgatagcgctctgtgcgcgtactccgaaagggaatcgggttaaaattcctgaaccgggacgtggcggctga

SEQ ID NO: 105073 - DNA, 831 bp, Glycine max
  Peptide Sequence Number=SeqID_221851
atggctaagacggaccttttgaacacccggttatctcgccgcagaatgatgttggcagggctggcggccctggcgttgaacggcgccgcttccccgctggctcacgcccacggcctgccgcgccccaaatctcacggggcgcgaaaaagattcctggtcatgttggatcccggtcatggcggcatcgactccggcgccattggccacaccggttcgctggaaaaacatgtcgttctggagatcgccagaaatgtgcgtgcacagctcgaccgacacggcatcgatgcccgcctgacgcgcgacagcgacgtttttattccgctttacgatcgggtggagatcgcgcaccggcacggtgcggatcttttcatgtctatccacgccgacggttttacctgccccatcgcctgcggcgcttcggtctttgcgctttccaataaaggcgccagcagcgcgatggcgaaatacttatcgaacagtgaaaacgcggcggacgatctcgccggccctaacgtcatcaagaaagaccgctatttgcagaagatactgtttgatttggagcagacggaaacgatcaaagaaagcctgacgctgggctcgcacctgattcaacatattgcgcccattcatcatctgcatgccaaaaataccgaacaggcggccttcgtggtcttaaagtccccgtatattccttccgtgttggtggaaacctctttcatcaccaaccctgaggaagaaaggctgctcggcacccccgcattccgaaataaaattgccacggcgatcgctcaggggatcgtcagctactttaaacgcgaaacgcacgcttaa

SEQ ID NO: 105074 - DNA, 336 bp, Glycine max
  Peptide Sequence Number=SeqID_221852
cggagagcgatcggtcagggcggtcacatcatagagcacgccccaattgcggccgatatcgaggctgccgaaggttgcgttttgcaccccaatataggcgagtcgggtgctgttgcgagtcgcgtcggcgaagctgacggtatattcccagtgggcgtaggcccgccagcgcggcgcgatcttttttttgcctatcaggccgaaatagaggtagctgcggtcgccgtcgtcgcgcgcgttttggccgctgtagcgtctggcgataatcgtgccgtagaaattcaggctgttttgctgcgaccccgtcaacgacacggcgaaggcgccgcgtggtaa

SEQ ID NO: 105075 - DNA, 715 bp, Glycine max
  Peptide Sequence Number=SeqID_221853
atgggggagacatatgaaatacctcaccacaatctagccgacttcaagccttgcctcggatatgccactgaagggcacgcagttggtgcgggtaaaatccctcctgctatggtagaaatgggaaagttggatcatctagaggaaaggctcagggccattgaagaagacggagtaccaaagtttgataagtacatggggactgcttgccctacgaatcatctaaaaatgtactgtcggaagatgggggcaaatgcgaaagatgaaaagctgctaatgcatttctttcaagagagccatactggggcagccatcacatggtacactaatcttgaaccctttcaagtattcttggaagggcagtatcagtacaactttgatatggctccggataggatgcaactacagagcatgtgcaagaggaggcatagatccttcaaggaatacgccccaaaggtggagggacctggcaactcaagtagcacctcccatgatggagaaagagatgatcacattgataggggacacattaccagcaaatttgtttatcctgctttgatgaaagagaaaactggggcaaatggagagaatgagatagagggaggaacccgtgctgctattaccgttcctacatggccaaattccccatcacctcaacaacatcattactcagccaatatcaacccttctcattaccccctacctagtcatccacaaa

SEQ ID NO: 105076 - DNA, 584 bp, Glycine max
  Peptide Sequence Number=SeqID_221854
atggcttgcctcccaactatacaccacccaatgttgcacccgctcccgatgagaatgtcaataactcccctcccatactcattgagagtcaacaaccctaatctgatcatgcatatgtctctcaacccatgggggacacatgaagttccccgagacgacaatctagctgatttcgaaccttacctcggatatgccactgaggggcaggaattttgcagcatacccctaccaaacactttggaaggaactcagtttcgccgacaaccacaacctttgcattttgcggtgggaagagtccctcctgctatagtggaaagggggagatttaatcatatagaggagaggatgacggccattaaaggagacagagattatgtttttgctgacatggcagagttatgcctaatgcctgacgtaatcatccctctaaagttcaaggtgccggatttcgataagtacaaggggactacttgccccaagaatcacttggaaatgtacagctggaaaatgggggcatacacaaaagatgaaaaattgttgatgaatttcttccaagaaagtcttactagggcagccatcacctg

SEQ ID NO: 105077 - DNA, 222 bp, Glycine max
  Peptide Sequence Number=SeqID_221855
atgacaattctcagaagattcagacctccactgcaatggaatgtagttgtgctcgacaaaggcattggtgataagtatgtcactctcccttggtataaattccttcaagaaggtgattttagccatggagacgagctctcattctactataggcgtgctgagaagatctgggaagttgtcatcaggcgtgcaattgattgggatgatagtgatatagattag

SEQ ID NO: 105078 - DNA, 158 bp, Glycine max
  Peptide Sequence Number=SeqID_221856
atgaaaaagaagaagataacaatatacgggagtcgatttgatgaagaaatgagtgagataggaaggtttggaggtttaggaatggaggaacgtcgcaaggaggaaggggctgcacagggatttctggaaaatgtgatatttatagagcaggacgcgtg

SEQ ID NO: 105079 - DNA, 213 bp, Glycine max
  Peptide Sequence Number=SeqID_221857
atggcccttggaaccatggcagcttgctcaggcgagccagggtccagaaatttgctcaaaatgacccttttgcccctccccttgggtattttcgcgtccttgaccagaacgtcgaacaatctcgtgccttgtgcaaaaaccgatgtcgaacaacacctctcagttagcgagaatcaaaaacatcaatggatgacagtccccggacgaaattag

SEQ ID NO: 105080 - DNA, 444 bp, Glycine max
  Peptide Sequence Number=SeqID_221858
atggaatactcactcccttattaccattttcaagaccaaaagacaagccaaacgttgtttccctcattctacattgatgttatcgagaccaagtgggaacaagatgacatgctccacatggatcacttctctgggttcctatgtagccatcgtataccagatgtaccaggagataggatttgtattattgacttttacttttcatggacccaccctacgccgtccaattatcattttccgatacccatgccgaggtgtgttgccaaaggcttgggtaccacccagggtagatatggtggatcttgtgtcggggatgaacgagaaaaagaggaggaggacacgtcatacaaggaggatccgtttatggatgaggaggaccccactacggaaccagagatcatggaggaggattcctcgcaggattcatctgaggattcctactag

SEQ ID NO: 105081 - DNA, 189 bp, Glycine max
  Peptide Sequence Number=SeqID_221859
atgaggctgaggcactaccgaatcgcgactgtaatcgatttctacatcgttctttgttcggatttggatacgatctatgcacccttagaggtcatctttgttgttttgttaatcttcatctctttcttctatcatcactcatctcttttctttgtaaagttcaatcttaaccgatcactagtgttgtaa

SEQ ID NO: 105082 - DNA, 130 bp, Glycine max
  Peptide Sequence Number=SeqID_221860
tttggttgatcattgctcgttgggagacgacctaggatcacttcctagatacagcatttttaatgtttatttgattcgagtacggcctcgatcaaatttggcgccgttgccggggagcagtgggccaaag

SEQ ID NO: 105083 - DNA, 366 bp, Glycine max
  Peptide Sequence Number=SeqID_221861
atcctgcgccagcatcggctccagatcgctcatgtccttatcggaggtgttgcgaacctgcaggtaaacagtcttctggctggacggctcaagccaaacggtctgactcatctgggttttgacgtcgaggttgcgttttttgatggcggtgctcatggcaccacagccggaaagcatcagggaggcagcggcaatcgccgccacgaaggcgttacgggatttagagagaaacccttccgtcagagtgccggaagggttatcggcgggagccgcgggaacttaaatctttttaatcagactgctgattttttcaagcgccagaccagcgccaagtctgctaatttcagccccaataatcatgtttaa

SEQ ID NO: 105084 - DNA, 432 bp, Glycine max
  Peptide Sequence Number=SeqID_221862
ctgtctgcggagagacgcggcagcggcgtcacggaggaaagcttgcagagacgtgaacgtaatctgaccgcgccggcaggtgccccgtcgcaggccatgagcgaagattttcgcagtggctcacaacgcgtgggtgagaaggcgtcgggtgccggcattgaaagtaacgtggccaacaaggttgcagcacaaagatctggcctgatggaaacaatcagggaaaatgacggtaaaatcgctgaaaataaaaccactgttcagacgtccagtgatatactcaggaatgagcatcagggggcggtcagaagtcagcagataggccgtactgaagaggatatcaggcagactaagccaaaaattgatgatgcagaaacagagcaattcaggcataagcttgagaagttgaggtcttcgcagcaaaaagcctcttaa

SEQ ID NO: 105085 - DNA, 1143 bp, Glycine max
  Peptide Sequence Number=SeqID_221863
atggacccatgggtactagtacctatcgccttaagagggttgtatgccctcaccttcagatggctgcacgtcctcgcctttagagggctccacgtcctcgccttaagagggttgcacgcccttgccttcagagggctgctcgccctcgccttaagagggttgcatgccctcacctttagagggctgcacgtcctcgcctttagagaactccacatcctcgccttaagagggctccacgcccttgccttcagagggctacatgccctcgccttcagaggactacaggtcctcaccttcagaggactacacatcctcgccttcagagggttgcgcaccctcaccttcaaaggactacacgttctcgcctatagaggactacttgtcctcgccttcagaggactacacgtcctcgccttcagagggccacatgccctcgccttcagaggactacacgtcctaaccttcagaggactacacatccgcaccttcaaaaggttgcatgccctcccctttagagggctgcacgtcctcgcctttagagggttccacgtcctcgccataagagggttgcacgcccttgccttcagagggctacacgccctcgcgttcagaggactacaagtcctcgccttcagaggactacacatcctcgccttcagagggttgcgtaccctcaccttcaaaggactacacgtcctctcctttagaggactacatgtccatgccttcaaaggactacacgtcctcgcgtttagtgggccacacgccctagacttcagaggactacatgtcctcgccttcagagagctgcacgccctcaccttcagagggctacatgccctcacctttagagggctacgtgccctcacctttagaggactacacgttctcaccttcagaggggggctgcacgccctcgtcttcagaggactacacgtcctcaccttcataggactacacgtcctcgccttcagagagctacacgccctcgcctttagaggactacacatcctcaccttcagaggtctgcacgcccttgccttcaaaggactacacatcctcgccttcaaagggctgcacgtcctcgcttttagagggatccacatttgcgccttcagagggcttaaggtcctctgcccttaa

SEQ ID NO: 105086 - DNA, 213 bp, Glycine max
  Peptide Sequence Number=SeqID_221864
atgaccattggggtcttgaaaataataacttttggtctccctctaagcgataaaggcacgctaagcgcaattccaaccgaggggaattgcgctgagcggcccaaagctgcgctaagcccaattccaaccaagaggaagtgcgctgagcgcctagagggggctgcgctaagcctaaatccttgcgctaagcgcaataagtgggcttcggcttag

SEQ ID NO: 105087 - DNA, 1979 bp, Glycine max
  misc_feature (1238)..(1238): n is a, c, g, or t
  Peptide Sequence Number=SeqID_221865
gcgagcgctggagcatcggtgcggcagccgctacgaggacttctccagcttcggcagcacgctggacggcaagctgtcggcgcgcttcgcgatcacgccggacgtagccctgcgcggtaccgtgtccaccggcttccgtgcaccgacgccggcgcagctcaacaccaccagtaccacccagggcctggacacgcgcaccctgcagatcttcaccagtggccgcctgtcgccgaacgatccactggcgcagctgctcggtgccatgccgctgaagcccgaagaatcgcgcaccgcctcgctgggcctgacctggcgcaccgacctgggcctgtccggttcggtggatgtctaccagatcaggctcaccgaccgcttcagccagtcggccagcttcgccattccggccggtacgcccaatccgctgggctatacctcggtgaactacttcaccaacgacttcgataccaccaccaccggcgtggacgtggtcggcaattacctgcgcgatcttggcgcaggccgcatgacgttgaccctggcctacaactacaaccgcacccgcgtggacaacggcagcacctcggtggccaccaacgagacccagcgcgtgctgttcgaagaccgcctgcccgagcacaagggcagcctgaccggcagctgggatgtcggcgcctggtcgctgatggcgcgcatgcgctactacggtgcctggactgattccagcggcaatgcggtgggcgacatctaccagcgcttcggtgcgatgagtttcctcgacctggccgtgggctatcgcatcaacgagcatcacagtctgcgcgtgggtgcggacaacgtgttcgaccgctacccggatgaggccaccttccaggccagccgtggcctggtctactcgcgtaatgcaccatatgacaccgacgccgccctgtattcactgccggccaaggcgtccgcgcgttacgctgcgcccatgcagattcccgcaacgaccgcggcgccggacgtgctggcccgcgatgaaggctactgggccgccgtggccagccacttcgacatcaccgatgaagtgaaccacctggagaacggctactggggcgcgatgggccgcgagacgctggccagctaccagcgccataccgctgaagtgaaccgtggcaacgcttggtacggccgtcgtgagttcccggcgcagtacatggcggtgcagcggcaggtagccgaactgctgggcgtgggtncggatgagatcgcactgactcggggggccacggaggcgatgctggcgttgattggcggctacaaccgcctgcagcccggcgaccaggtgctgtatgccgacatcgactacgacagcatgatcggcgcgatgcgctggctgcagcagcgtcgcggcgtgcaggtcgagcgtatcgcgctgcctgcggtgccggaccacgcgcagatcctgcaggcctacgaggccgcattcgcgcggttgccgcgcctgaaactggtgctgctgacccaggtcagccatcgccacgggctggtgctgccggtggcggagatcgccgagcgtgcgcgcgcacgcggtatcgatgtgatcgtcgatgctgcgcatgggtttggccagatcgactacgcggtgccacagctgaaggcagacttcgtgggcatcaatctgcacaaatggatcggcgcgccggtcggcgtcggcgcgatgtatgtgcgcaggggccgcgttgcggacctcgacccgtacatgggcgagaccgacgacggccgcgtgggcagccgcgtacacaccggcacggtcaacttcgccgcctacctggcactgccggaagcgatcgcgctgcaccagcgcatcggcgtggccaacaagcaggcgcgcctgcgctacctgcgcgagcgctggacgctgccggcacggcagatggcgcatatcgaagtgctgtcttcgccggatccggcgctggccagcgcattggccagcttcc

SEQ ID NO: 105088 - DNA, 795 bp, Glycine max
  Peptide Sequence Number=SeqID_221866
ggcaaggaaagcccggtcgtcgccattttggccatggtatgacacgttcgaccggggatgtgaaaagagtggcgcaagaattgtttgttgtgcactggctctctatgtgtggctggggttgtattaattataatcccgtcctcgccataagacagcttggctaccccatgagaggagtgccatcagacgaaagcatcacgcccttcatcgcacggggtttcagtgaccataacgcgagggacagagagcttaggggaagccgtaatgggatcatcggcggctatcataagtggctgagagtccaaacacgaggattggattggctcccaaatctaaagactgtgagagacgatgaggttaaagcttcggaagaaagtgatgaggtacaagccctaaaggcagagcttgaaagagcccgggtagtcgaagagaagttcaaggcagcaatagtgactcaagctccgaagagtgaaaggaatcatcacggtcaaaggcatgatcttgaaggacgagctaaagggaatatgtgggccatcatcgataagtgcaaagagaagctaaatctagcggcgactcacgagcaaaggctagaggatgagtatgccaagatatcagcagaaagcgaagcaagggagagggtaattgattcatggcaccaagaggcaacaatgtggacggaccgatttgctcttactttgaacaggagtcaagaacttccccgattgctagccaaggccaaagcaatggcggacacctactccgcccccgaggagatccacggacttctcagctatt

SEQ ID NO: 105089 - DNA, 624 bp, Glycine max
  Peptide Sequence Number=SeqID_221867
atggagaagataaatcaaaaacatcttacagtctactctaacatttcgttacaagtggctggtgaaaacaaaaaggatagaatccacgacatgggtaatagcttggagcttattagtggagcagatgcaaacacaactacaaatacaaacaaaatcattgtagcaacctttgtcgacacaaatgcaaacataaatgacgagcatgcagttacagatgtaggcacaaatgcaattgcagatgcaagcacaattggagttgacaggcttataagtgagcttaagctgtcaccgccaaaggatgcttatcataaactaaggcttactttgaaagttattaatactcaaatatctgctgctggtgatgttcaagttgtggatccagttgctggaaatccactttacaagatatatagccaggtgatcgaggaacataataaaaagagtgtagagacaacacttgctgaacttggtgtcactctaagtaattcagcttaccgattaaatgttaggcctttgctaaggcatgacatttcgccattggggttggcaaaacaggcacccatcacgttgacaacaggcacggcagcaatgggtttcgctggtgatattagcgaactaggctag

SEQ ID NO: 105090 - DNA, 204 bp, Glycine max
  Peptide Sequence Number=SeqID_221868
atgactactcgaggaaaaggtgttacttctagaaatgttccatcatctgatgatggtcactcatctggtggtggtccatttattgatgatgttatcccgtcacttaatgactcacaacctacaatggagccttcgagtgtagattctcacactaaagttgataggagacttgctttatttgtggaagacattaataatctgtaa

SEQ ID NO: 105091 - DNA, 207 bp, Glycine max
  Peptide Sequence Number=SeqID_221869
atgagagtaaaaagtgtaaatatattaccagtacaaatgataaggcatggccactccttaacacaaagaggaaccgcccctgagcgtaacccttgtgacaaagaccagtgtggcagtgtggataaggctgagtatggttcactccaaaacaagaatctaactacggacatgaatataagctatatagatagagaatccacgccataa

SEQ ID NO: 105092 - DNA, 408 bp, Glycine max
  Peptide Sequence Number=SeqID_221870
atggggacgaggggttgcagcagttacaatcccgttcttgctataaggcaacttggctaccctatgagaggggcaccagtagaggaagaaatcgcgcctaaggttcgtaaggcatgggaggtggtgcaaaagaaggacaaagaactcaggtgcagtaacaatgggcccatcggtggctaccgtaagtggttgagagcccacgtgcaaggtttggattggctctcaagtttgagaaccgctaaaagcaaggaagttgaggcaccggatgaagatgaagaggtgcaggccaacagtcaaagaaaggttcaaatcagcagctctgatgatccaaaaggagaatgtcgaattgagagatataaatacagctaccaccaaagccttggaacaagagaccaagaggggtcgtag

SEQ ID NO: 105093 - DNA, 242 bp, Glycine max
  Peptide Sequence Number=SeqID_221871
ggctttttccggaggagccctggtgcttaccaacatggatggcgaagagctaccttcacccgtgaactctgatgtcgggcaggatcaccttgggctaccttctggagtgaagacaaaatatgaatggcagaaaccagtcaaggtacttaaggatgaacgcaagcggggatggggtcacgaccgaccgatcgttgcccttctctgtgcgaaacaagcatggaatgtcgctgcaaggcagcccc

SEQ ID NO: 105094 - DNA, 237 bp, Glycine max
  Peptide Sequence Number=SeqID_221872
atgggaagtaaggttgtggcagaggactccataccagtggcaacagttggtatgattaggattccaagaccaaagcctattggaaggatctatgagattattcttaaacttcaaaagtgtctcacgctcacttgggatgcacacactctctctgcatgcttacaccatcaagtcaatctcaaggttttccattttttcatcttgaacctttggccactccacaaagtccagccatga

SEQ ID NO: 105095 - DNA, 219 bp, Glycine max
  Peptide Sequence Number=SeqID_221873
atgaatttcgaaatctgccaaattgtgcagcaaaaagctatcaaatttgtgcagcagaattttcaacgtgtgcagaaaatgcttgtgcattactggttatgggaaagatttttctgcctctactctgttttcttggttgagggtagtttcacgatagttggaattgatttgcttggatattatggaagcttggaagggttgatagggacccggtgctga

SEQ ID NO: 105096 - DNA, 302 bp, Glycine max
  Peptide Sequence Number=SeqID_221874
aggggatttatttgaatgaagttgatcgagttctacgtcctggtgggtattggattctatcagggccacccataaactgggagaatcactggaatggttggaagaggactcgtgagagtctcaaagaggaacaggatggaattgagaaagtggcaaaaagcttatgctggaaaaagttggtgcaaaagggtgaccttgcaatatggcagaagcccaccaatcatattcactgcaaaatcacgcgaaaggtctacaagaatagacccttctgtgaggcaaaggatcccgacacagcatggtaa

SEQ ID NO: 105097 - DNA, 687 bp, Glycine max
  Peptide Sequence Number=SeqID_221875
atggatatctgcttgacaccactgccagaggtgaatgacatcagagaagttagtggcggcgaattgccaaagtggccccagagactaaaatcagttccaccaaggattagtagtggaagtttgaagggaattacaggtaagatgtttaaagaaaacaatgagttatggaagaagagagtagcatactacaagaccctggactatcagctagcagagcgtgggagataccgtaatctgcttgatatgaatgcttacttgggaggctttgcagctgcactgattgatgatcctgtgtgggtgatgaacactgttcctgttgaggctgaggtcaacacacttggtgccatatatgaacgtggattgattggaacctatatgaattggtgtgaagccatgtccacttaccctcgaacttatgacttcatacatggtgactcagtttttagcctctaccagaacaggtgtaaagtggaggacattcttcttgagatggatcgaattttgaggccagaaggaagtgtaatcttgcgagatgatgtggatgtgttgttgaaggtgaagagtttcacagatgcaatgcaatgggaatctagaattgcagaccatgaaaaggggccccaccagagagaaaagattttgtttgcagttaagcagtattggactgcaccatctcctgatcaaaaataa

SEQ ID NO: 105098 - DNA, 276 bp, Glycine max
  Peptide Sequence Number=SeqID_221876
atgttattgcctagcgctgttcatgtgtcctccactttcgagtttggagctgtgtttcatgattgcctaagtgcggaccctcaaggcaatcctccattctcccctttttcgaagccccatgaatgttattgcctagcgctgttcatgtgtcctccattatcaagcgtgaagcctctgaagaaaaagagaaggagtagagacgagagtcgtcatcacggaaagggcaggacggacgaaatcagtgtcctatctttgttttcctcttatctccgatga

SEQ ID NO: 105099 - DNA, 474 bp, Glycine max
  Peptide Sequence Number=SeqID_221877
atgacaccttcgaccgaagatgtgaagaaagcaatgcaaggattgtttgctgtactccagctctctatgtggggctggtttcacacctttttctccaagaaggtaggcccgtctatccgctacaaggaaggaagaatcaagattctatcttcatgcgaaggatgtccaaatgttcccttgatgggaacaaggggttgtattaattataatcccgttctcgccataagacagcttggctaccccatgagaggagcgccattagacgaaagcatcacgcctttcatcgcacggggtttcagtgaccacaaacgcgagggtactccaaggagttcgcaaggcatgggatgcggcactgtgagagacgatgaggttaaagcttcggaagacagtgatgaggtacaagccctaaaggcagagcttgaaagagcccgggtagtcgaagagaagttcaagtccatagccatcaaagtctga

SEQ ID NO: 105100 - DNA, 576 bp, Glycine max
  Peptide Sequence Number=SeqID_221878
atgggtgaagtagacgaggtgcaagatcggataaaggccgacttggaggccattaaagagaaaatggccacaatgatggaggccatgatgagcatgaagaagataatggaggtcaatgcaactgcaattgccgctaccagtgccattgctgaggtggacttgactcccccatctagcctcaaccaaataaatcatgccatctcagatatggtagggcagacaggcaaagaattgggaagtacgggcggcccccattttgtgcaagttcaaaacaagaattccttcccaccatatgacttggctcccaactttgcaccacccaatgtggcgcgcactcccgataagaatgtcaataacttcactcccatactcatcgagaaccaaaaacctcaatctgatcatgcatttgtccctcaacacatgggggagacacatgaaataccccaccacaatctagccgacttcaagcctcacctcaaatatgccctccgtttcttccacaaccacaacccttgctttttgtggcaggaggaatccctcttgctatggcagagaagagaaggttggatcatatag

SEQ ID NO: 105101 - DNA, 267 bp, Glycine max
  Peptide Sequence Number=SeqID_221879
atggatttggatttggcacttagaatggaacgacccacttccactccgaaagcctccaatgagcgctttattccagaagcgtttcagggctctatttctgagggtgaaaatgcaaagaaatttattgatgaaattgaaccgtactctaccaaaaatgagaaggcggagacgagtaactttttggctaaactcatctccattaagtataagggaaaaagtaatacaagggagtacataaggaaatttctaacttggcatctaaactga

SEQ ID NO: 105102 - DNA, 369 bp, Glycine max
  Peptide Sequence Number=SeqID_221880
gggcaaacgagcccgttggcgcgcggagatttacatcgtcctcgacacctttttccgtcttgacccactaacattgtttgctgcaccttttgtcgtcctgacccgtgaagtcaatggacatgcggggttaccatatggtgacatgcggggttaccttatggttacccgcacctttggtcaaccaggggcaaatgagcccattgacgcacagagactaacatcgtcttctgcaccttttgtcgtcctaacccgtgaaggttaccttatcgttacccacaccgttcgtcaaccatgggcaaacgagcccattgacgcacagagactaacatcgtcttctgcaccttttgtcgtcctaacccgtgaagtcag

SEQ ID NO: 105103 - DNA, 252 bp, Glycine max
  Peptide Sequence Number=SeqID_221881
atgctccaaccatatgggatcaacataggcttaaaggagcactcaaacccggtgacccccaaggcctacactcagaagagtccgtcagggcctctccttcctgattcagcgattaacgagtctgagatcgccattttaatgagacagttttgggtgtatgcgggaaaagagaggattttgggagaggaagaaggaaaaacgaacatgagaagaagacgaagcgtaaagacgtatcgtcaatctaaaaactga

SEQ ID NO: 105104 - DNA, 1308 bp, Glycine max
  Peptide Sequence Number=SeqID_221882
aacctcgtgagtttaaagaccattgaccttcaagagtctcgagacttgattgagatcccagacttatttatggccaaaaaacttgaaagagtatatcttaatcattgtaaaagcttgtatcagatccatctaaattccaaatctctctatgtacttgacctcttaggttgttcttctctcaaggaattcacggtgacatcagaggaaatgatagatttgatgttatctcacactgctatatgtacattgtcatcaccaattgatcacttattgtctttagaagtgttagacctaagtggaactaatgttgagatcttgcctgcaaacataaaaaacctttcaatgatgagaaagctaaaattagatgatttctgtacgaaactcatgtatctgccggagcttccaccatccctaacagagcttcatttaaataattgtcagagactcatgtctctaccgaagcttccatcatccctgagagagcttcatttaaataattgttggagacttgtgtccttgccgaaacttccaccatccctaagagagcttcacttaaataatttttggagactcatgtctttgccgaagattccaccatccctaagagagcttcatttaaataattgtcggagactggtatccctgccgaagcttccaccaggggtgaaagaggtgagtgccatcaactgcatttctcttaagacagatataactcaacggctagtgttacaacacatgtatcagagtcgcataccctacttaaacaaagaccctacataccgtgaggatgaatacttcttcttccctggagatcatgtcacaaacagcaagtatggatttcatacagaagagagttcaataactattccttatcttccaaaatctcatttatgtggtttcatttattgcatcattcttttggagggatcagtcttaaaagataaccggttttcttgcgctatctatcgagatgatatgctgatcagtttggaccatcgcaggattataggctgcgaaaaattgatttcagatcaccgaatcatcagccaggagtgtgtcgatcaccttcaggaggtgcttctaagccttgttagcggaatgtgtgcgtgtggtaacaagggcataatgacgttgttgagggaccaaacgattaggttgtggtctgatcagaacaacaaccacaagtttgtgagttcaaagattctgctaggttacacgagctttgtaggacctttggagtggattcccccgaacacatcattcctgcaaggacactctggtctttgtctgggacttaaacacgggtga

SEQ ID NO: 105105 - DNA, 378 bp, Glycine max
  Peptide Sequence Number=SeqID_221883
atggcggtgttgacgaggaagcgccgacgcatgatggcggaagccgtggcggcggtgattgcgatcctgtcggaggatctgatgatcaagatccttgttagggttagggttagcaacccctttgcaattgaggtgcgtgtgcaagcagtggaaatctctggtgctggatctccaattcatgaagaagaattttcacacatcattcttggacatcaaggatctcacatccaaagccatggaggacatgaacgtgtttcaattgcaactcaatacgcccctgcattggcagaagaagagaagaagaagtgcattcgatggaccttggaaacgattaaggttgaagttcaagcgatcaaggagagagtgaagtgtctctag

SEQ ID NO: 105106 - DNA, 228 bp, Glycine max
  Peptide Sequence Number=SeqID_221884
atgaaacattctattctctcttccttagctcaagtgaagggacccgaacaagcaagggattcagatgaagcgcaaacgcaacgcgctcaagccaacaagcaaagagcgatagcagctctcccgagagggaatctttctctttctttccttctcccaggcgttattgtattgatggagaggattgagaacgaagtgagaggttatcagacccaagaagcaagggcttga

SEQ ID NO: 105107 - DNA, 354 bp, Glycine max
  Peptide Sequence Number=SeqID_221885
atgggtaaagcagaggaggtgcaagagaaggtgaaggccgatatggaggccatggccacaatgatggaggccatgatgagcatgaaaaagataatggaagtcaatgcggttacaattgccgctactagcactgttgctaaggcaaagatttgggaagtagggacggcccccatgatgtgcaaaatcaaaacaagcacgccttcccgccatatggcctgcctcccaactatacaccaccaaatgtggcgtacactcccaataagaatgtcaataactccactcctatacccattgagagccaacaaccccgaattatcatgcacatgtctcttaaactgtgggggagacacatga

SEQ ID NO: 105108 - DNA, 315 bp, Glycine max
  Peptide Sequence Number=SeqID_221886
atgcctatgttggatcaatttcagccatttatccacgacttcattgataacattgttgatgtccaagctgatagaaactgtgggtatcggttggtttccgatttattaggtatgggtgcagactcttggtcgttggtccgcacctatctgcttatagaacttgacaaattctcagaagactatatcaaactctttggtagcacgaacaaatttaaggaattaaggatgtcactacatgttgatgggttaaccaagaagtcaaccaccgggagattcttcggtgcatcgcataatttgtattggtcacgtctatga

SEQ ID NO: 105109 - DNA, 791 bp, Glycine max
  Peptide Sequence Number=SeqID_221887
accttcagagggccacacgcccttgccttaagaggactacacgtcctcaccataaagggccacaagccctcgccttcgtagggcaacacaccctcacctttagaggacttcatgtcctcgccttcataaggctgcacgccctcgccttcagaggactacgtgtcctcgccttcagaggactacgtgtccttaccttcagaggactacatgtccttaccttcagagggctacacgtcctcagcctcagaggactacacgtcctcagcttcagaggacttcacgtcctaaccttcaaagggctgcatgccctcgccttcaaagaactgcacgtcctcgtctttagagggctgctcgcactcgccttcagaggactgcatgtcctcaccctcagagggctacacgccttcaccttcagaggactacaggtcctcgccgtaagagggctgcacgccctcaccttcagagggctatacgccctcgccttcgtagggctacacgccctcacctatagaggactacacgtcctcgccttcataggactacattctctcacctttagaggactacacgtcctcacctttagagtgctacacgcccttgcctttagaggagagcccgtcctcgccttcgtaggactacacgccctcaccttgagaggactacacatcctcgccatcagagggctacatgccctcgccatcagaggtctgcacgtcctcgccttcgtagggctacacgccctcaactttagaggactgcacgtcctcacctttagagggctacacgccctc

SEQ ID NO: 105110 - DNA, 555 bp, Glycine max
  Peptide Sequence Number=SeqID_221888
attgaggttcatgggaagttttcctatgtttctcaaacagcatggatacagacaggtacaataagggagaatatattgtttggagcagctatggatgctgaaaaatatcaagaaacacttcataggtcttcactattgaaggatcttgagttgtttccccatggtgatctcactgaaataggggagagaggagtcaacctgagtggaggtcagaagcagcgaattcaacttgcacgtgcactatatcagaatgctgatatatatctcttggatgatccattcagtgctgttgatgcacatactgcaacaaatttgtttaatgtaacaaaaacttcttttcttcaggaatacataatggaaggacttgctgggaaaacagtcttgcttgtgactcatcaagttgatttccttccagcatttgattctgttttgttgatgtcagatggggaaatcatagaagctgctccttatcaccatttgttgagctcaagccaagaatttcaggatcttgtgaatgcccacagagagactgctggctctgaccggcttgtagat

SEQ ID NO: 105111 - DNA, 447 bp, Glycine max
  Peptide Sequence Number=SeqID_221889
caaatccttgaggtgggttgtgaagattctgatccgattctgatggcaagcaacgacaactcatggcgatcatcagacattgtggatggtggaggaggagggttagggctttggaatcaagccactgactaccttcctggtctgcacatctcaagggccactgatataaagatggttgctgacaaagtgagtccacacctaccggtttgggatgctaccaaaaagaaagactctaaaaaaacctccacttttggctatgatggaagtgacaatgttgagcaccatgacttcattcaagtgttatgtcctgttacgaagtaccactttgatgatgcttacgtttgctccacaaaggattcgacaactactcatttattcaacctccatgaagctcaacaaaggaggaaggttgaagaagaagatgctactgttgttgctatgaaataa

SEQ ID NO: 105112 - DNA, 258 bp, Glycine max
  Peptide Sequence Number=SeqID_221890
atggtgaatattggagattatattccatattgtcgcaacctacccttcggcgggagggcgaggcgagatgccaaaggagcatcttctcatgaagaaaatgtgtggagtcgccaccaacgtttatttgaggaaaacattagaaaaaccaaaaagaggtctgcgaattttgaaaataagggttcgagagttatttatgcacggggaagattgatattaattgcaaacaaaattcgtttaaggagttggaccttgaaatga

SEQ ID NO: 105113 - DNA, 279 bp, Glycine max
  Peptide Sequence Number=SeqID_221891
atgcggggttaccatatggttacccgcacctttggtcaaccaggggcaaacgagcccgttggcgagcggagactaacatcatcttctgtaccttttggcatcctgacccgtgaagtcaggtgtcatgcggggttaccttatgtgaagtcaggtgacatgcagggttaccttatggttacccgcacctttcgtcaaccaggggaaaacgagtcagttgacacacggagactaacatcgtcttctacaccttttgtcgtcctgaccagtgaagtcaagtga

SEQ ID NO: 105114 - DNA, 1059 bp, Glycine max
  Peptide Sequence Number=SeqID_221892
tctgatttgacgttgaaatgggcacttgcagtcgacaaggaaagtgttgacgacactgtatgcgaaaagtacaacattagcaaggagaaatgggctcaattttgtcagacccgtagagacccttcgtgggaggccatccagaagcaaaacattgcccctcacatgttgtctcgtggggaacaccctagtcgtgtgcatgctattggaaccggtgtcacgatcaagcaatactttggattgactccaaggacctcctacacgtcttcctccatgggtctcgaagacctagagcaactgacacaacaaattagggaccaactagaggagttgatcacagaaaaatcgcagatgcaatcacagggactcgcactgcctcctaagcctaaggttgatccttcagctacttgtgtcagcacaaaagagagttgtgttgatcccttagggaatgatccagacacgagtgactcagaaaaatgcgggttgtacatcgaagaaaatcctccccgcctggatgccttaggaagagtttatgagggatccataattgttcacaacattcctttgttacatgatcaagtcaaggttggtgttgaggaggttagagatgcagatgctcccattcttatacccactgaagagtccgctcgcgctccaactaaatcacagtttccgtcgccatcatcgtccgaaatgacgatggcagcaaccattgcaggttttgttccttcgaggaatgttagggataatgctaatgcgaacaacaacaacactgtgcagactcatcagaagtcttttaagcacaacaattcgaacacctcttctaatggagggcatcatccaccacaaatgtctgggcctcaaggtctgattgctcctgctgggtcccataactataattcgtcgccaaaggagcatcaacccagagctgaatttttgcctaatgatcacctgtcacagcgaaactcttttaggcaccggaatggcaatggtccacatcagcgcaaagacgatcaccaccatcataactatgggggcagacgttttagtgtttatgtacag

SEQ ID NO: 105115 - DNA, 465 bp, Glycine max
  Peptide Sequence Number=SeqID_221893
atgttgtcatacttaacaaatggtcaattactgggaaaagtggttgcatatatgcatactatagagtttcaaaagcgaggactccctcacgtgcatttatttctatttctacatctagataataaatatccatcttcaactgacattgacgagataatatcagtagaaataccttcccatgaagatgacccagaactctacagattggtggaaaatcatatgatacatggcccatgcggaattttacaacccaactctccatgtatgaaagaaggcaaatgcagtcatttttatcctaaacaatttcagcctcagactcttttggattcaaacggttatccagactatcatagaagaaacaatggtcattcaatttcaaagaatggtgttatcattgataacagatatgtagtaccttacaatccaaaattactaaaaaaaatatcaggcacatataaatattga

SEQ ID NO: 105116 - DNA, 1044 bp, Glycine max
  Peptide Sequence Number=SeqID_221894
atggcggcctttatggctgccggtcacgccaaatttaccggtgagctcggcgtctgtctgtcgaccggcggccccggtgccacccatctgctgaccggcctgtatgatgccaaaatggatcacgcgccggtgctggcgattgccggccaggcagaaaccaccgcgcgcggcgccagctatcagcaggagatgaatttagaccgcatcttcgccgatgtggcgaactttgtgcaggaagcggcagccccggcgcaggtccagcatctggtcgatcgcggcgtgcgcattgccaaagcgcagaacggcgtcgcggtgatcatcctgccgaaagatctgcaggatgaaaactggcagccaccgcagcatgcgcacggatttacccattccgggccgggctatcagcggccgaagattgtgccctacgacgaggatttgcgccgtgccgcagaagtgcttaacgctggcaaaaaagtcgcggtgctgatcggtgctggtgcgcgcggtgctgcggttgaagtggtgcagattgccaatgtgctcggcgcgggcgtggccaaagcgctgctgggcaaagacgtgctgccggacgatgcgccttttgtcaccggttcgatcggcctgctcggcaccaaaccgtcgtgggagctgatgcagaattgcgacactttactgatgattggcagcggttttccgtggaccgaatttctgccgccggaaggtaaagtgcgcgcggtacaaatcgatatcgatccggcgatgctggggctgcgctatccgtgcgaggtcaacctgcacggcgacgcggcagagaccctgcgcgcgctgctgccgttactgacgcataaagcggatcgccactggcaggaggcgatcgcggtgcaggtgcgcgactggtgggcgttgatggaacagcgcgccatggcgcccgccaacccggtcaatccgcagcgcgtggtgtgggagatgtccccgcagctgccggacgatgcgattgtcacctcggactcgggctcctgcgccaactggtttgcgcgcgattatcgg

SEQ ID NO: 105117 - DNA, 779 bp, Glycine max
  Peptide Sequence Number=SeqID_221895
atgaagatcggcgtgatcgtgatgctcgccggagccatcgtgctggtgcgcccggagatcaccgtccccgcgatcagcatcttcggcgagaacggcatgggcccggtgttcgccggcccgctcttccccttcctcttcgtcacgatcgcctgtggagcactgtccggattccatgcgctgatcgcctccggcaccacgcccaagctcatcgagaaggagcgtcagacccgcttcatcgggtacggcggcatgctcatggagtcgttcgtcgcgatcatggccctagtcgccgcgatatccatcgaccagggcatctacttcgcgatgaacgccccgacggcagcgacgggaggaaccgtcgagggggccgtcgccttcgtcaactcgctcggcctcaccggcgtgaacctcacccccgagatgctcaccggcaccgcgacgctagtcggcgaggagtccgtcgtgtcccgcaccggcggcgccccgacgctcgcgctgggcctcgcgcacatcatgcagcaggccctcggcgggcaggcgctcatggcgttatggtaccacttcgcgatcatgttagaggcgctgttcatcctcaccgcagtcgatgccggaacccgggtggcccggttcatggtgcaggactcgatcggcgcgtggttcccgaagctccgcgacgtgtcgaggcgccccggggtgtggatctgcacggcgatcatggtggccgggtggggagcgatcctcatcctcggcgtcacagacccgctcggcggcatcaacac

SEQ ID NO: 105118 - DNA, 252 bp, Glycine max
  Peptide Sequence Number=SeqID_221896
atgaacgattacggagtgaaacgaattgaagggaaagtgaagctcacaggacatgagataggagagtcctacgacgcatatgacgaggatgacgatccgtttcttagcttcctcgacgaggtctctcacagccacctggttcggcttcggcggcatgttcatctcaaaattcacagaatcgccgcgcaattcggaaaagcaaaaactcaattcaaatcaatctcagtctcattggaaaggaaattcggttga

SEQ ID NO: 105119 - DNA, 3309 bp, Glycine max
  Peptide Sequence Number=SeqID_221897
atgtcttcaagcaaatgccttattcctcaagacctagaggttctcactgtgacaagctcctcagtttgggtcaacttgccagctgcagcctccttaattattattctccgctatttatcactagattttgaaatgaagagaaaagctgcagcatacaacaataaagcaggctccaccaatgttcagtcttcaaagaagcctgttgaaaatcataaagttattgcaaagtttgagtggagaacaaaagtgaattctcctgttgttgaggatgcaatcgataacttcaccagacatttaatttctgagtgggtgacagatctttggtattctcgcttaacaccagacaaagagggtcccgaggaggatcttattaatctcatttgcacacatttggagctgtttcgtgctgcccactcaaagattgaaaagcaacatacaggttcattaacaatcgaaagtcaagacatggaactaaaaattgttttggctgctgagaacaaattgcatcctgctttattttctgcagaagccgagcataaggttttgcagcatctgatgacaggtcttatgcatgttactttcaagtctgaggatttacagtgttctttctttcgatatactgtcagggagcttcttgcatgtgctgtaatacggcctgtcctaaacttagcaaatccaagatttgttaatgaaagaattgaatctgtggtagttaacaagaccaaggttaacaagggggttcctgcagctcaagaggcatctcacactaaaccagatgagatacaaatctcatctgatgatttctccaagacttcagatccttctgttactggtgttgagcttgtgcagctaaggaatggtccatctaaaaatgcagagccatgtgctaaaaataatgcccgtgataatattactaaagatccgttgctttcaattgatgctcgaccttcccgtacatggaactcattgcctgcaaactcccaagctaatgatgaccaaggccttcaacaacatcgctcaggagagtggggagatattttagatgtcatctctcgcagaaagacccaagctcttgctccagaaaattttgagaatatgtggactaaaggcaaaaattacaagaaaaaggatggtgagaaccagtcaaatgagcatgtttcgcagcatcctgtggtagggaaactgccgaaggtagatcatatgaaagcaatatctggaccaaaagaaagagatagtaattccaagcttattcttccccctaagagacgccacattaattctggacacagcagtcaattctctgtagaaaatacatccattaatgtagacaagaatggatcaacttcagttacctcatacaaagacgatgagtcagttgcctcttttaaagatgatgagcacagccacatttatgggcagatgagtgattcagagagcagtacttcttatacctctgaagataacgaaagtagtacagtcactggtcttgattcccctgtcactaaggtttgggatggaaaaagtaatagaaaccaggctgtttcttatgttcatcacccacttgaaaattttgaccatcacggtgcaaagaaaaagaacaagagccattctcggtatccaagattatccagagcccaatctggcagtcaagggtcttggcctggtggtcataaaacacaaacgtggcaggaagttgagagaacaagctttttatctggagatggtcaagacatacttaattcttcaaaatcacatataaattctgaggagtccagtgatgatggtgatatggaaagtttgggtagactttatagtggagcagctgcctcctcttctgcctactctatttctatatcagattcttgtagtttgtctgttgatcccctgaaaagttcctctgccgtagattccttttacaagttgagatgtgaggtcttaggtgcaaatattgtgaagagtggctcaaaaacctttgctgtttactccatatccgttacagatgtaaataacaacagttggtcgattaaaagaaggtttcgccattttgaggagctacatcgacgcctgaaagagttccctgagtataatcttcatttgccaccaaaacattttctgtcaactggtttagatgtaccagtcattcaagagcggtgtgaattactggataaatatttgaagaactgggatcaccaatattctgttaccagcaggatagatgttggatataagtgtgcaggaaagatattggatatgagtaaactcatgcaactaccaacagtttcggaatcaattgaagtatgggactttctcagtgttgattctcagacgtacatattctcaaattctttttctatcatggaaacattatcagttggcttgaatgccaaaccatttcagaagactaaaaacacttcgaacttctctgcacctgcaagtgatcctgtttcctttcagagagaaaactgcagtgctgaaagtaaagaggctgttttgggagcaagaactaatgttgaggccaatggattgaggtcaaaagtaaacagcacacctctttctctgccaaaaaagagtacacatgaacctagaaagtcatttgacaattctagcagcaatacagacattcaagcacagaagagtgcaccttctcccaataacttgcagaagacagcgaaagaaagagataattcagatcaagtttctgaagtgcaccatgatgcttccgatgcttttccaacagagtgggtgccaccaaatttgagtgtacccattttggatctggttgatgttatcttccaggttcatgatggtggatggattaggcggaaggctttttgggttgctaaacaaatcttacaactaggaatgggtgatgcctttgatgactggttgatagagaaaattcagcttctccgtaagggttcagtggttgcttcaggggtcaagcgagttgagcaaatactctggcctgatggaatattcataaccaagcatccaaatcgacgacctccgtcaccttctagtccatctcagaattctcctcatggcaatcaacctacacaagtgtcttctccaaggttggatgatgagcagaaacaggaggcagatcggcgtgcaaaatttgtatatgagctaatgattgatcatgcaccgccagctattgtaggtcttgttggtcggaaggagtacgagcaatgtgcaagggatttatattttttccttcaggagttaattgatgtccttttggggtttataattccttttgagatcatttctcgagctattcttgctcaagcacatggctttaattag

SEQ ID NO: 105120 - DNA, 123 bp, Glycine max
  Peptide Sequence Number=SeqID_221898
atgtttgattcaggatatggacgtgatcttctgccaatgtggctacctgttcttggagtcccaccatactgcattttctcattagaagaaattgaagatgctacaaacaactttgacccatga

SEQ ID NO: 105121 - DNA, 210 bp, Glycine max
  Peptide Sequence Number=SeqID_221899
atgaagcgaattgcggatgccaaatgcagggaagttaactctgatgaaggatactgggtaatgttaaaagccacttatcaccttgaggacaagatgtttttggaaggcatagggaatgataggaagaatgaaccacaagtgcaaccaggcttaagggaaaggtccacgagaaaggttaccacaccagggtacctcaaggactatgtctaa

SEQ ID NO: 105122 - DNA, 693 bp, Glycine max
  Peptide Sequence Number=SeqID_221900
atggaggttgacggagaaggtggcatcctgaacgcatatggtgactgcctcacaaagaagttagcagtggagttgatgcccattacccaccatgactttgagtggagttgtggcccgagttgggctagatgtatcgaaaatatgtgcaagttgatctgggctggagttggagcaggaaaattaggtgggtcgcattctcgccgcaaagttaattcctcaggtgacaaccttttgatagaaaacgaaggaggtagtttcagaggtgtgggcaataaaggtgaggagtgtgacaaaatggaggaagaaataggcttgaacctcgtgttgaatctctggggccaagccaaaaataaaaaactcaaaagaaatggtggcggaagacctatgattcgattcaccaggtcttcgaactcaaagaggaaagcattgacggaagacatgccaagaagtaagttgaccgttattggtcatccattgaaaccaagtgagggctcgaccttccatgtagaaggaagcaatagtcaggcgtttgtgttctggggtcaagtggtattcgaaaatttgggtgatgttaaagatccaacccaggggattagcaccatcaaaacgcagaacttcgagcttcatggagtaagaaggagaaagggaaacatgagggttataaagttcagtgtttcgttaggggataactga

SEQ ID NO: 105123 - DNA, 1155 bp, Glycine max
  Peptide Sequence Number=SeqID_221901
atggtgatgttccacctatccgaaggaagtgaaaagatggaggccaacaacaacttatatggatcttctaatgcaatagtctccttggacactccgtcctggatgcaacctgtttatcccaacctggaaaaggtgcaacattattgggtaccttttggaactcaacaaactatgtgtccactactagataacgaaggagccgataaacccaaagggagaaagaaatccgaaagtgccatggcatttgaaagtgctcttatcacttcctccaaaagcagtatggacccatctaagggttgtcattctccaaccattgcatgggagaaacacattcatctgtggacaccattacaaatgaggcaactaatatcaaaatgctttgagataggacatgtccaaggttgccaatctataacttggggaagaaaaaatgggttcaaactcaactttgatgtagaggtgccctccagaaagcaaagagtggagcttgtcaaccatctttgtgactggaagactctttttaaaggcaacaaactcatagggaaactggatgtttcttatgctagaaccccttggaatcaaactgttgggtttgatacaacaaaagcttctatttctggattttttggcaaaaatcttgcgaagcacaaagattccatccaattcataaagctcttagacaagaaaaaaaaagcatgggaaaaaggtgtgcaagctaaactagctaaaaagactattgctaaagtcattgaagtgcttgttgatctcaataactcaggtggtttgcaagaaaatgctgaacaagttccttcaccagatgcatccaatgttgccaaggctaatgaactattacacactacaaatcctacacatgtgcccactcagcaggagccttcaaatgaagccacctctgtgcaaaaggatgttcttgatgtagtagtggccatcacacaacaaagtgaagaaatagagaaggagctaagagcttatgctgagcagcaacacattaagaatgagaaatacaagttatctattgttaatcatgtcgtccagccaccgccaccagttcaacaacaaccttgtattcttcttgctcctccacctgaaccaacatctatttccagtcctacatcacttccaccaccatcatcttaa

SEQ ID NO: 105124 - DNA, 696 bp, Glycine max
  Peptide Sequence Number=SeqID_221902
atggcaatttcactgccaatcaactcaaataacggtgatcgagttcctaatttggttttgcgagataaaagcaagatgccaattacaaatatgatgaaaatcatgagtcagattcttctaaataatgtacaagtttcatatgataccatggatatgattcaacaaagtgctacaaagtacataaactttgtaactagaaaagccaaggatcgatgccaaagtgagtgtagaaagattatgaatgcagaggacctattatgggctatagaggaattgggctttaatgactacgttgagcctctcactactttcatccaacgctatcgtaacattgaaggagttgatctcttcactacccataaggagccaatttctcacattgaaaaccatgggcctagtcttgggcctgagcctaaccttatgtccactttggagatgcttcatcctccacaaccaccacaagttaattcttctcagccaaaattttccatcatcccaaacacaaatctggaaatgctttacccaaatgaaatgagttctaccaaaatacatttggtgttggttgttcaaatgatgttttcaacaacattgatgtttctactttcttcaatcatgatcaacattgagatgataatagaagaaattcaactgcaattaacaattatggcaatggactatgatataggcaataagtag

SEQ ID NO: 105125 - DNA, 1353 bp, Glycine max
  Peptide Sequence Number=SeqID_221903
atggaacagatgaaggagagatttgctaaactgctattgggtgaggacatgtctggtggaggaaagggtgtttcttcagctttggcattgtcaaatgcattcacaaaccttgcagctgctgttttcggtgaacaaaagcgcctagagccaatgccaccagaaaggaaagcaagatggagaaaagaaatcgattggcttctatcggtcactgattacattgttgaaatggttcctgtgcaacaaaaaaacaaggatggctcaaccatggaggttatgacaacgcgacaaagaactgacctccacatgaatatccctgccttacgaaagcttgacacaatgcttattgatactctagataacttcaaagaccaaaatgagttctattatgtatcaaaagatgcagaggattcagatagaaataatgataccaagtggtggttgcctacacctaaggttcccgcaaacggtttatctgatgcagcaagaaggtttgttcagtatcagaaagattgtgtgaaccaagttcttaaagcagctatggccataaatgctcaaactctatcagaaatggagatccctgaaagctatattgaatccctacccaagaatggaagatcaagtcttggggacttgatctacaggagcattacagatgattttttcgatcctgatcagctcctatcagccatggacatgtcatcagaacataaaatcgtagatctcaaggacagaattgaggcatccattgtgatttggagacggaagatgaaccaaaaagatagcagcaaatcagcttggggttctgctgtgagtatggagaaaagagaaatctttgaagacagggccgaaaccatcttacttctcctaaagcatcgttttcccgggactccccaatctgcattggatataagtaaaatccaattcaatcgggatgtggggcacgctgttcttgaaagctattcaagaatattggaaagtttggctttcacagtgctgtcaagaatagaagatgtactccttgcagatcagcaaactcaaaatccatcacactcaggaacaaagagcagcatttcgagaaacccggttccgaagccagagaagtctccaactccaactcctaaagaagaggtagacaagagtggctcagaagcaatgacactatcagatttcatgggttggaacaatgatcaaggtgactcagacgctaagaaagaccattttgcagattcagatgacttcgacaaaaacattgataatggaaagcctcaaaaacttccaaacgtagtgacagacaagaaggtgtcctaccttgagacattgggaggtatgaggagtccaacatcacgccattaa

SEQ ID NO: 105126 - DNA, 2436 bp, Glycine max
  Peptide Sequence Number=SeqID_221904
atgggagtcaacatgtccaacacgccacctcacaccaaagacttgttttcctctccagttctctctcttagcttagctgggattttccggtatgctggggaggcggcggagacgtccggcatggagatggccagcgatgaggtccggcaagaggatactgctgatattagcagcgacaactcaggacccgtgagatccaggtcagaagaagattttgattgtgatgatgttcatgatggtgatgacaaagataacgatgataagaatagaaagaagaagagaaagtatcacaggcacaccactgaacagataagagaaatggaagcgcttttcaaggaatcaccgcatcctgatgaaaagcagaggcaaaaactcagccagcaacttggccttgctccaaggcaagtcaagttttggttccaaaatcgtcgaacccaaatcaaggcactacaagagcgccatgaaaactcattgttgaagacagaattagacaaacttagggaggaaactaaggccatgcgagaaaccataaacaaatcttgttgccccaattgtggcatggtaacggctaccatagatgcttccatgtccactgaagaaaaacaacttcttattgaaaatgccaaactcaaagctgaggtagagaagctccgaacagctttagggaaattctcaccaaggacaacgtctcctactacatcttctgctggccatgatgaagaagagaatagaaactctttgggtttttacagtgtacttttcgggctcgacaaatcaaggataatggatgtagcaaaccgagcaacggaggagctcataaagatggcaactatgggggaaccattatgggttcgtagcgttgaaacaggtcgcgaaatacttaactacgatgaatatgtgaaggagatggcagctgaaaattcgggcagtgaaaggccaaagacattcatcgaagcctcaagagaaactgaggttgtttttatggatcttcctcggcttctccaaagttttctagacgtgaatcaatggaaggaaatgtttccgtgcttaatatcaaaggctgtaactgttgatgttataagcaatggcgaaggttctaacaggaatggtgcagtgcaattggggaatatgtttgctgagcttcaaatgctcactcctatggtgcccacccgagaagtgtattttgtgaggtgctgcaaacagttgagtgatgaacagtgggcaatagttgatgtctccatagacaaagtagaagacaacattgatgcatcccttgtgaaatgtagaaaacgcccgtctgggtgtattattgaggataagtcaaatggccattgcaaggtgatatgggtggagcacttggagtgccaaaagagcacaattcatacaatgtaccgaactattgtcaacagtggtctagcttttggggcaaggcattggatagcaacactacaacttcattgtgaacgtttggttttctacatggcaacgaatgttcccatgaaggattcaactggtgttgccacgttggctgggaggaagagcattttgaagttggcacaaaggatgacgtggagtttctgccatgcaattggtgcatcaagttttcatacatggaccatggtcacaagtaaaacaggagaagacataaggattagctctaggaagaacttgaatgacccaggtgaacctcttggggttatcttgtctgccgtttcttctgtgtggcttcctgtctctactaacgtgctgttcgatttcttgagggatgaagctcgtcgaagtgagggtattcttgggcccaagttcaaggatttttttcagttaatgctattactagagttagaggcatcttggaagataccatttaaagttgctgagttccacaaaagtggatccaccaccttgtgtcttctacagatacatatctatagcagcagctatttaggcagtttgtgggatatcatgtccagtggtgggtcagttcagtccgttgcaaatttagctaaaggaaaagaccgaggcaacgttgtaaacattcaacgagagaagatcaagaaaatacaatcaaaagataacagtgtgtggatcttgcaagatagctgcacaagtgcttatgagtcaatggtggtatatgctcctgtggaatttgctggtatacaaagtgtgcttacaggatgtgattcaagtaatcttgctatattgccgtcaggattctcaattctacctgatgggattgagggaaggccattggtgatttcgtcaaggcaagaagaaaaatacactgaaggaggctctttgtttacaatggcattccagattcttgtcaacccttctccaacagtcaagttaacaacggagtctgtggaatcggtcaataatcttgtgtcttgtacattgagaaatattaaaacaagtttgcagtgtgaagatggttag

SEQ ID NO: 105127 - DNA, 378 bp, Glycine max
  Peptide Sequence Number=SeqID_221905
atggcttccattgttgcaagcttgccgccaccattgctgctccctgctagaaaatatcatccgggcaacttcccaagttcccctttttctcttctttcagggagacggaatcatgtttcttttgttgtgaaggcttctggagaaagttctgaatcttcaactacccttactgtttttaagtctgttcagaatgttgtgagtttttcctcccactcccacccttgtctttctttcaaagagacacaaaagtgggatcaacctgaggaccgtctgggacttattggtttgggatttgcagccatagcagcattttgggcatcaacaaatttgattgcggtaatctttgccactttcagtgttttggaaatgaatacgtga

SEQ ID NO: 105128 - DNA, 483 bp, Glycine max
  Peptide Sequence Number=SeqID_221906
atgacatcaaggattgttgaggtcaaggagattatgggctataatatgggattttttcctttttgctatcttggtgttcgaattttccaaggttgtcctaagaaggaacacttccaaccgattgttgataagattatgcttaagttagcaaagtggaaaggtgccttgttgtccatcataggtcatatggaacttattgttgagtctattattcaaggtgacatttactcgaggaagttggtcactgttgtgtgggccacagttggttctgatcgacttgcaacatgtggcagtatcttcagggactctcgtggaagtatattaggttgcttctcactaaacctacatgttagtaggactttatgtgctaaatgcattggtgctaggaacaccattgagattgcacatagacgtggctggaataagttatggcttaaatgtgactcaagccttgttgagttgatgatgctttcaagtttgtag

SEQ ID NO: 105129 - DNA, 273 bp, Glycine max
  Peptide Sequence Number=SeqID_221907
atggaaggaggaggaaccaactgtgtgacagagacaactcacaatggatctccttcgcctccaagtctcttaagtttaggagtaatggatatcattggtctccaagacaagtactcagagagagttttggagaagccattccctctcccatggaagtgctggtcgagacatagaaggaggaatgaggagtttgctcaccatcttgctagaatcaagctttctactccatcacctcttttcttcattctctctttgagagactcatcttggtaa

SEQ ID NO: 105130 - DNA, 552 bp, Glycine max
  Peptide Sequence Number=SeqID_221908
atggagtttcatcaaacagatcaggtcataagacaatttggctattgccaaactattccacctagcccattaaatctggatcaacttaacaaagaagatatgagaggaagaacagacagattgatcccaatatcaccaaagtctacttatcaacaacatgacttctacaggaataggcccaatcgtgatcaacaaacttttcaaccaatagggttctcaacatatacctctcaattctcatttcatcaagttccttatacttctggtatttttgctagccaatcaaatatgtttgtcacttattccatgacaccaccgtttgcatacaactcaacaccgtcaatgaattgttatcgtcccacaatgcttactcagacgagaaacaatgctgatgacaatgacgataacaacaatgatggtagaagttttggtgtttgtgaggactatgattctcaaaatgatgatgatgatgatgattgtgatgatggtgttcatcacgcacatgtgtccttttcacatcgccaaataagtagacatggtgatactatatga

SEQ ID NO: 105131 - DNA, 162 bp, Glycine max
  Peptide Sequence Number=SeqID_221909
atgaaaaaccctgctgctgcatttcgatggatcaggaaaatcactactgtttggagggcaacgactctatggggggctaagcatagaggtcttggcagaggagggttcagaaatggagatgaagggacttgggctgtgttgtgcagaaaaagaagagaataa

SEQ ID NO: 105132 - DNA, 525 bp, Glycine max
  Peptide Sequence Number=SeqID_221910
atggtagatgctaaggtaatgaggatcttttttattctgtatggagggagtatgaggttgttcatcttcaggaagagattttgtggttgcaaaaatctcattctaagtgaattgattctcttaagtgataggaattccagttgttttcatggttccactattatcataaggagaagaagtaaagtagatacttttaagtttgaagatgggagttggatctctaaccttgatgagatgaagagtagagtgattgaggaattgtttgttgatgaccatgcttatcaagagcttgtggttaaaggcatgtaccctacacttgatgctacttctttggaggcactaggagctaatatatcctctcaagaatttcaaagcatttgcataggtgctttcaaagctctagggccgaatgggtttcaagttgtatactatcaaaaccaatgggatgctattgaagaggcaaaattggtgcaaaatgtgtttagagtttgtagaagcaagcttcatgatgatgaatcaagttga

SEQ ID NO: 105133 - DNA, 393 bp, Glycine max
  Peptide Sequence Number=SeqID_221911
atggggatcgcacccacaaagacacccagtggacctaaagaagtccaacaggccctggggtttccagctcttgttacgggcctctgtcggccctacagggcgcccgttccccccagcaagttcatgtcgtcgtggcatagggatcgcgcccgcaagacacccagtggacccggagaagtccaacagggtcttggggtttctagctctgattacggacctttttcggttctacggagtgcctgtcgcccccagcaaggtcatcagagcgttgcctacgacacatggccgaccagcaggctaccaagtccaaagccaaagataagcaaaagtactaggtccgtgacaaacaagtcatcaggcatccagctcaagacgttaaagaagcgctactag

SEQ ID NO: 105134 - DNA, 174 bp, Glycine max
  Peptide Sequence Number=SeqID_221912
atgtcggccttcatcttctcttgtacctcctccactttacccattactctagctctagcacgggttcgaaatgggtttatgatcctgtcataccctaatttcgtccggggacctttgctcgatgacgtgcgaccattcttcggtcctcgtgaggtgcttggcacccatcattag

SEQ ID NO: 105135 - DNA, 981 bp, Glycine max
  Peptide Sequence Number=SeqID_221913
atggttgtgatttttgcatacccattagagagtgtttttcaaatgtggattggttcaccgttggatcgggctgatttttggacagcagcttcagttcgtataccaaatgccaaaccttgttggcggcggtctttgcggcatgtaattgtggcttctctttcttcattcttgtatggataccatattggagtagtcaatgaaaccttagagagcatttctatagatcttggctttagtgggaataccatggctgagggtcttgtagtaagtatatgcttaggaggtgcttttgttggatctctgttcagtggatggattgcagatggtgttgggcgtagaagaagtttccagttgtgtgctttgcctatgataattggggctggaatgagtgcaacagcaaaaactctttggggcatgcttttgggacggttatttgttggtactggaatgggacttggtccacctgttgcagctctttatgtggctgaggtctcacctccagcggtacgaggtgcttttggggccttaacgcaaattgcaacatgtcttggactcatgggttctctctttattggaattccagccaaggatatagttggttggtggcggatttgtttctgggtatctgtcattcctgctacaatgcttgccctttttatggagatctgtgcagagagtcctcattggcttttcaagagaggaagaaccattgaagctgaagcttcatttgagaagctcttgggaggagtacatgtgaaacctgcaatgaatgaactttcaaagtctgacagaggcgatggatctgattcagtaaaactttcagaattaatctgtggccgctatttcagagggtcagtagttgcaatgattctgatggataaacttggaaggaaagtgctgctcctgggtagctttctgggcatggtaggaaagaaaaatgaaaattcgtacattgctgaatcaacctcttttaaactctaa

SEQ ID NO: 105136 - DNA, 684 bp, Glycine max
  Peptide Sequence Number=SeqID_221914
atggtttatagtagaaatagaaaacagaaaggggaaatcgggcctttgaagtcaggtggtggtataggaagggaaaataacatagtgaccagaaaggagaattgggccaactctgaagatccagttgcatcaaaagagaatggatcacctattttaaaggtgggaatgggcttaaagaggtggcctcgtgggacagaaataacagaaaaaaggatgctggaagcaacaaacacttggactatagcaaaagacatgggggtccgttatgaagcagaggaaggaaaaatggtgtccaagattgctatcttagaaggaaaaaacagaggagcagtggaaagaggtttgggagggggggttaagtggagttctgtgcacaggattgtggtaaaggaccaggaggatttgttatgtattcaggaaactaagcgagatagggtggataagtgggcatgtcaagcattgtgggaggattcagagatatgctgggcagagagtccagcaatcaataatgctggaggtatgttgtgtttgtggaacgagtcaactttctctgttgaaaggaagatcattggtactggattcgttgtattggactcccaaactggaatagtgatggtaatagcatggcagaatgtacagaaaacagtacatccggtactgttaacaattattattcattattaa

SEQ ID NO: 105137 - DNA, 189 bp, Glycine max
  Peptide Sequence Number=SeqID_221915
atgggatttccgatgagtatctgttggagtctctggttgggaggagaagagagaagacgacaagagtcaaagaagatgaatagggtgaggcggtggggccaagggtggattgggggatggattgtgaaggaggaagggaggaaggcgatggtggggacactattggtggcgctaggtagcattgggtga

SEQ ID NO: 105138 - DNA, 300 bp, Glycine max
  Peptide Sequence Number=SeqID_221916
atggacaggaaacccaaatcctcctcctcgatcgtcgccatcgccaccaggttgattgttccctttgatttgctcgcgaaggatttgaagaaggacgcgaagaaagtggcgaggttctccatgctgcagaataagctgttcagaaagggcgcttctgagaagaaggagaaggtgaagaccttaaccaaggtgaagaacaacaccgggacattggccatggtgctcaggagcaagagggagcttctcagcatcaacaaagagctgagcaacaagtttctcagctcaagcattccacactcg

SEQ ID NO: 105139 - DNA, 522 bp, Glycine max
  Peptide Sequence Number=SeqID_221917
atggcgagtgaggatgatgcagtgaagaaggcaatgatagtagatgctcgtgcaagaaacattagtcataatgtgaggtgcacggagtgtgggagtcaatccattgaggattctcaagcagacattgccattttgctcaggaagttaattcgtgatgaaattcaatctggaaagactgacaaggacatctacaaaaagcttgaggacgaatttggagagactgtactctatacgcccaagtttgatatgcagacagcagctttgtggttattaccgtttaaatttgtgctgattccagaaatatgttctttgaaacagctcttaattgcaggttcagctgcaggagtatgggcttacaacaggcataaacaaaagactaatgtccacatcatggctttgaaccttgttagaggtgttccattgaccccaaaagagaaggaaacaatgcttgatattcttacaccacctcgttcccagggagttaggacacccttctggtggaggagatggctaggtcaatga

SEQ ID NO: 105140 - DNA, 1131 bp, Glycine max
  Peptide Sequence Number=SeqID_221918
atgcaaagcatagccaataaaagctcttctcagttttttcatcttccacttgttctcaacaagtcttctgagaaaagcagagatgaccattcgcagaatgggggaattcatacagataaaattttgttggataattttggaagattaagtgaagatccagcactgattttgtacactagtgggactacaggtaaacctaagggagttgttcatacacacaaaagcatcatttcccaggttgagtttttgccaaaatttagtgtgagaggagtttggcagagatggcgtgagtcatatccaactgatggttctaaggctgaagatgctataactgtgttcactggagttccaactatctatgcccgattgatacaaggttatcatgcaatggatcctgagctacaagctgcttcagtatctgctgcaaagaacttgcgtcttatgatgtgtgggtcctctgcacttccactacctgttatgcaagaatgggaagccatcactgggcatcgcttattggaacgatatggcatgactgaatttgttatggcattgtcgaatccattaaaaggtgagcgcaaacctggaactgttggcaaaccatttcccggtatacaggtcaagattattacagatgaagagagtgtgaatgaaaatactggaatgggtgagctttgctttaaaagcccttcgttgtttaaagaatattggaaacttcctgaggcaacaaaggaatcatttactgatgatggattcttcaagactggagatgcagttactacagatgaagatggatatttcatcattctaggacgtaataatgctgatataatcaaggctggtggatataagctttctgcattagaaattgaatcagttataatagaggcaagcctaccagacaaagactatggagagattgttggtgcaatcgttgtgccacaggctgatgttaaactgaaacgagatcaagaatcaaagcctgttctaagcctagaagaattatccacctgggccaaagacaaaattgcaccttacaagattccaactcaactaatcgtgtgggataaactccctcgcaatgccatggggaaggtaaataaaaaagagctgaagaagctgcttaccatttga

SEQ ID NO: 105141 - DNA, 441 bp, Glycine max
  Peptide Sequence Number=SeqID_221919
atgcttgagctgagaaacttgttgctcagctctttgttgatgctgagaagctccctcttgctcctgagcaccatggccaatgtcccggtgttgttcttcaccttggttaaggtcttcaccttctccttcttctcagaagcgccctttctgaacagcttattctgcagcatggagaacctcgccactttcttcgcgtccttcttcaaatccttcgcgagcaaatcaaagggaacaatcaacctggtggcgatggcgacgatcgaggaggaggatttgggtttcctgtccatgaacttcttgaccatggtggtgaaggtggggtcccccttggctgtgtttgagggtttgacctcgatgaaagctcgagaagaagaacaagaagaagaggttttgattttgaggctgttgaattcatgggaggaagaagggttggagaaatga

SEQ ID NO: 105142 - DNA, 258 bp, Glycine max
  Peptide Sequence Number=SeqID_221920
atgttagaattttcattccacttcttgtcccctttctttatcacttcatatgctttggtttgttttttgggcaatgcaaattcagagctggtggtgacgacctttgaccaccaattgggccctcaatctatctctgcaaacaaggagaaagtgaacaacgtggaacccatccgcaaaggtatgatggttgagtggtgcggcgtgggttgcaaattttttgagttgcatgatcttgtgttgaatatccgcgagaactga

SEQ ID NO: 105143 - DNA, 189 bp, Glycine max
  Peptide Sequence Number=SeqID_221921
atgagcccaaagttcatagagttcaaactaagtcaatctaaaccattgtacataacagtgatcttagtggtgtttaacagaattcagaagagaaaaggcagaaaggaatctgaaaagaaagtaccaggaaagagatggcagaacctaacccaacagctaggaatcgaccaagacaagaatcagcaatga

SEQ ID NO: 105144 - DNA, 1485 bp, Glycine max
  Peptide Sequence Number=SeqID_221922
atggcactcttgtgtctaacagcgatgatcccacagtctcggcctcctccttgcaaccctgcaactgaaagatgtaaaccagcaacagctggccaaatggcaatgttaatctcttcctttgctctcatgtcgattggaaatggtggcctttcatgctccatcgcatttggcgcagaccaggtgaataaaaaagataaccccaacaaccagagggccttagaaacatttttcagctggtattatgcttctacagctttttctgtcataattgccctcacagtcatagtatatatccaagatcattttggatggaaagtaggttttggagttccagcagcacttatgttcatgtccactttcttcttctttcttgcttctccgctttatgtaaagaataaaatacaaggcagcttaatcactggcttagcacaagtaattgtcgtggcctataagaaccggaagcttcctttaccacctaggaactcagctgaaatgtaccatcataggaaggactctgatcttgttgttcctactgacaaactaaggtttctgaataaagcttgcatcatcaaagatatagcctctgatggatcagcttcaaatccgtggagtctctgcacaatagatcaagtggaagaactaaaagctattattaaagttattccactgtggtctacagggatcatgatgtcagttaacattggaggctcgtttggaatactgcaagctaaatccctcaacagacatatcacttcacactttgaaattccagcaggttctttttctgtagtaatcgtatttatggtattcatatgggtggctctttatgatcgtgtcattattcctatagcatcaaagctcagaggcaaaccagttaggatcagtgccaagagaagaatgggaattgggttggttttctcttttctccacttggcaactgcagctattgtggagaatacaaggcgaaggagagcaatcagggagggacatattgatgacacaaatgcagtgttgaatatgtctgcaatgtggcttgttcctcaactttgcttgtcaggcatggctgaagcattcaatgctataggccaaaatgagttttattacactgagtttccaagaactatgtcaagtattgctgcttgcctttttggacttggaatggctgcaggaaatgtgttatctagtttgatattcagcatcgtggaaaatgttacttcaaggggaggaaagcaaggatgggttttagataatattaacaagggtagttatgacagttgggcttatgtacccacagttgatcaactatccaatgtttctgacgaaaataattcaaatgagaaagtattaattcaattgggcaatatgagccaggtattcaagattagtgaaaacaatgactcaaaggaggaaaagttaactgaactacaggttcacaataaaaaggaaaaaggaaggatttgtgcagaagacccgatgattgcctag

SEQ ID NO: 105145 - DNA, 1764 bp, Glycine max
  Peptide Sequence Number=SeqID_221923
atggagatggaagtagaactttcttcagctcaacccaaaatgggttctcagcttatttcccaaccccaaaggtgtggtaagggtggcctcgttaccatgccttttatcatagcgaatgaagcacttgcgagggtggcaactttggggcttctacccaatatgatattgtatttgatgggaaactacaatcttcatttaggcaaagctaccaagatactcctcttatcagttgccaccaccaatttcatgcctcttcccggtgccttcatttctgattcttatctgggtcgctttctcgctgttggtttaggttccttcattactttcctgggaatggcactgttgtggctaacagccatgatcccacaggcacggcctccggcttgcaattctcaaagtgaaagatgtgaatcagcaacacctgggcaaatggcaatgttaatctcttcccttgctctcatgtccattggaaatggtggcctttcatgttccctggcctttggtgctgaccaggtgaatagaaaaggtaaccccaataatcaaagggccttggagatgttcttcagctggtactatgcttcgtcagcgatatcagtcataattgccttcactggaattgtatatatccaagatcatcttggatggaaattgggttttggagttccagcagcacttatgttcttgtccacttttttcttctttttggcttctccactttatgtaaagaataaaacacacagcaacttgctcactggctttgcacgtgtgattgttgtagcctataagaacaggaaacttcgattaccacataagatctcagatggaatgtatcatcgtaacaaggactctgatctagttgttccatctgataaactaaggtttctgaataaagcttgcttcattaaagactcagaaaaagatataacctctgatgggtcagcttcaaatccgtggagtctctgtacagttgatcaagtagaagaactaaaagctattattaaagttattcccatgtggtctacggggatcttgatgtatcttaacattggaggctcttttggattgctgcaagctaaatcccttaaccgacatatcactccaaatttcgaagttccagctggttctatgagcgtaatcatgatatttacaatatttatttggatagctctttatgatcgtctcattattcctctagcatcgaagatcagaggcaaaccagttaggatcagtgccaagagaagaatgggacttgggttgcttttctcttttctgcacttggtaactgctgcaatggttgagactataaggcgaaggagagcaattagtgagggacatgttaacgacacacatgcagtgttgaatatgtctgcaatgtggctcttccctcaactttgcttgggtggcatagctgaagcattcaatgcaataggccaaaatgagttctattacaccgagtttcctaagactatgtcgagcattgcttcttccctttttggactaggaatggctgtaggatacgtgttatcttctttggtattcagtgttgtggaaaaggttacttcaagagggggaaaagatggatgggtttcagataacattaacaagggtcgtttcgacaagtactactggcttcttgccacactcagtgctgttaatgtactgtattatctagtatgcagttggatttatggaccaactgctgatcaagaatcaaaggtaactgaagaaaatggttccaatgaggaagaattgccattaatttaa

SEQ ID NO: 105146 - DNA, 246 bp, Glycine max
  Peptide Sequence Number=SeqID_221924
atggcagaggattggaaccgcacggctcttcttgtgatcgatatgcagaaagattttatagaagattggagtcctgtggcactaaaaggagggaaagacattgtcccaaatgtgattaaggccgtggaagttgccaggcagcgtggcattctcatagtttgggtaatatctaataacactctttctctgtcatgccttatctatggactttttctgagtaacttcatgccaacacttatgtgctaa

SEQ ID NO: 105147 - DNA, 294 bp, Glycine max
  Peptide Sequence Number=SeqID_221925
atgagggataaggatacgaaaattgaagctacattaagcaaaaaggcaacaaaaagtgaaggaaaagaagaaaatctgaagcaggctcagcccaatacgcatgctcagcgcgcgtcatgcgctaagcgcacctacgaaggcccaaagcccacttcagtaactataaacagagagcaagtccaagggaagcagacaccaccacagaaccctcctctcctaggggtttcatttactccctttcttccaccccttttcattctcattgtaaagccctcaatggccatgagtggttaa

SEQ ID NO: 105148 - DNA, 1297 bp, Glycine max
  Peptide Sequence Number=SeqID_221926
atggctaatccagagtgtaaatttttacattctagattagggtgcaagaagcaagtccagaggaacttgaaagatctatgtcttcacggaacactagcacttgaaattgggaagctggttcacattaaatcaatcattttgcgcaacaattatttctacggagacatccctaaggaaatactacaattagaggacctggaagttcttgacttaggatataacaactttagtggacaatttccatttcatgaccttgcaacctatccatccctgactacccttttattggacaacaatgaccatcttgccagcttaactccagaagtgtatgagctcaagacattttctgaattgcatgtagctgaagaacaactaactggtgccaccactagagaagcatgtgttaggataactaataactggcacattggcacacatggggatatagcatccagaagggcacttctccaagaagcaaatggtgaaaagaggggtgatgatgacacagaaactctttcaccatcaccttttccctctacactatcaccattttctgagcctttctcaccatcagagagtccctcagattcaccaatatcatctcctgaagtttccccttcaccatccccatctctctccaatttctttttcactctctcaccctcaccttcacctgaggtagcaccaactccagacttgtcacctccagcaaatccacctatggttgtgtccacaccaccacagtccaattgggtttcaatgccttctcctgcttcatcttcaaaccaagggaatgcaaacagttcaaatccaaagcaacataccgcgattatttggtccacagttgggggattctccttcttgattttggtttcagccattgcttttgtttgcttcagaagtaacaaggttgtaactgtaaaaccttggaccacagggctgagtggccagctgcagaaggcatttgtatcaggtgttccgagtctgaaacgaacagaacttgaagtagcttgtgaagatttcagcaacattattggctcacttcctgaggggactatttataaggggactctctccagcggagttgagatcggtgtagcatcctctgcagtgacttcatcccaaaactggtccaaaaacatggaaactcagtttcggaagaagatagagatgttgtcaagagtgaaccacaagaattttgtaaatcttattggatattgtgaagagaataagccattcacaaggatgatggtttttgagtatgctccaaatggaaccctatttgagcatctacaca

SEQ ID NO: 105149 - DNA, 4902 bp, Glycine max
  Peptide Sequence Number=SeqID_221927
cgacccaattggccaaagcctttgtcactgcgctcaaaatctgctcttgctgttgctggagctgaccctttggaaatggcagaggattggaaccgcacagcccttcttgtgatcgacatgcagaaagattttatagaagatgggagacccatgctagtaaaaggaggcaaatacattgtcccaaatgttattaaggctgtggatgttgctaggcagcgtggaattctcatagtttgggtagtacgggaacatgatcccttaggaacagatgttgagctctttcgtcggcatcattatgcagcagggaaagttggtccaacttctaaaggaagtgaagtccttcaaggagcagaaattaatagtctggtggtcactggtgttcaaactccgaactgcattaggcaaactgtgtgtgatgccgtagcattggactatcagccggtaactgttattgttgatgctacagcagcagccacacctgatattcatctcgtggtgtactggtgttcaattccaagactcaagaaaggtgctgacgtctttgacagcatagcattgcagaagcgcttcttacaatatataagggctaccaagggacaagttcctgacaacaataacaagaaaatacacaaatccagggaatatcctaacagaatgatattcccttattcaccactacaaaggcactaccaaaaagatacaaatcctactacactcttcataccccttacttcctgcagtcccattgatacagaggaacagaccattgcagttcaagctcaagatgcaggaccaattgcagaaccaatttcacagactcgagaacaagaagagaatgcagaagcaacagatcagcaggtgtatcaagtggtgctttcattgcctcccatgtccgatcaaccacccctttcttcgactaagctcgaggagatcctcgttgctcttaccacacagcaattgaccctctcccataaaattgatgaccttatccagcatatatcccctgttcttcacccccaaccatctatcacctcctccattcctcgcctataccccatacctgcacaacaacacagaatgaaattagagatcccccgttttgacggcgttgatccaattggttggatcttcaaggtgaatcaattctttgattactatggcacccctgagcatgagcgattacagatcgctgcgttttacatggagggccgcgccctctcttggtttcaattgatgtccgccaacgcacagttcacgtcgtggccggcgttcatccaggcgctgcaaacgcgattcgcgccctctcagtatgaggacccaattggaaccctgtgtaaattaatgcagaaaggcacagtggctgcgtacctgtcggaattcgaggacattgcgaaccgtattgtcgcccaccagcccctcaccctcacccaagccgctggcctcgccaaactccaagaggaaaaactcctcgactcccgcccctctccacctcctccccgaccatgcccaccatccacatccttctttcccaccatacctctccgtaacaccaactctctatccctaccctcttccctgccttcctcctccccgcatcaaccaaacccagcaccctccccgcttccttcgcctatccttcgtccccaaccacctcctccatttaaacggctcacttccgaggaaattgcatcccgccgtgaaagggggctttgcttcagttgcgatgagaaataccatcgaggacaccggtgtgcctctagggtattcctcttgctcgctgaagacggcgacaccttcccttcccctgaatcccctcttataagccatccggaccctgaccctgacccgacacttgacccggcccatcatccggacccatacccgacccatgaccctgacccatacccggcccagttaagtttgaactcaatggcaggacatctcgcgctagagacgctccgtttcattgccaccatctccggcaatgaagtcgtgcttctcgtggatggcgggagcacgcataattttatccaaaggcagctcgtggatcatttgggccttccttctcggccgacaacccccctgcatgtcatggttggcaatggccaacaactggactgtgacaccatctgcgaggccattccaatcatcatccagacccatgaatttcacgtggacctttatgttcttcctatttccggtgctaatgtggtattgggggttcaatgggagacatggatgcttcccttacatccctttcgtcctttcgtcctttcgtcctttcgtcgtctcacccgtaaactcgctactcccatgtactatcatattaccttattagcagaccacaattcgaccactcaaatgattcctcctgccatacagactcttcttgataaattcgcaaccctatttcagccacctcaatcccttccgccaccgcgaaacactgatcatcatatccatttattaccccaggcagctcccgttaatgtcaggccctaccgttacccccattaccagaagaaggaaatcgaagagcaagttgattcgatgctacaaaaggggctcatccaaccaagcaccagccccttttcttctccagtgcttctagttaagaaacaagacggatcatggcgtttctgtgtggactaccgcgcattgaatgccttgacggtgcgtgacaggttccccattcccaccattgatgaactcttggacgaattgggtggagcgtgctatttctcgaagcttgatcttctgcaggggtaccaccaaatccgaatgcactccgatgacataccaaagacggcattcagaactcatcacgggcattacgagttcaaggtgatgtcgtttggactctgtaatgccccttcatcgtttcaagctacgatgaaccagatattccaaccatatcttcgccgtttcatcatcgtcttcttcgacgatattctaatctacagtcgctctatggatgatcacctccggcacttggacattacctttcaggtattgtttgtgaatcaatttgttctcaaactttctaaatgttattttgctcagcctcaggtggaataccttggccatttagtctcgcataagggtgttgaacctctgccttccaagatctctgctattcagcaatggcctactcctcacacaactaaggcagttcgaagttttctgggtttggctgggttctacaggagatttatacaagggtatgctacccttgcagcacccctggtcaaagcaacgaccctcgacccttttcaatggacacctgaagcacaacttgcttttgagaagttaaagcttgcactatcgtcggcaccggtgttggcattaccagatttcagtattccgttcacagttaagacagatgcctcaggggtaggcatgggtgccatcctttcgcaaaagggacatccaattgcgtttttcagtaagccatttagtgccaagttgcttcgttcctccacttatgtaagggaactattcgctattactgctgccattaagaaatggcgccagtacttgctggggcatcgtttcattattctaacagatcatagaagtcttaaagagcttctcactcaagctgtgcaaaccccagaacaacacatgtatctggccaagcttatgggatatgattaccagattttgtatcgttccggcgcccataatcaagctgcagacgtgctatctcaagttcctgaatctcagtcccacctctctatgattctttctgttccatgcttcacatttttagaggaacttgcacagcaattggcccaccatgatgattatcttcagttatgccggaacattagtgaagcacctgcggtgtttgagggattctctcttactgataccttcattctctttcgaaatcgtatttggcttcctcgtactcttcctatcatacccactgggggtcacgccggaatcacaaagacactgacccgcttgtccgaaaacttcttttggtcaggaatgcgagctgatgtctcgacatttgtggcaaattgtttcaaatgccaatgtaccaagtatgaaacaaagaagatgtctggtctcttatgccctttaccggtgccgcggcaaccatgggaggatctctcccttgatttcattacaggtttgccaccctccaatggtcacacagtcatcctggttgtagtggatagattctcaaaaggggttcacttagggctttcgttcaccggagacccaccacgtggggcaagttccttccctgggcagagtattcacacaatacttcttagagctcttcgacgggttcaactccctacgaaaccctatcgtcagtcatcagctaagggattggaaccgaccacaggcaagctatcaaagcggttttttggtccctttcaagttgttgagcacgtaggcaaggtcgcttatcggctccaacttccggcaaaggccaaagtacaccctgtttttcattactccttgctgaaacgtttccatggtgatcccgcagcagttccggcagctttccctgctgcaattctcacatctcagccctccattgctcctttagctatcttagcagcgcgcaaggcctccaatgcaactactgaagttttggtccaatggcagggcctttcccccgatgatgccacttgggaagactggatcgaactccgcaatgaatttcaccttgaggacaaggtgctttcccatgggccgtggaatgatacagaggaacagaccattgcagttcaagctcaagatgcaggaccaattgcagaaccaatttcacagactcgagaacaagaagagaatgcagaagcaacagatcagcaggtgcaattagtaaagaggcctaagagggtagtaacaaaaccatcttaccttaaagactatgtctga

SEQ ID NO: 105150 - DNA, 2043 bp, Glycine max
  Peptide Sequence Number=SeqID_221928
atgctctatggtggctttgctgaatccaaaatcaacaagattgatttctcaggaaatgggatatgtccaaaggggatgagggcagtggagttttacagcaggaacaaaagattggaccttttctgtccaatgactgttttggagcttctgtcctttgccaataggttttgttgtgaggatatgaaatctgcttgtgatgcacatttggcttcaattgttgtgaacgttgaagatgcattggtgcttattgagtatggattggaagagagagccacacttcttgtaggggcttgcttacaagtgttgcttagggagcttccaaattctctgtacaatccaaaggtggcaaaaatattctgtagttttgaggtaaaggaaaggttggccaatgtggggtgtgcttctttcttattgtactactttttgagtcaggtggcaattgaggaaaacatggtatctaaaaccacaatgatgttggtggagagaatgggggagtgcgctacagaaagatggcagaaggcactagcattccatcaattggggtgtgtgcttcttgaaaggaatgaatacgtagaagctcaacattgttttgaggcagcacttgaggaaggtcatgtttattctttggctggtgtggccagaactaagcacaagcagggtcagccatattcagcctataagttaattagttctctcatatttgagtataaaccagaagggtggatgtatcaggagcgtgcactgtacaacatgggaaaggaaaagagttttgatttggatgttgcaactgaattggatccctccctttcatttccatataagtatagagcactggcaaaggtggaagagaagaagataaaggaaggaattatagagttagataggtttattggattcaaactctcccctgattgcctagaattgagagcttggttgtatgttgcacttgaggactatgacagtgcaatgagagatattcgggcgctgctgaccatagaaccgaattacataacttcacatgggaagatcaaaggggaatacttgctccaacttctaaaccgtggagttcagcagaagtgtcaggctgattgctggatgcagttgtaccaacaatggtcttgtgtagatgatattggttctttggctattatacatcaaatgctagagaatgagcctggaaagagtgtgctagagtttcgtcagtctctcctcctattgagattaaactgtcaaaaggctgcaatgcgcagtttacgattggccagaaaccattctagctcaatgcaagagaggctagtttatgaaggatggatcctatatgacactggatatcgcaaagaagcattggcaagggctgacatatccattgcaaagcatagatcatttgaagctttttttctaaaagcatatgtgttggcagatacaactctggatcctgaatcttcttcctacgttattcagcttctaaaagaagcacttaaatgtccttcagatggtcttcgcaaaggacaagcattgaataacttagggagtatttatgtggattgtggtaagcttgagcttgcaaaagaatgctacaagaatgctcttgcaattaggcacacaagagctcatcaaggtgtggcacgcatttatcatcagaaaaatcaaagaaaagctgcatatgatgagatgaccaagctaattgagaaggcagagagcaatgcctcagcatatgagaaaagatcagaatactgtgaccgtgagatggcaaaggctgatcttgatgttgtaactcaacttgatcctttaaggacctacccatatagatacagggcagcagtgatgatggatgagcaaaaagaaactgaagcagtagaagaactcactaaggccataaagttcaagcctgacctgcaaatgcttcatctacgagcagcattttatgaatcaatgggggacctatcatctgctcttcaagattgtcaggcggctctttgcttagacccaaaccatgcaggcacacttgatgtatatcgaaggatacaaagattgaacttttaa

SEQ ID NO: 105151 - DNA, 777 bp, Glycine max
  Peptide Sequence Number=SeqID_221929
atggctgggaaccctaactggtggactatgcatccaccatctttgatccctccccagtatgtgtttggatcttcttcaattccttttaattcttctacacaaaaccaagagccccctcagtcattgagccaacttcttttcactggtttaccaggagaggaagagagaattgcattcagtccttttcaatcaaaaaagttggatgaatggaatgaccaaatgcttaatattccgtcccctatagttccaatgcctgatgtaataaagcaagaggtttcccaaagtggcagcttatatcaccatggacatgatcaggaatttcaggtttctggggcaccttggtcacatatggtgccaatttcttcttcccctaggtctagtgttgctagcttcagtagtaataatttattggatttcacttacaacaagacagatcataggaagaaccaactaccagatacatccgagtgtaatagcacagccactgctggagtttacaagaagactaagagccaaccatcttcaagccaaccacctctcaaggtgagaaaggagaagctaggtgatagaataacagctcttcaccagctagtttccccattcggaaagactgacacagcttccgtcttgttagaagccattggatacataagattccttcagggtcaaattgaggcactcagttctccttacttgggcaatggatcaaaaaacatgaggaatccacagtctgtacacggagaaagaaattctgtatttcctgaggaccccggtcag

SEQ ID NO: 105152 - DNA, 345 bp, Glycine max
  Peptide Sequence Number=SeqID_221930
atggcggaagcacctggcaccgcgtcgcaccggagtcatgtcatgtccgtattcgtgttcggtgtgagttcgacgcgggacatgccgctgaatttctacagtgtttcaaactcagaagaaggctccgcagcaaagacaaattcgatggcctcctccggagacaaatggatacaaactgaacaaagatgggagctcgatctattggcaatcctgaggggatccgcaaaaatcacgggtgaatccgattcaaaaatgacaatcaacttcatctgcaatggagttgtgcccacccatccttacttccctatagtgggcaagattcaaagtttcaaagacttgaactag

SEQ ID NO: 105153 - DNA, 1527 bp, Glycine max
  Peptide Sequence Number=SeqID_221931
atggccagtgcacacggtcttgctccaattttcaaattgggttttgtgttttcttctgtttcaccatcacaaaggaagaggcaccctttgatgtttcctgcatcacactgtggattttccctcaaattctatggtgggctatctgccagatcctgcaagttcaaaaacccttcctttgtcagtgcaaaacacggttcattaaggggttttagggctctgaaatccgttgaaatggaccaatatgtgaccagtaacgatgaaatgagtgatggattctttgaggcaattgaggagcttgagaggatgacaagggagccctctgatgttcttgaggagatgaatgaccgtttgtctgcaagggaactgcagcttgtgttggtgtatttctcccaggatggaagggactcatggtgtgctttggaggtgtttgattggctgaggaaggagaatagggttgacaaggagaccatggagctcatggttgccatcatgtgtggttgggtgaagaagttgattcagcagcagcatggcgtgggtgatgtggttgacttgctcgtggacatggattgcgtggggttgagaccgggttttagcatgattgagaaggtgatttccttgtactgggaaatgggggagaaggaaggggctgtcttgtttgtggaagaggttttgaggcgcggaatcccttatgttgaggaggacgaagaagggcataaaggagggccaactgggtatcttgcttggaagatgatggctgagggtgactataggaatgcagttagattagtaattcgttttagagaatctggcttgaagccagagatctacagttaccttgttgcaatgactgctgtggttaaggaactgaatgaatttgccaaagctctacgcaagttgaaaggctttacaagggctggtttggtagctgagttagatctagaagatgttgaacttactgagaagtatcaatctgatacactagccgacggggtgcgcttgtccaattgggtgattcaagatggcagcccatcacttcatggaatcgttcacgagaggctccttgctatgtatatttgtgccggtcatggaattgaggctgagaggcagttgtgggagatgaagcttgtgggtaaggaggctgatggagatctctatgacattgtccttgccatttgtgcatcacaaaaggagtccaatgccacggcaaggctgctgacccggttggaggtagtgagctcaccacagaagaagaaaagtttgtcgtggttgttaagaggctacatcaaaggcggccattttaacgaggcggcagagactatcatgaaaatgcttgaattgggattctatccagagtacttggacagggcagctgtattacaaggtttgaggaaaagaatccagcaatatggcaatctagatacttatgtcaggctctgtaagtccctctctgatgcaaatttgattggaccttgtcttgtacatttgtatataaggaaatataagctttgggttgtgaaaatgctctaa

SEQ ID NO: 105154 - DNA, 372 bp, Glycine max
  Peptide Sequence Number=SeqID_221932
atgccagactatctcgctcctttcaggaggaacatatatcgtttgcgcgattttcgcgaaggatgtggacgtccacgtggaaaagaagaattattcaattacagacactcttcattaaggaatgtcattgaaagatgctttggagttttgaaaacaagatttccaattttgaaattgatgccaagttatcccattagaagacaaagattaatttctattgcttgttgcactatacataattttataagaatgcaaaatggtgtggatacactctttgaccaatatgctgaacagctcatggatatggatgagcaatggttaagtgtagagcaacaaggtgtcaatgaaaatcaaacaactgaaatggcataa

SEQ ID NO: 105155 - DNA, 399 bp, Glycine max
  Peptide Sequence Number=SeqID_221933
atggagtccgaactcaaagacctcaattcgaagccaccgacctacaatggcaacgccaacagcatttgcgatgaccgtcctctgttgaagtcggagcctccggccttcgccaatagcatcgtcgagatggagaagaagctcaccacatacgttcgccgtgacgtgtacgacaccatgggacatagcgagtttccagggaaggagaagctcttgctcgacttcgcgttgggcactcttctccccattcgaggtttgcactctcttctctactctgactggcgaggaggaataggaagattacgctcatatgagtgggttgaggagaaccatcattgtttcgtgtgggtgtgccctctcaagagtcatgctcttcattttcggcttttattggatccctga

SEQ ID NO: 105156 - DNA, 255 bp, Glycine max
  Peptide Sequence Number=SeqID_221934
atgtggcctatggagcatatgatgatcatcacagcaagtccactagttgttgcacatcccatcacagtttctggtccatgtgacttttccttctcaattgcagtgcctattgccgcaaacatgagaaagaacgtgcccataaactctgctccaacctggcaaaaggggagacatgctaaggcatggcagattctagtgctgggaaggaagattcaaatgcatactcagcaaaatctcaaaaatccttcaggctga

SEQ ID NO: 105157 - DNA, 273 bp, Glycine max
  Peptide Sequence Number=SeqID_221935
atggaaccagctgtgaatgtatgtatacatgattttgatgatgccaaagaagaatcaaacaaggctgcttcaaaggataagcattacttcaagattaatacaagattgcttcaacaaataaagccttgcttcaagatttcttcaagatcaagccttgcctcaaaacaaagggtttcaaagtcatccaaggctctaatgtttgtaatcgattaccagcaacggaactctggtttaaattcaaaagtcataacccttcaaaatatcattgtgtaa

SEQ ID NO: 105158 - DNA, 438 bp, Glycine max
  Peptide Sequence Number=SeqID_221936
atggcacaaaccctcgccgccaacgacatgaccgaccacctggaccgtctgatcctcgacctcgcatctgagaatgaaatcaagtgcggcgacgatcacaaggggctagccagtttgatcaaggccgtcgttgctgccaggagcagagaatcaactgtcaggatttacgggctcatgaacaagagtggatatggttccgttactgaacccgatgagtatgtggttgaggttttggttagtgggctcaagagtttcggggaagaggctcttgctaaagaacttcaacatgaatacaaaattgcacttgctaagttaatgtggatggatctcaccgacagggtgggtcaaacttcagcttgtgattgtctcatccgagacttcaaagagaagtttattaaaggcttgcattgcaatattggtcatagtaatgccctgtga

SEQ ID NO: 105159 - DNA, 1074 bp, Glycine max
  Peptide Sequence Number=SeqID_221937
atgggcattaaggatcttgacggagtaattatgaacttcctcaggttgatctctttgcttgtttgttacattttaaccattccaattttcaagataccgatcctgaagattcaatgctttgattttagttacttggaatgtggaattctttttgtttatccagaattttcctccattcgagtgtatcagtgtttcatggaggtggtaactgaggagataggatggcttgatttttatggttcatatgttcaaataaattgcaaggagaaaaggtctaaatataatgctcgccaggcagagaaagagataatttcttctgtagtgtttactgtatgctatgatgttttctctggatttgcacacttcaatcgctcaactcaacaatcattggacacagcttcgcgctcatacttgcttcgttgtgaatcactaaatactgcggatcatgctgcatttgacaaccatacatcatatatgggaagtataaatggacccaagttacctctggtgtttgaagtgcagcagatgccacatgatttaactacagaaggatgtccaaagaacaattttcaaaacagttgtatattcaataaggctccaatttcagcaatcacgaataagaaaacatacgaggaagatacctgtgtcgacaagtcaaatcctcagcatgaaagttttatcaagagatacagcatcaagttggcatccacaagtgcagacctctggatgggtattgtattgctcttcatagacattatggttgctttagaaatacttgtaaggcaagtgcacggctgcaaggcttccgggagtcaaagaaagagactaaacagaaccatgactgacattattgtgctaattccagtgacaatcttgatgctaattcctgtaacagctgtaggccatgcagctattctagcagctatcaagaagtatatgccatgcttgatcccctcctctttttcttcagagcggttggatgttgtaaagcaaataaagcgaactagagagatgggttatcagttacatttggctcagtttgaccttgaagatcaaccagcaaccacttcttga

SEQ ID NO: 105160 - DNA, 1149 bp, Glycine max
  Peptide Sequence Number=SeqID_221938
atgggttttgttcgcatgaaagctgtttgtgtccttgaggccatccttagaaagaaggacgatgatcatttttcaccagtggattcttacttcaccgaaaataaagatgtggtgctgagatgttctgaatctccccaagcctctttaagggaaaggactgtgaaggttcttggtcttttaggtggaggccagccaaacagctctatgataaattcagagaaggctgtgaaaactgagaatgctactgttgctgagttgcctgacttgatagacactggtgattcaaatgattaccatggaaatgatgacactctaaagggtacaagtgatcaaaatatagcaaatttgacatcatcaactcctctggttgatgatctatttggagattttagtggctctattggagctagtcaagaaccaaaaaatggtgatccatttgctgatgtatcatttcacacaagtgagaacaaagaacatgctgatgatctcttttctggaatgactgttggtagcgataaacagggcgatcttaagagtcacaggcaggggaatataactgaacctcaactttttgacatttttgcttccaattctgaacaaggaaaccataaggagcctgttagtgatttaatggccggtctgtcaatggatgaaaatacctcaagtacgaagcagaagggaacgtctccttccatacattctgaatctttattttcaggtttaaataatcatatccctgacaatacttcaggcggcatgttgagctctcagccaatggggtttaatgtaaatcctatgtttcctactggtcctatgccttataatatgcagcctggtttcatgttgaaccaaccttattcttcccagcccctcaattacagtgccatgggaacccttttagctcaacagcaattcctggcaacaatggctaatttccaacaccttagtaatgtcaacatgcaagatgatggtgttgctcaaatggctggacccaatggaagatcacctttgccagacatatttcaaccaaattttcaaactcaaactcctagctcaatgatcaacacttcaaggaaagaagaaactaaagcatttgactttatctcggaccatatgacctctggtcgtgattcaaggagaatgatttaa

SEQ ID NO: 105161 - DNA, 1044 bp, Glycine max
  Peptide Sequence Number=SeqID_221939
atggcgcgctccggcgacggttacggtgtcggagtggacgagtcgtatcgcgcgctgccgtggctgtacctgacgttcttgtcgatctggttcttctctgcttgctcttggaccgtttacacctacaaaacgcgccattctcagtggacacttgcttcggttccgttgattaaagcattacagctcatgctgtccttcctcttctggtattcctgcttcaattttcaggcctgctctttgtggatgtcatttggggtgtatgtaacaggggtgctatttcagacagctgcttttgtctcctttttgctcatttctcatggttactgcatcatgtgtgagcgtctttctttaaacgaacgccgttcaactgccgcacttgcatgtgttttttacttgactctggttggttacaaggcttgtgtgccatacttctctgttcttctgctactaaattattttatatcattctacataatattccaccatatatcccaaaatctactagtgttgcgagaacaattgagcattatagaacatgaggatattcaagcaatgcatgatgctgtgtataagaagtacacaatgttcaagaaatttcagggtgcaatgcagatagtagctacagcagaaactatgatatatatgaacatcgatgactcttcagagaattactggcttcgtttattgctcagagaatgggcacaattctgcatctttttgtacattggatggattttcaggtcacaagatttggcaccaaacttctctgttatgcctaccacaaagtgtaaaggcgagactctggtgcctcccacctacagtattgaaatggatgcaggaacatttaaagaatttagtagccatgaatggcacattggggtgccaacctctacttctcatgatgaaagctccaaagatgaagttttggtaatcattcagcatcctcgagcacagaggctaagaaagctcgatggtttttcgcaaaacgctgactgttttgttgtgtcagatctcaatgcaaattcacctccatgcccaacataa

SEQ ID NO: 105162 - DNA, 486 bp, Glycine max
  Peptide Sequence Number=SeqID_221940
atgacccgacccgcctacattgccctccaagacaccttccgtatcgaggcctcacatttgaagcgtgcgtcggagttctcactcttcgacatgtgtttcgacctatccgggctcgcaaaggtgaaggtgtccacgccgatccattgggcttgtggcctggcgagagcagctcccccgccgcagccacgtgtttggatattgccactgccaggaagtgtcacttttcaatcgggaagtgcagtgcatctaatgaatacgatgattatgactttagtattaaaggcactttttgacccaacaagagtagtagtggcttccattccagcattgcgaagagagggtgctgagggaaatgatgagctgattcaaacttgtcaatctattaatcgtacatggtcacttgtcacacatcaaggctttttggctttttcctgcagtgtcccttttttttctgacccttcccaactagatggccacatttcctga

SEQ ID NO: 105163 - DNA, 1686 bp, Glycine max
  Peptide Sequence Number=SeqID_221941
atgattatcaaacggaatttgaaatcccaaatgccgagtctgaaacgggtcaaactcggtgactcggtgggcgagaatgatgagtgttcttatgctcgtaagaagagaaagaccaacaacggttactaccctttgaaccttctcggcgacgtggccgccggcgtgattccggtgagttttcacgggctgctcggtgccgccggcgtggtggagaaggggttctctgcggcatggtgcaacggagtggaatcgaacgtgaaaaacgaagttgtcgtggaagtgaagaagaagaacgaggtacagcggccaccgctggttagaacttcgagggggagagttcaggttctcccttcgcggttcaatgattcggttattgataattggaggaaggagagcaagagtagtagtggtggcttgcgtgattgtgattatgatgaagaatttgaatgcaagaaggagaagttcagcttcaaggcacccaaggtttgcaataataatcagaagaaagggaaaagcgaggagaaaacgggttctaaggctcgtaagtactcggcattgtgtaatagttttgagaggagcaagtgtttgagttcgcctggtgatggttcattggccttgaggcacagcggggcagccgcggttgaagaggatgatgagaagggaaggtttttggaggtggaaaaggttggtttgatgggtttgaaggagaagagaaatgggttgtttgggccagaagatttttatgcaggtgatatagtgtgggccaaagctgggagaaaggaacctttttggccagccattgttattgatcctatgactcaggcacctgagttggttctcaggtcttgtatagctgatgcagcttgtgtaatgtttttagggtatgcggggaatgaggatcaaagggactatgcatgggtgaaccatgggatgatttttccatttatggattatgtggacaggtttcaggggcagtctgagttgagttactatactccttctgacttccaaatggcgatagaggaggcatttttggcggagaggggtttcacagagaagttgatagcagatataaatacagcagctagtagcaatggttatgatgattctattctgaaagcttttcagaaggtcagtggttcaaaccaatatgcaggatatcattttctgaaccaggtcttatataaaggggcaagaaaatttctcaagaaaagtcttatatacaggagcaaggatttatttgataagaaagaaacacggccctgtgaagcctgtgggttgagccttccttacaagatgttaaagaaaacaaaggattcaagtcccggtgggcaattcctatgtagaacatgtgctaggctaacaaaatcaaagcattattgtggcatatgcaagaaggtttggaaccattcagatagtggaagttgggtgcgctgtgatggatgcaaagtgtgggtgcatgcagaatgtgacaaaatttctagcaaccttttcaagaatcttgaaggcactgattattactgccctacttgcaaagccaagtttgattttgagttatctgattcagaaaaaccacagccaaaagtgaagtggagcaaaaacaatgggcagctagtgcttccaaatagggtcactgttctgtgcaatggtgtagaaggcacatatttcccaagccttcattcgtaa

SEQ ID NO: 105164 - DNA, 393 bp, Glycine max
  Peptide Sequence Number=SeqID_221942
atgtcatgcaatagtgagcatgattttaatcctaagcaggttcttgaatatcgtggtgaacaagtgaggcgcagcattgcagatttgagggaggcacgctatagattagaagggaaagactgctacctgtttaagataagtgaagaagtggtggtagatgccactgataaagggaatatagctcggctgattaatcattcttgtatgccaaattgctatgccaggatcatgagtgttggtgacgacgagagccggattgtactcattgctaagactaacgtggttgccggtgatgagttaacgtatgactacttgtttgatcctgatgagccagaggaaaacaaagtcccgtgcctatgtaaagctccaaactgccggaaatacatgaattag

SEQ ID NO: 105165 - DNA, 312 bp, Glycine max
  Peptide Sequence Number=SeqID_221943
gtaggtatattgggtaatgctgctgacttttacaaggatggttcgaatggtagctctttggacaacttggacaggcgacagatgatgattgcatttgacatgagatgcgtgggctttataatggctaaaatggtaatgcgagaacttatggatcccttgatttttgcaaagttcaaattgttcctcaaaaagcctcttgaatgtttaaaaagaattcaagctttttttgatggaaaaagaaaactagttgacctcaatgctctagacacacacacacattcattgatagcaggacataaaccattatcatga

SEQ ID NO: 105166 - DNA, 129 bp, Glycine max
  Peptide Sequence Number=SeqID_221944
atggcggaacaagtgtatcgccattccaacttgcggcattccctttcaaaacagacccccattgttaaaagtttgcaaacagaccctgaatggacccaggttgcgattagaacttttcctatggcctag

SEQ ID NO: 105167 - DNA, 414 bp, Glycine max
  Peptide Sequence Number=SeqID_221945
atgggttttcctttgccggcagtcacttaccttgccaaaaatttatctggccaaggttcaaaaaagtttaaggttgtgtctcaatggggtcttttatcgtgggagcccgatcttgatatctggggcaaaacaaattcgtgcgtcaaggtgtcggtctcgggccgaacttccatattattccacaaggcatgcgcaacaatgatgatttggaaacaacgtgcaaaattagtcatggccacagccaggtgggcactcaagcatcctgtttatggcattgtgatactacggttgggaacttacacaaacagacccaacgtttccaaattatgttctttcatcagttcaatgaatccatccattcttatctcggttattcaggaaaataaactcttagcgtcagtcccttgcttctag

SEQ ID NO: 105168 - DNA, 273 bp, Glycine max
  Peptide Sequence Number=SeqID_221946
atgaccgcaatgctgatctccccctggggaagtatcagttggtctgtgtcgttccgacatagggatcgtgcccataagacacccggtggacccggaggagcccaacagggccctggggtttctagctctaattacgggcctctggatcgtgcccacaagacacccagtggacccggagaagcccaacagggccctggggtttccagctctggttacgggcctctgtcagtcctacagggcacccgtcccccaagcaagttcatgccatcgtga

SEQ ID NO: 105169 - DNA, 240 bp, Glycine max
  Peptide Sequence Number=SeqID_221947
atgaccggccctctcgatgagtcgatctcttgctttctcataaaggtggacccttgggtactagtacctatcacctttagaggactacacgtcctcgccatcagaggactacacgtcctcaccatcagagggttgcacgccctcacctttagaggactacacgtcctcaccttcagagggctgcatgccctcgcctttagagggctacgcatcctcactttcagagaactcaaactttag

SEQ ID NO: 105170 - DNA, 231 bp, Glycine max
  Peptide Sequence Number=SeqID_221948
atggggttaatggaggcaatggaggtaatgaggctgatctataagagaatactttgtagaactatcccagtcccatggtgggaggcagattggttgctttttcattcacattatcgggaaaggctgaagattgactcggtgacttcccgaaatctttgtctaaagcctgtgagcgattcaatgggctacatagaagcttctcaaaccatggttatcccccataaaggttag

SEQ ID NO: 105171 - DNA, 288 bp, Glycine max
  Peptide Sequence Number=SeqID_221949
atgcggaaattgattaaggaaaggatggaaaataaggtggttaatctcgtgggtcttaataaggtggtttctggcataaaatggatgaatgggatgaaatatagaaatggcaataacggaagctacagggctccaaatgaggtgattccaaaacgagaggtggattttctggaattgtggtttgaaagaacaagggtggagatgataggaaggaaagaatcactctttccagcgagggcaacacacaaaggttgtgaaagtcctttgatacagccagggtgttcttga

SEQ ID NO: 105172 - DNA, 297 bp, Glycine max
  Peptide Sequence Number=SeqID_221950
atgaggggttaccgtatggttacccgcacctttcgtcaaccaggggcaaacgagccggttgacgcgcggagactaacatcgttttctgcaccttttgccatccagggacagcgagtcaggtggcaggcagagataccttatggtcatccgcacatttcgtcaatcgaggggaacgaatttgacggttttactctcatcgtccggaaacattcatgcccaacgacgcgcgagattcttctctgctgggtagggacgatcgagtgcaatggcgtagggttccgctggtggggatattga

SEQ ID NO: 105173 - DNA, 1209 bp, Glycine max
  Peptide Sequence Number=SeqID_221951
atggattgcagaatagagagtgccgaaactcacaggaataagtgtgcagcatgcttccgacagttcaacaaactggagcatcttgtggagcacatgaggatctcataccattcggttcatgaaccaacctgtggcatttgcaggaaacactgcaggtcttttgagtctctcagggaacatcttataggtccattgccaaaacaggaatgcagagatatattttcctatagagggtgcaagttttgtttgaaagtctttgaaagccctaactctcgcaggatccaccaagaaaaatgccaactctctggaacaaatgctggaataattggtcgcttttcaaacttgggacttcgtgataatttggctattggtggtggagcaagaggaccacaagtagttgctctagcatgtaaaatggttggaggcggcagtgatggctcacttgatctctgtgcaagagtttgcttaatcgatgaacatgagaacataatattccattcttatgtgaagccaccaattcctgtcgcaaactacaggtatgagacaacaggcatcacaccagaatatctgagggatgcaatgccaatgagacatgttcagaggaggattcatgacttcctttgcaatggtgaacctatgtggacaattcgagcaagaggtggaagagccaggattcttgtgggtcatggtttggatcatgaccttgaaagtttgcaaatagaatatcgagctgaaaaaataagctcctcgatctctagaatcaacaacaaagatggatgccatacatcaaatcataggtttatttcaacacattcaaatattgattttgaattcatattgaataatcagggacactgcaaaataccctccactgatgaaaacaagcaagctgagcaactcactcaagtacttaacacaggcatatcttgggcaagcttctgttttggggcacatatacatataagcaggtatgacattcaaactgggattcaggatccttatgaggattgtattgcaacgatgaggctctacatgagaatgagatctcaagcacatagagtacaggaataccctttggcgtctgaccctcagaacaggaataattttgcttcatggaggcaaagtgagattgaaagaatgagtcctgaacaaatgctagaaatttcaaggtctgactactactgctggtgcttggattccttgtattga

SEQ ID NO: 105174 - DNA, 342 bp, Glycine max
  Peptide Sequence Number=SeqID_221952
atggcagcggaatggagaaggaagagagagaggagacgccacttcaaggagaagatgagtctagaagaagctcaccaccataggaggccatggataagagcttggaggaagaaggagatgaatgaagggagagggagagaagagcacaaaattttgtgctcaaaaagagctctgaaatctgaaataattggacccaaccttggcccatgggctcagaaatctaccctaaggttcatgagaaccctagggccttcttcagcagctctagcccagtcttcttggagcctcttgctcatggttctagtgattggtcccttcctagggaggattgcatcagtatga

SEQ ID NO: 105175 - DNA, 342 bp, Glycine max
  Peptide Sequence Number=SeqID_221953
atgtggctaccaccaaagccttggaacgagaaaccaagagggcttgtagggaagaacacggccgaaacaaattccgaggggctctgtggggcagcaatagcttgctcgaggtccaaaagaagtttgtctcagcggttatgcgagacagagaccaacatgttagctatcatcaccaagtaccaagaagaactaaatctagcctcggcccacgagcatagagtggcggaagagtatgcccaagtgtacgcgggaaaggaggctagaggaagggtgatcgactcactacatcaagaggcaacgatgtggatggaccgatttgcccttaccttgaacgagagttaa

SEQ ID NO: 105176 - DNA, 201 bp, Glycine max
  Peptide Sequence Number=SeqID_221954
atgacaaaggaagtgatccacgatcataattctgcagcacctcggcttcgcttttcttcttctccttcttcttctgttaaaagccatttagtgcaggggaaactcgcccaggcgagctacttgtttaggactgaaggtatcagctcggccaggcgagtgacttgcttagggctaaattttctcttagcccaagcaagctag

SEQ ID NO: 105177 - DNA, 213 bp, Glycine max
  Peptide Sequence Number=SeqID_221955
atggaagaactcctccaaaagggtgttcatggaaaagaaagacaaagacaagaactagagaagtctcaagataagaagaagtactacaagtccaaggaaaataaaagcctcatgagcacctgggaggacctaggtgacaccttgtttaatgaagatgaagaagaagctaacctatgtttaatggcaaacacaacctttgaaaaatctaaataa

SEQ ID NO: 105178 - DNA, 666 bp, Glycine max
  Peptide Sequence Number=SeqID_221956
atggccccgagaaaacttgcctcaaagagatccaggaaggataaggcggccgaaggaactagttccgctcctgagtatgacagtcaccgctttaggagcgcggtacaccagcagcgcttcgaggccatcaagggatggtcatttctccgggagcgacgcgtccagctcaaggacgatgagtataccgatttccaggaagaaataggtcgccggcggtgggcatcactagttacccccatggccaagttcgatccagaaatagtcctcgaattttatgccaatgcttggccaacagaggagggcgtgcgtgacatgaggtcctgggtgaggctcctgggatatccgttagtgctggaagagggccaggagtgcgagtatggccagaggaggaaccggtctgatgggttcgatgaggaggccatcgctcagctgctatgtataccggggcaggattttgcccggactgctgtagggaggcgagtgcgaatcatgcgcaccaacatgaccaccctgacccagatatggatgacgttgctcctcagcaacatcctgcccagcgatcataattccgacctccccttgccgaagtgtcagctggtatggcgccctactaggcacccttggacccagataagtccaacagggccctgggatttccctcgctga

SEQ ID NO: 105179 - DNA, 486 bp, Glycine max
  Peptide Sequence Number=SeqID_221957
atggcatccaagaggggaatattgacttccacccttttgaaagtctcaacaagatcaaagtcaagctccactttctttgcaggaatggatctagaaggaaaaggtagaggaatctatttgggtgcagaatctgttttggcactatcatcaattttggcaccaacatctgtttactttggaagctctatgtcactcctcatggtcttggatggtggcacttacattctgttgaaactaaatgttgctggtgggaatttgcttcatcagctcctccaaggaaggatcatacctcaaattctaatggtctctccaaccaagattataggtgctggagtaaggattatattgctgttgttgaggtctgaatggttgtccaggttgcatggcagaaacattcatctgttggatgatcagaagcacaatagataccacatttctgctattgcccaatggctagctacctcacaagggatgtcgactttgtaa

SEQ ID NO: 105180 - DNA, 453 bp, Glycine max
  Peptide Sequence Number=SeqID_221958
atggtgtggcgtctcctctcaactcttcttcttctctattctgctgccattaaaattcaagaagcaaaggactccattgatgaagaagatccaaggcctacaagctccacatggagctacatcaccatgcttgacctaggagcctcgattaatgtcatgcccacatcagtttatagattgtttcatcttggtgatttaaagcccactggttctaatcctcctatttctcttccactagctgtcaaccttcctttgctttccattgttcagctaccttccttggagctgaaaccattacctaagaaccttaattgtgcctatttagataatgctcaaaagcgtccattcatcatatctagtagcctttcacttgagcatgaggataagttgctgcatgttttgagaggccacaaaaggccattgggtggacacttgctgaccttcctagaataa

SEQ ID NO: 105181 - DNA, 477 bp, Glycine max
  Peptide Sequence Number=SeqID_221959
atgtcatatgatacaatcctccctaggaagagaccagttaccagagccatgagtaagaagctccaagaggattcggctagagctgttgaagaaggcccgagggttctcatgaacctcaggtgctcctttccatgcagtggtcttgtggcaagcaacgatagctcgtggcggtcattgatggctaatggtggaggaagaagaggtttgggggtgttgggtgagggtttatgggagaagaaggaaaccaaatggcctgcaagactcgcccagatgaaattttgctcacctgggcgagttgacccaactcagactcacctgggcgagttatgggcgaaatctgctccaacatattttactgctttctttgaaaatgtcatatctcatactccagatgttactttagaaatcccaacggtagaaacgtggacacatgattttcaagcctacagtccaaatttgaaggcgatccaacggtaa

SEQ ID NO: 105182 - DNA, 378 bp, Glycine max
  Peptide Sequence Number=SeqID_221960
atggcagaatcatcaaagaaacgaaagggttcttccgcctccgcttcgacttcaagagctcatcgttccgaagccactagcgcatccacaacaccaattccaccatcattgtcctcttccccagacagcactctgacttctgaaatttttgggataaaaatggtcattgaccagtcccttttccatgacttaaccaaattacccagtgacggtgtaccatttgaaggtacactgaatgacgactggaaatttgatttctctgcccatgatgcccgccagctggttggcaccaacaatgcggatatgaccggacgtcttcttgccgggtcattggcttttgaaagccgcatccttcactatttaattgtgcgtatttag

SEQ ID NO: 105183 - DNA, 606 bp, Glycine max
  Peptide Sequence Number=SeqID_221961
atgtcttttggtttcctcaggaaggtgctaaatgagcaaacaagttcttttagcttggttcttgagaggccaacatctccttttcccattcaactactgcacaagatgaatgatcttgaaatagtgttcaatagaggtcgagttcctattgccacatggaacaagactctattggcatcaaatttacaaccatctagtgagagctgcgggaatgccggatttctgatgttcaactcaaaatttcttaaaccaaatggaagcaagttattgagcaatcaaaatcaacatatcatcacccatggtgagagaaacattgttactgaacacacaacacaacttgcttgtgtttttaccgaagaagtgtgtggagatggagattgggctcatggaagttttccgcttgaggaatacattcaggctctggatcgttccaaagatgagatgtactataatcactctcttggtatgcgctatagtaagggagttactgctgttctgaacttccaaagtggaactgaagctgaaaattggggaatcaatgcaaaatcaatcaatgaatcttgtcaaaggaaaaatattctcatgatcaactatcctatacggtaa

SEQ ID NO: 105184 - DNA, 1320 bp, Glycine max
  Peptide Sequence Number=SeqID_221962
atggctctgaaaattgatgtccgcaaagcttttgacactttggattggaattttttattttacgccctagaagcttttgggtttaatcagatcttctgtcagtggatcaagttaatggcatggcagcagggttctttgcttgcaagagggtgtgtgaggcaaggagatcccctctcccctcctcttttgattggcagaattagttctcagcagagggatatccaagttaattcagaatggtctcttacctcggagaaagggttgatgcatttgatgaccttgctttctcaatatggggaagcttcgggacagtggattagcctggaaaagtgcagatcagattttttcagggcgttctctctcgaaataggatcctctcttagggacatccttggtattggaaagggatctcttccttttcattaccttggtgttcctattttccaaggtagaccacaggcaagttatcttatgcccgttgtcgataagattgcagctaaactaacttcatggaaagatatgcttaaaaagaaattggtacaagtttcttgggccaaactttgcactcctattgcttctagggagttgcgagttaggccattacaagatattaataaggcagccatgctgagattgggatggcttttggttacttctgatggggcttgggcttctttggctagagcaaaattctctacgtggcctgggattcgcccacagttagacacagtcatggagaatttaggctggcatcttgggaatggttcagcaatatcgttctggtcagacagatggttgataactaccatattggaatctcttgatatcccccaagagatgagaccgatgttgaaagctaaggttagtgacttcatttttgagggaccttggaatattccaatggattttcaaagccactatcctgaagttgttaatgaggttactcaggtggttattcctaagtctgttaatatttggcaatggctgagtagtaaaattggtttggggttggatttaacgtctcccctctctcttatttccataactaatctgaaatttggctctcagaatgtgcttactgctgttgctatttcgggtaatttctccaagggcacaatgcttcctaatataaatgagtttaacttgctgaattcgttaatggtcaagggtcatcctaagaagcaaattcatattaagcaagtgctttggatagctccctctcctgggtggataaaggtaaacacagatggtgcagctcatggttccccaggggtggctgctagtgggggtctttttcgtgatagtagaggccagttctag

SEQ ID NO: 105185 - DNA, 321 bp, Glycine max
  Peptide Sequence Number=SeqID_221963
atgggtggaaataaccgaaatagaaggcgggaaaaatggattaagggtttggcacatgaaagaaggttaagtgacaaagtaggaagtcattgtgcatggacaatcatggattcaaagctagaagtctggaatatgtctatcctaaattgcaagtggaaaagtcacaaatacagatggcaagataatcaattttggtttgggatatgcatgaaaaattgggtggtggaagggtcattgctttttcgagggtgtaactggaggcaagttaagtggtttgggaactgtggagcattgaatgctacgtctaaagattggacgtga

SEQ ID NO: 105186 - DNA, 270 bp, Glycine max
  Peptide Sequence Number=SeqID_221964
gagcttgaaccagaggagccagcagtagcagcagagggggaggatgagctcactcctcctgagcccttttattttgattcagatgtacacatggctcaggaggaggagacttccacagaccagatgccagagccatctcctgcatctgttcctgaggagacccagccatctgcaccagtcatggagccagagcaacctattcaggattcatcagcagctctaacactggatcttaatgaagatcaatcacaggatgagcatgatgtttaa

SEQ ID NO: 105187 - DNA, 151 bp, Glycine max
  Peptide Sequence Number=SeqID_221965
acacttcctgagcaggatgtcacgacatctcacgtgacatcagctttctgctccccctgtctccatgctcttactgttgtgaagcagttcactgcggcattctgcaagttgcaaatctacaagtcttttccaggatgtcaagacatctcat

SEQ ID NO: 105188 - DNA, 1245 bp, Glycine max
  Peptide Sequence Number=SeqID_221966
atgtcccttgaagaacttgttggtactctcaaagttcatgaacaagaacttcagcaagacgaaaggtcagagagaaataaatctttggctctcaatagccaaagaacaagtaggtcttatcgtctagagagaaagcctccagaagcttgtccaaagctctcaaagttgaaaactgctatactaaagaatccgaggaagaatctgatgaagatgaactcaccttcatttcatgaaagatttgcaaaatgtggaaaaacaaagggagatccaaatggaagaactcctcaaaaagagtactcaaggataagaaagataaatacatccttcatagtatgctatggatgcaagaaacttggacacttcaaatctgaatgcccagagttggagaagtcactagacaagaagaaaaaagaaaaaaaaagggaacccaaatggagccaacagtgctgcaaaacagatgaaacttgtgataataaaggtgcgaatgagaatctccaaaaccacaatcaaggaatgaagcagagttcactggctgcaaagcgcaagagattactttggacaacagaagaagaaaaagttctcaagaaaacagggctatggtgggagtgggatcagggatggaagtttaaattatatctgcacaagaaaacagaccagagtagcatagaaaagttaaagacattaatgaagaagagacaagctgaatgggtcaaaagtcagggaccaaaatgcctattcactcctaatgaagatgaagaagaagtcaatctatgtataatggtagacccaacttttgaagaatctaagtcagatcaagaggatgagataaatctcgataaccctaaatctcttaaaaagacttatcatgaattacaaccaaactcatccattctttcaaaagcttacaaaaacttgcaaaaagatttcaaaaggttgtccaaagatgatatgcaacttgagaaaacccttcaagataaagtagaggtttcattggacaagtacactcaagcatgcaaagcttgtgaaacttttgagcaaaaagagtttaagctatgtttcaagaatgaggcaattgccaaagaaaaatctgctcttttgggaaactttcaggagttggaaaacaaactgaaagctctacagaatgatcaaaatgagctaaataaacttcacgatcatcaaagtaaagaactattcttcagccatcctagtcatgtgtatctcatattttctcaattttccaaatag

SEQ ID NO: 105189 - DNA, 1020 bp, Glycine max
  Peptide Sequence Number=SeqID_221967
atggcagctagtgatcacgccattcttcgtgatcacacatatgcaccaacaaagagaagccttctagaactaaccactcaagatgcaatcttggctcaaaagaagttgttgtcccaacaattagaagccctgacagagaccctctacaaacttccacagcaactacaagcggtaaggggatgtcacatatgtggaggaacacatgagtcaggcttatgcatggtcaaagatgaagcatccaatgaagttaactacatgggcagccataatcatcaaggattccatcaaagaggaccaccaggattctatcagagcgataattttttgcaggaccacgattggagatattatccaagtaataacttcaaccaaaggggttcaccctatcaacatcctagccagggtccgagccatcaagagaagccgcctatcagtataaaggaaatgctattaagcttcatccaagaaacaagggcaaacactcaagagacaaaagcattcatccaggagacgagatcacatcaaaagagcacagatgcaaccatcagaaacctggagatacaaataggccaactagctgagtcaattgctgaaaagccgactgaaacctttgcggtaaatgctgagatgaagcccaaaaaggattgcaaggtaattttcactgagagagaagaggaagaaaagaaaacagaggaagatgtgtgtgatgaggaaggagaaaagaagaaagaaacaaaaagaaatgaggagaaagcacaacaatgggagaagtactcacaagtagaaattcagcaagaaagtattctccaagtcaatacccctcctcatcaactgattgtcaaggaagaaaggcatggaaaacatgagaaagccttaagtgtcattctttccttgatcgctaccacttctcttgcaataatgtggaaggtgcttccagaatacacgagtttcatggcgtctctaactaagaggcgaaaatgcaaggaagatgtgttctacgtgaccttcatgccaccttga

SEQ ID NO: 105190 - DNA, 174 bp, Glycine max
  Peptide Sequence Number=SeqID_221968
atgttggacttttgctttggtcttggaatcataataataccaactgttgccactggtatggagtcctctgccacaaccttacttcccacgttcttcagcttcacctcaacacttcagattctgattatgcaaattgggaagcttatcggagatggagctttggtggagagataa

SEQ ID NO: 105191 - DNA, 576 bp, Glycine max
  Peptide Sequence Number=SeqID_221969
atggcaacaagtcaacaagaagatgctacagtatcaacaacaggggtacaccaaccaaacaaagaggtgcaattagtgagtaaaactaaaaagaggattgcaaagtttgatatcgcagaagctacgaaggtgaagacgaaggttatgtcaacagtagcgacgagatggcggcaatttaagtccacattgactagcaaatttgtgtttgctaagagtgaaggtcaacaaacacaggatgttgtgacaaaatatggactagatcctgaagcatggaaacaatttgaagaaacccggctcacacctaactgggagggtattaggaaacgagcacaatcaattcaaaaacacaatgactgcccccacgtactttcacgtgggggatatgatttgcttaagaagaaattgttagaccagaaacgaaaaaggatacaagaggaagcattgttgagtgaaaatgcagcaagccttgatgaacccccatctccaataaaaagacatgttaagtggaaggttgctcggaccagggctgttggcaatatgacatctgagtccgcacaggaaattgcagataaaata

SEQ ID NO: 105192 - DNA, 1452 bp, Glycine max
  Peptide Sequence Number=SeqID_221970
atggatgttttctcaaaatcaggcttcaacaatgacttttcccctttttggcctcttatgagcagatatgtattaggtgatgattcacagttgcaagcctttcttgttgaggaggataggtctacgccaaacaggttccaggatttgcattcctctgatgaaagcctatcctggcttccagagataataaaagattttgttctaccagcaggctttcctggatcagtttcagatgattacttggattacatgttattacagttccctaccaatgtgactggatggatctgtcacaccctagtcacttcaagtcttctaaaggctgttggtattggctctttcactggaaccacagcagctgcttcagctgctgccatcaggtggctcaaaaattttagagcctatgcttttgtgggtctcaaaggatggcattggagctgttggacgcttattcattggtatggcaatcatgaagtgggagatttggaagcctttttgatgatgatcccaagcaatggagaatgtatgcggacttcattggcagtgctggaaggtctgtgtagtatgccttgtttccccattggaaatatgcaaataaaatcgggctctagagagacctcttacacttctgacatctcatgcagcatttttgatctgacaacccaactatatcctgcctatttccttcctttggcatctcttggaaatcttaccaaggctgtagcaagagggctaaaagatccttcttttcgtgtgattcaaaaccactttgcaatttcaggaaatctaggagaggtagctgcaaaggaagaagtttgggaagtggttgctcaactggttggcctttctttaggcatattgattctggatacacctggccttgtaaaatcatatggtgtaatttcgttaacttggttgagtatgcgactactgcatctttggctacgttatgaatcactttcagttctccagtttaacacaataaatataaagcgtgctcgcatactggtggaggcacttataaaattatatgcaagtgagaaatatattcttatggtgaatcaacagacagaagatttgagattttatgtttctttcaagggaaaaaacattaatgccatgaagaaaaagtacaagaaattgaagaagcagcaacttgaggaattgaaccaaagtagcagtcttaggaaatgttgtttctcactgatgattggtaaggttggagctacaaatgtatcggtattgcgaagtgtgtggcagagtttctggctaagtgagaactgggatagcgatgataatgttcgtgatcaaattgctactagcctaatggaattggaagaaaagtttgaggatttcattcaaaagttgaaagatgcagaatgggatacccagcaattaaatttgaaggttcccaaagaaatcttcattgatgacaataccaattctctctaa

SEQ ID NO: 105193 - DNA, 337 bp, Glycine max
  Peptide Sequence Number=SeqID_221971
gaagcctcctttacaacaaagagaagaacaagatgaaagattctaagaatacaagtggtaaggatgtctccttcacctctaggatctcacaaccactcacaaactcatctcaagctctcagaacggcttccacttcaagctctggtggccttgttcgtgctcgtgtgcttagcgcaattctgaaccgcttagcgcacattagtgaatttcggcttagcgctggtgtgcttagtgaacatgtacagctcatcttcttccagattcttcctcgcacttatccaatgagtgttgcgcttagcgaacactcgctaagccagcagattggcttagcgagaag

SEQ ID NO: 105194 - DNA, 201 bp, Glycine max
  Peptide Sequence Number=SeqID_221972
atgtgggtaccgatagggccgaacattgacaggttctgcattcgaaaggaggttgaagggggctcgcatgataccatgcgaatatggaagaaaccactagctccatccttatggaccaaacgtcatagttgtggtggcgtaatggaccgcaactcagaaccatgtcccccttcagatccaccacaaggccaacacatatga

SEQ ID NO: 105195 - DNA, 417 bp, Glycine max
  Peptide Sequence Number=SeqID_221973
atgattctgaaacagatctgcaaaaacaaatccaaaaagctaaacagtcgattaccagttatgtgtaatcgattacacagtgcatattgcagtgaagatggagtgcctagagggagttcgggagaccctcgaaggcaatgcgaggtgccgattctgtggcacgatctgactcacggctacttcattgtggggccagtccaagtgatagaggtgatgtcatcagaggaagaccctgaggaggacccagaggagctacctcctaagcctgctgtggatgctcttgactttccagagggtgatgaggacccactccctaaggtggattctcccaaggacgtcatgtgggcatctgaggcagactccacggaggagagcggtcctgaggggatagcgactggtggaggttcttcatcatag

SEQ ID NO: 105196 - DNA, 354 bp, Glycine max
  Peptide Sequence Number=SeqID_221974
atgcctcctaaggtgtctagctcctccggcagaggaggaagatccggtactaaaggtaaagatgttatattggctctaccagagccaataaccaagaaggcaactacatcatcttctgggtcacctactcagactgggtcatcaacccagaaaggaaagcttgaagggtcattgacccagataactaccgttaaacctgagtcatcaactcaggaatccctaaaaccaacaacaacaaaacagaccgtggccgactatgcctggtcgatacaaactctcctggccttagaagacataggcctcaccagagtaccaaaattggccaaaaagacctgggcaaaaatggcctcataa

SEQ ID NO: 105197 - DNA, 336 bp, Glycine max
  Peptide Sequence Number=SeqID_221975
atggctccgaaaaagctttccacgaagagatctaggagggacgccgcggctgaagggaccagtgctacccccgagtttgatagccaccgtttcaggagcgccgagcaccagcagcgcttcgaggccatcaaaggatggtcgttccaccgagagagacgtgtccagctcagggacgatgaaagagggagtgcgggacatgcggtcataggtgaggggtcagtggattcctggcgatgggaggcgcctgcagaggctcccagcgatacagaggaagcccgcatggatgaggagatgacggatttgctcggtttcttgggtgggagcagagccacgtga

SEQ ID NO: 105198 - DNA, 174 bp, Glycine max
  Peptide Sequence Number=SeqID_221976
atgagcaagaggctccaagaggattgggctagagctattgaagaaggccctaaggttctcatgaaccgtaggccgcgcgctaagcgcaagatcagtgtgctaagcgcaacaagtgccttcagccaggctaagctcgagactggtgctaagcccaatttcacttactcgtgctaa

SEQ ID NO: 105199 - DNA, 955 bp, Glycine max
  Peptide Sequence Number=SeqID_221977
atgagtcacaattccttgaatggaactattcctcctcaaattggttccttatccaatctcaacactcttgacttgtccactaataacctctttggtagcattcccaataccattggtaatctctccaaactcttgtttcttaatctttctgacaatgatctctctggtactattccttctgaaatagtacacttggttggtcttcatacattgcgcataggtgataataatttcactggatcccttcctcaagaaataggtagattgatgaatctgagaatacttgatattcctcggtccaatatctcagggactatcccaatctcaatagaaaagttatgcaatttgtctcatctagatgtcgaaagcaacgacctttctggcaacattccactaagaatttggcatatgaacctaaagcatttgtcatttgctgataataacttcaacggttccatccccaaagaaattgtgaatttgaggagcatcgagactctccggctttggaaaagtgggctttctggctccattcccaaagaaatttggatgctgaggaatctaacatggcttgacatgagccaatccagtttcagcgggtctattcctcgtgatattgggaagttaaggaatctaaagatttttcgtatgtcgaaaagtggcctttctggctccatgcccgaagaaatttggacgttgcgtaatttagaaaaacttgacataagcatgtgtaatcttattgggtcaattcctatttcaattggagcactggtcaatctaacacttctaagtttacacgaaaaccaactttttggtcacattcctcatgaaattgggaagttggttaacctccaaattctatatctcggaaggaataatctttctggcttcattcctcctgaaattggttttttgaaacaacttggtcaacttgatttgtctgataactttctctctg

SEQ ID NO: 105200 - DNA, 249 bp, Glycine max
  Peptide Sequence Number=SeqID_221978
atggacccaatcatgccaacgtggaaggttcgcgaatggagaagacgaggcgttatgaaccgacacgtcgcaatcagagatgggttgtttcatcaaggtggtccaggtcccagagagttcggagatgacaccagaagcaactcgtttgctgtgggtgtgtcggacttactcactactataccccatttttctctctttgctctatccatcggtgtcctcgtttttagggttaggcttatggtttgttaa

SEQ ID NO: 105201 - DNA, 189 bp, Glycine max
  Peptide Sequence Number=SeqID_221979
gctaaggtaaccatcacgaagcttaatgaggagaggcgcaggaccactcaagaaaaagatttactgctgcggcaggaggaactagacaatttgttgttcagaatttctcaaatttctcaaatttctccattgggtgttcattcatggcttttggaagatgcaataagcaataaatatttacttatctga

SEQ ID NO: 105202 - DNA, 378 bp, Glycine max
  Peptide Sequence Number=SeqID_221980
atgaatctaagagggagagaagtagagataagtgacccaatgtgcccgttatgcaacaattcagaggaggttgcagcacaccttttcttcaattgcatgggtggtttcccgaaagaacagaaagatcatttcatgcagcacagccgaaggaatgctacacgaacaaaagatataagatggagctattggtggatagccctcacaaggaccatatggcaacatagaaataaggtggtctttgataaccaaacttttaatgcaagcaagctgatggatgaagcacttcttctagtctggtccttgcttaaagctatggagaaagatttcgatacacattttaatcaatggtcttccaatttgacacatgcctttgtgtaa

SEQ ID NO: 105203 - DNA, 1401 bp, Glycine max
  Peptide Sequence Number=SeqID_221981
caacaccaccgacggcgtggtgctgaacatggtggagggcctggttggctaccggagaatggcacggtggcgccgctgctggccaagtcggtcgatctgtccgaagacggcctgacctacaccttcaagttgcgcgacggcgtcaagttccacaacggcgcgccgttgacgtcggccgacgtgctgtggagctggcagcgctacatggatccgaagacggactggcgctgccgcagcgacttcgacggccgcaacggactgaaggtgacggacgtgtcggcgccggacgcgcagacggtggtcatgaagatcgaccgcaagtcggcggtgttcctggattcgctcgcgcgcaccgattgcggcatgacggctatcttgagcaaggattcggtcaacgccgatggctcgtggaagcagccggtcggcaccggtccgtaccagttcaaggaatggaagcgcggcgagtacgtgttgttgacggcgttcaaggattacgtgtcgcccggcgccggcgacaagccggacggctacgtcggcgccaagcgcccgctggccgacgaggtgcgcttcctggtggtgccggacccatcgacggccaaggccggcctggtgtcgggcgcgatcgacgccagccagatcaccattaccgacgtggccgagctgaagaacaatgcggcggtgtcggtgatgagcccgcacgacgcgaccaagcacacgctgctgttccagacgcaggatccggtgctcaagaacgtcaagctgcgccaggcgatcgcggcggcgctggacattccgcaggtggtggcggcggcttccgagggcctggggcagctgaacaattcggcggtgtatgccggctcggcctattaccaggaagccgagaagcgcacctacaaatacgatccggcgcgcgcgcagcagttgctcaaggaagcgggctacaagggcgaaccgatcgtgatctacgccaacaagcgcgcgcacgtgccgagctatcaggtggcggtgatcgcgcaggcgatgatgcaggcggtgggcatcaatgccaagatcgaggtgctggaatgggccacgcagctggaccgctacaacacgggcaagtaccagatcagttcgttcacgttctcgtcgcgcatcgatccggcgctgagcttcgagcagttcgcgggcgacaaaagcaagcagccgcgcaaggtctgggatgatccagcggcgcagaagctgatcgacgagagcttcctggagtcggatccggcgaagcggcagaagttgtttgaccagctgcatgcgttgatgctggagcagacgcctttgttggtgctttataacggggcggatgcttgggcgaccaacaagcgggtgcaggggttttcggtttgggaggggaagccgcgggcctgg

SEQ ID NO: 105204 - DNA, 192 bp, Glycine max
  Peptide Sequence Number=SeqID_221982
atggatttgccgatcatgcatgacagtgatcgctatgagcttgtgcgtgacattggttctggcaacttcggtgtagccaggcttatgagggacaagcacaccgaggaacttgttgctgttaagtatattgagagaggtgaaaagtgtatatcaatcaaccaaccaatgattgggcttagccgaagagactaa

SEQ ID NO: 105205 - DNA, 303 bp, Glycine max
  Peptide Sequence Number=SeqID_221983
atgccattgtgcaccactttatcgtgtcaacctagggtcgccacgtggaatagtagggaacgttcaaacaatgacatttttggtgtagttgaagagaatggctctattgttggcgaagatgaagagggtggaatctacattggggaggaggtggttcgtggagtactagtgacgggcagaggggagtttgagccagtcgcaagtggtagtggtggtggagcaagggaagaaggtgcaatctttcttttcgtcgtcgtcaatggtggggcatgggcggtgccacattcatattccaaaagatag

SEQ ID NO: 105206 - DNA, 564 bp, Glycine max
  Peptide Sequence Number=SeqID_221984
gttatattgaccccaacacatttagcaattgtgatggaatatgcttctggaggagagctatttgagagaatatgcaatgcaggaaggttcagtgaggatgaggcgcgcttcttcttccaacaacttatatcaggggttagctattgtcatgcaatgcaagtatgccatcgcgacttgaagttggaaaacacattgttggatggtagtcctgctcctcgtttgaagatttgtgattttggctattccaagtcctcagtgctacattcacaaccaaaatctacagttggtacccctgcatatattgctccagaagttttgcttaagaaggaatatgatggcaagcatgtttggctaactgatggagaaagacctacaagaatggtaaatataattctttacatgctcaatccgatatcagatcaacttgaccaaaaaatcaacttctctttctctcaggatgaaaacctaaagagtggaaaatggaaatctttctccagtgagaatagtttatttccttcgtgtgtgtgtgttggtggatgggatcaccttaaggaagaaagttaa

SEQ ID NO: 105207 - DNA, 309 bp, Glycine max
  Peptide Sequence Number=SeqID_221985
atgagttccgaatcacgcgaaagtgtggttcaggtacctgaaggagttgttgcagaagaagattccgaagcgacgaatttgaagagtgctgaattttgctttgcttctcagatttgttactcccttcaaccacatcttcatcgttcttctacaagagtttccaaggagtcttggatggtgggtctattgtgggaagctttgcataggtcatgcttccacctacatcgaacatggttgttactagatctattagtgttgcaacactactctacacttgcattggaggtggtgaagggagttgcaagataa

SEQ ID NO: 105208 - DNA, 129 bp, Glycine max
  Peptide Sequence Number=SeqID_221986
atggaacaaagcttggagctaggtcaggaaatgagggatttcgacgactcagcagtccagcacgacagcaatgacgacaaccaccacgacgcgagtagctcagcgagagtcattttgggagtagcttga

SEQ ID NO: 105209 - DNA, 216 bp, Glycine max
  Peptide Sequence Number=SeqID_221987
atgaaggacaatccaagtagccccaaaaacacccatcttcatgccattcaagagatcaacatcaattttgtcgatgcaccattacaacgaagtctctcacctatcactttcacaaatagggacttcaagggtatcaacctcgtcaaccaggatgaccctgtggttgtctccatcatcattgcaaacttcatggtgtccaaggtcatcattaactag

SEQ ID NO: 105210 - DNA, 624 bp, Glycine max
  Peptide Sequence Number=SeqID_221988
atggccgctcatgccactactactggtgtctctgtctacctcggtcttccactttatctcttcttttgcctacttcatggttccaatgctgcttctcttgtcggtcttagtgcttccttattgctggttgcacttctgttcagcttgtctaactttgttcctgaatctagacatttcttccatctagatgtagcccttggcttgttcgtgcaactcgtccatgctattgaggggttttttgcacaatctgtccatgaacttgtcgggccattgggcgaggagcatgtaatgaaatgctacctctgggttaagatttcaggcagtcaaggtcatgcagtgagatctgttggtcgtgtactgcacactaaagcgttcgacgagggtgtcaaagatgcgtctaaatgctcatctggatctgtggtcccatcatactgctcaaggttgagtggtttccactccaaggtcaggaaatgtgtgagcggagtgctcttcgccctaggggcatctgatatgagcttccagatgatcgtgagtatctgtgtctatcataactgccaaatgaggatgggagccttcaaaaagggtctcgcgtttgaggcaagaccgggtgctaaccatggatga

SEQ ID NO: 105211 - DNA, 1170 bp, Glycine max
  Peptide Sequence Number=SeqID_221989
atgaaattccctaccctaattgggaagattgtaaccgtcaaggaagaccaaaagcaagcacaacagtgctacacagagagcctaaaggtagcaccttatcctcccaccaaggaacctgccaagcctcaccccacagcggcggaagatctgcatgatgacacctctgacagaggcccaaaacccatcgaagagcttgtcaagctgcagctcggacctaaacctagacagtgtatgcagctcagtagggacctcaccagccatgagcttggcaatgctgtcaaagaagaagtggacaaactccttaatgctaacttcatcagagaagccaacggaaaatggagaatgtgcatcgactacactgatctaaacaaggcatgccccaaagatgcttaccctttacctagcattgacaggctagtcgatagagcattcaagtttcaagtgctaagcttcctggacgcttactccttatataaccaaatcaggatgcatgtttcagaccgggagaaaacaacatttatcattgaagatgaaaatttttgctacaggattggacaaaatgttgaggtatatgtggacgacataatcgtcaagtctcaaagcatagcccaacatgtggcagatctagaagaagtctttgggaaactccgcaaatataacatgtgcctcaaccctgaaaaatgtactttcgaggtaggcggaggcaaattcctcggcttcatcataactcaccaacggattgaagccaaccctgacaaatgtaccaccatactggagatacacaacctggccaacatccaacaagtccaaaaactaaatgataggctagcatccctatccatgttcctcctgaagctcgccgaaaaggtgaagccattttacaaactgctcaagaaaattgagcccttcctatgggacgagacctgcaaacaaactttcctcgcttttaagaaaatcattgccacaccgccagttttgagccgacccaaaccagaagtacccctactcctatatctctcaaaagcttacaaattcgttagctcaacccttatacaagaggaaaggaagcaccatctccctatatatttcaccagccgcatactccatgacactgaaaagcgttaccatatgatagaaaaggtggctctagcacttattacctctgcttga

SEQ ID NO: 105212 - DNA, 168 bp, Glycine max
  Peptide Sequence Number=SeqID_221990
atgattggtcttaatcttgaagatgatgattcaacccttgatacttatcacactcctttctccacacacatgcctaacatcaatggacaagaagaagcacatggctacaccaccgagctcccattctcccgagttagcaccttcactgtctacattgaagaggactag

SEQ ID NO: 105213 - DNA, 315 bp, Glycine max
  Peptide Sequence Number=SeqID_221991
atgacaaaaggtgtagaagatgacgttagtcttaatgcgtcaaggggcatgcttcccccgtggttgacgaaaggtgcagaagacgacgttagtctttgcgcgtcaacaggctcgtttgcccctggttggcgaaaggtgcagataaccatacggtacccccgcctgccacctgacttcccggggttaacagaaatcgtttgtacggataaccgcttgggtatctccgcatgtcaccgaactcgccgtctctggatgacaaaaggtgcagaagacgatgttagtctctacgtgtcaacgggttcgcttcccccctga

SEQ ID NO: 105214 - DNA, 297 bp, Glycine max
  Peptide Sequence Number=SeqID_221992
atggttatccgcacatttcgtcaaccaggggcaaacgagaccgttgacgcgcagaaactaacatcgtcttctgcaccttttgtcaaccaggagggaaacgagcccgttgacacgcagagactaacatcgtcttctgcaccttttgtcatccagagacgagacagcaagtccggtgacatgcgggggtaccttatggttatccgcacctttcctcaaccaggggcaaacgagctcgttgacccacagagactaacgtcgtcttctgcaccttttgtcatccagagacaggtagtctga

SEQ ID NO: 105215 - DNA, 201 bp, Glycine max
  Peptide Sequence Number=SeqID_221993
atggagcatgaaacattccttgcaacttggttggcagagattgattcctctcccaatggcttgagattctcaaatttgcaaccacagcctaggttgatcaaccatgaaaaacctatgctatgtaggtggcacaagcttaatcccttgaaaattaagggtaggagatttgccctggattcagctaaggactactttccttag

SEQ ID NO: 105216 - DNA, 297 bp, Glycine max
  Peptide Sequence Number=SeqID_221994
atgtctcttgcaactctttttggaaaaaagcttcaggaacatgaaatggaacttatgagactccatcaacatgaagagaatgacaaaaagaataaaggaattgcactcaaagcctcgtcatcttctattcaagaaaaaagtgacaaagaggacttgaatgagatagaagaagatgatgatttcagattttttgtgcagagattcaatatatttatgagaaacaggaaatcaaaggagatcaaatatcaatccaaagaagaatggagaaaattcctccttagccctaaaatgctttga

SEQ ID NO: 105217 - DNA, 981 bp, Glycine max
  Peptide Sequence Number=SeqID_221995
atgtatgttgagatttataagcatcctaaagaagaaagaatagcccgaacttggggaaccactgcccctggcctaccctatgttgaacaaactataaccaatgctggaaattggttgattgggggtgacctagaggtcattgaaccaatccagtacaatgatggacttgatcattttcggctgtctccagcagaactccgtgcagagttcacaaggcgcaatgcagatgctgtgtttgccttccagctccggaatcctgttcacaatggccacgctttgctaatgactgacacccgtaggcggcttcttgagatgggttataagaatcctgtcctcttgcttcatccactgggaggctacaccaaagctgatgatgtcccacttgattggcgaatgaaacaacatgagaaggtacttgaggatggtgttcttgatccagagaccactgtggtatccatattcccttctcccatgcactatgctggacccacggaggtgcagtggcatgcaaaggctaggatcaatgcaggggctaacttctacatcgttggtcgtgaccccgcaggcatgagccatccagttgagaaaagagatctgtatgatgctgaccatgggaagaaagtattgagcatggcaccgggactagagcgtctaaacattcttcctttcagggttgctgcatatgacaagactcagggtaaaatggcattctttgacccttcaaggcctcaggacttcctgttcatatcaggcacaaaggagtacaaaaataggaaacatttcatcaaccaaatggcatcttttaggcatcaaggatgtctaactaagtgggttgaacaaaatatgcgcacactggcaaggaacaaagaaagccctcctgatggatttatgtgccctggtggttggaaggtactggttgaatactatgatagcttagtactctcaagcaatggcaaagtgccggaagctgttccagcttaa

SEQ ID NO: 105218 - DNA, 2505 bp, Glycine max
  Peptide Sequence Number=SeqID_221996
atggcgatgaaggcttcgttcggcaatatggcagacactctccttgactgggatgacgcgcataatgacgacttttgttcttggcgtggagttttctgtgacaatgtcagccttactgtggtttctctgaacctctccagcttgaaccttggtggagagatatcaccagccattggtgacttgggaaacctgcaatccatagacttgcaagggagtaaactaaccgggcaaatcccagatgaaattggaaactgtgcagcactcgttcatctggatttgtccgataatcagctttacggtgatatacctttctccttgtcaaagctgaagcaactcgagttcttaaatttaaagagcaaccaattgactggtcctatcccttcaactttaacccaaattccaaacctaaagactcttgatgtgagaggcaataatttgactggtaccgtacctgacagcattgggaactgcacaagttttgaaatcttgtatgttgtgtatttggtatttggtatttgggacatatcatataatcggattactggggagattccatataatattggatttctgcaagttgctactttgtcacttcaaggaaatagattaactggggagattccagaagtgattggtttaatgcaagcccttgcaatattggatttgagtgagaatgagttagtgggaccaattcccccaattcttggcaatctgactttcactggcaagctgtaccttcacggaaacatgcttacaggttcaatacctcccgaactcggcaatatgtccaaactgagctacctgcaattgaatgacaaccacctagagggtaatattccaaatgaatttgggaagctagaacatctttttgaattgaatcttgccaataatcatcttgatggaactatcccacataacataagttcttgcactgccttaaatcagttaaacctctctgcaaacaacttcaaggggattataccagttgagttggggcatatcattaatctagacacattggatctatctagcaataatttttcagggaatgtgccagcatctgttggttttcttgagcatctcctgaccctgaatttgagtcataaccaccttgatggtcccttgcctgctgaatttgggaatctcagaagcattcagattcttgatttgtcattcaataatctctctggtatcattcctccggaaattggacagctgcagaaccttatgtctctgattatgaacaacaatgatctgcatgggaagattcctgatcagttgactaattgtttcagtcttacctcactaaatttgtcctataataacctttccggagtaattccttcaatgaagaacttctcacggttttcagctgacagagattttttcgagagttgctgttgtatgcctcacgcttggaattatgatattgttggccatggtcctccaaaactggttattcttcacatggatatggctatccacaccttggatgatataatgagaagtactgagaatctcaatgagaaatatatcatagggtatggtgcgtctagcactgtatacaaatgtgttttgaagaattcccgaccaattgcaattaagcgactgtacaaccaacaagcacataatttaagggagtttgagactgaacttgaaacagttgggagcattagacatagaaaccttgtcaccttgcatggatatgctcttactccctatggaaatctccttttctatgactatatggcgaatggctcactgtgggatcttctacatggtcccttgaaggtaaaacttgattgggaaactcgcctgaggattgctgttggagcagcagaaggacttgcatatctccatcatgactgcaacccacgtatagttcacagggacataaagtcttcaaacattctgctggatgagacttttgaggctcatctttctgattttggcactgcaaaatgtatctcaaccacaagaactcatgcatcgacttatgtccttggaactataggctatattgaccctgagtatgcccgaacatctaggctgaatgaaaaatcagatgtatatagctttggcatagttctgctggagctacttactgggaagaaggcagtggacaatgagtccaatttgcatcaattgatattgtccaaggcagatagcaacactgtaatggaaactgtggatccagaggtctccataacttgcattgatctggctcatgttaagaagactttccagcttgctttgctttgcacgaaaaagaacccttctgagaggcctactatgcatgaagtagccagggtgttggtatcactacttccttcaccactaagtaaaatccttgcccctcctgcaaagaagttcgactatgcccatttcgtgatcgagaagggacaacaacgaaaagtggaagaacaaaaacctcagcaggataacatcttacccaatgctcaatggtttgttcgttttggggatgttatatccaaaagcacttga

SEQ ID NO: 105219 - DNA, 201 bp, Glycine max
  Peptide Sequence Number=SeqID_221997
atggagaaacattccacactaaacgaaggaaaaccagaggcatcaggcagcaagaaaagaaaaaccagagaagaaataggaagcaaagcttacctgcgcggggaaggaaacgaatgcggcaatggaggcgcttgcgggaacaagaaggagaagacacaaaatggcagaagaggtatttttttggtaagcattttaaaataa

SEQ ID NO: 105220 - DNA, 210 bp, Glycine max
  Peptide Sequence Number=SeqID_221998
atggctacagccaggtgggcactcaagcatcctgtttatggcattgtgatactacggttgggaatttacacagacagacccaacgtttccaagttatgttctttcatcagttcaatgaattcatccatctttatctcggttcattctggaaaatacactcttagcatcagtcccttgtttccagaagatacgtttgctctttacgaatga

SEQ ID NO: 105221 - DNA, 168 bp, Glycine max
  Peptide Sequence Number=SeqID_221999
atggaggagcccctgggcattccattgagcattgattttcaagtgcaagccattggtcagtttgctcaagcgacctgtgctcctgagtttggacttccaagaccgttcaatcagagattactcgtcttgcacgttggtgggggtgtcgtaaaacgacgagtaaagtaa

SEQ ID NO: 105222 - DNA, 384 bp, Glycine max
  Peptide Sequence Number=SeqID_222000
atgatagcagtaatgaaggtgacaatagagacaatggtggtggtgacaacaacaagaaaaatgatgatgttattggtggcgacaatgataatagtgattggcagaagtgacattagtaatggtggtggtggtcgcaacaatgtagcaatggtggttgccacaacgatactgtataggattcacaaaagcttggtgatgctgtttctgcattttgggaaggtttgggaggtgtttgttgtgaaaagaagagataggtggggtaactggtatggattcgtgagatttataggggttcaagatgcacactcattggaaaaaaggctggatgacatatggactgggacaacaaagatgcgggttaatatcccgaaatacataaagtga

SEQ ID NO: 105223 - DNA, 399 bp, Glycine max
  Peptide Sequence Number=SeqID_222001
atggatcctaaagaccaaaggaagacaactttcacttgttcttttggagtttttgcatgcagaaggatgccctttgaattgtgtaatgcaccagtcactttccaaaggtgtatgatagctattttcttgaatttagtgggaaaatacattgagggattgttcttggtcacaatatcatcaaggggcattgaagtggataaatctaaagtggatgttattaaaaatttacctccaccagtgaatgaatttgatttggaaatcaaatacaagaagggcaatgagaatgttgtagctgatcatctctccaaatttaacaatagtgaagtgaccattaaagaagctgagatacaagaagaatttcctaatgaaaagcttctagcagtgcaacaaagaccttag

SEQ ID NO: 105224 - DNA, 177 bp, Glycine max
  Peptide Sequence Number=SeqID_222002
atggagaagagcatcacctcaacatcatcagctaccggtagtgcctccagacctttgggatatcttgcactcacaactagattgtgcaaatttcatgcttggcttggtgacaacccaattttcccaagggagatggaagctgctggtgttggtgctgatgctggtgtaggagattaa

SEQ ID NO: 105225 - DNA, 966 bp, Glycine max
  Peptide Sequence Number=SeqID_222003
atggagatgaagccatatttcctaagtttgattagtgcacatcagtttgcaggcatggatcatgaggatccatatactcatctatctactttctatgaactgtgtggcacaatgggcattcctgaagatgttgaacaagccataaggactattgatgcttttgtttcaaataattaccaagctcggcataacaaacagtcagttcaaattcacaaagtcttagatgtgatttttgtggaggcaaccatccaagtggtcaatgttctctccaataaatcttatacaaacaatttttcgcaaggttggagaaataatccaaatcagaactttggatggagacaagaagcaagttcttccaatagacaacctccaaatcaaaagcaagcaaatttttctcctatacatgaaaggatgcaaagcttgaagacaccttggagaagttcatgcaaggttggagaaataatccaaatcagaactttggatggagacaagaagcaagatgcaaagcttgaagacaccttggagaagttcatgcaagcctcattgactaataagaagaatagtgaggcttcaattaaaaacctagaaactttggagcgttggaaggcaattaatacaagaagtggaaggattattgggagtggtgttgatgataacttggctaaagaggaacaagtggatggaggcaagttgaacaagggtaagaaaaatgatagtgagagtgaagaggaaaccaataaaaaagaaagagtgtcttccttatcctcatatgcaaacaaggaaagacaattttctcattgcatggagatctttaacaggtggcaaatcaacattccctttttagaggcagttgagcaaatgccaacatatgcaaagttcatgaaggagatccttaacaataaaaggaagaagtacattggaaaggagaccattgagctagaagcaagttgtagtgccataatttag

SEQ ID NO: 105226 - DNA, 912 bp, Glycine max
  Peptide Sequence Number=SeqID_222004
atgatcacaactttccttgaaatgaaaacctttaccttcaatgtggccctgctttcaatttttggaaaagatgagaatctctatggggaggatctgaagcgatgctactacaccctcgagagagggtacaattcaatgcctataaaccttccaggaacactgttccacaaggccatgaaggcaaggaaagagcttgcacagatcttggctcaaatcatctcaacaaggaggaatatgaagcaagatcacaatgacttgttgggctcgttcatgagtgaagaagcaggactcagtgatgagcaaatagcagataacatcattggtcttatttttgctgctcgcgacaccactgccaccgtacttacgtggattgttaagtaccttggtgaaaacaccagtgtcctagaagcagtaactgaagagcaagagtcgatattaagggccaaggaagaaagtggagaagaaatgggtttgaattggtcagacacaaaaaatatgccagtgacatccagggtcatacaagagactctaagaattgcatcaattttatcttttacattcagagaagctgtagaggatgttgaatttcaagggtatctcataccaaaagggtggaaagtattaccactttttagaaacatccaccatagtcctgacaacttcaaagagccagagaagtttgatccttcaagatttgaggttgctctaaaacccaatacttttatgccatttggcaatgggacccatgcatgtcctggcaatgaattagctaagttggagattttggtgtttctacatcacctcaccacagaatacaggtggtctttgatcggagcaaaaaatggggttcaatatggcccttttgcgcttccacaaaatggattgcgcatcacactatatcccaagaaataa

SEQ ID NO: 105227 - DNA, 225 bp, Glycine max
  Peptide Sequence Number=SeqID_222005
atggaactttttcaaacaaaaacaacgctactaggaaatagaaccacactacccacgaaacaaaagacgagagaaaagatgcaagacaaaattcggatgggtggacagaacgaagaaaacgaaaagaaccaaagggccgccgtcattcgtactcgccgtttcccagcgtatttgacagctatcgctttcccatttacttacgcgcctctcctcgcgtgcatttaa

SEQ ID NO: 105228 - DNA, 333 bp, Glycine max
  Peptide Sequence Number=SeqID_222006
atgaaaaaatggtgggggtacgcaccttcaagctttgcggatttggtcttcgccggcaaaaggatcgaaacgggtctgaaaagaggcaaatttgatcatcctgctttgatgaatgagaaaactggggcaaatgaagaggatgagaatgaggaaggaaaccatgttgaggttgtcattcctacatggccaaacttcgcaccagcccaacaatgtcattactcagccaatattagttgttctcattacccaccacctagtcacccacaaaggtcatccctatatcaaccacaaagcctgctcgccgcacatccggtgcctaaacaccacctttag

SEQ ID NO: 105229 - DNA, 2714 bp, Glycine max
  Peptide Sequence Number=SeqID_222007
atggctgataccaaattgggcggcgtatattacgaagtcgatattgagcttgagaaggcgcttgaaaaggtggcaaagctcgataacacacttgatggcatgggtaattccgctgttaaagcgggcaagcagatcagcatcgcagaacgctcaatgtcatcgctttctcgcgtggccactgcgcttaccgcagttctgtcagttcagcaggtcgctgcctatgctgatgcctgggcgaatgtgaacaacaaactggctaacgctgtcaggccgggtgagcagttagcgtctgttactgagcgagttttcaacgtcacccagcaaactcgttcaagcctcgatgccactgcctcactgtatgcccgattagagcgagcgacccgccagtatggaaccagcgcagatgacctcgctaagctcaccaccatcatcaatcaggggtttgtggtatcgggtgctactgcacaggaagctgaaaacgccattatccagctctcacaaggtttagcctctggcgcactgcgtggcgaagaatttaactcggtgaatgagcagggaaaccgcctcattgtggcgctggctgattcaatggatgtcaccattggtcaaatgcgcaatatggccgcgcagggaaaactgacgactgatgcggtggtcaatggcctgctttcccaaggggccagcatcgggcaggagtttgccagaaccacagcgacaatcggacaatctctggaggttgcgggtaataatatcacccgttttattggctcatctgcgaccgttaaagccgctgttgccgtgttcaatagtgcggtgatcacattaactgaaaacctcgattcaatttcgacagccgttctggctgtaagcgccgtgatgggatcaagatatgttggtgcgctggcagctgctacagcacaacaaatcgctaatgccgcagcagcttacagagtcgcaacagcacagggagctatgacggcggcagcggctggtgccagaggggtcatggcgctgattggtgggcctgctggcgcagctactctggcagcagcggcaatcttctatttctaccaaaaagctcagcaggcaagacaagaagccaacaatttagccgacagcgcagccaatctcgcagccaagtttaaggatatgtcagccactgaggttggcgcatcaattgcgcgcctgcgagagactatcccgagcctaacggacagcgtcgaggatgcgcaaaagacgtttgataacaccgtttatcgtgtgcgcgatctccgtaaagaaatcgataactggggtactggaaccacgagaggccgtcaggcatcagaggctttatcaggtgctattgatcagcagaatatcgcagcggaatctctggaaaaagctcaacgccgcctgagtcagacacaaagcgccatcatccttggccaggcccagttaacaacaggcttgaaaacaggcatcgacttgctaagtcgtgaaacaacggctgctggtgacgctgctggaatgatgtctcatttcgccaagtcgataaatcaggccgctagtgcgaaggagcgttttaactccaccagcctgattattactcgtccgaaagacattcaggactacctcgacaaccagcaggaacaaatcgacctgcaaagtgagtttaacgagaagaaacgcgcccagctcaaagctgaaatggacattcgtaatcttgccaaaaaggacggaagcaccaattccgaccagatagagcgtgatgttcagctggcacgcgaaagggccggtgtgacattcgaccagcagaaagcagaagaaaatcgccggaaagcccagcagcagagcgagcagcaggataagcggtcagcctcttcggctgaatctgtttctcaaaagctggaaagcctgcgtcagcaatccgaattatcagccgactctacaactgaaatgagccgcgctcaggccgttcttcaggcccagttgtcactgggtaaaggggccactcaggagcagattgcgctggccggtaagtatcgtggcgagatatgggatacgtccgcagcaatccgcgctcaggctgccgctatgaagctaatccctgagcaggctgagaacacacgctataagcaggatgtcgctgacctcaaaacggcgctggagcaaaagaccatcactcagcagcagcatgacgcagccgccgagcaaatggagcaacagcaccaggtcaatttagcccgaatccgggcaacgcagaatgccggagtgacatcacttcaggaagctcaaggtgctatcgacccggttcaggcactggctaatgagaacgccaaaaagctcgcgttaatacaggagttcgaaaccgctaagggacaaattaccctcaatggcctggcattaatgaatgctgccaacacgcaatacgagcaacagcgcatcgcggcgcagtgggaaatctatcgcaaccagagcgccgctaacagccttctggctgacgcagttgattctctgcagggtggcgcgacaaatgccattaccggccttctgaacggcactcagagcctcagtgaggcattcgccaacatcggcagcacaatcctgaatagtgtggtcagtggtctggtagagatgggcctgcagtatgtgaaaaacatgctcatgggacaggcagcagcatcagcagcgcttggggcaacagcaacgcaggcaacagccgcagcagggat

SEQ ID NO: 105230 - DNA, 261 bp, Glycine max
  Peptide Sequence Number=SeqID_222008
gtgatcgccgcccagccacacgcgatcgcgcgccaggccaacctcatccgccagatgccacagcgcatcgcggaactgggccgccgtttggccggtatagccgccgaactgattgacctggttggacgtcgcctccaccaataccggcgtgccgcgcgctttggcctgccgcagcgcggccttcagaacccagggatgggcggaacagacggaaaagatcccgaccggcataccggccttgtgctgctcgacaagctgtaa

SEQ ID NO: 105231 - DNA, 468 bp, Glycine max
  Peptide Sequence Number=SeqID_222009
gccggcggcggtggcggacaacgccagctgctgctggatctgttccagcagcgggccgacgctggtcagggcggcgcgcaggttggccgcgatcagcataatgccgacgatcagcagaacggggcgggcatgcagtcaatcagtgctgcatggcatgatgcgttgattgacgttaacgcttacgtaccgacaaatcgacggtatccgatcgcaagtgtagggaagatggcgcgcgctgacaagggtatgacccggcgggatggcggcggcgccgctttcgctttcctcgcagcccgcacctcggcgctccgggcttctcgcccatcctggcatttcactttttctcccttccgctttttggcttttcgatccgtttcgattcgaaagagcgaaagccatcttctccccggcgatgccggaaacctgaggaccgcagctcatgccagtgaataccgcaaagcgacgtga

SEQ ID NO: 105232 - DNA, 174 bp, Glycine max
  Peptide Sequence Number=SeqID_222010
atggcaaatgcactatcattagacaaacctattggcacaataacctctatggaaaaacaacatatcaatatggggatagacgatatgatgtatcaattgtctaaacagttggcaaatgtcatcaagcctatggttcacattgaatttcagcaagctgaagaatttgagaacgtg

SEQ ID NO: 105233 - DNA, 1554 bp, Glycine max
  Peptide Sequence Number=SeqID_222011
atggctggggatgatgaatttgatagatggatttctccgattgaaatgacgctgaacaccctaacaaataaaaaagtcagaggaaatagcatcgtagatattccagaacaccttaaaaaatcgaacatgaaagcttacaagccaaaggtggtctctattggacccctacaccggaaatctagtagggagctgctatacatgaaggagatcaaatggcaatgcatgttgtctcttcttcatcgacttaatccaaccgatgatcaaaaagttgtgccaccgaaacgcttgaaagattgcggcgaagtcattttaaagtatgatgaggcagtccgagcgtgctacatggacccaatcgaattggaccgccacgaactcgcccaaatcatgctagtcgatggctgttttctgcttgagctccttctcattactaacgacaagcaattaaatggcgaaccaaaaagcaaattccctgttaaagtctcaaaaagggaagaattcctgtctgatttgaaattacttgaaaaccagatacctctgttcattattgatttgttgtatctaaaactgtttgggcaaaaatcggaagggataccgaatataatcaatggctacgcactgtatctctttggttgttcttctggccgccctataataagtccaaacagggcacaccttcttgaactcacgcactggttcttgactagtaggcaaattgaagctaaaccagatcaagaacgcagcgcccccgaaactgttgtagagcttacaattgatcctccggatcatgaacacatggaaagcatggacatatggctccgagagagggacgaacgtgacaaaaaagtcagcaaagaaactacacctaaattagaacgttgcgctgcgaggctccaagctgcaggggttaagattaaaaccttttatggaaagaaccgaagcagcagcaaattagaaaaggatcctgtaagtgtcatgtttggctgtaaggaaaaattcgagcagggagtgctagaaatccagtctctgtgtattactgaggaaaccgaacttcagtggcggaatttcattgcttgggagcagaccagatctgccgagaaaacttgggagcagacaggaaccccagctaccgagaaaaaattcagtcagtatgctttgttatttaaaggtttggtttgttgcgagtacgacatagaactgctcaaaagtgccaaagtcttgaaggtgcacgatgaaaacaagtggagcaatgagaaggtgaacaagttcattcatgacattgccgagggaattcaaattgatgccagcgcggatcccaaattttgtgaaatgattaatgacttgaacagttgtgacaaaggatgctgcagattcatcatgttcaagcattgctgccgaatccttctcacaaaagcaaggaaattctgcaggtacttgtaccgtcttttgatgcgtgactattgttccacgccgtggcaaacgttaggagtaatggctgctgtcttgctgctttttctcaccattgcccagactgttcttgcagccattgccctgtag

SEQ ID NO: 105234 - DNA, 543 bp, Glycine max
  Peptide Sequence Number=SeqID_222012
atggcaagatggatacagtcaacgacaaacagcctgattgctttagctgtgggtcgccgccaaaacctcgctttaagacagaggaagaaaaacgaatctcttttggagaaaagtggtttccgaccgtttcaaaatgcgacccaaagtacgacgatctggggatctaagatccgtttccagcttatgagctctatccatcgtgacaaccccttcggtaaggggtctaacatggacgagcttgatcaaatgaatgactcagcttcagcaagggaatccgatgaacgtccctcagatatacgaaagaccggggttttaaattgcggtaatgatcacgatggcaatgagtcagaaaacctatgcggtttatgcactcctaatttcggtgttacgaatcaccgtcgtagatttttgagtttatatattctcgcaacaaagcaccagcgcccttgcttgcctgaattacaactcgaaaaacctagcgcctcgactgcaacccttgaaaaacctagcaccgccgtgaagtccgtcccgctaccagcctga

SEQ ID NO: 105235 - DNA, 369 bp, Glycine max
  Peptide Sequence Number=SeqID_222013
atgacttgtctcagggttgactcatgtgactggggaaggttaggtgggttttcatttggaaggggaggaatggaaattaatggaattaatggaggagaattggaggaggtaagcggtttattagataggctgctgtttggaaggcaaaggtccagaaaatgggagaaagggatgcatggtgtagtagacaacgagccatctcaattaagtgatgatgtttacgttcagaaacaccattatgttcaggggtataaggtggggttttcatgcccccaaacatcaaagtacacaatttctaatggatacgagctagagatagaggacctagaaaatggaaagcttatgactcttattggaaagacaatctag

SEQ ID NO: 105236 - DNA, 942 bp, Glycine max
  Peptide Sequence Number=SeqID_222014
atggatgtcaataatgcctttttacatggagttatatctgaggatatttacatgtctcaaccttctggctttattcatccatattttccaaatcatatatgcaagctccataaagcattatatggtttgaagcaggcacctcgggcatggtaccaggaattaaagtcctttgttgttgcctatggatttttcaatgctaaatctgattcttcactctttatttataaacaagatcatgtctttgcttattttttagtctatgttgacgatcttcttcttacgggaaatgatgtcattttcctagccaaattcaaagcagctcttgctacaaaattttctctcaaagatcttgggacgtcgagccacttccttggtgtagaacttcttcctaccgctaatggcatgttcttatctcaacaacactacatttgggatatcttgcaaaaagattggggtggtgatacaaatgacaaaaagtctacaggtgcctatattgtctatcttgctccaaatgctatatcttggtcttgcaagaaacaatccacatttgcaagatcctcaattgaggctgaatatcgcatcattggattaattgcttctgaacttctatggctacaacaactactattggaacttggcatcaaattaaccaagcaaccaactatcttttcagacaatattggtgccacatatctttgtgcaaatccaatttttcactcaaggatgaagcacttagctattgattaccattttgttcgtgacattgttgccaagggtgaactcaaagtgtctcatgttccttccagtcatcaactagcagacttgctaactaagccgctctcctggccacgccatgagtttctcatcaccaagattggcgtcgttacctcctcctccatcttgcaggggcatattagtgataaattcaaacatagcatttaa

SEQ ID NO: 105237 - DNA, 192 bp, Glycine max
  Peptide Sequence Number=SeqID_222015
atggaaaaccgttgggcccaaaggaagtggatcagagtagaagtggacgagaagttgagcacatgctcacatggtttcgcacatgaagagctctctatcccacagggtcacgacaacaattcactgtacaacgtttatgccgcacatagacttcaaaccaatgctgaccctcttcgtatctatcctttataa

SEQ ID NO: 105238 - DNA, 564 bp, Glycine max
  Peptide Sequence Number=SeqID_222016
atggcgaaatcgagcaaagatccgatgacgtctcaggagcgagtcgaggagaaaatctccgttgtcctggaccgccgcgacgtctcgttccgggagacgcccctccacctcgctgtccgcctcaacgacgtcgccgcagcgcgcgccaaagcctctgttagcgtcgatatctccctccacaacgccgttggttggaacccgcttcaggaggcgctctgcctgcgcgcctctgacatcatgcaggtcctcgtccggctccaccactgtgccgcctgggccaagtggtgccgccgcctgccacgcctagtggtggctctccgtcgcatgcgtgatttctacatggagatctcgttccacttcgagagctccgtgattcccttcgtcggaaagatcgctccctccgtgattcaattttttaaaggctgttcattggtttcttctgtggttttcgggagaagctgttgcaagagagagaatagtgagagaatgaaggaggttttcaggagaagctgtcgtggaggtatcctacagcacaaaagaatttcaaattctttcataaaatga

SEQ ID NO: 105239 - DNA, 351 bp, Glycine max
  Peptide Sequence Number=SeqID_222017
atggagggcaatgatgctaacaggctccatggaccaccaaattatgctaccttaacaccgcaacattgtacccagaatttcactctgaacaatgaaacaattgaaggccaccagagacaccgtgaccgcattttgacccatgtggattcatctcaagtgtttaactctatttttcctttatactactccaaattgcacctttccaacaacactaacagtccaaacacctcatcaaacagcaacaacaacaacaccaatgctgacgaagcaaatgctctcctcgaagaccgaacgcagaagaggatgttcttcaacagagaatctgctcgtaggtcctctaggccatgttga

SEQ ID NO: 105240 - DNA, 792 bp, Glycine max
  Peptide Sequence Number=SeqID_222018
atgaaacctcgtctttctgaggataactttgttacttgtgcattaaaagacatgtatgctaaatgtggatgcttggaacaatctcggaacatttttgacagggtaaatgagaaggatgaagcagtatggaatgttataattgcaggatatggtatccatggacatgtgctgaaggctattgagctgtttggattaatgcaaaataaaggatgcagaccggattcttttacatttctgggagtgctaattgcctgtaaccatgctggcttagtaacagaaggattaaaatatcttggtcaaatgcagagtttgtatggcgtaaagccaaagttagagcattatgcttgtgtggtggatatgcttggtcgagcagggcaactgaatgaagctttaaagcttgtaaatgagatgccagatgagccagattcagggatatggagttcattgctcagttcctgtaggaactacggggatttggaaattggagaggaagtttccagaaagttattagagttggaaccaaataaagcagaaaattatgtattgctatcaaacttgtatgctggattaggaaagtgggatgaggtgagaaaggtacagcagagaatgaaggagaatggcctatataaagatgcaggctgcagttggattgaaataggaggaaaggtttatagatttcttgttagtgatggatcactttcggaatcaaaaaagattcagcagacttggattaaattggagaaaaaaaaagcaaaattggatataaacccgacacaagttgtgtgctcatga

SEQ ID NO: 105241 - DNA, 153 bp, Glycine max
  Peptide Sequence Number=SeqID_222019
atgttctcgctaagccgctatccaactgacataagtgactgtgaaaagatgaagaataagaaggttgtagcagctggtatctcgctaagcgaggcatatgcacttagcaagcaacatctgttaagcgagacatcagctcacttagcgagttaa

SEQ ID NO: 105242 - DNA, 243 bp, Glycine max
  Peptide Sequence Number=SeqID_222020
atggacactcatcttcgtatgattggtgatcccctgaatagagttcaacaggtgcagtcaccagaggcggatgttcttttctttttcaattctttcatctgtttacgtgattgtgatggccggcggttcagatcgccaacagttggtgaaccaactgcacgcaatcatggccattcaaatgtttatgtaattttatgggaaaaaaaactaagtgctttttcaaagcttggccgttggatgtaa

SEQ ID NO: 105243 - DNA, 315 bp, Glycine max
  Peptide Sequence Number=SeqID_222021
atgaagcttgtccagaaagtggagaccgcaagtaacaacttaaaggattatgaagaacctgaaatctgtgtccattgcaaagctgattgggaccttcaagatcttgataaatcagcttacaagaaaaggtacttcaaaccaaaggacaagaatgcactaatgagcacacgggaagaactagacaacatatcgtcaggtgaagaaatagaagaggaggaagaagccaacctttgtctaatgacaaacactacatcagaaggatccgattttgaatcagatgaagaagtaaatataaaaaaccttgaaactctttaa

SEQ ID NO: 105244 - DNA, 219 bp, Glycine max
  Peptide Sequence Number=SeqID_222022
atggatgagatcccagaagcattcgatataactctagttgacaagtcttccaacctcaaagttgttcttcttcaaatgaccatgctaggagttgttgttgcacttacactcatgcctacaccaaaatccccaacacttgagcctacaccaccatccgttgaaccaacactatcacctccacctacccaacctctaccaccacctcaagttcaagattga

SEQ ID NO: 105245 - DNA, 537 bp, Glycine max
  Peptide Sequence Number=SeqID_222023
atggctatgaaggttgcaatagaacaaaacctgaaggaagctccacaactggacttggatgccatcaacacgaggaagcaaaaaaggctagccacggctaccactgatgaagatagaggtctcaacagttttggcattgccaagaaaattcaaaaaaaaatcatgaatgaacagctgctctttagaagaaaaaggttatggcccaagctgctatttccccaaaaagaacaaaagttgtcaaaccagctcttgcacaaagaatctatcatttcgtccaccattccgagatgcatcaagacaagggatactaaagccaatcccaagattggtgagaaagaatggactatcccattcactggaaacaaggagaactcagcttcatcctcaatagatagtgagttcactaacgccacttccatctctcatcttcctaaccgtccattcgacacacccaaaccacgtccacctccatcccctattcactttgagaagtttagaagatcagttcaactgaaggaaaccttaacaaatgcttag

SEQ ID NO: 105246 - DNA, 825 bp, Glycine max
  Peptide Sequence Number=SeqID_222024
atggagcttataaggaaacgtttgaaggatcatggtatttttgttccatcccgactcaaagtatttagaacgaggaagaagtttatggctgggccatttgaggtagagcctatcacagtgactcattctattcctgattgctgtggactagtgctccgttgttctgatggtaccattcttcacactggggattggaagattgatgaaacgccattagatggtagagtttttgatcgtgaagctctagaggaactctcaaaagaaggagtcacattgatgatgagtgattcgacaaatgtactctcacctggaaggacaaccagtgaatctgttgtggcagatgcattattaaggaatatttcagctgctaaaggaagggttataacgacccagtttgcatccaatatacatcgtcttggaagtgtgaaagctgctgctgatttaactggtagaaagttggtatttgttggcatgtcgttaagaacatatttagatgcagcttggaaggatggaaagtctccaattgatccatctactctggtgaaagcggaagatattgatgcttatgcgccaaaggatttgcttattgtgacaacgggatctcaagcagagccacgtgctgccttaaatctagcatcttttggaagtagtcattctttcaagctgacaaaggaagatactgttttgtattcagctaaggttatacctggtaacgagtctcgtgttatggaaatgctaaaccgcatatcagagattggatcaactatagttatggggaagaatgaatgtctgcacacatctggtcatgggtatcgtggagaatta

SEQ ID NO: 105247 - DNA, 240 bp, Glycine max
  Peptide Sequence Number=SeqID_222025
atgtacaaagataagtggacccaaccttggcccatgggctcaaaaatctaccctgaggttcatgagaaccctcaggccttctttagtagctctagcccaatcctcttggagcctcttgctcatggctctggaaagcatcttgatagaatttctcataaccataatgagattcaagatattagcatttcatctctaaaggagaatttaggagaaacactgggtccaattgaaatagagtaa

SEQ ID NO: 105248 - DNA, 1359 bp, Glycine max
  Peptide Sequence Number=SeqID_222026
atggctcaattgaaagcttctcctttgtgttcaacccctgccactgctccttcccttcatacaacagggcaccttctgtaccatcagttctggaaggcaaagccttcgtcattcaaagagttggggctaagaacaagcattggtgccactaaacttaaagttattaaagcagctgcacgcagtgatacagaggtagtttctgaatccacaaaaggtggtggcctacgtggaaaattgaataaggtggtgttggcttacagtggtggcttagacacatcagtcattgttccatggctcagagaaaattatggttgtgaagttgtttgcttcactgctgatgttggccaaggtataaaggaattggaaggtttagaacagaaagccaaagccagtggggcctgtcaattagtggtaaaagatttgaaggaggaatttgttaaagattatatatttccttgcctgcgtgctggtgcaatttatgagaggaagtatttgcttgggacctcaatggcccgccctgtaattgcgaaggttcgatttgagctcactttctttgctctaaaccccaagctcaatgttgtggctccatggagggagtgggatattacagggagagaagatgctattgagtatgctaaaaagcataatatacctgttcctgtgacaaagaaatccatatatagcagggataggaatctttggcaccttagccatgagggagatattttagaagaccctgctaatgaacctaaaaaggacatgtacatgatgtctgtagacccagaggatgctcctgatcaagcagaatatgtggaaattggattagagtcggggcttcctgtttcagtcaatgggaagaggctttcaccagcatctttacttgctgagctcaatgagattggtggaaagcatggaattggcaggattgacatggttgagaatcggcttgtaggtatgaagagccgaggagtgtacgaaactcctggtggaaccatactgtttgctgcagcacgagagttggagtctttgacacttgatcgtgaaacaatacaagtcaaagattcattagcccttaaatatgcagagttagtgtatgctggcagatggtttgatcctcttcgggagtccatggattcctttatgcagaagatcacagagaccacaacaggttctgtgactttgaaattgtacaaaggttctgttattgtaactagtcgaatgagtccctttagcctgtatagggaagacatttcatcatttgagagtgggcagatatatgatcaagctgatgctgctgggttcattcggctttatggtcttccaatgaaggttcgagcaatgcttgagcagggcatctaa

SEQ ID NO: 105249 - DNA, 555 bp, Glycine max
  Peptide Sequence Number=SeqID_222027
atggccacttgcacttctctgtctctttgtcctcacactttctgttgccgccaccgccctcaccctactcgccgttcccttgcgtcgtgctctctctccccttcttccctcccagatacggatggacctaaagtactgcgtaaaagatctagaagaatagaaggtcctagaaaaagcatggaagactctgttcaatgcaagatggaagaattctacgaaggacaggatgggccacccctcagagttcttcccattggtgggttgggtgaaattgggatgaattgtatgcttgttggcaactatgatcgctatatcctcattgatgctggtgaactgaccttgatttatgcatggattgcatatttcagctatgacgagcttggagtccaaaagatcatacctgatacaacatttataagaaaatggaagcacaaaattgaagcagttattataacacatggtcatgaagatcatattggtgcattgccttgggtaatgctttcttcaaggaaatgctggcttaaaaaaactcttttgtcaactagttctctttga

SEQ ID NO: 105250 - DNA, 534 bp, Glycine max
  Peptide Sequence Number=SeqID_222028
atgaagattccaacagacttgcctgcaaaatgtcctgctttccctaaatctcgtagaaaagccttaaatgaagcagccatcattccaaaaattgttgggaaagcaaagataaaaccactagccttagagagctcatttggggtaatgattgatattagcggagcaatttattctgtgggaatgttgatatttccgacggattatatccatggaatagggatccaccgaaaattaaaatttcccaaaacaaaagagctttaccctagccgtctgagtcattgtggtgttttcgtattcttctccgcctcctcccccatttgtgctttccttgttgccaaacaacagcctcttgtgagagtcactccgtcgcgccaaagttatcgtcactgtcatgtcgtttcagcctcccataagcgcgtcctctgtgttgttctatttgcctcattcatgcatcgtcatatgcttgagacaggtagcttttatattaacacttgcactggctgcaacatgtttgaagaaggttgttgtcgttag

SEQ ID NO: 105251 - DNA, 2310 bp, Glycine max
  Peptide Sequence Number=SeqID_222029
atgaaacaagtcaatgatgttgatttgactgagattcaaggtggcgaggttgcaattactaattggcattcttgcaatggtcctgagtttgttttccaacttcacctcaaaagtgaaagttcaagagaattacaagcaaatgcacgtatgagatttgtatatctcccattcacaaagggaaaggagaatatagagagggttttggaaaagttaaagtctgatgggttcgtaataagtgaagactttcaaagctttagtcgtgtctctgttaggaggcttggtcgactacttcctgatgctcgctggactttacttccttttatggactttaggaacaaaaagggaatcaaggctcaaatattgaagagatgttcccagcggaaactgatggaggtttcaagcctacactgtccaagaagattgcagaaatacttacgcaaactcttgggttttcagactgatctagctcaccacaatcctttcaccgctgctctgaagaattttggcaataaattttctgaaaaagagaaggatgttactgttgaaattcggaaggctacaaaagtgttaactcttttaaagctacaaatggagtatcaggattggatattacaaatgcatcatcagtatgatgaagaagctgattctggcgaggatcaaccagttatcattgttggcccagcaaatgagaaggcacttggcatctcttcagatgttatcagagtccatcaggttttgaacaggaaggaaaaatcctggaaacgtgggcagaaaattaaagtgttgaagggtgcatgcgcagggtgtcacagaaccactatttatgcaaccattgaatactttttgcttgaaggatttgaaggagacgctggtggagaagccagaataatatgcagggcaatagatatcccagatgagaatggatctttcctctctgtcggggatgaagatgcaagtttggagattcgtggctctttgtctttacctataagtgtgatagattctggaaaggtaatagctgttgaaagtattgaatgggaaaatcgacttactaagaaacaacagaaatcaacttcaatttacttgccgggtgcaaaccattatgaaaatctggagactaatggggtagtttctgttgaaagtattgaatgggaaaatcgactttataagaaacaacagaaatccccttcgattaacttgtcgggtgcaaaccattatgaacatttggaggctgatggggttcctgtcatcaaaatgccaatagtgaagtatgctggtcaacctccatgtacggataagggtatcatagacctgcaggaaccatcactttatcacgaaaatagcttaattgagttttttttaaattatgacaaggaactttttgatagcatctgcaaacttgctgagagaattcaaaaagtagaaagtcatcttaataattcaaatgagaaaaaggctgaaaccgagcaggagatggtgaagctgctagagaaggttgaaccttatcaattaagcattatggactcttcgtttaccaaagacgaattgatgacaaaaattagaagtatggaaaactcgccatattctgtcttgtgcagcctttctaaacgtgaaaaaccaccgaattatttcttggaagatttaattggtgtggttgcccttattggcaccgttcagagacctgagcttagcagaatcttagcggaatatcttggtgaagctaaaatgctgggtcttatttatagatcttttgatactgcaagttcccttgagaagtataatcaaaagggagaaattgattatgagcgtgctttacatgctgaagcggctgctcttggaaaagctattagtaaccgtttccatgttatctgctttgaagatataaggccttacactgggtggttgcatgatgattctcagagaaggctagcattgccaaatccacgcattgcaaacggggaaacaccagaaggttttataggttatgctgttaacatggttgacctagacataaattccttgcagattatgacagcctcggatttcggattacgggaaacagtgttatttaatcttttcaagaagcttcaggtttacaacacaagagagaatatggtggctgcccgtacctgtatagaggatggtgctgtttcgttagatggtggcattttaagtgaaaatggaattctgtctcttggttacgggtctctctctctctctgataaatactgtcttctgcatctgctttatgtttacaatcatttttgcgtggagctcttagaacatgatgcctactgcctaacacgttaa

SEQ ID NO: 105252 - DNA, 429 bp, Glycine max
  Peptide Sequence Number=SeqID_222030
atgccgatctccccctgcgaaagggtcgcgcccacaagacacccagtggacccagaggagcccaacagggccctggggtttccagctctagttacgggcctctgtcaatcctacaggatgcccgtccccccagcaaggtcatgccatcgtgacatagggatcgcgcctgcaagacacccagtggacccagagaagtccaacagggtcttggggtgcccagctctgattacgggcatctgtcaattctacggagtgcctgtcgcccccagcaaggtcatcaggccccctactaaccaagctttcatcaagaagtactgcgcccccaggcagacgcagggcgaaacaccacagcagcctggggatggccggcagcgggcaacagacgcaccgccaccacctctagagttcacctcagctcatccacaataa

SEQ ID NO: 105253 - DNA, 183 bp, Glycine max
  Peptide Sequence Number=SeqID_222031
atggcgggagagaaaggaaagaaaatgagacaaaagatcgtggagttgaagaagaaggcagaggaagccactacgcccagtggttgttcattcatcaacttggacaaattcattaaggaggatactgtcttccattgtgttccttattctaatgacagtgccacaaagcaaaatagggaatga

SEQ ID NO: 105254 - DNA, 348 bp, Glycine max
  Peptide Sequence Number=SeqID_222032
atgagagtttctcgttgcattgtaacatgtctcgtgcctgtccttttttccgctagcatcttagctacacaactgggttcgccaagtgcaattggcatagctgatcatcaccatgatcacgatcaacttaaacattcaagcacaatggacaatattggaagtaggaggggcagaacacttcaaattgcaggttcaagattaccagattgcatgcacgcttgtggctcatgctccccttgtagattagtaacggttagctttgcttgtgcctcactcacggacgaatctgagtcatgccctatgtcttatagatgcatgtgtgataataaatcttacccaataccatga

SEQ ID NO: 105255 - DNA, 192 bp, Glycine max
  Peptide Sequence Number=SeqID_222033
atgcactacatcatatgggcgagagactcctattgggcaaagaaggaagaggaagggtcggcaggagaaggtgcgattggaggcgagacgactggcgggggtggcaacagcccagttgatcaccaggctgagggactcatatgtcagtgtatccgagtcaactccctgatagtcgtagagtgcggtaattag

SEQ ID NO: 105256 - DNA, 279 bp, Glycine max
  Peptide Sequence Number=SeqID_222034
atggcgccagaggacttcatccagcgagttgcgtggccgggagtccagccctctattgatgggggggtgatacctctggcgttggagatgctacaaatgacggagctgacactgattatgttgccttattgtgaagtgatgaagtatgaatcgaaaaacaagagtgaagagacaaaggatcaagctgaaagttttgatgatgccaaaggattacatgagtcatatgcttctcaaagatttactcaagacaaagcaattagagatattcaagatggataa

SEQ ID NO: 105257 - DNA, 246 bp, Glycine max
  Peptide Sequence Number=SeqID_222035
atggagaataattggacactaaagcagaataggaagcaacagagcctagtgcttaccttcaatttggagctcgtgttcaagactgagaggagcaaaccaaatggaatagccttcacttgctcaccaacacaaatcgaacagaggagctcgacccacataacacacaggaagaaggagattgacccacacacgcagaggaagaaggcgcagtcgagactcaagattgccagggagggggaaacctaa

SEQ ID NO: 105258 - DNA, 240 bp, Glycine max
  Peptide Sequence Number=SeqID_222036
atgcaagatgataactgggtaaaagctatgcaagaggaacttgatcagtttcaaaagaatgatgtttggaagttagtagagctaccaaaaaggaagaaagttgttggagcaaaatgggtcttccacaacaaactggatgaaaatggtaaggttatgagaaacaaggcaaggttagttgctaaagggtattcacaacaagaaggtatagattacaaagaaaccttcaagatttgggagtga

SEQ ID NO: 105259 - DNA, 528 bp, Glycine max
  Peptide Sequence Number=SeqID_222037
atggttggtgtcctttacaactggaggagactgcccttacacttagggcccttgacatcggtcaaagcattcaaatctacattgcagctggggaaatatatggtggggacaagagaatggcaagtcagaaaggaaacactgttggaaccatctgatcttcagttcttccaaaatcattcctctcagatggcggctttggattaccttgtctcattagagagtgatatctttgttcctacatacgatggaaatatggccaaagtagtcgagggtcatcgcagatatcttgggttcaagaagacgattttattgaacagaaagctcctagttgatttgatagatcgataccatgatggaatattgaactgggacgaattctcttcggctgtgaaggaagttcatgctgatcgcatgggtggtgcaactaagagattggtgatccctgacaggcccaaagaagaggattatttctatgccaatccagaggaatgttttgaactatcagatgttatgttgagtagtacgtga

SEQ ID NO: 105260 - DNA, 267 bp, Glycine max
  Peptide Sequence Number=SeqID_222038
atggcaggcataagattactccttctatctttgatggtgggagggaaaaatgttgttactggggaagggaagcgaaaagactctggaaaaatcaacgggagacagaactggtggaagaggcgggagcaacattcaaagatgccagtgtcgtactcacacatggtggggaaagggagtttagggaaggcatcaagggaggtgtcaatggttttcgtttatttcagagagggaattggaaaaagaacaaaaggcaaaaagggaacttaa

SEQ ID NO: 105261 - DNA, 1428 bp, Glycine max
  Peptide Sequence Number=SeqID_222039
atggtgctgagtcagctggggattgacgtgccgcgctcaccccgccagcacgctccatgccccgcgtgtggcggtaaagatcgcttccgtttcgatgacaaagggcgcggtagttttttctgcaaccagtgcggcgcgggtgatggtttagacctgatccagaaggttaatcagtgcggtacaacagaggccgcccgtatggcggctgatgtgctgggtattgattaccgggtgacagaaactgaccagaaagccgccagccagagaaggcagcagctggacgagcagcgccaccagcatgagcagcagcgccagcagaaggaagctgccgaggcagaacagcgccgtgagtgctttgtgagccactatcagaggctctcagcgcaaaccacgtcaggcgaaagtgaatatctgattgccagagggctaaacggtttcactctgccttgcttgtccgatggagcaattttgctgccgctggtggacgaatccggtggtgtggccgcagcacagaccatcacgcagcagggggaaaagaaagtgctctatggctcagccaagcgcggagcgtggcacatcgttaaccagccgcaggaagtgaaggaaatcatcattggtgaaggcttggcaacaaccctcaccgctcacctgatacggccttatgcgctggcagtggtggcgctcgatgccggtaatctaccgacagtcgcagagactatgcgccgcctgtatccgaacgccgcaatcatcatttccggtgataacgattggcatgagcctggcgaaatcgatgacaacggcaagccgaaggtaaacggcggaaagatattcgctgacaaagccgctgaagccgttaacggagccgtttcattacctcccacacactacaaggccgactgggatgattaccgtcagcagaacgggctggaggcagccacagcagcatttaacgattcactgtaccaaccgcaaggggaaagcatgggcgctcagttggaagtcattgagggaggtaaaacagcagcatccgatcccgatgtactcaagccacgaattgaaagccgtcaggatggcgtttactgggttgagccaaacaccgataagcagaccggtgaaatcatcaaccgtgaaagctggctgtgttcgcccctgcaggttatcggcaccggccgcgacgataaagaccagtttctgatcctacgctggcaggcatggggttcagatagcgagaccacgcaggcgatcccgttggccgacattggcgagcgtgaaggatggcgaacgctcaaagctggtggcgtgaacgtcacaaccaaaagcggcctgagagcgattctggctgactggctacagcggaacggctcgcgggaggtctggagagtggcgcacgctactagggtggcaatgcggcgcttatatcatgcctga

SEQ ID NO: 105262 - DNA, 2021 bp, Glycine max
  Peptide Sequence Number=SeqID_222040
gaaacgactttgccactattgtcccggttatttccggccaaatcggtgggcgtgaaaccaatattgtaagtgcaaaagctctgcataaagcattaggcgtgggtaatgacttctctacctgggtaaaactccgcattgatgaatatgggtttaccctcggagctgattacgtggtttttgattcctcagatttcaggaatcaaagtgcaaatattgagcaggccgaacgcggatgggtcacgaagcgcggcggtgatcgtcgcagtaaggattacggcctttcgcttgggatggcaaaagaagtggctatggttgagcgcaatgaacagggccgtgccatacgccgctacttcatccagtgtgaagaggcactacagcgcagcgtgcctgagattgccgcacagtatcgccgccagcttaaagcccgcctgagtgccgccaacatgtttaagccgatgtgcgccgctctggatgttgcccgtgcagaacaggggaaacagactttatcccgtcactacagcaacgagagcaacatgatcgcccgtattgtcttgggtggcctcacggctaagcagtgggcgcaggtaaatggctttcagggcgaaccacgcgacggcatgaattcatctcagctggagcacctcacctatctcgaaagcaccaacatcacgctgattgatatgggcatggcctatgaccagcggaaagccgaactgatgcgtctgtctcagcgaggtgaagccatgattgccgtccagagtaagcgcttcccgctggctggcctgttaatgaatgctagtccagagaacctcacaaaacctgacatccacttagccaaaagtttggctttgtgcctgacgatgtgtaaagccatgatgcgtaaggcagtgtcttacactggtattgctggttatcacaaacaggcaaaaaaccgcttgccctctttgcaatcttcggactatcctcaacctgcactggcaaaatccggtgtcaggattggcgtcctggtaatgttgtcggcgacatttgacgcgcctagcgtctttttttgtgtcgtaaatctgactcacccttttttcggcgatatggttataatccgtgtcgctcacgaagtaatggtgggctggatgggggcggagaaatccgcgccggtttccgataacgccggttacgccaaccctgttcagtccaccaccagtgaaattggcgtttccggtgatggtatcaaataccagttatcggaggctgccaccatggctactaccctcacccaaaccacgcccaaatttgagtttcgttttctggctctgtcacgtgctgacatgatggccaagccctgtcgtgtatccgttgaagccaccagcgagaaagaagctcgccgcgttctggcgcctcacttcatcctgtcattagccgcacgcctgccagttcatcaggaggccatcatcggcaatgagaacgccccgacgccaaacacacccgaaaatatctctcgtgatcgcctactgcgcgctcaggctggcttgctccacctgctgaccgaggtgattccactgatttcggatgagaagcagcgccatgagatcatgaaacacgtcaacacctcggtatcaatccagcgcccgcagacggttgctgtgcttactcagcagcaatcgcctcttaactcagtgtctatcgacattcataacgctgataagtacgcgcatcagctggctgaaatttataacggcagcgtccacgcagcacttatggagcacgatccaaaagccgcagtgcgcatcgcaacactgtttgctgagctgtgttcaaccaccgatcgtgccggcatgcgtatcaccagactttccagccagtttgctcatggggcgaatctcaagaaggctcgcgccgttctatccatcctcctggagacgatgccaggcaccgacgttaacgaggattacacctggctcatcaatctggcgcacggcactgttcacgacactatccaggcgcttgaggccgcagttgatgcctga

SEQ ID NO: 105263 - DNA, 417 bp, Glycine max
  Peptide Sequence Number=SeqID_222041
atgaagatgcgccgccctcatgtagtgccgctttccatccaggctaaatctctccttgaagaaattcaccaactgacgggaagaggtcgctatgtgttccccggccgcaacgatgcagggaagacgatgagcgaggccagtatcaatcaggttatcaaacgaatcggttatgacggtaaagctaccggtcacggcttcagacacactatgagcaccattttgcatgagcagggctataacactgcatggattgaaacgcagctggctcacgcagataagaacagtattcgtggcacctacaaccatgcccagtatctggacggacgtcgtgaaatgcttcagtggtatgccgactatatggatgcgctggagaatggcgagaacgtggttcatggctcgtttgggaagcgtgcgtaa

SEQ ID NO: 105264 - DNA, 369 bp, Glycine max
  Peptide Sequence Number=SeqID_222042
atgttttcaattaccaacgtcttgatatattatgggactcaatcggacatccgagttaaaagtgattgtggtatgcatttgctacgagtttccgttttcaatttcgattgtctcgatatattcttggactcaatcgaacatccgagtaaaaagttactgtcgtttgaattttctacgagcttccattttcaatttggagtgtctccatatattacgggactcaaccagacattagtgtataaagttgatgcaatcctccttaggaagggaccaatcactagaaccatgagcaagaggctccaagaagattgggctagagctgctgaagaaggccctagggttctcatgaaccttagggtagatttctga

SEQ ID NO: 105265 - DNA, 312 bp, Glycine max
  Peptide Sequence Number=SeqID_222043
atgctggttttcaggaaaaactatgtttttgtcgaatgggatgtgtcgcaacctacccttcggtgggagggcgacgcgagggctcacgggtgcgtcttccatgggaggaagatgcgtggagtcgccaccaacgtttattcgaggaaaacgttggaaaaactggaaaggtgtggtctacgaactttaagtgtgaaaggtttgggagtagtatttgcccatggggaagggtgtttcccttcatccaacgtattccttaattgtgataaggaaatcagacctatgcagttctttcaaaaggggcgaatcaagtga

SEQ ID NO: 105266 - DNA, 204 bp, Glycine max
  Peptide Sequence Number=SeqID_222044
atgcaccatgtccctttgggcaatgatcaagtgaaggtgggtattaaggaagttcaagatgttgatgcttgcatccctatacccgctaaagagatgaaaaagaggctaagttttgaagtgcaaaaagtgacagttgagcttagctcaacagttgggctaagcgcgcatccaccgctaagcgcagctttaacgcacttagcgtga

SEQ ID NO: 105267 - DNA, 636 bp, Glycine max
  Peptide Sequence Number=SeqID_222045
atggttttgtttgaaatgcagaatatgtgggattcgacgcccgacactgatctgttactggagcttcctgaagaatatactttcgaaacagcactggctgatttaatagataattccttgcaagctgtgtggtctaatggggaggataagaggaagctaattagagtaaatctgggtaaaagtaagatttcaatcttcgacaatggcccagggctggatgacactgacgagaattcccttgtgaagtggggaaagatggatgcttctcttcacagatcttcaaaatcaaaggcaatcggggggaaaccaccatacttaatgccttattttggaatgtttggatatggtggacctatagcatctatgcatttggggaggcgtgcttcagtttcttacaagacaaagcatgtgaagaaagtctacacattacatcttgagagagaagctttgttaaatacatctagctctcaactcacatggaagaccggtggcggaatcagagatcctttagctaatgaaattagggactctcatggaagctttacaaaggttgaaatttacgagccaaaaataaaagatgttcacataaatagactcccgtcccatctgaaagacctatatttcccttacatacag

SEQ ID NO: 105268 - DNA, 207 bp, Glycine max
  Peptide Sequence Number=SeqID_222046
atgggagctgaaaatgtgagcaaaactgaacaactgagaagctcagaagcacttctcttaccgtgtgaaagaagtggtgtgagaagcgctgattctgcacaagctgggagaaggagtaaaaaaatggtgaaatttgcagtgaaatggggaataaataagcctggggaggcgaaagggctgagagtaagaaggaaaaaaagagaatga

SEQ ID NO: 105269 - DNA, 1340 bp, Glycine max
  Peptide Sequence Number=SeqID_222047
gccaggatgaacatgcaagatgcaggtagcagagataatcaacagaaaagagcaaaatctaacaatgaggaagattatgaaggagatcttatcaacaaattaccagatggaatccctgtagccattttatctaaattgccaataaatgaggctgctaggaccagcatcctctcaagaaaatggagatatctatggacctttttttgtggaaccttagaatttgatggttcaccaattatgaaagacatgaaaaaagacattaagaaggctgcaggaaggcaattgcagacggcaatggagatcatgtatgatgctgaaaggcaaacatatacaacttggatcaatgaattgttaagttcactcaagagttccactctacaaggattgaaattttggtttcatgtgggtactgggtgtgatgttgataagtggattcactttgccattcaaaagaaggttcaaaagcttgagctgtattttggacatacatttgaatatgttcttccattgcacttgtttaaactagaaagctttaattccttgcatgttttgcgtctgaaatccattactgtgaccgaggagatgctggagtatttactgtgtcgctgtccattacttaaaacgttgagcttggttaactcgggagttccaaaaactatgaaggtttcaggtccatcactcaagctgaaatgtctagaattggtaagatgctgggagctgataaaactagaaatttttgctgagaatttgatgtcattcaaatactatggatctcatttggacacagaatttaagagcgttccatgtcttgtggaagcaacatttggaggatcctttgtggagttcactagagaaagttttctcccacaaataaaagtgcttaaattggatattacacaaaacgaacctcaagtgcttttccggctaagtcaacttcccaagttaaaaaatctcaagcatttggagctggttgcctgtgttgatgatggtatcacacttgcttgtgcattgctattaaaggcaacacattcactatggaggttcacactcaagatgctaaataccaaaccctcttttagaacagaacgcaaatttacaatggaatctcggtgcaatctcaaagagttggaattggttgggttttgtggagcagcatgtgaagttgaattagttatgtacatacttgagaatgcagctgaactccagaagataattattgacacaaggttaccaactaaaccgaaattgagaccgctaggggagcaatgcaaaacttgggatcatgaggaaaacagaaagcgtgcaagaggacttcaggagaaaataccaccttggattga

SEQ ID NO: 105270 - DNA, 747 bp, Glycine max
  Peptide Sequence Number=SeqID_222048
atggctcatgatcctccgtatgcaaaatttgttaagcctgccttcgatgattttattcttccatccaaaaaatatgctgacatcatcatacctcgcggtggagacaatcttgtagcaattgacttgattgttcaacatatccgcactaagcttggccaacataacctctgcaagatatatccaaatgtgaatgttatacagtctactttccaggtaacggctttgagctttctacaggatttacagcccctcttaacaactaatcttaatatcaccgacttcacaggtagtggaacatggtcttggttacttgccatttacagagaaacaagttatcacacctacagtggtgaaagcatggaaaatgctttgcgtgcttgctgtaaaggaataaagataggaaaaattctaattcaccgtgaaggtggtgatgaaacccagcttatttatgagaaacttcctaaagatatttcggagagacatgttcttctcatggacccagtacttggaacaggtaaaactgctagccaagcaatcgagcttcttataaagaagggagttccagagtcccggataatatttcttaacctcatttctgctcctgagggaatacattgtgtatgtaaacattttccgcatctgaaaattgtcacatcggagattgaagaaggattaaatgaccagttccgtgtcataccagggttaggagaatttggtgatcgctactttggtaccgacgattcttag

SEQ ID NO: 105271 - DNA, 2520 bp, Glycine max
  Peptide Sequence Number=SeqID_222049
atgtacatagccttacccctgaaagtgaaatggctgctttcaggatctgaacccatgacctctgatgggaaagaaatgaggggaaataaaattggtatgatgaaaataagccaaaatcgcttctattcccatccttattacatcgtagaaggtttgaggcatgcctttgttcatcttttccaagtccaacttttgagctctaaccctctgatttcctgtggtatctcattctcctgccacttctggctttctctggcaccctctggtctccagactcgtgtcccctgctacttgatctcaatgataccatctctaatctgtcttctgttcacacttctgttgcagattgcagttatgttctatggtgtgacagtcatagtgttttatatatgcggtgtgactgacctgaaggaggaatttaagcatttttggggccagccgctctgcattgctgtctgggttgataactatgctcaagtgggaccgtctaatggaagtcgggggaaggttgtcttactatttgatgataatcccttgtctaaaattggtgtgagatttgataaacccatacctgatggagttgatcttggtggtgcctgtgagggaggtcaaggatttttctgcaatgtcaccgatcttcgtttggaaagcagtgctgtagaagaactggacaaattacttattcattcattgtttgaggtgccatttaccctaccctgtagtctaagaatgctctacaatcattttggcttcaatcttacgattagatctatattcgggtattttttccaggttgtttttagtgagagtagaagtgcaccattcattttgttcatgaaagatgctgagaagtctattgtaggaaatggagattcacattcatttaaaagtaagcttgaaaatcttccagacaatgtggttgtaataggttcacacacacaaaatgacagtcgcaaggaaaagtcacatcctggtggtttgctttttacaaaatttggtagcaatcagactgcccttctcgacttggctttcccagatagttttggacgattgcatgacagggggaaggaagccccaaaacaaaatagaactttgactaagcttttcccaaataaaattacaattcacatgccacaggatgaggctcttctagcatcctggaagcagcaactggatcgagatgttgagactctcaaaattaaaggaaatttacatcacttgcgcacagttctgggacgttgcggaatggaatgtgaaggacttgagaccttgtgcattaaggatcagacacttacaaatgaaaatgcagagaagataattggttgggctttaagccaccacctcatgcagaattcagaagctaagcctgattcaaagcttgtattgtcctgtgagagcattctgtatggaattgggatcttgcagtctatccagaatgaatccaagagcctgaagaaatcacttaaggatgttgtgacagaaaatgaatttgaaaagaggcttttggctgatgttattccacctagtgacattgatgttacttttgatgatattggagctcttgaaaaggtcaaggatacattgaaggagttggtgatgcttcctttacagaggcctgagcttttttgcaagggacaattaaccaagtgcccttcctctgtccccactctaaaggagaggaaaaagaaggaagtggaatcagctgactatccctgcaaaggtatcctattatttggtccccctggaactggtaaaacaatgcttgcaaaggcaattgctactgaagctggtgctaacttcatcaacatttctatgtcaagtatcacatctaagtggtttggtgagggtgagaaatatgtgaaagctgttttctctctggcgagtaaaatttcacctagtgttatatttgttgatgaggttgacagcatgttgggtcggagggaaaacccaggagagcatgaggccatgcgaaagatgaaaaatgaattcatggtgaattgggatgggttacgcacgaaggaaaccgagagagttcttgtcctggctgccactaacaggccttttgaccttgacgaggctgtcataaggaggatgccaagaagattgatggtaaatttgccagatgcccctaatcgagcaaaaatattgaaagttatactggcaaaagaggaattgtctcctgatgttgatttagatgcagttgcaagtatgaccgatggatattccggaagtgatcttaagaatttgtgtgtaactgcagcacatcggcctattaaagagatattagaaaaggaaaaaaaggaacgtgctgctgctcttgcagaaggccaaccagctccagcattatgcagcagtggggacgtcagatctttaaacatggaagactttaaatatgctcatcagcaggtatgtgcaagtgtttcttctgagtcagtaaatatgactgagcttttgcaatggaatgaattatatggagaagggggttcaagagtaaagaaagcactcagttatttcatgtga

SEQ ID NO: 105272 - DNA, 336 bp, Glycine max
  Peptide Sequence Number=SeqID_222050
atgaaggttttcggagcttgggacctatccaaatttagaaaacaagatacaggaagcaaaagagcaatcatgttctctatgtcaaaatgcagatatcaaaagttgtatatgactaaaaacatgattttggagatctcgcgatataatgtcggcgcgggcgagacgacggtgccaaacgaaatcactcaccaaaggaaaaagagggtacggcctctttttggaaagccctcaatcaagggtcgccacgtatccctgccgaacatctggcatgtgggccccacgcatctgcctcggcatttattggctcgttttaatgaggcgcacccaataaaataa

SEQ ID NO: 105273 - DNA, 231 bp, Glycine max
  Peptide Sequence Number=SeqID_222051
atggccaggatcatggacccattagctagcgaaatagagacacctagcccttcaaatgcacctacatcatatggctttgagtctcaacctaagttggaaactgataacatgccatccacctctgggacagctaaaaagttgctcattcaaattagccaccaggacacagtcattagaatttgtgaaataaataaataccatgctgaggttgagtcagtatttaactcttaa

SEQ ID NO: 105274 - DNA, 291 bp, Glycine max
  Peptide Sequence Number=SeqID_222052
atggatggggaggtgaatcaaaagatggaggattctcatcaccaaaggggtggtgaggatgccaatgaagctattactagaactgaagatgttgttgatgttcctggagttgaagaaggagctaatgttgatgctaatgatgagattggagctgatgctgagactatcattgccactactattgatgtaaatgatgaagttggagcaaaggaagatattgttgttgagaacaccactaagggtgtacctcaagaaagtatcattgagggggaatttgtagctattgaatga

SEQ ID NO: 105275 - DNA, 273 bp, Glycine max
  Peptide Sequence Number=SeqID_222053
atgcagctctggtgtctcccatgtcatcgtcttcatcgcaactccgagtgtcgcgcctccgcgtatgtgttcctctccgtcactaactctctacgtcgcgaatcttcattgtcactcccactcgcggccagtcttgttgccactgttgctgttggtgtcgagaatgtggtagtagccattagcttggtgtgtctgcaaaagaacttgctatgtggtattttcaacaacggcttctatatatttgtggttagtgtatgggaatgtcaaatctga

SEQ ID NO: 105276 - DNA, 1353 bp, Glycine max
  Peptide Sequence Number=SeqID_222054
atggcaatggcaacgatggaagagattccacaaagcccagaagcgaagttggggatgcgagtggaggatctttgggacgttcaggaggcacagttgagtcccaccgagaagctcaacgcttgttttgaaagcatccctgtctctgcttttcctttggatccttcaaacacagaaattgagattaaatcagacgccaccctagcagatgctgttaagatattggcaggacacaacgttttcagcgcgcctgtggtggatgttgaggcgcctgaagacgctagttggattgacagatacatcggaattgttgagtttgctggaattgttgtatggattttgcatcagtctgaacctacgtctccgaggactccgtccactccatccagtgcaagggctattgcagctgcagctaatggagcggcttttgctctagaacttgaagccttaggccttggatctgctgcaacaactgcagggaacttttttgaggatctcacttcttctgaactttataagaataccaaggttcgtgatatttcagggacattccgctgggccccgtttcttgctttagagagatcaaactcatttctaaccatgctcttgctgctttctaagtacaagatgaagagtgttcctgtgttggatttaggctctggtgcaattgataacattattacacaatctgctgtgattcatatgctggcagaatgcgctggacttcagtggttcgaaagttggggaaccaagaaactatctgaagttggtcttcccctggtgacaggaaatcaaatcatcaagttgaaccaatcctacaaatcttcaatttttatacataatggcaaatgctctgaacttggagaagtatattacttcatttttcctttacaagtttatgaggatgaaccagtcctccaagcatttaaagtaatgaggaaaaaaagggtcggaggggttcctgtaatcgaaagagagaccaaaaaagcagttggtaatataagtttgcgagacgttcaattcttgctaactgcaccagaaatctatcatgattatagaggtattacagtaaaagacttcctaactgaggttagaagctacttggagaagaataaaaatgcatccccaatgttaaatgaatatgtcacatgcaaaaaggactgtacaatcaaagagttgattcaactacttgatcaagagaagattcacagggtctatgtggtggacgatgatggggatttgcaaggactaatcacactaagagatatcatctcaaggctagtacacgaaccgcgtggctattttggtgatttctttgatggtgttctaccgctgcctgcaaacagcagagtttaa

SEQ ID NO: 105277 - DNA, 1578 bp, Glycine max
  Peptide Sequence Number=SeqID_222055
atgaacaacaccaacaacattaacaacatcaacaccaacccaaccaagaatgccgcaacaccgtcgtttttcaccaaccccggagcaccctccatccccatgaaccacccacaaccccaccttctctcacagacgcagcctcaaccacaaggtgccacgtcacactttcacggccactttcagctttcacaaccccaaacccacgtcgtcgcacagcaacaacatcaacaacaacaaccacaccctcacccacaagtgcacaacaatgccaacaccaacgcccacgtggcagcacccacaccacccaagcgtgcaaatcagaaacccccttcacgccctcaaggctcctccaacgctacccaatcctctgcgttcaagaccatggaactcaccgttgcgccgccgcggaaaaagagaagctttcccggtaacctgattccagaaaaagtggccaagcttgttccagaatccgcaatctacgccaagttgctcgaactcgagactcagatagattctgctttggccaggaagaaaattgatgtgcaggcgaatgttagaaaccctcgctgcgttaggaaaacgcttagagtttatgtttataacactttttcgaatcaggtgaaagtggagactgggaagaatggtgtggaggagccttcttgggctctgaggataactggaagggtgttggaagatggtaatggaaaggattctgtggcggaaggaatttcgacgaaggaatatccaaaattctcggctttctttaagaagattaccatatacttggatcagggtttgtaccaggataaccatgttgttgtgtgggatagtgctcattcggcggctgcgcagcagcgtgatggttttgaggtgaagaggaaaggagataaggaattcactgcggtggttaggatggcgatgaattattcgcctgacaagtttgtggtttcaccgcaactggctagagttttaggggttgagtttgactcgcgctgcaggatcatagctgctctttggcactatgtgaaggctaagaagctgcagagtcccaatgacccttcgttcttcatgtgtgatgcttctctccagagggtgtttggggaggagaagatgaaattctctgtggcttcgcagaagatatcgcagcatttgtcacacccgcagcctatacacctggagcataaaataaagctttctggaaatggtccagccggaagtacttgctatgatgtgcaggttgatgtgcctcttccacttgagaaggatatgtctgcgttcttggcaagcactgagaggcacaaagatattgatacttttgatgaattgatctctgattcgataaagaagattcatgaacatcataggagacgggcattctttctcggctttagtcagtccccagcagagtttattaatgccttgatagcttctcagagcaaggatctgaagctcgttgctggagatgtgagccagaatactgaaaatgaacgacgtgctgaattctacaatcaaccgtgggttgaggatgctgttattcgctacctgacccggaaaaatgctcgaagtgatgctccttga

SEQ ID NO: 105278 - DNA, 189 bp, Glycine max
  Peptide Sequence Number=SeqID_222056
atggttcgtaattttggaagagacttagtagagggatcgaacagtcaaacaaccactagggacttccaccacctgactgtggagaggcttcgtgcgcttttgaaatctaaaggcctttcaaccaaaggaaagaaggctagtatttcaacagttttaacatacatgcatacaaaagttgcattgagatag

SEQ ID NO: 105279 - DNA, 1119 bp, Glycine max
  Peptide Sequence Number=SeqID_222057
cctaagcttgtggcagtttccaatttcatatcatttgtcaatcctaaagtgcctctgtatccacgacttgctcaggggaagtcttgggatgaaatgacagttacatggactagtggatatgacataaatgaagctataccgtttgttgagtggggtcctaagggtaaaacgcaagtgcaatctcctgcccggaacattgacattcagtccaagaaatattcattcaagtcatcaccttatcctggacaggactcacagcaacgtgttatcatatttggtgacatggggaagagttatgatctttggaaggtgaaaatgaagtcttacacggagtcttttgatttatggaatgatgtggaagaggattatgaagtatctctgttgcctgaaaaccaagaaggcgaaggcaaatacatgcctatttgctggaagagtatgaaggggatgcaagtgctaaacctgatgagtgaatttgagatgcaaaagatgaaggaatccgagacaattaaaggatattcggacagattgcttggtatcactaacaaggttagattgctaggcactacatttgtagattccaaaattgttgaaaaaattctggttataatgtatgcaacggattatggcatgtttcgcttctgcatagctgacactgaacatgattggagggaaggatcagaacaatacaaattcatcgagcattgccttgcaacagtagacagacagaaacaaccctggttgatttttgctgctcaccgtgtgcttggatattcatctgatttttggtatgtttatggccatgtccataacaacgaaaggacatgccccatttatcagtctcgctattccggcgttgtgaatggaacaattcatgttgttgctggaggagcaggaagccacttgtcaaacttcagccaagtaaccccaaagtggagtctttacagagactacgacttcgggtttgtcaagttgacagcattcgatcattcatctctcctctttgaatacaagaaaagcagtgatggaaaggtctacgattcttttaccatttcaagggattacaaagatgtcttggcctgtgtggatgatagctgtgaagcaaccacttcagcaacttga

SEQ ID NO: 105280 - DNA, 372 bp, Glycine max
  Peptide Sequence Number=SeqID_222058
atggcaatgacagtggggcacttccagttgttgtcgctgcagaggtctaccaggaatgccggcggtgtaatagatgaggacaaagatcatgccaccgaaggcccatcgatgccgagaaggccaacgccgtcgcatgctctagtctgttttttgtggccaatgacggtggcgatggtgacagttggaaagaacaaggttgaacagcgtgaccatgcgagcactaatcatctaatgggtagccaccacagaggaagagtagatgagaaacaaatatggatacaacagttgagggactccaacaataagccaggggcgatcagaattcttgactcgagaatactctgtcagtactctgctccaaaacataaatga

SEQ ID NO: 105281 - DNA, 207 bp, Glycine max
  Peptide Sequence Number=SeqID_222059
atggatgatagttttagttttacgtttcagattcttcagccctctgaaggacccacgtctctttctgcccccatcaacgccagcattgacgacgcgcggctcttaatcctaaacggcaactgtggcatggcgttcgtacgaacttgggtcccacgcggtgccccaaaagaccttcacgctttcttcccgttgttccagctatgctaa

SEQ ID NO: 105282 - DNA, 2742 bp, Glycine max
  Peptide Sequence Number=SeqID_222060
atggctagggagaaacaattcttcaaggagaagaagaaagcaataagaaaggcaggcaaatcaaagcacatctttgaggagcctttaatggcaggagaccgaccatcaagattgattcaaggcaacctcttccatggtctgccaaatgaagattcatatgctcatctggctacttgcatagagatatgtaatacgatgaagattgtaggggtggttgagaagttcttgaagaagtatttcctggagtccaaaatcgccgaggagaaggcagagatttcctcatttcaccagttgcctgatgagtcattaggtgaagctctggactgcttctgtggtctacatagaaggacttctactcatggtggaaagattaaattgaagacccctgatgaagctatgaagctcatagtaaatatggcagccagtgatcatgtcattctacgtgataaagcttatacacccgcgaagaagaagacattgaacaaacttcctcaacagtttcaatttttgcaacctgcttcatccttagtgaagccagttggcggatgcaccctgtgtggtggagctcatgagtcaagcatgtgcatgactcaagaggacgcgcctaaagagttcaactacatggccaacccaaatcgccaggggttccatcctgggaacaacttcaacaaggaccaaggaggcctatccaatcaaccccctaatcaaggccctaacttgtatgagagaactgccaagctggaggacaccctaattgagttcatacaggtgggccaacttgctaagcatatggctgagaaatccactgggaactatatggtgagcacagagaagaacccaaaggaggaatggaaggtggtccttgcaaggagcaagagaaatgagagccttgaaaaagaagagagagttgagggagtagtggaggatgtaagtgatgaggaagtagaggatgaaaggaaaaagaacaaggctaacaatgaagagaaagaattaagagatgagaaaaataagctagagattgccatcccttttggagaagccctgcaacagatgccgatgtacactaaatttttgaaggaccttctcacgaagaaaggaaagtacatcaacaatgagagcattgtgaggattgggaacctgaggattatcccaaccagaataactcttcaactagcagacaaatctattacaaggccatacgatgtggttgaagatgttctggttaaggaagcagatcttgctatgcgatgcttcaccgttcattcaccattggaaaaagccttgatgaatgccatcgaatgtttgaccaatgaggaggagaaagatctcaggtcttactctacaacagagaagcctaaggttgagttgaaggtcttacctcctcacctgaagtatgtttttcttgaggcaaatgatgccaagccagtagtcatcagtaatgacttgtcttcagctaaggaagcacagttagtggaggtactcaagaagtataaggtagcaataggatggcatatcttcgatcttaaggggattagcccatcctactgcatgcataaaatcatgatgaaagctgattatagactggggaaacaatcacaaaggagacttaacccatccatgaaggaggaagtccaaaaagaagtcctcaagttgcttgaagcaagacttatctatctgatctctgacagtgcttgggtgagtctagtccaagtgatgcccaagaaaggcggtatgacaatgatccataatgagaagaatgaactcatccctacacggactatcacagggtggagaatgtgtatagactaccacaagcttaatgacgccacaagagatgatcatttccctttgtcgttcatggaccagatgttggagtggctaattagacaagctttttattgcttcttggatggctactcggggatgccatttgggttatgtaatgcctttgccaccttccaaagatgtatgctagctatttttgttgatcaggtagaaaaatgcatcaaggtgttcgtcgatgatttctctgtctttggcttttcctttgacttttgtttatctaacttggaattggtgttacagcgcaaggtcctaaatgatgcacaactgaattatgccaccacagaaaaagagttgctagcaattgtatatgcattagagaagtttagatcatacttgattggctctaagatcaaagacaagaagggatgcaagaatttagtggctgatcacctatctaggttggtgaatgaagaagtcactcaggaggagcaagagattcgggatgagtttccagacgaatccctattatctgtgagtgagtggccttggtttgcatacattgccaacttcaaggtagctagaatcattctagatgatcttaattggcatcaacgaaagaagttcctccatgatgcacactgttatgtttgggatgatcctcatttgttcaaacttggagtagataacttgctgaaaaggtatgtcactaaagaggaggccaggagtatattgtggcattgtcacaattccccctatggaggacattatagtggggatcgaacagttgcaaagaaggttttggggcactacaatgtcaggcataaggtcacttctccttatcatccccagacaaatgaccaggttgaggtatccaatagggaattaaagaagatccttgagaagaccattgcatcttcaagaaaggcttgggttgtgaaattggatgatgccttatga

SEQ ID NO: 105283 - DNA, 120 bp, Glycine max
  Peptide Sequence Number=SeqID_222061
atggaggtcgaaggaagggatttgctagctgaaggaaggaaagcaagtgagacggagcaggcgagaaagagggtatggcctacacgcccgcttagtgggagcatcgcgattagccgttag

SEQ ID NO: 105284 - DNA, 369 bp, Glycine max
  Peptide Sequence Number=SeqID_222062
atggaggtggatgatggtggccaatctctcaatattgccaccattgtagaccttcaacctttggtcattcactatccagctgtgcttcgagtcagtagaagaggagtccatcgactcaactactccataaggcttcacatctttgattgtgaatgggccagacaacttggacttaagctttacaaggaaaagcttgagctagaagtttttcttcacaagtttccaatcatgataagctttcattttctgcttgactcaacaaagttgaggaacttgagagccagtaagccttgtgctccatctctactggaagatgacaagccttcccataaaccatctggaatggggacaaaccaattggggtcttaa

SEQ ID NO: 105285 - DNA, 225 bp, Glycine max
  Peptide Sequence Number=SeqID_222063
atgtcggttactatgctattgaaggaggagacttacatagaagaggcttcacaaaccctatattactcaagaacaacccgagatcacgatcaatggccactcgtgatgcaatcctaccccccaagggcattggatagaagactccaagaagattgggccagagatgcaagagaaggccctagggttctcatgagccttagggtagattttgggcctatgggctaa

SEQ ID NO: 105286 - DNA, 675 bp, Glycine max
  Peptide Sequence Number=SeqID_222064
atgcggggtacatcctttgtggtacaagtagagggtacatctacttgggttgttgtgactgagaacaagagagggtacatctcttgtgaatcagttctagtgaagggtacatccactaggttgttcaaagagaacaagggagggtacatcccttgtggatctttgcttgtaaaggactttacaaggttgaaaagaaatctcaaggaccacaggccgcttggggactggatgtcaagttgtgacctgggaaaccttcaagaggggaacataactgtagctgaatatgcagccaagttcgaagagctggtgaggtacttttctcattaccaaggaaaagatggtgaaagctcaaaatgtgtgaagtttctgaatggcttgcaacctgaggatgaagactcccgagacaaggcggcatattatcggagtacgggcccaatgaagaacaagaagaatggatcccaaaatcgggataaaccatacttgacccctcctaagcaatatggcccgaaggccacaataagagtttttactcttaatggcgctgaagcttcgaaatccaaagatctaatccaagtggaatggagaaggaggaaaggtgattggagacgccacttcaaggagaatatgagtcaagaacaagctcaccaccataggaagtcgtggataagagcttga

SEQ ID NO: 105287 - DNA, 252 bp, Glycine max
  Peptide Sequence Number=SeqID_222065
atgagtgaactgactttgagatcatcaagattgagcagggttgatgaagtgatatatgggcttgttgatactcgaacccaagtatgtgggttattaatcaaattccaaccctgctttcctaacatggctaggttgaatccgtggagattacaaaatcctatacctccaaacttcttcttcacggaaagcttgtcccaattgagccagtttattcctcttgttgatgcaccttttgatcccccaccaaaataa

SEQ ID NO: 105288 - DNA, 321 bp, Glycine max
  Peptide Sequence Number=SeqID_222066
atgttcatgaaaggaatcaccaacgattgtaggaggatgatctatgcatcgaccgaaggaaactacttcaataaaaccaccactcaagtgaagaccataattgaagatttggcggctagtgagagaaccgtagaaacgaattggtcaaatcccctaaaagaagccttcactaaattccccaaagtggtcatcaccaaccacaaaagtgccgaagctgtgatcaaaagcatggagactcaaatagggcaattggccaaacaattgcaaacctcttcaattggcttttctgcatccactgaggagaacccaaatggccattga

SEQ ID NO: 105289 - DNA, 219 bp, Glycine max
  Peptide Sequence Number=SeqID_222067
atggtgtcgatcgaagattcatcgtcaagggagtcggttagaggtgagcatgaggtgggtgaaagcattgtggctccaacattggtcgccgttgccgaggtggctgcttctcggcctaagaaatgctcaacgctgaaggagaagtgtttcccttctcctatcacgtttttggagtatatgtgggttgatgaagaggtaggcacctatttctctcagtag

SEQ ID NO: 105290 - DNA, 351 bp, Glycine max
  Peptide Sequence Number=SeqID_222068
atggcagcacaagaaccaactatgagtgaactagcagctggccaaggggtcaagagatacaaagctctgatccgtagttgtcccaaccatggatattcagagtatagccaaatctcaaaatttacgaaaggaactactcatgagtgcaagaggatggtaaatgcttctataggtagtaacttcttgaacaaaactactatcgtggttaagaagattattgaagatttggttgctagtgagaggaatatggactatggtagaacaattcctcaaaagggtatttatcagttgaatggacaagacaaatggcttgccatccaacaaaggaccatcacaaagcaaatgcaatag

SEQ ID NO: 105291 - DNA, 168 bp, Glycine max
  Peptide Sequence Number=SeqID_222069
atggaaaaagtcatagaaaagaatgttaagcatgagggagagatcgttgtttcggatgctagcttggaaaccctagcttcggttcggaggggttggtggtgttgcgatagcatgagcggctggacgaccggtggtggggtctctgaggtgtgcggtggcgtcgtgtga

SEQ ID NO: 105292 - DNA, 738 bp, Glycine max
  Peptide Sequence Number=SeqID_222070
atgaaagtgattcaggtgccaaagattgataaaagcccaattccatggaataaaaggagggtggttgagttcaatgtcgagaatggaatgaaaacattacgaatcactgtcaacaatgaagaaaaaggtgcatccagaataattaagccatttgaaaaaatagaggctgtgaataaaatgaagcagaccttagccatgattgcagatttgaaagttagaggccaagcaaaaacctctctaagtcaagtggtttttgcattgggtcatgcttttggcaaccattcattagtcacaacagaaatctcgaccggaagaccgacaaaacaagagttgaaacatatagaaaactcattattggaagcttggttgaatggtaatgatttaccagatcagaatgaaagtttagatggagatatgtgctctaaggaaactgaatgggctactcttaggaataaggagaatggtgggagcacaagaagaagaaaaacatcaagaggtggtgttacccttagttttgaggcacaagatcccttggaagaggtcaacctgggaactaatgatgagccaaggatgactaaggatgagtatgtcatgcccatagtcgatatgttagttgatgcaacagctaagcatggtgtccttaccttcatggatgggcattctggttatgaccaaatttttatggttgttgaggacatgtacaagatggcattatcctggatctcttgggatatatga

SEQ ID NO: 105293 - DNA, 546 bp, Glycine max
  Peptide Sequence Number=SeqID_222071
atggatcaaaattcaacaaagacaatgagccaactagctaaagaggggaaactcatttccaaaattttcctctccaaggagaagccctatcctcacataagacgttaccagccaagtcagaagatccaggtagtttcaaaatacccattactattcgcagtttgtcaattggaaaggaattccttgactttggagcttaacctaacacctttgtctacgttggagaggattaggcatatggaagtgaaggagacccaaattaccattcaattggtagatcactccattagaattcctcatggagtggtagagaacatgttggtcgatgtgggaaaattctcgttgttggccgactttgtcatcatgggcatagaagaagacttagatattcccttaattttggaaaggccattcatgaacacgaataatgctattattagtattgttgaagggaattttaaaatccgagtagatggggaagaaataacttttgatgtgtttcaagctatgcagcaccgagaggacaaaggagcttcttcaaagtag

SEQ ID NO: 105294 - DNA, 153 bp, Glycine max
  Peptide Sequence Number=SeqID_222072
gttaaactgaaatctattacatataatggcttacttatttctgttgacgacgtggtggtggcagtcgatggcccgatcgatggtggtggcactaggttagacaatagtggtagcgtgggcttgttttctggtgaaaaaggggaagaaggataa

SEQ ID NO: 105295 - DNA, 303 bp, Glycine max
  Peptide Sequence Number=SeqID_222073
atggtctgggaattaatgcatagaggaggcacgggtctcgagaggaaaaaattgaccaacccaacagtgccatttgaaaattcagtcagagatgggagagtggtctcaagttttccggtgaaaatctcaccaccactatggtgcctcttccgcaccactgccgctattactgtccccagggcggcctcgtgtcgcggcgccatgcaccggtggcaccgaggaggcgtgccaccctccgtggtggcttatcctattggggcactgtttgggaagctaggtcatctagggttatttcaactctga

SEQ ID NO: 105296 - DNA, 423 bp, Glycine max
  Peptide Sequence Number=SeqID_222074
atgcctagtagacttttttgccaaattgacaaccgctatagcaatggcaactactatgttattgagggtggtggagacctatacaagagaggattcatgactcctctattgaagtgcctaagtagggatcagtcgacaataggtgaaaccccttttcgactatcatatggatctgatgctatgatactggtagaagtcagagaatcttctctccaaaacataaactttatagagaaggaaaacaatgagatgcatagtgaatcactcgatttagcagaagagaccatcaaagaagtccacatgagagccaaattgtaccaaagaagagtcgagaaaaaaatgcaacaactgagtcaagccgataaacttctaggcaagcgacttggtactaaggaaatgtggaaaagccaagaaatatactag

SEQ ID NO: 105297 - DNA, 219 bp, Glycine max
  Peptide Sequence Number=SeqID_222075
atgcaacacaaaccaaaagttcagaaagcaagcgcaaaggagagaaatagtgaacggagtgagcacaggagagatggaggtacaggatggcaatggcaaaacaatgacaatattggaaaatgtgaaaagaagaaatgggaaaaaaatggaaagcagaaaagggaagaagcaaaagcgggtaggatgaacataaacaaaggggcaggacacgtggactga

SEQ ID NO: 105298 - DNA, 645 bp, Glycine max
  Peptide Sequence Number=SeqID_222076
atgtctcgcaaagaaaatctgatatctgagttacacaccagaaaaggaacatggaaaatagttgtgcgtatcactgatctttggcaagctcgaaagcaaaatagtaaacaaacaattgagatggtgttgatagaccaaacgggttcaaaaattggagctactctctggcaagaactcttcactgaattgagggacaagttacagtgtggttcttcgtatttgattcaaaacctgaggattgttgacaaccaatctgaatacagagtcagcccagctccatatttggtttatttcctaaaaactacatctgtcaaggaaatccaccgtccagaaattccttctaatatttatctcattactccttttagagatataatctctggcctcgcaccccgccatactttagtggatatagttggtgtggttgctgatttcatcgatgttaagacagataatccccctcacaggatgacagtaaggctcagggataacagtaactgcgacattctaataactgtttgggaggactatgctattcagctagatgatgctattgacaaaaaccttatgcttcaggaaccattggttgttatgttgaccctaggtaaaatcaaggatgctacaagtgtgtctggtgttggttag

SEQ ID NO: 105299 - DNA, 195 bp, Glycine max
  Peptide Sequence Number=SeqID_222077
atggagggaggttgtcagggattgagggtgaggctctcaaagtgcaatcgaagacatgaggctaatagggttcgatatcgaaagagaagggcgaaatggggcaggcctaaacagtttacgggtcttaaattctcgtccaacccaacttctttggagaacgggccctgcaagcccgtcgggcctgacccggtttga

SEQ ID NO: 105300 - DNA, 558 bp, Glycine max
  Peptide Sequence Number=SeqID_222078
atggacaatcaacctgaagaggacaaagtccatacaagaaattctctcaagcacacaatgctactttctaagatcaagccaaagcacatagatgatgaactccccaaaggtaaatctgttgttgaagcaagatgggtgttcagaaacaagctggacgaaataggtaaggccaagggttacttacaacaggaaggtgtagattatactaaaacttttgctcttgttgctcgtctagaggcaatacgcattttactaccttttgttgctcatcatggtatgatgttgtatcaaatggatgtaaaaagcacgttcctcaatggactaatcaaggaaaagcaaaaagacaaaggcatatacatacatcaaaccaagtacatgaaggaacttctgaagaagttcaagatggacgatacaaagccaatgaagactcccatgcatcaaaccattgtactcggactagacgaagattcaaagcagattttgctggagataaagtggaaagaaagagcaccagtgaaggatgtcacttcattggtggatgcttggtttcttggatga

SEQ ID NO: 105301 - DNA, 471 bp, Glycine max
  Peptide Sequence Number=SeqID_222079
tcaagattacctcagagaagctttgaaatgatggattgggggaaatttttccaccaaatccttgaggaggattatgaggattctgctctgattaaaatgttcctcttggtgtgggggttcggcggcaagcaacggcagctcatggcggccaccggtggtcggggtggtggagaaggaggtgttagggtttgggtggcgtctggagaggagaagagagtgaaaatccacgactcactctgcactaagtctcgctcagcgggtcaattctcgctcagcacaattccctctcgggttggaattgcgcttagcgtacccttcgcgggtgttacaacgtggactcttggttccttgtccttcatcataacttcagcaacaagaatgttaataggtgctggcctgtcaggtgtggcctggacaacttggggttggttctatttcttggccattgtcttagggttaggagatttctag

SEQ ID NO: 105302 - DNA, 828 bp, Glycine max
  Peptide Sequence Number=SeqID_222080
tgggaagaagaggatgaacctgcattacaaccaggtccaccagacgaggttctggttggaaatggaaatgccttgactgttgaaggattaattcaagacttggaggtgaaaatccaaggtcatacactgaagctaccagtgcacctacttccagtttctggtgctgatctagtgcttggggctgcatggttggcaataattgggcctcatctttctaattatagtactctgacattgaagttttacttgggtaatcaatttatcaccttacatggcgagagaccctccctaccacaacaggctcaatttaatcacatgagaagaatgcagcatacgcatgccattgcgaaattgcttactttacaatactcacggttggatggtccacaagatccattattagatataccggttgatatggaaccagaactggtcatgatactttacacttatagattagtctttgatgtgccatcaggattaccccctagcagaactcacaatcattcgatcctattggttgaaggtgttggaccagtaaaagtcaagccatataggtatcctcacagccggaagaatcagattgaagtaatgatagttgacatgctcaaggaagggattattgctcctagcgcaagctctttttcatctccaatcattcttgtcaagaagaaggatgacacttggagattttacacagattgtagggccttgaatgccatcacaatcaaagatagctttcctattcccactgttgatgaactaattgatgaactacatggggcagtatatttctcaaagcttgatttgagatctggttatcactaa

SEQ ID NO: 105303 - DNA, 396 bp, Glycine max
  Peptide Sequence Number=SeqID_222081
atgcaggtgaggcaagcattgctgaagatcactggatatgggatgaatggcaaacaaactatgtttgcttttgcactagcgccatctacttcagttgtcgtttttgcatccattcctccagttgaaattatggattgcatagttgaactggttgaagcaaagcttcatgatgaatcaagaatgattcaaagatgttttgatgataacaaaggtgatgacaaaaacctcaaaggtcaatcaaagaatgagttcaagatgtataagatagaatcaagaaagaatgagttcaagatgttcaagatagaatcaagaacacttcaagattcaaggatcaagcttccaagaatcaagatcaagattcaagactcaagattcaagaatcaagagaagacttaa

SEQ ID NO: 105304 - DNA, 270 bp, Glycine max
  Peptide Sequence Number=SeqID_222082
atgcctcggccttgttttttcttcttctttctcatttttctccttaatttcactaaatcctttcagtatatgaaggttgaacccctttctttagtctcctcaagcctatttataggaaatgaagggacttggttgatctacagcttccctaggcgagctggttacttcacccctaagctatttgggggcccaggcgagccagaggctagtcgggcaactggtgtcaagcagctcaattcggctaacaagaatcaaaatgttagcaaatga

SEQ ID NO: 105305 - DNA, 144 bp, Glycine max
  Peptide Sequence Number=SeqID_222083
atgtctcattatgatatacttgaatcttacgttggaagcaccgaaaaggccctagaagcaatattttattcttacaagagatatattaatggttttgctgcaatacttgatgaagatgaagcagcgaatgtttcaagtatgtaa

SEQ ID NO: 105306 - DNA, 1868 bp, Glycine max
  Peptide Sequence Number=SeqID_222084
gtgtttggcctgaatccaagagttttagtgatgaaggttttggaccgatcccgaaacggtggcgtggaatctgtcaaacagaagataaatttcactgcaacaggaagcttattggagcaagatatttctacaaaggttatgaggcaggttctggtataaaactgaatgcctcagaggttagtgtacgtgactatgaaggtcatggttcacatactttatcaacagcaggtggcaactttgttgctggagctagtgtgtttggttttggcaatggaactgcaagtggtggatcaccaaaagctcgagttgcagcctacaaggcgtgttggccagatacgttctttggtggatgttttgatgcagacattttggctgcttttgaggctgccataagtgatggcgttgatgtgatttcgatgtctttgggttcagaagatcccccagaatattttcaaagctctatatccatagcatccttccacgcagttgccaatggcataacagtagtgggttctggaggaaattcaggaccttctcctggaactgtatccaacaatgaaccttggatgctcacagttgctgcaagcacaactaatagagacttcgctagccatgttacacttggtgacaagaaaatcctcaagggagctagtctttcggagcatcacttgccatctaataagatgtacccattgatcagtgctgttgatgccggaactaaatatgcagctgttaacgatacccccttttgcctgaacaaaactcttgatcctgagaaggtgaaggggaaaatattggtctgtcttcgcggtgttaatggtagaattgagaagggtgtgatagctgctagtctaggcgctgttggaatgattttggctaatgacaaggactcagggaatgaagttctatccgacccccatgtgcttcctacttcacatgttaactttgctagtggaagttacatttataattacatcaaccacaccaagtctcctgtggcttacatttctaaagccaaaacagaattgggtgtaaagccagctccatttgtggcttcattttcatcaagaggccccaatctccttgagccagcaatcctcaagcctgatgtcactgcaccgggagtcgacatcattgctgcttatactgaagccgtatctcccacagatgaggcatctgacacacaaagaactccttactatgcattttctggcacttcaatgtcatgtcctcatgttgctggccttgttgggctgctcaaagcctttcatccagattggagcccagctgctattaagtcagcaatcattacctcagcaactacaaaaggtaacaatagaaggccaatcctgaattcatcatttgtgaacgaggcaactccatttgactatggaggaggacacattcgaccgaatcacgctgtggaccctggacttgtatatgaccttaacactgctgattatttgaactttttgtgtagtcgtggctacaacagttcccagcttaagttgttctacggcaagccttacacttgtccaaagtcattcagtttagcagatttcaattatccaacaatcacagttcctcggattcaccctggacattctgtgaatgttacaagaactgttactaatgttgggtccccaagcatgtatagagtgctcatcaaggcaccaccacaagttgttgtttcggttgagcctaagaaactgaggttcaagaaaaagggtgaaaaaaaggagtttagagttacattgaccttgaagcctcaaactaagtacaccactgattacgtatttgggtggttaacgtggactgatcacaagcatcgtgttaggagtcatattgtagttaacattcagcattaa

SEQ ID NO: 105307 - DNA, 954 bp, Glycine max
  Peptide Sequence Number=SeqID_222085
ggtaggcgctgttggattgattttggccttgacaactcagggcttgaaattctagccgacctccatttgctacctgcttcgaatgttggctttgtggatggcaattacatttataactacatcagaatcaccaagtctcctgtggcttgcatttctagagtgaaaacagaattgggtgtcaagtcagctccatttgtggctccattttcatcaaggggtcccaatccacttgagccaacaatcctcaagcctgatgtcacttcaccaggaaccgacatcattgctgcttacagtgaagccatatctcccatagaacaagattctgacaaacgaagaactccttacattactttgtccagcacttcaatgtcacgtcctcatgttgctggccttgctttgttgctcaaatcccttcatccagattggagcccagctgctattaagtccgcaatcattacctcagcaactacagtagataacactagaaggccaatcctggattcaacattagtgaacgaggcaactccatttgactatggagcagggcacattcgacctaatcgtgctgcggacctggacttctcccggcttaagttgttctacggcaagccttacacttgtccaaagtcgttcagtttagcagatttcaattatccagcagtcacagttgctcagttagaccctggacattctctgcgtgttactcgaaccgtcactaatgttgggtccccaagcacgtatagagtgcacagcaaggcaccgccacaagttgcagttccagtgaagcctaggaaacggaggttcaagaaaaagggtgaaagaaaggagttcagacttacactgaccttgaagccgcaaactaagaacgccactgattatgtattcgggtggttgacgtggactgatcacaagcaccatgtcatgagtcccaatgcagttaacttggaacattaa

SEQ ID NO: 105308 - DNA, 1305 bp, Glycine max
  Peptide Sequence Number=SeqID_222086
atggaggtcgtactcaaagagttgcacgccgatcttcaatctctgagccaatcgcttcccgatccatctcaccatgatttgctccgcaaggtttttcttcctttacaattctcacttcatattccgatcccctcaatgaagccgaagattccgagttgctttgctcacgaaaatttcattcgtttatctgattctgtcatgattcaattgcgtgttgaggaccttgcgaagcttgcagaggctgcacctgttcgtcgctctaaagttgaggatatgagtgctgaggttgtagatagcaatccttatagtcggcttatggcacttcagagaatgggtattgtggacaactatgaaagaatacgcgatttctccgttgccatagttggagtaggtggtgtaggaagtgtttcggctgagatgctaactagatgtggtataggtagacttttgttgtatgattatgacaaagtggagctagcaaacatgaataggttgttctttcgtccagatcaggttggcatgacaaagactgatgcagctgtacagactctgtcagacataaaccctgatgttgtacttgaggcaagttttgaaacctttatgtcgagtttgaaaaataagtcacttcgcccaaataaacaagggagtggcgtggatctggttttaagttgtgtggataattatgaagcaagaatggctgttaaccaggcttgtaatgaattgagccaaacatggatggaatcaggtgtttctgaggatgctgtttctggccatattcaattacttattcctggagaaactgcctgttttgcgtgtgcacctcctcttgttgttgcatctggggtagatgaacgtacgctcaagcgggaaggggtttgtgctgcatctttacccaccactatgggggttgttgctggccttctagtccaaaacactctaaaattattgctaggctttggacaagtctccccgtatttgggatataattctcttaaggattttttcccaactatgcaaatgaagccaaaccctcaatgttcaaatgtagcttgtttggaaagacaggaagagtacatgcttgcaaaaccagcaagagatgctgcagccaaagcaaaaatggaagctgaagcaccatcaactgaggaagtgccacttcatgaagaaaatgaatggaatataagtgttgttgatgatattgagctggatagtccggataccagaagttcagacaattcaagaagtaaaaaatgttggcacttaaatttgcacggccccattttttgtggacttgagcagcttggataa

SEQ ID NO: 105309 - DNA, 614 bp, Glycine max
  Peptide Sequence Number=SeqID_222087
ttgacaatttgaaccccgaacctgcaacttgccccaaatccaatcgcgttggtgttcatagtttctccatgaacaactgtgattggcgccttggtttccgcaatcggttttcgcttcttctaccgttcctaaccgcacgccaaatcctcgctaaacggcaccgtttcctctccccgcgaccctgtcgactcctccaaacgcaaagggttggggcttgtttggtgagtcaagatggtgtaattcttggaattggttataatgggtttccaagaggttgttctgatgacaagctaccctgggcacaggactgggaatcctttgaagacaaagtacccgtaagtgttgtgtcttttgtccattcacttttgttgattgaaaccttaatcatagaagttaatgctattctcaacactaatcatgcctctgctgctggacaagttagttccactgcactctccataactctttcccttaaattcttgatgcaagttccattggagcttgtaggcctaggatcttcttcatcaatggattcatttgcttcttgggagatgaatggcagcggaatggagaaagggagagagagaggagacgccacttcaaggagaagatga

SEQ ID NO: 105310 - DNA, 150 bp, Glycine max
  Peptide Sequence Number=SeqID_222088
atgggcaatgtgcggatacactggaatagggacatgtccaagttgaacccgtacggctatgcccaatcacagtccatgtggattggatattgggctaagcccaaattaaaggttccttgtctcacagaggacctcgtcgaagaaaaatag

SEQ ID NO: 105311 - DNA, 1287 bp, Glycine max
  Peptide Sequence Number=SeqID_222089
atgtcaatgaatccggaagaacaacaacatcaatgccaaataaaatggaaggagaaagacatcaatgactggcttcctatcactaaatccaggaacgcaaagtggtggtactctgcttttcacaatgtcactgctgttgttggagctggtgtgctgggtttcccatacgccatgtcagagctaggatggggttggggcgttacaatattgctcctttcatggatttgcactctgtacactgcatggcaaatgattgagatgcacgagcctgaaccgggaaagaggtttgacaggtatcatgaattggggcagcatgcgttcggggaaaagcttgggctgtggattgtggtgcctcagcaactaatggttgacgttggcataaatatagtttatatgatcactggtgggaattctctaaagaagatttacgatattctctgtgatgactgtgagcccattaggagaacttacttcatcatgatatatgcctgtgttcaaatcgttctatctcacctccctagtttcaactccattgctggtgtttcttttgctgccgctgtcatgtccgtcggctactccactattgcgtggataacttcacttcacaggggcgttcaacaaggcgtgaaatatagtagcagattttcaagcgatgcagaaagcgtatttgggttctttggcgctttggggactatagcttttgggtatgctgcgcacagtgtaattttggagatccaagcaaccattccttccacgcctgaaaagccctccaagatagccatgtggagaggcatggttgttgcttatgctgtagtggctctttgttatttccctgttggtatccttggttactgggcttttggaaactctgttgaagacaacatccttctgtcccttgagaaaccacgttggctcattgtagctgctaatatttttgttgttgtccatgtaactgggagctatcaggtctttggcgttccggtgtttgatatgttagaatcgttcatggtaaaatggatgaagttcaagccaacatggttccttcgattcataactcgcaatacatacgtttgtgagtatgcttttccactgtcatacaagtctacttatcgattcctgctcccctgcataatgtggcttgtcctatacagaccaaagatatttagctggtcttggtgtgcaaattggttttgcatcgtttgtggagtgttattaatggtgttagctcctatcggtgcattgaggcagatcatactagaagccaaggactacaaattttactcgtga

SEQ ID NO: 105312 - DNA, 2505 bp, Glycine max
  Peptide Sequence Number=SeqID_222090
atgtttgggcataaaaggttttcccgctttctgttgtcgttgccacgtgtacagcttcggcctggtgttgagggttttcttgctgtacatttggttccttcggaatccccggaaccttgtgagagcagttctgtggcatccacaatgtctggtgcgaagaataaggagaaagggtgtgcagcgactccgaaggtaaatggtgaggataaaagtaaggttaagggagctgatgagaaattctcaattgccccgatccgtgaaaggagttcggatgacaaatcaaagccagtccaaccgagtccttcacaagggagatccaatgaggagtatgttgatggtgaatcatcatctcctgtattggttgaaaaacatgtttgtcagccaccaaataagttgcagaaatcttctgtagcttgtgacaaggttgtggatgtggctaatgcacaacactcagagactcaactgccacccaaggacaacaaagattctgaaacgaagatggattccttaaaagtgacttgtcaaaaatcatctgttgaagacattgttaggtgtgaggatgcaggtcataaaagtatggaaaagcatacaacttcagagaatcactctgctggaaatgatcaatcaatggtggaagacaatgttattgcaaattatgaatctggagattttgaagcaaagaacaaatgtgaggatccgactagaatggaggttgatgaagttgttcacagcccatcttcttcaccagttgatggctctccagttgtccaaacacctggtgcaagtcctaaaactaataacagaactccaacattctttagctggattagaagctggtggccatttgggagaagcaatgaaaagtacgatgatttgatcgctcttcagaacaaggctgtgagtcatgttgagggttccaagttatctgaactggaccagactgttagtcaatctgaagagcccaagttatcagaactggatcaggatgttagtcatgccgaggattccaagttatctgagttggaccagactgttagtcaatttgaagagcccaagttaacagtattggatcagactgttagtcattctgcaaagcctgagttattttctagtgcttccttttggaataatatggaatctttcatttttgcacccaagggatcacttcttttctcccagtcaagaagcagggaggatgtggtgcataaattacaaaatggtggacccctggttcttagatcactccccaaagaagacatccttcaattggtggaattgttaataacagagaaaaaatggttggaggaaaacccctccaaaacatttccttttaagctaattcgacctgttcagaagaaatcatcggtgaaccaatcccatgatgtaaatggtttgagatctctctttataggtagaacatcacagtcaaacttgcaaaaatcattagaacatgatgtggagaaacacaatcagagtattgctcattctcaagtttctgcaccaactatggaaacaaaatataccgagagatccagaaatgatatattagaagactgtaaaaaacttgtgagtgaaatgctgagggaacacccagaggggtataatattggttctttccaaagactatttgttgataggtatggctatcatcttgatatacagaagcttggttatcaaaagttggcagccttgctacagataatgcctggggtcaaattagagtccacttatatttttccttctgttcctgctgtctgtgattcagacttggaaacttctatcctcaaaactcaagcaaccactgatattcatgcagcttccaactcagatagtgaatcatctgagtcagcccccaaagatgataacatggaatccctatggtgtgaggtaggtcctgtttctatcaacaattccgacaagagtggtttagaattaaagccaagtcagaaaactatagaactggatacatcaaaatcaaagcatcctgattatgaacctgtcgtatcagatgatgagttttctgcatctgaaggagatgactcttgtttaactcaatcagcacagcaaagaaagccaaaatgtaatgaacaagacagttctttttggcaagctatggatttgtggcacagcagcaaggaagaagagaatagtggcaagaaatcaaacaatgttgacagcttggacatttctctggctgaaattttagattcatccaccgagtcaaccagggacaccctttcccagattccttcatcgaaatacagagagaataatggcaagaagtcagacaatgttgacagcttggacacttctctggctgatatgtttaattcatcatccactgaatcaactacgggtaccctttccaaaattccatcatcaaattatagagagaagcaacggtctcataagaactattcctttgttgctgatccagtcttacctaacaaggagaagctggttgatgacctcaagaaagcagatgagtcaaagatgcaaaactga

SEQ ID NO: 105313 - DNA, 372 bp, Glycine max
  Peptide Sequence Number=SeqID_222091
atgatgccatcacctatgctgctgcctgtaccattaccatcttctttgatgaataacatttccactcacaattcaatcttgtgttgtgactttaaagatgtgaatttgagcaaccaaagaggtacaagccttttgtgttcagcaaggaggcaaattagataccaagatggggatgatgcagatagtgatgaagagtatgggcacaatgagcagatttctaagttggagtcttatagtcaatcagcaaaaggagaagtactcgttgtgcatgcacttgtggaccaggagaagttgatgtgcttatcttcaagaaagatgtttcctaagaaaaatttggttgcaacacatctcaggggttctcatcatgcttga

SEQ ID NO: 105314 - DNA, 711 bp, Glycine max
  Peptide Sequence Number=SeqID_222092
atggctcctgctgcggcggagtttccggtgggtctccgggttctggtggtcgacgacgacgccaccacgttgaagattatcgagcaaatgtctattcgctgccgttaccgtgttaccacatgcactgaggctactgtggctttgaatcttctgcgggagaggaaaggttgttttgatgtggtgctgagtgatgttcatatgccagacatggatggctataaactccttgaacatgttgggctggaaatggaccttcctgtaattatgatgtctggtgatagtactacaagtgctgtcatgaagggaatcagacatggggcttgtgattatttgattaagcctgtacgtgaggaagaactaaggaatatatggcagcatgttgttaggaaattctggaatgacagcaaagaacaggataattctggcagcatggaagatagtgatcaaaataaacgggggaatgatgatgctgaatatacttctgttgctgacgcagcagtagttaaagcaccaaaaaagaggagcagtttaaaagaagaagatattgaattagagagtgatgatccagctgcatctaagaagccccgtgtagtgtggtctgtggaactgcatcaacaatttgtcagtgcagtgaatcaacttgggcttgacagtatgaatctcctacaatattttctttctattgcttttattttttcattcagtaactag

SEQ ID NO: 105315 - DNA, 1248 bp, Glycine max
  Peptide Sequence Number=SeqID_222093
atgacatgggtagaagtgatagcaagaattttgcagatatgcagtttttttcccttctactttttagaaggacataaatttagactttatttgaagcgattaactggagtggcacagcaacagaatgggatgctaaacacagttcctgggcctatagaatccaatctgggaactaatggaagatttgacgtacaagctttggctgctgctggccatgttccccctgaaacacttgcagccattcatgctgagctcttaggtcacccgacaaataacataatgtctacagtggaccaaactaccctactgcaagcatcaatacaggggctaaaacattcccatgctggacatgctgtggcatatggtcagcctcttgtaaagtgtccttcgaacattggcaagaatttctctccatctatcttgactgtaaatgatacgtcatcaggatatggtgcatggctgtcatctaataatacaattggtttagtgagacccaataatagtgttgaaagggtgggtattcagaataacaacatgctgatattagagcaccaacaaaggcagcagccccagcaaaaacaacagcagcaacagcaaaagcaacagcaacagctgcagcagcagtcattgatacatgatcgaagttgttcaatcaatgttcaaccatcttgcctggtggttccctctcaatcctctgaaactttccaggcaataaatagtcctgcttctgtcaatcaggattgcagttttgcctggaatgccattattgattatagtctattgccacaaaaatcaaataattcatttagtgcatctcaatttcctggtggggacacaaaagctcgaggtgttctctatgggtatacgacaccctcttcttgttcaacaagctccagcaatggcaatatacaacagcttcaaaactccactttaacatttggtgctgcaagacctttgcctagccttttgcccatgactgacagaaaagatccctatggttttaaatcgggtgatttacttgatcaagtatgctttaggaatcttgggtttgttggcaaagatagctgcattccaagtaggtttgtagaaaatgaaattgagtcatctgtaagtgattttacccaaatgaaagttaatgtagatatcagtggcaacagacagaaggaggagccaaatattccaaaagtgagccaccctatcatagaaagatatccatctcgtgatcattcaagtgtgttcgctgaatag

SEQ ID NO: 105316 - DNA, 486 bp, Glycine max
  Peptide Sequence Number=SeqID_222094
atggggagagatggtttgataagtggattgaatgaaaagttggaaagggtgactgtacatggttggaataacattagcatctgtattgggggcactaaaccacccgaagatgttccttttgccagagaaggtgcgagactcagaagcagattaagcaacccagaaacacatacagaagcaactacactagtcacattgatcaacttaaaacgaaaaccgaaaaatgagagagaacatcacaaaatcgaagaagagaatcagagaagaagtgaacttgaagcaaggaatgagaggagagattatgaactcgactttgccccctacttcgctatggagaaaaccaattcaccggagatggaaaccagttcactggaaaaggtgcgcgaggtcctcggagaaggtgcctccatgacaaccaagaagtgtgagacttgtgagagattaagagtttctatctttcccctttctaaatgggtcaaacagtga

SEQ ID NO: 105317 - DNA, 264 bp, Glycine max
  Peptide Sequence Number=SeqID_222095
atgatcataatctttcctaatggtgttgtccatgctcttctgctctcaaaagacctcaagttgtacgaaattatcatgaccatggcgtctaccctgacttatcttccttcactggaagtgacgtctacccagacttatcttccttcaccggaagtggcatctacccagacttatcttccttcaccggaagtggcgtctaccctgacttatcttccttcaccggaagtggcgtcatccaaaaactctacagcctgtatcaagtga

SEQ ID NO: 105318 - DNA, 636 bp, Glycine max
  Peptide Sequence Number=SeqID_222096
atggatcaacaaaccaagaagaacggtttgaaacaagtagagagttcattaggaatgtttctttccttaatgataagccttgtagcaactatgttacctactccttcgattggcactacgtcaactatgatgcctactattgaattggaggcaagaaatgcgcatgttgacgagaattttgcttcgtctatgcctagaaatccagaagtgacaaatcgggcaagtgtaaatgattatgctaaccatgttcttcctacacatgcgggtttagccaaaaggcctccaaatgttgttggcccaattggtttgccgaatgttacttcgtttgtatctcctactagaggagtcaataagcttaaatcaatggagaggccaatgtacaagaaaccatatccagaatgggtggattgtatgattcctttgccaaaaaggtataagacaccatatttctcaacattttctggtgaagacgacaaatcaactatggagcatataagctggctgatttactgctcagagtggcctcagcctaaagtaactatagctgatttgatgaacatgaggaaaatggttgaaaaatcaaaaatagacttcatagaaaggtttagaaaggctagaagtcgctactcaatgtag

SEQ ID NO: 105319 - DNA, 3276 bp, Glycine max
  Peptide Sequence Number=SeqID_222097
atgtccaagacaattcaaatgcatggattccaatctaatgtgtcagctgaagaggtgaagaaatttttggagaaacatacaggccaccaaactgttcatgctgtagaggtttggcagcataaaggagatcctacaacacatgttgatgttcaattcacagacagaaaaagtgttgaaacaatcttgctcttagttactcagcacctatcttacagtgactatgttctaaatgctactgaaataaatcatgacatttttccaaagccaaggaactttcctcacagaatggatgatatagtagtgcactttggatgtcaaacatccaaggacaaacttagtgtactctgggaacatccaaatgtttcagttaaattcgggtcaagattgagaaagatgtatatatttttcaattatttgacaatggattataagctgcagatttcttctgagagtatatcgcgtattgagctgcgccattcagatgatttaaccaagaagtttctcctttttcagttacgcggtgctcctatgatctatgagaaagatgtttccaaaagcaaatattttaaggaggcttgtgacaaccattggtttcgaggggtagatttcaccccatcaagtagcattggacaatcttccactctatgttttgagcttccacaaagtattgaggttccaaaattcaatcagcattatcgtaattatagtgaagttgatgacagcatctttactcttgagaaacaccttggtttctcttctaacttcaaatttgtccccatagtgatccctccagaaggcttcaacttgccatacaaaatattgttcaaaatcaactcattaattcagcatggatgtcttcctgtgctagcaattgacatcaatcttttccatctagttgatcctagaagagtaaggcttgaatacatagaaagtgccctgcataaattagatcaaatgaaagaatgctgctatgaacctgcacaatggttggagaaacagtataacaaatactcaacaaatagtctagttccactatctagtgctatttctttagatgatgggttggtctatgtgcatagagtacaagtaactccatccaagatatatttctgtggtcctgaagtgaacctttccaatcgtgtcttgcgcaactatcctgaagacactgataacttccttcgtgtttcttttgttgatgaggacatggataaacttcattcagctgatctagtgccacgttcatcgtctacagatgtggacagagaaacaaagcttcacgagagggtactgtctacactaaaaaatggcattgcaattggtgataagaagtttgagtttcttgccttctcaccgagtcaattgcgggataactctgtctggatgtttgcatcaagaactggacttactgcatctgatataagaaagtggatgggagagtttcatgaaattagaaatgtggccaaatatgcagcaaggctgggtcaatcattcagctcttccagggaaacagtaagtgttggcgaacatgaaattgaaattattcctgatatagaattaagaagaggtgaaaccaaatactgtttcacagatggcattgggaagatatcttctgaattggctcaagaagtggctaagaaatgtggttgtagggataataatattccatcagcatttcaaatcagatatggggggtacaaaggtgttgttgctattgatcctacttcatcaactaaactgtccttaagaaagagcatgttcaagtacaagtcagaaaacacaaaattggatgttttggcatggagcaaatacaaaccttgttaccttaatcgacaaataatcaccctcttgtccacactcggggtcaaggatcgagtcttcagaaagaaacaaagagagattcttaatcaactaaaaatgatatcaacaaagccactgatggaattgcagctcaaaactaggatacttgttaagaaaggaagagcactcttaggatgcttagatgaaactaggacattaaaatatggagaggtatttgtgcagatagctcaccaaagaaataaacaaattcatgctatgccctctctttcttctaacagatatggaggaaacaagagcaagcatattgttaaaggaaaggtagttgtagcaaaaaatccctgtctgcacccaggagatgtgcgcattttaagagcagtggatgtaccttccttgcatcatatggtggactgtgttgtttttccacagaaggggagaagaccacatcctaatgaatgttcaggaagtgacttagatggagatatctactttgtcagttgggaccctgatcttattcctcctcatcaggaaaatcccatggatcatgcaccatctcaagttatgaatgtggatcatgatgttacattacaggaagttcaggagtattttgctcactacatagttgaagacaggctaggaattgttgcaagtgcacacactgtctttgctgataaagatccagaaaaggcaatgagccctgcatgtactgagcttgcaaagctacactcaattgcagttgattttgcaaaatctggagtgccagcagaaattccacaacatcttcgcgtggaagagtatccggacttcatggaaaagccagacaaaccaagttaccaatcaaatagcataatagggaagctttatcgcgaggtgaggaatgttgcacaacacaagaatctcaataagaccttcactagaagagtggcgaggcaatcatatgaccccgacatggagattgatggctttgagaagtacacggctactgcttgtgaatacaagaacatgtatgatttcaagttggggaacctgatggattactatggcatagagacagaagcagaaataatcagtggcaacatcttgaaaatgtcaaaatccttcaatgaaagaaaggatttggaaggaattaatcatgctgtgatgtcactaagaaaggaaactagaagctggttcaatgtgatggtaaacaagtcaaattctcaaggtcgtgatgcctacgcaatagcatcagcttggtaccttgttacatatcatcctaggtattggggatcctacaatcaggggctgaacaggggtcatttcctcagtttcccatggtgtgtgcatgacactctcatccagataaagaaggacaaagacaagcttatgtacttaaaaatcacagttgaatcaaactctgaagaacctataatatttagagctatgctcctctttaggattcttgaggtagcttggatttga

SEQ ID NO: 105320 - DNA, 480 bp, Glycine max
  Peptide Sequence Number=SeqID_222098
atggtaaagaagtttggaaaatttctcaagaagtctgaagacagaaagttctctaaatcctctaagaagattgaaagcaacaataacaacttcaaatgcttcaaatgtgaagctcaaaggcttgttgttctaaaaaataagctgaaaagcgatctaagaaagtatatccctaaattagcttcaatagaaagtgagctggataaattgaagcaagaaaatgaaaaacttgtttcaagctataaagccactgattgtgattgttcctgcacttctttcaatatggatgattacatgtttttgcaaactaaattagaaaatttcaaaaaggatcactatgctgaaagtctgaagttgcaaactgagctttcttatcttacagacctttttggaaaattgaacaaagaaaagagtgatctcaatcacatgctcagcgtgcaaaaacatactaccgataagattggtttggggtataacaagtaa

SEQ ID NO: 105321 - DNA, 558 bp, Glycine max
  Peptide Sequence Number=SeqID_222099
atgtctaccaccaacaattctcaatcgagacccaacaaatatggtgatggctctaatgatgagtcatcgtcctcctcttccagcttctcgaacaatcaagatgatcaagaacatcccgtagctcttggtggtttcattaattttctcaaagcccacacaggacatttctaccttcctccttatgctgatgattccattgctatgaacacttttgtgttccctttcggcttcatgataatcacactgctagatgtagctaccatcttgggtctccctattgaccccactctaggaaattctcttcagatcaagttcaccacttcgggtttggctcacttcttcatagaggccatttttggcatactagattatgtgggtgctttatggaatctcccaactgttgaccatgtctttcttgactggctgaagatggatcctcttggcaatttggaggctaaattgtcgcaacctacccatcgacgggagggcgatgcgaggctcacgggtgcgtcttccaaggaaggaaaatacgcggagtcgccaccaacgtttatttga

SEQ ID NO: 105322 - DNA, 564 bp, Glycine max
  Peptide Sequence Number=SeqID_222100
atgaagaatgttcacggaattgatcacggaaacatcacggaagcgttacagaacctcccatgcccttctatagccaaaataggggagaaggttgccgcccagctcgcccaggctagctgttgcttcctccagaagaaattgactgttgctcctagtcagacccataaaagattaaaggttggatccatttctacacccattcattcccttgcttcctctgccccagtggtatcagatggatatcttattgatgaccatttttctcatgtggaacaattcatgtcagtagatgttcctttctatttggctatgttgaagtcgattcggctatcctttgccaagttggccaaagcacccacaatatctaatgctactcgccaactcctcaaccatattaggatgaccattgctgacttgatcttcaatcataatatgcatcaacgtcgttaccattttgttgtagctaatttagaacaactaaggcaattgcaaactcaaaagtctacttatactgccaactttcaagctaccagagcagagcgacaagctgacttggtcaaataa

SEQ ID NO: 105323 - DNA, 327 bp, Glycine max
  Peptide Sequence Number=SeqID_222101
atgaaagctagggggcaagaagagactttagtgagccaaatagctcttgcactgaatcaagctttcaacaagcatatgtcggtcactatagaaaaatcaattattttgactgattcagccaaccatactccagtcgaaatgatggatgcatgcgaaaaaattgaccaagctccagaagataaggaggaagaaaatgggggagccattttggatatcatgtcattgaccacactaaagaagttaggaagaggggacttgggaatcttgcaatttgaccaagaagtggttcatcataaattgacaagccgaagcacgaccatcaattga

SEQ ID NO: 105324 - DNA, 729 bp, Glycine max
  Peptide Sequence Number=SeqID_222102
aggactacacgtcctcgccatcagagagctgcacgccctcgccatagaggactacacgtcctcgccttcatagggctatacgccctcaccttcagaggactatacgtcctcgccttcagagggatacacgtcctcgccttcatagggctatacgtcatcgccttcagaggactatacgtcctcgccatcagaggactacatgtccttacctttaaagggctgcacgcccttgccttcagaggactacacgtcctcaccttcagaggactacacgtcctcgccttcaaagggctacacaccctcgcctttagagggctacaggcccacgacttcagagtactccatgtcctcgccttcagaggaccgcataggactgcacctcctcgccttcagaaggctgcacgccctcgccttaaaggactacatgtcctcgcattcagacggctgcacgccctcgcctttagagggctacatgccctcgcctttagaggactccacgtcctcgccatcagaggactgcatgtcctccccttccaagggctacacgccctcgccttaagaggactatatgtcctcctcttcagagggcaacacaccctcgccttcgtagggctatacggcctcaccttcagaggactatacgtcctcccctttagaggactacacgtcctcgccataagagggctgcacgccctcgccttagaggactacacgtcctcgccttcatag

SEQ ID NO: 105325 - DNA, 591 bp, Glycine max
  Peptide Sequence Number=SeqID_222103
atgctggacgacgtctcctcgcttcttcatcttcccgtgattggtgacttacgcgcttttgagcccttgcacgtggacgatgcggttcagatgctggtggacttattgatggtctccgcagagtctgctagggctgagacagcccagtgtcgtggaccgtacatacgcctgcaatgggtacatgatatatatgagcgccgatgccaggcaggccattgggcagctgcgagtgcaaccaatgtccatgttgtctacttggaggcccttcgtgacctcagtatgatggagaggtacgcttggggagtggctgctttggtgcatatgtatgaccagctgaacgatgcatctatgagccacagtcggcagcttggaggttacatcacactgctgcagtgctggatttacgagcactttctgtcggtcacggactccactgctgatcaagagtacgacgaggattctccgcgtgcgtgtaggtggattgcgaccaagaagaccgtgaagagcattcgtacgccgtcatatagggagcacctggaccgactccggatttcggatgtctgttggatcccttatggggagcaccgggag

SEQ ID NO: 105326 - DNA, 216 bp, Glycine max
  Peptide Sequence Number=SeqID_222104
atgaatgcaaagagaagagaatatatggttggtgtgctttcaaagagaagaatattgatgcggcatggagagttgcaggggaaccgggacacgacgacatacagcaccatattcgaccacaacattcagtcaacggtgcaaggcatggcccaggttctctgcatcggcaagcacctccatcgtgtgataggcagcaacggctgctcccctaactag

SEQ ID NO: 105327 - DNA, 288 bp, Glycine max
  Peptide Sequence Number=SeqID_222105
atgcctcctcttcctcaaacctttagggttaatgtggatggaagttttcttcctgatttgggtaacataggatccgacggtatcatcagagattgctcttgtaattggttgtcgagtttccgtgcttataatggtattggtgatgtagtgaaggctgagatcttaggtctgcatactagtagagaggctaatttgatggctcattcccttgtggcgttgggtgtccaccaaggactccccctttgtacttctcttgctaaccttcttgtgaaagatagtcatgtgtag

SEQ ID NO: 105328 - DNA, 156 bp, Glycine max
  Peptide Sequence Number=SeqID_222106
atgcaccggggattggttggcgcgggaaacgtgtcgtgtgttgggagaaggaaagcgaagggacgaatgggagaaggaggagtgcacagtggtagcggcagaaaagtggcacgtaagaatgcgagagcttcggggattgtgaatgagaaactttga

SEQ ID NO: 105329 - DNA, 147 bp, Glycine max
  Peptide Sequence Number=SeqID_222107
atgggattaaggaggtgggacagatggacaaatagtgttagggatggtaggaacatggaaggggaggcgtcacttacctatgcgtcatcgttttcaaaggttgtcagtaaaggagatgacaagctgaaaattgtctacacaagctag

SEQ ID NO: 105330 - DNA, 234 bp, Glycine max
  Peptide Sequence Number=SeqID_222108
atgatcaacagtgtgcaagattttgggggctatcgaggaaatgttcttaaaaatattgggtgcattgatgtgccaagtattggtagttgttggatatgtagaaaaatagatcaatcgcaacttgcaatattcgttttcaacaggcaggggcttagaatcttggtggagctgctgatgtcagagctaggtggtagtgagaaaagatggcaaagtccaccaagggtgctgaagtga

SEQ ID NO: 105331 - DNA, 1157 bp, Glycine max
  Peptide Sequence Number=SeqID_222109
acagcaaagagctgttctacgaggaaacgctgaaaggcggcaagttcaaaaacaacccggtgctgctgcgtgagttcgttgagcgtgcgccagaagccattgagtggctggcggcgaaagacattgagctgagcgatatcaccatcaccggcggcatgagcattgaccgtacgcaccgtccggaagatcgctcggcggtgggcggcttcctgattagcggcctggtgaaaaacgttaaccagcgcaacatcgaagtgctgctggaaacctcagtggccgagatcctgtttgaaaacggtgcggtgaccggcgtgaaagtggtcgatgagtacaacgacagccgcatcctgaatgcgaaaagcgtgattgtcgccaccggtggcttcagcgccaaccgcgagatggtggtgaaataccgtccggagctggatggtttcgtcaccaccaaccacaaaggcgccaccggcagcggtatcgccatgctgcagaaaattggcgccgagaccgtcgacatgggtgaaatccagattcacccaacggttgagcagaccacctcgtacctgatttccgaagcgatgcgcggcggcggggcgattctggtcagccaggccggtaagcgtttctacaatgaaatggaaacccgtgacaaagtttctgccgagattatcgcgctgccggaaaaaagcgcgtggattgtgttcgatgagcaggtacgtgccaacaacaaagcggcggacgaatacatcgccaaaggctttgtgattagcgcgccaacgcctcacgagctggcggtgaaactcaacatggatcaggaaacgctgcaaagcacgctgggccgttacaatgagtttgtgattaaccagaaagatgaagactttggccgtgccaccgcgctgcgtcatccgctcaatcagggtccgttcttcgcgattcgtatcgcaccgggcgtgcaccacaccatgggcggcgtgaccatcaacaccgagaccgcggtgcttgacgcgcagaaacaggtgattcctggtgcctgggcggcgggtgaagtggtcggcggcatccacggtgcgaaccgcatcggcggtaacgccgtcgccgatatcattatctttggtatcaaagcgggccgtaatgccgctaaactggcgttaggtaactaa

SEQ ID NO: 105332 - DNA, 966 bp, Glycine max
  Peptide Sequence Number=SeqID_222110
atgacaagcgacgctggcgtccattcctattctgccgtcctcatgggttcgcccattctgctcaaactgttcgaagacaatcccacgctggccagccaggtctttcgcctgattaaacagcaggaaaacctgtttaccgtcaaccgcgccgaatccgaagtgatggccattaatcacgccgccggacgccatccggtggtggtgagcgcgccggtttttgcgctgattagcgtggcgcacgcggtgagcatcctgccggacagcgcgtttaacttcaccatcggtccggtggtgaaacgctggaaaattggttttcaggggcgtgaagtgccgcctgcagcggagattgaggcgctgctgcgcctgaccgatccgcatcaggtggtgctggatgctgaacagcactcggtgtttctgccgctgccgggcatggagatcgatctgggcgccatcgcgaaaggctacatcgccgatgtggtgcaggcgtttctgcgtcagcagggtgttgcgcaggcgctgattaatctcggtggcaatgtgcagacgctcggcagcccgccgcatcagccgcagggctggggcatcgggcttaaaaagccgtttggccgggacgatgagctgctgggtacgctgcaggtgcagggcaaatcggtggtgacgtccgggatttatgagcgctactttgaacgcgacggccgctgctggcatcacatctttgatccgcgcaccggctatccgctggacaatgcgttattgagcgtgacggtgattgccgatcgctcgctggatggcgatatctataccacgctgctgtacggcatgggcgtagagcaggggctggcgtatctcgccggccagcctgacatcgacgcggtgtttgtcacccgcgatcggcaaatcatctgctcgccggcgcgccatttccgcttcagccagctggatttcagctggcagctgcgtcactga

SEQ ID NO: 105333 - DNA, 1116 bp, Glycine max
  Peptide Sequence Number=SeqID_222111
atggccgcaatcagaggcgcggaagccgatttccgtctgatagttattagcggtcttcagaatataggcttctacctgcgcataatttttcatgtgcagcaggccgaggatcacatgcagcttattcatgaactcgtgcgagcgctcacgcagggcatcaacatagtttaccatgccggtcagacgctgcatcagctggctgatttcggtcttgtccctgaaggtgcagaccgcgccgataatgcgtccctgactgcgcaccggcacggtgttgctcagcagcagtcggccattgacgttgagctcctcatcgcgccgtgcgcgaccgccgttgagcacttcctgcagatgctggtcgatcaccgaggcatcataaatgcgcgcggtactcaccacgctgctgcccattttatcgctcagcagctggcgcgccgcctgattgaccagcgtcacctcgccctgatcgtccatcgccaccacgccttccttgacggagttaaggatcgcctggcgctgctcaaacagggtggaaatttcgtatggctcgaggccgaacaggatacgcttcagcacgcgcaccagaatgaaggtgccaaccgcgccggcaaaagtgccgatcagaatggtccacagaatgctccagcgactctggttgatctggtcggtgaccgcctccagcgagatgccgatagccaccacgccaatctgccgctgctgggcgtcatacaccggggtaaacacgcgcagcgatttggccagcgagccctgattcacggagacattctcgttgccgcgcagcgccggttcgatgtccgggccgataaagtgtttgcccaccagctccggattacggtgcgaatagcggatgccatccatgttggtgatgctgataaacagcagatggttgctctcttccaccgctttggcgatgggctggatagcggcccgatcgggcggcaggcgcagcgcctgctgaatttcgggggatttcgccagcgtgcgcgctaccgccatggctttatcctccagttggctgcgcgtcgcggcgccaatctggaagaaataaaacatgtgtacgctcagcagcaccagcacaatcaccgcgctgagcattag

SEQ ID NO: 105334 - DNA, 1467 bp, Glycine max
  Peptide Sequence Number=SeqID_222112
atggcggtagcgcgcacgctggcgaaatcccccgaaattcagcaggcgctgcgcctgccgcccgatcgggccgctatccagcccatcgccaaagcggtggaagagagcaaccatctgctgtttatcagcatcaccaacatggatggcatccgctattcgcaccgtaatccggagctggtgggcaaacactttatcggcccggacatcgaaccggcgctgcgcggcaacgagaatgtctccgtgaatcagggctcgctggccaaatcgctgcgcgtgtttaccccggtgtatgacgcccagcagcggcagattggcgtggtggctatcggcatctcgctggaggcggtcaccgaccagatcaaccagagtcgctggagcattctgtggaccattctgatcggcacttttgccggcgcggttggcaccttcattctggtgcgcgtgctgaagcgtatcctgttcggcctcgagccatacgaaatttccaccctgtttgagcagcgccaggcgatccttaactccgtcaaggaaggcgtggtggcgatggacgatcagggcgaggtgacgctggtcaatcaggcggcgcgccagctgctgagcgataaaatgggcagcagcgtggtgagtaccgcgcgcatttatgatgcctcggtgatcgaccagcatctgcaggaagtgctcaacggcggtcgcgcacggcgcgatgaggagctcaacgtcaatggccgactgctgctgagcaacaccgtgccggtgcgcagtcagggacgcattatcggcgcggtctgcaccttcagggacaagaccgaaatcagccagctgatgcagcgtctgaccggcatggtaaactatgttgatgccctgcgtgagcgctcgcacgagttcatgaataagctgcatgtgatcctcggcctgctgcacatgaaaaattatgcgcaggtagaagcctatattctgaagaccgctaataactatcagacggaaatcggcttcctgctggagaagatcaaatcaccggtgattgccggttttctgctcagcaaaattaaccgcgcctctgattgcggccatcgtctgaccatcagcgatgccagttacctgccggacagcggcaacgagcagcagatggcggcgctgatcaccgtggtcggcaacctggtggagaatgcgctggatgcgatgagtgagcagaccgagggcgaaatccacgtcatgctgcactatcagaacggctggctgacctgtgaagtgagcgatgacggaccgggtattgcgccgcagcatctggcaaccgtgtttgacaagggcttctctaccaaaggcgaggatcgcggggtcggcctgttcctgctgaaacagcagacggagcacctcggcggcagcgtcagcgtggagtccgagcccggcgtgttcacccaatttttagtccaacttccgtgggatggaggaaccaaaccgcatgattaa

SEQ ID NO: 105335 - DNA, 636 bp, Glycine max
  Peptide Sequence Number=SeqID_222113
atggccaagtgtttgacagtagcagtagaggcttcatcatcgcaattcacctttttcaatggtaggttggacatgatgagtgacggtgaaagtggagtttgcaagattaacagtaatggagaagttatgctcaaagcacaacaaccaaccaactttctaagtttgatcagtgcacatcagtttgcaagtgctggtaatgaggatccatatactcatctatctactttctatgaacaatatggcacaatgggcattcctaaaggtgaagaggaggttgtgtaccttagattattgccattgtctttaacagggaaagccaaagcatggctacaatctcatccaaatcaaagtttgacaagctggagcatagtggaagaaaagttcttgatagatttttccctccatctagatgttgctcagctaagcatattttgtaatgatctaaagcctaaatttagactgaatcaatccaagcttcatcctcagatccctctagttggactagcatggctgaagacaactattgcgcttagcacactgatctcgtgcttagcacgcgatcttgatattgatgctctgccagattcttctgttgcgctaagcgcctttagcggtggatgcgccttagcccactga

SEQ ID NO: 105336 - DNA, 168 bp, Glycine max
  Peptide Sequence Number=SeqID_222114
atggctctcctccatcttaggagtatgtgtgcttggttgagaaggcacctgctaaagctcttcatgattgagctcatgctgaaagagaggctcaaaggtggaagggctttagggattatttcttcaagaaagaaagaagttgccaaacaaaagggggagaagaagtaa

SEQ ID NO: 105337 - DNA, 255 bp, Glycine max
  Peptide Sequence Number=SeqID_222115
atgactgcaggggttcccatggtcacttggcctatttttgctgaccagttttttaatgagaagttgggagatagtattgcatgtgatgcagtggagaaggctgtgaagaggataatgatcggtgaagaagccattgaaacgaggaacaaagcaaaggtgctttcacacctagctaggcaatccatagaagaaggaggatcatcctactctgatttgaaagctttaattgaggagttaagttcattgagccactaa

SEQ ID NO: 105338 - DNA, 1438 bp, Glycine max
  Peptide Sequence Number=SeqID_222116
atgagcaatgaagttcgttctttgcatgtattcttcatccctttcttggcacatggccatatcataccaaccattgacatggccaaactatttgctggaaagggtctgaagaccacaataatcaccacaccccttaacgtacctttcatctccaaagccatcggaaaagccgaatccgaatccaacgacaacaacgtgatccatatcgaaaccatcgagttcccttatgcagaggctggtttacctaaaggctgtgaaaacaccaactccatcacttccatgcatttataccctgcgttcttcaaagcacttgggttactacaacacccctttgagcaacttttgcttcagcaacacccaaattgtgttgttgctgatgttatgttcccatgggctactaattcttcagcaaaatttggagttcctagccttgtgtacgatgggactagtttcttctccatatgcgccaacgaatgcacgaggctctacgagccttacaagaatgtttcttctgattcagaaccctttgtgattcccaaccttcccggtgagattacaatgacaaggatgcaggtgtcacctcatgtcatgagcaataaggaaagtcccgccgtgaccaaattgttggaggaagtgaaagaatcggagctgaaaagctatggtatggttgttaatagcttctatgaactcgagaaggtttatgcagatcatttaaggaacaatcttggaagaaaagcatggcatgttggtccaatgtttcttttcaacagggttaaagaagaaaaagcacatagaggaatggatgcatctattaatgatgagcatgagtgcttaaagtggcttgacacgaaggaaccgaattcagttgtttatgtgtgctttggaactacaacaaagttaactgattctcaacttgaggatattgccattggtctagaggcttcagggcaacaattcatctgggtcgtgaggaaaagcgaaaaagatggagttgatcaatggctacctgatggatttgaggaaaggatagaaggtaagggactaatcataagagggtgggcgcctcaagtgttgattcttgaacacgaagcgattggcgcgtttgtgacgcattgcggatggaattcaattttggaaggagtggttgcaggggtgcctatggtgacttggcctattgcttatgagcaatttttcaatgagaagttggtggccgagatcctcaaaattggagtacctgttggagctaagaaatgggctgcaggagttggggatactgttaagtgggaggcagtggagaaggctgtgaaaaggataatgattggggaagaagcagaagaaatgaggaacaaagccaaggggttttctcaactagctagacaatctgtggaagaaggaggatcttcttactcagatttggatgctttaattgcagagttgg

SEQ ID NO: 105339 - DNA, 690 bp, Glycine max
  Peptide Sequence Number=SeqID_222117
atgaaaaaacacagcgaagacatcctctactactcctccgataagctggcggcactcgggctggaaagcctgctgacggcattaccggtaggctgccgggcgcatgagctctggtcgctcagtaccgtcatctcgcagtgtgaaaagctgcgaccccgcttgctggtgtttatctttcacgaaaatatgccgctgagtggcaccttcaaagtgctgtatgcgctgcagcagcagtttccggctatgcaggtgctggtactgacgcgacgcctgttgccgatgatgcacgccctcagtcgttatctgcccggactcagcgtcctcgatttaaaatcctcacacaccgcgctgtgtcgttgcctgctggcctgtatcgccggcgggataccgcagttgcaggagggggctgacattctgctaccggaccggcagctacgggtgctgctgatgttggcgtggggctacaacacggagcagattggtaaccggctcggtatcagccataaaacggtgaatgcacacaagctaaatgcgttaacccgcctgcaggtgaaaagcaaaaacgacatggccgatctgtttatggtgattgacgagctgcgcatgctggtgggatggctgcgcctgcaccgcaatggcaagctgagcgatctggcttatcattcgctggaagagttactggaagcataa

SEQ ID NO: 105340 - DNA, 243 bp, Glycine max
  Peptide Sequence Number=SeqID_222118
atgcctaatcctgcaaagttcataactgagacgtccatctcccgacttgcaagggtgacatcaactaactggggaaacaaagcacgtgtaaatggaggcgttggcattgaatgcgagttgctgaggtgtcttctggagtggacctttgtcttcatcttcgcaatgaaccttgatgtttctcttccaccttcattacaagagaaacagcattctacattggttatttgggagcaactacattga

SEQ ID NO: 105341 - DNA, 291 bp, Glycine max
  Peptide Sequence Number=SeqID_222119
atggaggaagaaaaaggagtgccgaactacgacgagttgacctgtaaaggcgagagagctgcgtggttcaagctgggtctccgcttttcctcttcagcagcaaaggatgatgttccaaaaccctcctcttccttcctctccaaattcgtcaaagcctcctccgagtcaaagaagcaagcgcagctccaatccatccacgacaatctcaagaaaagccttcttttgagtctagggtttcgagctgggatagggacaacgatagaagtagaagatgaagtaggagcagagtaa

SEQ ID NO: 105342 - DNA, 585 bp, Glycine max
  Peptide Sequence Number=SeqID_222120
atgtacgagcatctgaacgacgcgtcgcaggcctctacacgacagttgggcggttatattacacttctccagtgctggatatacgagcactttcctacaatgcatacatccgttgttcatgatgcttatgatgaggggagcccacgggcctgcaagtggcttacgggtaaggctcatatgacggggatcaagggagccccgtatcggagacgtttggatgccctgactgtgactgacgtgtgctggatgccctatggtgagcaccggggagttaggggctttgacttgatatcatcgtacaccggccagctcagatggggtcagattgtggtgtacgttcgacctgagcgggttcttcgacagtttggctaccttcagacggtccctccgccgccggtttgtgattctttgacgggtgatgatatagatgaccagtggctgcatttttcagaccatttgttgccttcaggagagctctgtgtagttcctggacaggtggcgcctgactacatggagtggttttttcggatatcgcacccatttttcacgcggaccgaggagactgctgcatcaagacatgcctaa

SEQ ID NO: 105343 - DNA, 975 bp, Glycine max
  Peptide Sequence Number=SeqID_222121
atgggtgaagattcttatgggaagatgtacagaggtcagctgaagaatggctcacttgttgctattcggtgtgtagaaatgaaaaagagacacagcactcaaaactttgtgcaacacatagagctgatatccaaacttaggcatcgccatctagtcagcgctattggacactgctttgaatgttctttagatgattcaagcgtcagcaaagtatttcttgtcttcgaatatgtaccaaatggcacgctcaggaattggatctctgatgagcatgctagaaaatcctttagttggactcaacgcataggagctgcaattggagtggcaaagggaatccagtttttgcatacagggattgtccctggtgtatattccaatgatctgaagatagaagatgttttattggatcagaatcttgttgcaaaaatcagcagttatcacctgcctttgttgtcaaacatggggaaggttcggcgtggaaattcttccagtggattaaaaaattcaagcaatagtaaaagtgtaaagcaggaagataagtctgatatatacaactttggagtgatactactcgaacttattctaggaaggcaaataaagacagtaaatgatgcagatgcttttagggatctgttttcattatccatattcaatataaaccatgtacaattctatgaccctgcttctgttaattgcatcatgaggcagttgcaagcaagcttaggaggtgatgaagagggtaggaggggcgttgttgatccagcatttcgcaaggcatgcttggatcaatcattgaagacaatgatggagatttgtgtgaggtgcctggttaaagagcccgcagataggccttctatagaggatgttttgtggaacttgcagtttgcatctcaagtacaagatgcatggagaggggattctcaaagtagtgaagggtcaccaggctcagaatctcgagggctacccttccattag

SEQ ID NO: 105344 - DNA, 186 bp, Glycine max
  Peptide Sequence Number=SeqID_222122
atgatcaactttcaagacaagaagggactaatcataagaggatgggcacctcaagtgttgattcttgaacatgaagtaattgtgggcatcagtgacacattgtggataggattcaacgttggaagcaataactgttggggtgccaatgatcacttggcctgtggctgcaaagcaattttacaatga

SEQ ID NO: 105345 - DNA, 891 bp, Glycine max
  Peptide Sequence Number=SeqID_222123
atggccatagaaggcatggttagagacctacctgtgacaatgcagggacacaaactggttttacctgtgtatttacttgttgagcagttctatgttaatgggaatttattacattgcaaggagagcagcctaccctccctgctcagtctcaataccatcatatcaaaaggatctaaactagtcaaggtgaagccttatagatatcctgacagtcagaaggagcagattgaaaaaatggtgaaggaaatgctacaacaagcatttggaatcggttctccaaattctacagcaacacaccttatttgccaaattgtcaaaatgctcatttggcttaatagaggattcttgggtttaattggatactaccgtagattcatcaaatcctatgcttcaattgctgcaccactcacaaacttactcaagaaagatgggtttatgtgggatgacacagtaggacaagctttcactaagcttaagcaagccattacctctgctccagttctaggcctgccaaatttcagtcaaatatttgttttcgaaactgatgctttaggaagtggggttggtgttgtcttgagtcaagatggacagcctattgcatttttctccaagaaattaatcccaaaaatgcagaaacaatcagcctatgcaagggaattccttgccatcatagaagctatagccaagattaggcactacttgttgggacacagggaaagaaatctagctactgataccttgtcaaaagtgatgcttatggctaggtcggaacctcattgtttactgcaacctttgcctattccttctcaagtttgggaggatatcacaatggatttcataactggtttgcctttatcttttggatattgtcatcatggtggtcgtggatag

SEQ ID NO: 105346 - DNA, 519 bp, Glycine max
  Peptide Sequence Number=SeqID_222124
atgggacttgaggcatcgggacaacaattcatctgggtcgttaggaaaagcatccaagaaaagggagagaaatggttacctgaaggatttgagaaaagaatggaaggtaagggactaatcataagagggtgggcgcctcaagtgttgatccttgaacacgaagccattggcgcgtttgtgacacattgtggatggaattcgacgttggaagcagtgagtgctggggtgcccatgatcacttggcctgtgggtggcgagcaattttacaatgagaagttggtgactgaggtacttaaaattggtgtacctgttggtgttaaaaaatggactcgttttataggggatgatagtgttaagtgggatgcattagagaaggctgtgaaaatggtaatggttgaggaaatgagaaatagagcacaagttttcaagcagatggcaagaagagcagtggaagaaggaggatcttctgactcaaatttggatgctttagttcgggagttgtgttccctctcccattga

SEQ ID NO: 105347 - DNA, 351 bp, Glycine max
  Peptide Sequence Number=SeqID_222125
atggcccgcacgaaaaaatcaagtcaaatgatgtctgaggaagcaaagaaaaatgcagacaagattgtaaattctctggaagagcatgcctcacagggaagctttgtcacccatggatgtcaggatgcactgactgctgccattgggcgaccagagcaccttagtcgtgtctattctgctggagtcggtgtcactatcaaacactactttggaccagcttcaaggggcacccatacctctttgtccatggctcctgaagacctagagcaacttacacaaaagatcaaagaccgactagaggactcgatcacacaaaaaatgactcaacaattaatgatgttcttaagctag

SEQ ID NO: 105348 - DNA, 2115 bp, Glycine max
  Peptide Sequence Number=SeqID_222126
atgaaaccatttcgtttagcggcgctatcgttagcgctccttaccgcactctcattaagcggctgcgataacagcggtgaaccacaggccgtatcggcggccgataaaggcgccgccgatagcgcgaaaaagccggatagcgcgcagttggcgacgttaaaagaaaaaagccagggcaaggcgctgacgttgctcgacgcttctgaagtgcagctagatggcgcggcgacgctggtgctgaccttctccattccgctcaaaccggatcaagatttctcccacagcgtccatctggtcgataagaaaagcggcaaggttgacggcgcatgggagctggcgccgaatctcaaagagctgcgtctgcgccacctcgagccaaagcgtgaattgatcgtcaccgttgacccaacgctcattgccctcaatgacgccactctcggcagctcttttgaaaaaaccatcgctactcgcgatatcgcgccgagcgtcggtttcgccagccgcggttcgctgctgccggggaaagtggtcgccgggctgccagtgatggcgctgaacgtcgacaatgtcgatgttaatttcttccgtatcaagccggaatcactctcggccttcgtcagtcagtgggaataccgtaactcgttaagcaattgggaatctgacgaactgttgaagatggccgatctggtttacagcggccgcttcgatctcaacccggcacgcaatacacgggaaaaaatgcagctgccgctcggcgacgtcgcggcgctgaaacagccgggtgtctatctggcggtgatgaaacaggccggcacctacaactacacgcaaccggcgacactgttcaccctgagcgacattggtttgtcgctgcaccgttttcccacccaactggaactgtttacacaaagcctcgccagtggcgatccgctggcggatgtcagcttgcagctactggatgaaaaaggccaacagctggcgagcggcagcagcgacagcgagggtcatttgcgtttagcggctaacgccaaaggcaagctgctgctggcgaccagtaagggccagacttcgctcatcgaccttaatcgcccggcgctggatctggccgaattcccgattgatggcccgcaaggctacgacaaacagttcttcatttttggcccgcgcgatctctatcgccccggcgaaacggtcatcgttaatgcgctgctgcgcgatgccgatggcaaaccactgccgccgcagccggtgaaagctgaagtggtgcagccgaatggtgaagtggcacaaaccttcgtctggcagccagagaacggcgtttatcaacaacgttttgccttaccggcctcggcgatgaccggtaaatggacgctacgtattaacagcggcgacaaccagccgcgcagctggccgttcaatgtagaagatttcctgcccgaacggatggcgctgtcgcttaaaagcaacgctcagcccctgtcgccagatgccaacgtcacctttgatgttgaaggtcgttatttgtatggcgcgccagcggcaggcaacgaactacagggccagctgttcctgcgtccggcgcgtgaagcggtcgctgcgttgccaggttatcagtttggcgacatcactgaggaactgaaacgtagccttgatgatgtggatgaaaagctggacgacagcggcaggctgcagctcagggtcgaaagcagctgggcggagagccactctccgctcaacctgattttgcaggccagcctgctggagaccggcggtcgtccggtaacgcgccgcgccacgcaagcgatctggcctgcggccgcgctgccgggcatacgtccgttgtttaacagcgaatcggtgtacgactatcgcaccgatcgttataacgacgagccaaccgtgccggaaaacagcctcgccgaatttgacgtggtgtacgccaatgcgcagggcgaaaagctggcggcgcaggaccttgatgtgcgtttgatccacgaacgtcgcgactacttctggagcttctctgacagcgaaggctggcagtcacgttacgatgaaaaagatttgcaggaagagcagcagcgcatcagcattgcggcgggcggcagccagaaa

SEQ ID NO: 105349 - DNA, 198 bp, Glycine max
  Peptide Sequence Number=SeqID_222127
atgaagaagagttttaatatgattggagctattgatgatagcaaagaaacattcaagcttggagttcagattgtggacctgcggtttgaccaagtgcgtgaaaagtctagccaccttgaaatggtgttgatggatggaaagatatgttgtcatttagatttagttttgttagataatgtgattattgctcctctttaa

SEQ ID NO: 105350 - DNA, 1477 bp, Glycine max
  Peptide Sequence Number=SeqID_222128
atggcaatcgaacgcactttctccatcatcaaaccaaacgccgtcgctaagaacgtgattggtgctatctacaaccgtttcgaaagcgctggcttcaaaatcgttggtgcgaaaatgctgcacctgaccaaagagcaggctgaaggcttctacgcggagcacaaaggccgtccgttctttgatggtctggttgagttcatgacttctggcccggttgtggtatctgttctggaaggcgaaaacgctatccagcgtcaccgcgatctgatgggtgcaactaacccggacaacgcgctggccggtacgctgcgtgctgactacgcagacagcttcaccgaaaacgccacccacggttctgactctgcagaatctgcggcacgcgaaatcgcttacttcttcgcagaaaacgaagtctgcccaccagatgtagtacaattatgcgcccttgttgagcctggctcagcgagggcgctgccagagaacattatgtccgaacagattgtgacgccgtcgtccgcttcccccgtggttgtttccccgaaaaacgaaaaaattaacctgctggatcttaaccgtcagcagatgcgcgaattctttgttgagatgggcgaaaaaccgttccgtgccgatcaggtcatgaagtggatgtaccactactgctgcgatgatttcgagcagatgacagacatcaataaagtgctgcgtggcaagctgatgcagcgcgctgaaattcgtgcgccggaagtggcggaagagatgcgctccagcgatggcaccatcaagtgggcgattcgcgtcagcgatcagctggtggaaaccgtgtatatcccggaagccgaccgcgccacgctgtgcgtctcctcgcagggctttaaccgtaacctgcgcgtgtctgaaatcatcggtcaggtatggcgcgcggcaaaaattatcggtgccgctaaagtgaccggccagcgtccgatcaccaacgtggtcatgatgggcatgggcgagccgctgctcaacctttaccaacgtgtaccagcgctggataagctcggcgatatgatcgacgtggcactggcgatttcgctgcacgcaccgaatgacaccatccgcgatgacatcgtgccaatcaacaaaaagtacaacatcgaagccttcctggcggcggtgaagcgctacattggcaaatccaacgccaatcagggccgcgtgacgattgagtacgtgatgctggatcacgtcaacgacagcaccgaacacgcgcatgagctggcggcgctgctgaaagagacgccgtgcaagatcaacctgattccgtggaaccccttcccgggcgcgccgtatggccgcagctcaaacagccgcatcgaccgtttctccaaagtgctgatggagtacggtttcaccaccatcgtgcgtaaaacgcgcggcgacgacattgatgccgcctgtggtcagctggccggcgatgttatcgaccgcaccaagc

SEQ ID NO: 105351 - DNA, 585 bp, Glycine max
  Peptide Sequence Number=SeqID_222129
atgcagcaggttaatcacctgctggcgggacacctgccggcgcgcggcgtacccggcgatccgcgcccggcgacggtcagcgccgtcagtatctgctggcccggcggccagccgttgcccgccggcgacgagaactgccggcagcggcgttacagctgggtgctgaatcagaccgtgccgccaacgctgctggcgccggggcaggagggcgtcaatggcttacgccagcgcttctggcaaaacagcaaagggctgcgcgtggcggcggattgtccggatgcgcaaagccgggaacgcgtgatgtggccgctgccgcttgagccgtggctgccaccgggcgaacggcgggcgcagcgcctgccgccagtggatgtgacctgtccgccgctgaatcagggggacagcgcgccgctgctggtgaccggcgtgatcaatggccagcgcgtgcagccgctgcccgggcgggcagggtacgcagcgctggtggtttttaaacgggcagccggtggagcttgctgcgggaaaaagcagcgcctcgctggtgctgcgcgagcccggtcgttatcagctggtggtgatggatga

SEQ ID NO: 105352 - DNA, 408 bp, Glycine max
  Peptide Sequence Number=SeqID_222130
atggcagaaaattccgctcgtcccggtaaagggttgagtctctggtccgtgttattcgggctggtcctgctggcgatcggcctgttcttcgcgatcggtggcggtaaactggtggccctgggcggcagctggtacttcctcattgccggtatcgtcatgttactgtcggcgattcagttctttcgccgtaaatcctcggcggttacgctgttcattctggtcttcgccggcacgctgatttgggcgctgtacgatgctggctggcagttctggccgctggtgtcgcgcctgatggtgccggccggcctgatggtgctggcatttattacctggccggcgctgcatgttccagccgcatccgaccgtggccttcaccggcaagcaactgccgctgatcccggtagataa

SEQ ID NO: 105353 - DNA, 456 bp, Glycine max
  Peptide Sequence Number=SeqID_222131
atgcgggagcagccggtcaatgtcttcctgactgagcagggacaggaagttatccgttacgctttattttatatctgttggtacgggagctacgcccgttatgcagcgcttcatttttgctacaaacgcagcgcgaagcgagcagccagcgccacttcgcgctatcgcaaaccctcattcgatgacgtcttccgggcgataatgcacgcgcctgctggagatcaggccgtgaccgtgggtacagaaataatctatggcaccgcacgccttcagcacctgcagcggctgctggcagtcgggacagcaggccagcgcggtgaaatgacgctggcagtgcgggcaatcgaagcgctgttcgctgtaagtgagcggttgctgacagtgagggcatggggtgagcatgatgactccggaatcgtggctgaggatcgtgataaaccggatgttacgccataa

SEQ ID NO: 105354 - DNA, 219 bp, Glycine max
  Peptide Sequence Number=SeqID_222132
atgtgtatatttgtttttcagaatttggtggataaagatgcagataaacgtcaagcagtagcattgcgtgtagacggtgataaagctgtattttatcgagttaggcttgtgggggagcaggacactctcttggataacacaggaatccattatttctaccgaagttacattcaaggatccgttgattttatatgtgggcacgcaaaatcattgttccat

SEQ ID NO: 105355 - DNA, 522 bp, Glycine max
  Peptide Sequence Number=SeqID_222133
atgggggagacacatgaagtacccaatcacaatctagccgacttcgagccttgccttggatatgccactgaggggcaagcagttggtggcatacccctgccaaacactctagagggacctcaaattcacccacaaccacaacccttgcattttgcggtgggaagagtccctcctgccatggtggaatgggagaaattggattacctagaggaaaggctcagggccattgaaggaggcgaatattatgcctttgctaacctagaagagttgttcctagtacccaatatcatcacccctctcaagttcaaggtgttggactttgacaagtacaaggggactacttgccccaagaaccatctaaagatgtattgtcggaagatgggggcatacgcaaaagatgaggaactgctgatacatttcttccaagaaagtcttactggggtagcggttacctggtacactaacttggaaccttcccaagtccattcatggaaggacctaatggttgcctttgttaggtag

SEQ ID NO: 105356 - DNA, 303 bp, Glycine max
  Peptide Sequence Number=SeqID_222134
atggctcttgggtcaaaaagggtgctcaacccgctgatgatgaaggcaacctaccagttgaagacaactcctctcttcttcaaaagcttttggacaagttcgatggattgtcatcatcaaaaagggggagattgtagacaaaggatcaagctgaatgttttgatgatgccaaagggttacatgtttctcaaagcttgccaaagggttacatgtttctcaaagctttattcaagacaaagaaatcaaagatattcaagatggatgatcaagacagtttctagagtcttaggaagagtatattaa

SEQ ID NO: 105357 - DNA, 258 bp, Glycine max
  Peptide Sequence Number=SeqID_222135
atggtggggtacgtgccttcaagctttgcggatttggtcttcgccgatgaaaggattgaaatgggtctaaaaagaggcaaatttaatcatcctgcttggacgaatgagaaaactggggcaaatgaagaggatgagaaggaaggagaaacccatgctgtgactgccattcctatacggccaagttccccaccagctcaacaccatcattactcagccaatatcagccattctcattacccaccacccatttatccataa

SEQ ID NO: 105358 - DNA, 270 bp, Glycine max
  Peptide Sequence Number=SeqID_222136
aatgtttatacggataaccactcgggtatttccgcccgtcagcgtgactcaaaagtcagtatgacagatcttgtgagcgcagaagatgatgtaaatctccgcatgtcaacgggcttgtcgaccgcgattgacgaagggcgcagaatgaccataatttgtctctgcgtgccatcggacacaactgtgtctgaatggcaaaagggtcagtatgacagagattgtggggcggctgacaaaagcaaggctcttgctcctacgtatcctcaatga

SEQ ID NO: 105359 - DNA, 270 bp, Glycine max
  Peptide Sequence Number=SeqID_222137
atggtcattctgcgccctttgtcattcaggggtagtgagtcaagtggtgggcggagacaaattatggtcattctacacaccgttttgccatccagaggcgatcgtgtccgttggcgcccagagacaaattatggtcattatgcgcctttccatccaagcccgatcgtatccgatggcacgcagagacaaattatggtcattttatgccttgtgttaaccaagaggaacgaattcgacagtatcaggatgatgttggtcgttcggtgctga

SEQ ID NO: 105360 - DNA, 399 bp, Glycine max
  Peptide Sequence Number=SeqID_222138
atgaaatgcgttttcggtcaaaggttctccaccctcgagtttggagctatgcgtagtgattgcttagtgcaattctccagtctcaccacttttcggagccccatgaattgcgttttcgttcaaatgtccttcaccttcgagtttggagctatgcgtagtgattgcttaatgcaattcccctttctcacccttttgcggagccccatgaattgcgttttcgttcatgtgtcatccaccttagagtttggagctatgcgtagtgattgcttagtgcaattctccattctcaccctttttcggagccccatgaattgcattttcgttcatgtgtcctccacctttgagtttggagccatgcgtagtgattgcttagtgcaattctccattcttaccctttag

SEQ ID NO: 105361 - DNA, 498 bp, Glycine max
  Peptide Sequence Number=SeqID_222139
atgggtgacttcgcccaggccactcatgaagcaggtcagacctacgggtgggactgtgccatcgtctgctgctactcttgctgtcggagaaaggggttaacctattgttactgttactcctgctcccccacctcctcttgtggcgcttgtttaggaggttgttcctgcatgctacctgctttggatggttttgttgtggtgccctcgtctaccatcgttgcacctttattgagtgtcggtgtggcgactgctagtgctcttggtgcaagttacaggctggaccataagaccttttgtctcattagatcacctgtacacctcgactggggtgcaaaatgctatggattctgccaaagtctttctctagagaattttggtgattctaaaggagaatggacaacagaaccaagagacttttcacaaggtggcgtccttggaggcggaggtcgccaaatggagggctactactcgcactgtttggagagtagagcgccttaa

SEQ ID NO: 105362 - DNA, 309 bp, Glycine max
  Peptide Sequence Number=SeqID_222140
atgtacaagacaaaaggagtagagcccaactcaaaagttgaaatgaacaaaaggtatgagcaagacgctcttgagcttcgttatataaattctttagggatcaacccgtgtcatcaattttcggcgggatcaacagaaccatggcatcactctatgaccttaaacaaaaaaggggggggtcacttggtgatgcaatcctatcccgcaagggcattgggtagaagactccaagtagattgggctagagatccaagggaaggccctaaggttctcatgagccttagggtagatttcgagcccatgggctaa

SEQ ID NO: 105363 - DNA, 654 bp, Glycine max
  Peptide Sequence Number=SeqID_222141
atgtcttcattcttgtttgattacgccaccagcatgggcggtagtgattctgagggctcgattgagcaacccttgatggaccgggaagtcatttccattggtagttcctcctccttggatgctcgtcgtggtgccgtcgatagcaagtcctcctccttggagaaggtgaaggcttcatgccatactagtggaggaagttctcaccttcgcgggagggtgcgaccttccgttgcttctggggagcctttcctggttactatgatcctcccccctgttgcttttgggggagtgaggagaggtagtggcaatggagatgccagggcatttgcccacgttcgatgtagccatagtgctggctcaccatcgtccccacttgctattgttggctgtcgcaacctgcccttcagcgggggcgcgaaaaggcttctcggatgggccaagggtgcgtcttccaaggaaagaaaacgcatggagtcgccaccaatggttcaggagtcatttatgcaaggggaaggtattagcaccctacgcgcttgtcacaagggactcgacaagggtgtttccctcactcctacatattcctcaattgcaatgaggaaatcagacctaaaggagagagtcgttaaggtgttggaccttgaaacgacctcttga

SEQ ID NO: 105364 - DNA, 1128 bp, Glycine max
  Peptide Sequence Number=SeqID_222142
atgtcgacaacgaaccacccaatgcgcggcaaacgaacctccaatgaaaggaaacagtgccaggaagagaagaagctcaaaaggcagtgcaaaaacaaccaaatggcgcatggaagaggaagtgttttttatttttcactcaccgaccggaagaaaatcccccttacattatcattgcgcctcttcgtaagcccaccgcggcttatgttgtttttggccatggacgaatcaccggcgaacagagagagcaaaagcgaggaagaagaagaagatgatggctacatgggtgacctttctcagtttcttccttccgatgctctcgaacctgctaagttgtcttcgtccaaaaagacaaatgttaatgattgtagctgtaactacaattgcggttgcagagacatgaaaaacgttgatgttgcagtcacaattgtttttgcagaccgcattttcaaactttgtgcgtgtaacatacacagtgatgatatctccctttataccatgcagatttccagcaagaaagatccttcagtcaactcttccaagaactggttgaaaactcttaactggcaagaacggcgaaaacttgaaagagaaaggaagcaacaagaagaggatgagcaaacattagcgaaagtggaagctccaataccacaatccaacattggatttaagcttctcaaacagatgggttattctccaggttctgccctaggcaagcaaggctcgggcagggctgaaccagtggggattgaaattcgacggtcacgagctggtgtaggcttagaagacccccacaaggagaagaggaaaaaggaggaaatcatgatggacaggaaaagaaggaaagaggaggacctaatgaaagaatttgggtctaggcagaagtcacagtggcagagtaggagagttataattaattacaataaggcaaaggctgcccttgaccaactggagaatagggtaattgtggagccacaaaagaatgacgatgttgcagagggtgaagaagaagaagaggaagaaataacagaagaggacttgcacgatgttttgatgaaactgagggatgaatttaattattgcctcttttgtggatgccaagtgagtaaacaccagatttacttctaa

SEQ ID NO: 105365 - DNA, 246 bp, Glycine max
  Peptide Sequence Number=SeqID_222143
atggttcattggcaagtggtggttgtagtgatggttgatgtggccattaacggtagagatgaagatcaatggatgcatgacagtataatatttgaagaagctgatatgaataaagaaaatgaagacgaacttggtatgaatgaagaacatgttgattgttttgataccttcaatacttctcaaaggaaaatgcaaggatcatgcataagtaaacatgaagagatgcttatgcggtgcatgatatga

SEQ ID NO: 105366 - DNA, 360 bp, Glycine max
  Peptide Sequence Number=SeqID_222144
atggtccaccgtatcatcgaagctgacatgcctaaagatgaatatctggatgctttcttgactcaggcaaatttgtacactaatgacgatgtgatcttgtgtcgtgtctttccaatgtccctcaagggggcgacaatgaccggacaagcagatgatgaatctctccagaaattaagggataggtttggaggcattgtcatccaaatccataatctcaacccagaggtagcattacacttcattctcctcgctttacagtctggcaagtttatggacagtctatgcaaaaaaactcctagtagcatggacgagttgtacgaacgagccaaaggctacatccagatggaagaaatatcttga

SEQ ID NO: 105367 - DNA, 336 bp, Glycine max
  Peptide Sequence Number=SeqID_222145
atggaggttgttccaaatatccccaacccccattggctatgcatttcagctgttttgggtgaaaaaaattgtttccgtgaagaaaatccaagccgaggtgcttccgtaactcttccgagacgtttccgtgagcaaatccgtcaaggtttttcgtctttcttcaccgttcttcatacgttcttcgttctttcttcgttcttcaacggctttcatcttcatttcgttcattttcggttttcttttcttccgtttttaacgagctttaaccgatcgtttaagccgttatctcgcctcataaatgataaaatgaatttcaaccggtcatttgcattgtaa

SEQ ID NO: 105368 - DNA, 525 bp, Glycine max
  Peptide Sequence Number=SeqID_222146
atgttaaagaaggggcacaaaatctcaaaggccatcatcatggcccgattgttcaggaaggattgcctgacgcgccctcaagaaagggaggtcatcactcccacaagcctggacgactaccttgtaggagtcctcaggattttccagcttcacctagtgttggagagcagtgatacttgctgcagaggtgagggaggatttatacttcaaaacatcgtcccttacccactcatagccagcaacgacaggggggacgatggcgacccaatgctatggctacgtcgcacgcagggagatgccctaacatccccatcgcttgtccttactcccttaggagtagaaggagggagaatcaccatgatcgagatagactccctgaccagggaagcaatgaaaggccgcaccctccgtggaggtgggaggttcctctaccaatatggtgcgaagccctcaacctctctgaggaataggattcgctatcagaggcactacgacaagtatccaccgaggaggaaccaccaatga

SEQ ID NO: 105369 - DNA, 276 bp, Glycine max
  Peptide Sequence Number=SeqID_222147
atgcaagagcacgacattacgtctctaatacgtgtcactgcaagagtggcacctatgcaagagaacaacaccacatctccagttcacaaaacccaacgtccatcctttggaagcctcaacgcagctctacaggcttgtcaaaacccagggcaaacacgtccttgtccaaggctcgttaaacccaagggatacaagaacataaaaaacccaaggtctacccttggtaagcactcgcacaaaacccaaggcaccctccttgataagctcactccttaa

SEQ ID NO: 105370 - DNA, 375 bp, Glycine max
  Peptide Sequence Number=SeqID_222148
atgaaggtagaactcgtgacaatagatgaagtccaagaaatgatcaggattagagaagaagctaccaagcttcgagcagcaaggagatacaatacaaaggggcttgttaaacccaaggttcgtccttgggaaagggaagaatcaaaagaattctcagactgtgtcgttttgaattctttgaaaagggagaagggagacaaaagaattcaggcgattagtccttcgttcttttggaaaagggagaagagaaacacaaaaagaattcaggcgaacaaggtttggaaaccaaaaaactcagaaagcttttggcaaaggaagaagaagaagaagaagaagaagttcaaaaagatgttcaaaaagattcaaaggttgtaa

SEQ ID NO: 105371 - DNA, 306 bp, Glycine max
  Peptide Sequence Number=SeqID_222149
atggagagttccactacagctaaagcagtgagaggtgggaaagttccaaggtgtaattgcaccgacaacccctacaggttgcaaatcccaaagagacttgtagagattcaagacgctaaaagcaaatcatttgtcaaccacgcaactgtgagctattttcataggaaaaaaatgataaccatgcattctctcatagcaagaacagaagagaagcaactcactgctgccactgcatatgacaagcctatcaatatgatgcaggcacctggaacttctacatctgtcaagttttacaagtgctattag

SEQ ID NO: 105372 - DNA, 413 bp, Glycine max
  Peptide Sequence Number=SeqID_222150
gcgagaataacggcaccgtggtgaagaaaaaacgtgaaattgcttgtgagattgaaactgccggtggggatattaagctgggccccaccgcggttctggaagcactacatgtaccgaatcgccctccgaaacgatttggtgttggatgttttcccatctccgccactgccgaaatcctcgatcgacaagacgaccttccttggtggaacatcgcgaaagaagccagcacaggttggtgtagttattggaaggggcggaagttgaaacccggaggcggaggcggcggcgagacttccaagggagggtttggaggaaaggattgcggtgcagcatcatacatgggtttggaggggaggagtggggtgcggcgcaagagccttatgcctcagattgaaaccactgaagctagctag

SEQ ID NO: 105373 - DNA, 1464 bp, Glycine max
  Peptide Sequence Number=SeqID_222151
atggtgattctccctccttctactcctaagggagtaaggacaagcgatggggatgttagggcatctccctgcgtgcgacgtagccatagcattgggtcgccatcgtcccccctgtcgttgctggctatgagtggtgtgttcaataaactgtttgatttagacttaaacaacttttgctacttcaaggatcgtttcttcaaggtcctggttactgatgtcgtggctaatggattttttgatgacaaagctattttggaacagctatcgacctcattggacgcacgggccattctgtttgttcctttggaaagcgatcctcttgttgccttagacgataaattttgtaccttgtcttgtcaattcaagccccttatgaagcaggtcgaacctactgatgggactgtgccaccatctactgtcccccctgttattggagaaaggggtcaacctgttgatgagattggctctattgttggtattgttaaggtcgcccccaatgctcgtttctatgttttgactaagaggaagctagatgatgacactggggtgcaagctacagggttgacacttggtttgggtcaccctccaagtttgcaagatgtgtctccggctccaagggttgttgaggctcctgcttccactgttattgttgttgctactcctgctcctccacctcctcatgacactcctgctactggagttggtgcgatggctacttcagttggttctattgcgacatcttcttccaacgttgccacacccttgttgagtgctggtgtggagaccactaatgctcctttgatgccgcctcttccttctttggctccaccggttccaccttttattgtgttggcagcggcggtgccttcctcatcttctcatccccatgtctctttggatcacttgtatgattcattgtggggtgcaaattacaaaccgaagaagaagaccccaactggctttgtgtcatcctgtgatagaaacctcatccagtcagttggggtgcagaacactatgaattctgccaaagtcttcctcttgagaagcttggcgattttgaaggagaatggacaacgacaccaagagactctgcgcaaggttttgtccttcgagacggaggttggtagtgtcttgcccaagttgttgttcacaaggttggacggtgatgaactgtccgcacactgcaagggcttgtgggaagagaaaaatgacttggctggcaaggtggaaggcattgcggcagagagggatgagcttgccaaggttgttgttgatttaaaggcttggctgaaagagtcaaagtccaggctagaggagttcgagctgtgggctattaggcaagccaggttcttcaccaaggaccttgacttgggtctttttgaccttttcaaggatgtgaaggacggtgttctgcttgacgaggaagatattgctgctgaggaagaggctggcgaggaggcgtag

SEQ ID NO: 105374 - DNA, 372 bp, Glycine max
  Peptide Sequence Number=SeqID_222152
atggatgtgcttggaagtgcaaggcaacatacatccttgcaagaaaaatcattccacgatttaccgagattgttgcaaactatacatgaatttcttcccggtatgtttatagagaaggaaatacttccaatgcccctacaagaaggtgaaacaatagagggtttcatgaaatcccatcatcttttttggattttcagaccatgtatcgatgggtttcaatatgggaagtctgttgttcaggtcgatggaatctggttgtacggaaagtacaaaggggccctccttgtgattgttgcacaagcatggatttccttcctcaaaaacttgaaaaggcatgtcacactacaagatggtcagatagacatgagttaa

SEQ ID NO: 105375 - DNA, 774 bp, Glycine max
  Peptide Sequence Number=SeqID_222153
atgtgtgatacattggaaagtgatttgaagaattttttgtatccggtgtgcaagaagtcattgaccctattgtcaacggtgttaagtatggttaatatgaaggccagatatgggtggagtgacaaaagcttcacttcgttgtttaaggtagtgcaagaaatgcataaatgccccaggtgtgggatatcatggtacaaagtgacaaatgatgacaagtgtagcaatgatgaaagcgcaaagaaaaggctcccccagcaaaggtttaagcgtctctttgctaatggagatgatgcaaaagactttacatttcatgcaaatgggagaaactacgatggaatgctctgccattcagatgatttttcccaatggaagaagattaatcatttctatccaaatttcaggaaagaggcaagaaatcttaggcttagacttggcgctaatggaatgaattcctttggcagtttaagcactaaccacacttcgtggcctattttgctagtaatttacaacttgtctccttggttgtgcatgaagcgaaaatacatgatgttgtctatgatgatattgggcccaagacagccaagaaatgacatcgatgtttatctaagtcccttgattgaagacttcagaaagttgggtgacgagggggttaaagtgtttgatgggaatcaaaatgagacattcaagttgtgtgcaatgatattttgtaccattgatgactttctagcatatgggaatttgagtggatacagtgttaagggtcatcgtgcatga

SEQ ID NO: 105376 - DNA, 842 bp, Glycine max
  misc_feature (154)..(154): n is a, c, g, or t
  Peptide Sequence Number=SeqID_222154
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtanggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtgaatcaaacgagctttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 105377 - DNA, 356 bp, Glycine max
  Peptide Sequence Number=SeqID_222155
gtctccaaggtgaacaggcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 105378 - DNA, 560 bp, Glycine max
  Peptide Sequence Number=SeqID_222156
aatgtgtgcgcacaaggtcattccacaaaggagataatgatgagtgatgaagatttcgtaacatcgcgcgatacccaggcgctggcggatgaagtcgcctgcctgaaaatgatggtgacgctgatcctgaaaggtatgggccaggcagatgccggtaaggtgatcatcaacatggagcgctacgtccagtccgcgctggctgataaaccgcaggccgaggtgttcagcaacaccattcgccagattaaaaccgcctaccgtcacgacgcgtgccgcgatacttctccgccagcgctggctgctgcaccggaatacgaatggcaaacagattgtcttctgactggatcagtcccggcgagagcggctcctgtaccgaatgccataagatgttcagcggcagttcggcatccacttcaaggcgggccgaatagcgcgacatttcccacactttttgctggtcaaaaggcagcaccatgccctccggcacttccggctcgtgccacggtaacagacgtgcgcagccacaaatgccctgacgcgcagtccaggcaatcagccag

SEQ ID NO: 105379 - DNA, 691 bp, Glycine max
  Peptide Sequence Number=SeqID_222157
atgcctgaaccgggctgtcacttgcacccgctaagcgcagtgcgccccaaaatggcgcagcagacgcctcattttggcgaaatatctgctgagaaatggctatgtcactgcaggtttcacgtcacgatttcggatcaatggatgatgccggtttatgcccctgcggcttttgtgccggtgcgtgccgaaggttttacgctgtgggatcagcagggcaaagagtacattgattttgccggtggcatcgcggtgaacgcgcttggccatgcccatcccgcgctgcagcaggcactgactgagcaggccggtaaactgtggcacaccggcaacggctacaccaacgaaccaattctgcgcctggcgaagcagctgattgatgccacctttgccgaccgcgtgttcttctgtaactccggggcggaagccaacgaggctgcgctgaagctggcgcgtaaagtggcgcacgaccgtttcggtgccgaaaaaaacggtatcgtcgccttcaccaatgccttccacggccgcaccctgttcaccgtttcagccggcggacagcccgcctattcgcgcgatttcgccccgttaccgccagccattcagcatgccacctttaacgatctggcctcggcggcggccttaattaatgaccagacctgcgcggtcatcgtcgagccgattcagggcgagggcg

SEQ ID NO: 105380 - DNA, 219 bp, Glycine max
  Peptide Sequence Number=SeqID_222158
atggaagaagaagcccacgaggatgaggagatggccgatttgcttgactttcttgggagggagtggagacacgtgactgggagatccccagattcatcgcatacattttgtttagatcgttgcgttagtatttatatatcattactatcgatgatgttggaaattctggaaccgtgtagagttcttcgtttaggaacatcgtccaaagtatatatgtaa

SEQ ID NO: 105381 - DNA, 294 bp, Glycine max
  Peptide Sequence Number=SeqID_222159
atgctcgtcatcaccgtagaagtggagtgggtgatgacgggaaaggacgagagtagagtggtgacgtggtggtgggcattggcatcggcgagacgcagcttgactttgacctccattggggaagagaggagggagagtgcggttagggtttacacagagagcccgatgcgatgggccttggaagagggatctttgtgtagaagcaagcttcatgatgaatcaagattgattcaaggagttttgatgataacaaagatgatgacaaaaagctcaaaagtcaagatcacttcatga

SEQ ID NO: 105382 - DNA, 276 bp, Glycine max
  Peptide Sequence Number=SeqID_222160
atgtcagagctcataggctcacctgatgacactagcattggatttctacgaagtgataatgcttgtagatatgtgagacaacttccacaatatccaaggcaacaatttgctgctagatttctaagtatgtctcctggtgctgttgatttgttagagaagatgcttgtccttgatccaaataggcgcatcacaggttattcaacatttaacatcggtgcttacgtcaccaacgatgttaaaacacattttttacatcgttcacgaatacaacactga

SEQ ID NO: 105383 - DNA, 1734 bp, Glycine max
  Peptide Sequence Number=SeqID_222161
atgggttggggaacacccgtgatctccaacccagaaccaaaaaccatctattttttatacagcttcttgcttgtggaaacgttagaaggtttacacgttctgttcacaagacaggcagcttggaagtattttatcccatggggcccccttactcaagatacaaatttttctcacactatagacatgtacacaaaggacaatttctattcatgttatttaaatcgaagggccagctctaccgccaataggtcaaattgcccgtgcggagagcttgcttggacacaaggaaaatgggctgaagcagaatccttcccaacaagggattcactttatgtgcatgcacaagacgggcatgtgtatttaactgcagctctcttggcagccattgagatttttatcttgtttctcagggctgcctatttggtgattttgttctgtccttgcatagctatggctcctttagttggtttttttggcactcaatttagaaaaacatggattcatgttgttcgagttacactagaaaaagctggtccagcgttcattaagtggggtcaatgggctgcaaccagacctgacctctttccaagggatctctgtgatgaacttgcagaatttcaaaccaaagcgccatcacataaatttagctatagcagaaaatgtatagagaatgcatttggtcacaaattatctgaaatatttgaaaattttgaggaggaaccagtagcttcaggtagcattgctcaagttcatcgagctacactaaaatacaaattccctggtcagcaaaccaagcctgttgttgtagcagtgaaagtccgacatcctggggtttctgaagcaattaaaagggattttatccttatcaatcttgttgccaagatttcgtctttcttccccaatttgaagtggttgagactagatgaaagcatacagcaattttctgtttttatgatgtctcaagttgatctttcaagggaagcagtgcatcttagtcggtttatctataatttccggagatggaaagatgtttcatttccaatgcctctgtatccccttgtgcacccttctgttttggtagaaacctttgaacaaggtgaaagtgttttgcactatgttgaccagcctgaaggacatgagcatttcaaaagcacccttgctcatattggaacacatgctcttttaaagatgcttttggtggataattttatccatgcagacatgcatcctggaaatattcttgtccgagtaggaaaaagcaaatcaactctcttgaagtcaaggcctcatgtcattttccttgatgtgggcatgactactgaactttctaagagagaacgagaatatttagtcgaattcttcaaggctatagcacttcaagatggccgcactgctgcagagtgcacacttagattatcaaaacgtcaaaattgcccagatccgaaatctttcattgaggaggtggataaatcgtttgaactttggaggtccccagaaggtgaatctgtccacactgctgatcgtatgcaacaattgcttgagcatgttaggcgctgtaaagttaatatcgatggcaatgtttgcgctgtgatagttaccacattggtcctggagggttggcagcgaagacttgatccagaatatgatgtgttgcacgctttgcaagcactgctatttaaagctgacttggcagagtctctatcttatgccattgaaggattggtggctccatga

SEQ ID NO: 105384 - DNA, 207 bp, Glycine max
  Peptide Sequence Number=SeqID_222162
atggcggtttgtggtggctactggtggctctgggtgatggagaacaagattggcacattggaaatggaaaggaagcattcctcacacgccagatgtggtatcaaagatcgcaacggtcaggtcgtggatacgtgttttttaaagcttcaaaccaaatttcgagaagatccaacggttaatgaaggcggaacagcgtttttaccgtga

SEQ ID NO: 105385 - DNA, 366 bp, Glycine max
  Peptide Sequence Number=SeqID_222163
atggattcacatgttgtctttgttgcgagcgtgacgctggtggaaaatcctggagcaccactctacagacttgcaatcgagccacaatgtggaggttgtggcaccgcaagcttccggcaaaactactgcatagaggtggctagcaaccagctcgcctgggctaatcaggtttcttcaagcataagtaatcaactcgcctgggcaagctacaactcgctcaggcaagtctgcaccttcagagctgatgcaatcctccctaggaagggaccaatcacaagaaccatgagcaagaggctccaagaagattgggctagagctgctgaagaaggccctagggttctcatgaaccttagggtagatttctga

SEQ ID NO: 105386 - DNA, 297 bp, Glycine max
  Peptide Sequence Number=SeqID_222164
atgggaggtaaaaaaggagaaaaggtaaaagaaagcaccatgatagaggcagagatgaaagcacaaaagaacccttcaatccaaggtatgcattcatcacttaatcctccattttttgattttagcaagctaagaatccataaacaaggagacaatgagaagatgtccaaattcgagaaatacatggggatgctacaaaggaagaaggaggaaccacctattgaaaaactcacatgggtggtgctacatcaacggaggactagcaagttccaatcattcgaggaagatccttcatga

SEQ ID NO: 105387 - DNA, 324 bp, Glycine max
  Peptide Sequence Number=SeqID_222165
atggtggacgggacaacagcgaaagaaaagcaaaaactagaggaatgtcttcatgatctagattttcccaaggaagtgattgtgggtaaggatgaaaaaccaatcattatcaatagttccttgactaaattcgaggaagaaaagttggtaaaagtgctcaaggcaaataaagattcaatagggtggcatatttctgatctcaaaggaataagcccctcttactatatgcacaacatcaacttggaggatgactgctatcgcaacctacctcacgacgggatggcgaaagaaaataaaggaggcgtcatcgaaaaaagaaaatga

SEQ ID NO: 105388 - DNA, 900 bp, Glycine max
  Peptide Sequence Number=SeqID_222166
atggccaaagccataactaatgaagaaaaaggtctaaaaaactttggaattgataagaaaatccagaagattatgaatgagcagcaaaagaagaagacaaggaaacaatctcaaagggaaaaagaaaaggacgaattgatagctagagagcacaaaactaagaaatggtacgagcagtctgacctcaatgaaactgatgatgaagaagaagaaaatgtgcagagtgttcttcagaagcgaaaggttatggcccaagttgctcctactccaaaaagaacaaaggttgccaaaccagcacgtgcatccaaagaagttgtcattccgtccaccattcctagacacgtcaagacaagagccactaaagccaatcctaagattgtaaccaagatgcaactacattggttggggcttggaactcaacgtgtctgtccatcaactaaggtcacactagctgttgcatggaggaacctccaaatgtctaaggttaagaaaagcactcaaaacagtatccctagggatctatatgagaaacataggagggatccttcacatgaggtggaaccaccaaagaggttgcacatcttaaaggcgaccaagatcaaaattattgtagataaggatgtagacaactactttgtcatcaaccacttgttaagttttcctaccattcaacatgaaactatctatgatcttgccaagatagacaaacaagaacttgtagctcatgtgactaagctccacgatgctcaaaaggcaaaaaaaaaatctcaaataaaagaagaagaagaaagggttgttactgatattgcgcaggtacaagctgttacattctatgttgaagcttctactaaaccttctcaacattctcaacctccaccaccacctcaagttcaagattga

SEQ ID NO: 105389 - DNA, 735 bp, Glycine max
  Peptide Sequence Number=SeqID_222167
atggccaaatccacattagatcaactttcctaccaggggccccccatgagaagaagcggggtggttgtcaaagcgtttgatggatcaagaaagtctgttatcggggaggttgatttgcccattacaattgggctgtttgttttccaaattacattccaggtgatggatatccaagtcgcatacagttgccttttgggtaggccgtggatccatgaagcgggggccgtgacatccaccttgcatcaaaagctgaagtttgtcagaaatgggagattgatcactgtgagtggagaggaagccttgttggttagtcatttgtcagctttttcctttattggtgctgatgaaacagaaggaacctctttccaaggactgactgtagagggtaaaaagccagagaagaatgaagtgtcttttgctacttggaagagcgcacagaaagtggtgcaggagggaacaggtgtaggatggggaaaagttgtgcagttgatagagagtaaaaaccgtgaaggactgggatttgcttcctctgcaggatccgcaacgaacagtgttggatcaagctccattactagcaccttttgtagcgccgggttcatcaacaactcgccagaagccaatgctgtcttggaagacgttcctgaagagagagtacttgcatttgtcacacctggaaaacttgtccgcaactgggacgcggttgacgtcccttcagtagttcatgcatcaaagtaa

SEQ ID NO: 105390 - DNA, 3780 bp, Glycine max
  Peptide Sequence Number=SeqID_222168
atgaatgaagcttcgattaatagcgcagaaagctacttatatctccacccgagcgagaaccctgctatagcccttgtctctccagtcttagactcaaccaattaccactcatggagtagatccatggtcactgcgctaagtgccaagaataaggtggaattcatagacgggagtgcacctgaaccactgaagacggacagaacctatggggcttggcgccggtgcaacaatatggtcgtgtcatggctagttcactcggtggccacctccatacggcaaagtatcctctggatggacaaagccgaggagatttggcgtgacctgaagtccagatattcgcaaggagaccttcttcgaatctcagatcttcaacaagaggcgtctacgatgaaacaagggaccctctcagtcacggaatacttcacccgtttacgaataatatgggacgagattgagaacttcagacccgactcaatctgctcgtgcaatatcagatgttcctgtagtgccttcaccatcatcgcacaacgcaagcttgaagatagggccatgcaattcctacgaggattgaatgatcaatatactaacattcgatcacacgtgcttcttatggatcccatacctgctatttccaaaatattctcttatgtagttcagcaagaaaggcaattgttaggcaacacaggtccaagcatcaacttcgaacccaaagatgtctccattaacgcggcaaaaaccatctgcgacttctgcggacgtgttggtcatgtagaaagcgtttgctataaaaagcatgggatacctgcaacttatgacggaaggaacaagagcaacaatggaaggaaaacttgcacacactgtggcaagatcggacacacagtggacgtttgctatcgtaaacacggatatccgccgggatataaaccgtacggaggaaaaaccaccgtgaataacataatggcagtagaaggaagaaccaccgatgatcatgctcagcaacacgagtcacaagaaattgttcacttctcccctgagcagtataaggcactactggccttaatccaacagccacaggcaggaaactcgacgactaatcaacccaaacaggtggcgtcaatgtcctcaagcactattaatacatcactaaacccaggtacgtcaccttccacacacagatatcccacctcctggattctagattcaggagcaacggaccatgtcacttgctctctacataatctacattcatacacaaaaatcgacccaatcacggtgaaacttcctaacggccatcacgttcacgccactcactcaggaacagtacatttctcatccaatttaatcctacacgatgtactctacatacccacattcacgttcaatcttatttcaatctcaaaactcgtttcttctaataattacgaattaatcttctcgtccacatcttgtgttttacaggacacgaacaaccatgtgaagattggtatagttgaagcaaggcatggcttatatcacctgataccaaaccaaatacccactaaagctgcaaactcgatcatcactcatcctcagtgcaataccatccccatagacctatggcattttagaatgggacatccatcaactgagagattacaatgtatgagaaactattattccctttcaagaaatgatacaaattttgtctgcaacacatgccattatgcaaagcataagaaaatgcctttttattctagcaaatcacatgcattgcattcttttgatttactgcatatggacatatggggtccatgctcaaaattatccatgcatggtcacaagtactttctaaccatcgttgatgatcattcgcgtttcacatgggtatacctcatgaaaactaaagccgaaacgcgacacatcatcaccaacttcattgctttcattgaaacccaatatgacggcaggattaaaataataagaagcgataatggaatagaattcttcatgcatgattattatgtgtctaaggggatcatacaccaaaccacgtgtgtcgagaccccagaacaaaatgggatcgtagaacgtaagcatcaacacttgcttaacgttacacgatcactcctgtttcaggcaagcttaccacctaccttctggtgctatgctttgccacacgcggcgtacttgatcaatcgtatccctacgccatttttgcataatatttcaccttacgaaaaactgcacaaacacccatgtgatatctctaacattcgcgttttcggatgcttgtgttatattaacacactcaaagcaaatcgacaaaaatttgatcccaggggacatccatgcattttcattggtttcaaagcacacacaaagggttatctcgtgtatgacttgcattcacatgatgttgcagtatctagaaatgttactttttacgaaaatcattttccacaattgcctgaaacccaaccttcgaacagaaataactcagcgccttcaccgataccatttttcggcaaagaacttcacccaccggaagagaaacaaatcccccaaacctcaaaaccagcacatccgccttgtaatgatcatttgagagaacaagctccttcacaatctaggcgttcaacacgatcaaaacgttccccagcctatctccaagactatcacagaagccttgcttcgtctacatcaacggcttcaatggttgttcgctatcctctaagctcggtactttcatactcacggctttcacctacacatagaaattttgtaatgactatatcctcagccatagaacctgcgtcatacgtcgaagcttctcgccatgactgttggattaaagctatgacggccgaattacaagctttacatatgaacaatacttggagactcatgcctcttcctcctcacaaaacagctatcggatgtcgctggatatataagatcaaatatcgagcggttgggtccatagaaagatacaaggcacgcttggttgccaagggttacactcaaacggaggggttggactaccttgacaccttttctccggtagcaaaactcacctccgtacgagttcttctagctttggccgcactcaacaaatggcacctgcggcaactggacgtcaacaacgcgtttctccacggggaacttgaagaagaggtatatatgcaagttccaccgggacttccagttgataacccgaagctggtctgtcgtcttcaacgttccctctacggccttaagcaagccagccgacaatggttcacgaagttgtcaagcttcctcacctcccatgacttccaacggtctgattcggatcattcccttttcttgcgaataatcggatccaccattaccatcctcttagtatatgtagacgacataattcttacagggaacagcttgacggagatacaggctataaccactcttttggaccaagagtttagaattaaagatcttgggaacttgaagttctttctggggctggagattgctcgaacctctaaaggaattcatctatgccagcgtaagtatgtattagatatcttatctgaatcaggcatgttgggttgcaaaccgcactcaacaccaatggattattcagtaaaactgcaaaagagctcgggtaaccctcttccgaacgagtcttcttcctcttatcgaagattaatagggaagctcatatatctgaccaacacgcgtccagatatcgcatacgcagtccagcaactcagtcaatacatgtctgctcctacaactgctcaccttcaggccgcttttcgt

SEQ ID NO: 105391 - DNA, 518 bp, Glycine max
  Peptide Sequence Number=SeqID_222169
caacaggaacgccccaactccgagctttcagtgactcggattgggcaggatgcaaagattctcgaaaatccaccacagggttccttgtgtatctaggctcttccctcgtttcatggcagtcgaagaaacaatccaccgtctcccgcagctcctccgaagctgagtatcgcgctcttgcatccacaacctgtgaacttcaatggctgacatatcttcttcaggatcttcgcgcaacattcgttcaaccagctactttgtactgtgacaatcagtccgcaattcaaatagcaacaaatcccgtattccatgaacgcaccaagcatattgaaatcgattgtcatcttgttcgtaacaaagtcacttcagggttcatcaagcttcttcccgtatcgtccagtctgcaactcgcagatatctttactaaacccttgaccccggtagttttccagcatctttgtaacaagctgggaatgataaacatacattcccagcttgaggggggcgtgttaacagtataa

SEQ ID NO: 105392 - DNA, 1041 bp, Glycine max
  Peptide Sequence Number=SeqID_222170
atggctacgccgcctaattctttttgttctttgttctttatttattccattctactttcttcattcttccttgcctatgaggcacaagcctaccccccagtagtgaatggactatcatattctttctattcccaaacctgtcccaagcttgaatccattgtgagaaaccatcttgagaaggagttcacgcaagctagttggcaagctgcagccttactcgtcgttttcttccatgattgttttgttcagggatgtgatggatcgttgctgctggatgggaatccaggtgaaagggatcatccactcaaccgaggcataagccttaaggttctgcggaccattgatgatctaaggaatgttgttcacaatgaatgcggcaggatcgtttcttgtgcagatatcactgtcttggcagctcgtgacgctgtttacctttctggaggtcccaattttgctgtgccacttggaagacgagatagtctaaactttagcttcgaagaagtaaataatcttccattaccctacaacatcactagtgtgacactccagacatttgcatccaaaaacttagatgtcacaaatgtggttgctttagtaggtgcccacactcttggtcgtgcccattgtcacacattctacaataggctttctcctctagaccccaacatggataaaaccctagccaaaatcctcaacacaacttgcccaagtacatactcacgtaacactgccaacttggacataagaacccccaaagtgtttgataacaaatactacattaacttaatgaatcgccagggtttgttcacctctgaccaagacttgttcactgataagaggacaaaggggctagtagaggcctttgcacacgatcagaccttattctttgagaaattcgtggatggatttataaggatgagccaattggatgtcttgacggggaatcaaggtgaaattcgtgcaaaatgcaatgtcataaacaataagagacctatagtgacgtctattaatgtagatgagatggtacaactaatctattag

SEQ ID NO: 105393 - DNA, 954 bp, Glycine max
  Peptide Sequence Number=SeqID_222171
atgagaaaagataacctcagaggagtaaggagtgtgtttctgccacaagaattgataattgaaatcttgttgaggttgcctgtgaagtctcttgtgcgtttcaaatgtgtgtgcaagttatggctctctttaatatctgatcctcactttgcaatatcacattttgaacaagccgccatacacaatgaaagacttgtgcttttggcaccttgtgctcgtgaattccgatccatagacttcaatgcatcccttcacgataattctgcttctgctgcattgaagcttgactttctgccacccaaaccttattatgttagaatcctaggtgttcacaaacaagtacctcgctcacctattgtgtccgatatggatgtcaggtttttcacatttctctatggttttgggtatgacccatcaactcatgattacttggtggttcaagcttctaacaacccaagctcagatgattatgcaacccgtgtggagtttttctctctcggggctaatgcgtggaaagaaattgaagttgtgtttgatttaatggagaggagtttttcagagatacctctgcccgttgattttgacattgagtacttctatgactataatttttgtcagttggggatactaggagaatgtctcagtatatgtgttgtggggtattactgttccacagaaatatgggtcatgaaagaatacaaagtgcagtcgtcttggactaagactattgttgtgtgtgttgatgacattcctaatcggtacttctcccaagtttgctgtacaaaaagtggtgatattgttgggataactggcactactggattggtgaaatgtaatgacaagggacagttgcaagagcatcgatcctattgcaatggtccaaaggggtaccaagtgactgtgtatacagagtctctactttcactcccaagtggcagtaagctagaagaataa

SEQ ID NO: 105394 - DNA, 675 bp, Glycine max
  Peptide Sequence Number=SeqID_222172
atggagataatgatggagtcgttatcatcgacactcaagtgtcgagatggtagtgctaatctatctacaggaggtcccgattatgcagtgccactaggaagacgagatggcctgagcttcagcacatcaggaacaagtgatctccccaaacccttcaacaccaccggcgtgacccttgacgctttcgccgccaaaaactttgatgtcaccgacgttgtcgccttatccggcgcacacacctttggtcgtgcccattgcggcacattcttcaacaggctctcccctctcgaccccaacatggacaaaaccctagccaagcaactacaatccacttgccccgacgcaaactccggcaacaccgccaacttggacatcagaaccccgactgtgttcgacaacaaatactaccttgacctaatgaaccgccaaggggtgttcacctctgaccaggacttgctcaatgataagaggactaaggggttggtcaatgcatttgcgttgaaccaaacgttgttctttgagaagtttgtggatgctactataaagttgagtcaattggatgtgctcactggaaatcaaggtgaaattcgtggcaagtgcaatgtggtgaatgctaggaagtctttgttgacgtctgtggtggaagaggtggtgcaattggttgatcagttttga

SEQ ID NO: 105395 - DNA, 474 bp, Glycine max
  Peptide Sequence Number=SeqID_222173
atgcctcgcttaagcgagttcatgctcatacttaagcaaggtagcccctcgagcttaggcgaggacctaagtgagaccccttcttggttaagcattagcaactgctcgcttaagcaaggagaacatcgatggatgaagctttctaaaccagaccaggagtttagtgatgtcataagatgtgagttctatgaaaatgcttaccatcctctggagggtgaggctaacgttcttgagtggtacaacatcatctatggcattcatatcccctacaatgcacgagccatcaacacctatttggcagaatccgctcctaaaccgggtacttattttgtgagaatattgaacacaagggtgagggatcccaagggatggggatttcaaaagagggaaaaaatcatagatcacgattccatgaacttcggaaagaagagaatgacgactgagagaaagatagatggtcgatggcacaactag

SEQ ID NO: 105396 - DNA, 377 bp, Glycine max
  Peptide Sequence Number=SeqID_222174
atggatcaagttcaacgtcagtcttttagcaaggctacggaggtttggatgacgccacttccaaagagggaagataagtcaggccctaacaatagaggagttcgaggggatcttaggatgctcgataggaggaaggaagacatacctcttttctgggaatggagtagcgggaataccgaggaagtgcttggaggagaaggcagaaactctggaaagccaaggagagtggatatcattcatggatgtattagcattacaagtgtttgggacagtactattctgaatgtagacggacttgtagatctagcagcaattgatgcctttcttgtttatcaccatagcaaggaaagcctgatcattgttgttttagcaaatgc

SEQ ID NO: 105397 - DNA, 648 bp, Glycine max
  Peptide Sequence Number=SeqID_222175
atggaacacaagaggaacgaagctgctgcgattccaacaatcaacaacaaaaaagatgccaagaacacatttcctaaagactccttcatccttggacgatgggtgaacttccaaagtctagaagaagagatctttcatgaaaaagatgataaccttcctaatgctagaaaacctgacttatatgtccagacttatccacaactttttgttcaacatggtcatgcccagacaggctttggagttggaagaagtttcctcacgtctgtgaaagctttatcagctaaagagcacaagaagaagctagctgaagatggaaagattgttgccttggaaagaaagttatttgaagaaatttcagatgaagtaatttttgaatctctgaagacactatttgttgaagaagttcagaagcagagtgctgaaaaggccactatgatggacatagatcgtgaggcagtgcctgaaacaataatagttgagatggacgaacttgagagatttcaatctacaacagaacatgtaactgggtttttgtctctgaattcttttcaaagacaagtaaggatggaagctaccattgttcctgaagacatggatcctatagagaaggaagttcttgaggaggcccatgctttagcctattattga

SEQ ID NO: 105398 - DNA, 783 bp, Glycine max
  Peptide Sequence Number=SeqID_222176
atggctcaacatcagaggagactcaacccagttatgaaagaggaggtaagacgagaagtgttgaagcttttggaagtaaggatgatctatcccatatcaaacaattcatgggtgagcctatataggtggttccaaagaaatatggagattttaacaatgcaacatggaaagatcactttccccttcctttcatggatagagaggttatttggtcaagccttctactgctttctagatgagaagtacattgagatcttcatggatgacttctcaatttttggagacttgtttgatacatgcctctcaaacttagagttggtattgaagaagtgtgttgaaaccaacctggtgctcaattggccaaaatgtcacttcatggtgacagaaggtatagtacttgggcataagatctcgactagaggatttgaagtggataaagtaaagatagatgtgattgagaggctaccaccaccaggggatgcaaaggctggtaaggtgcttaacggtgtacaactcaactatgcaaccacagaaaaagagatgttggcaattgtatatgcattggagaatttcagattatatctagttgggtcaaaaattattgtctacaatgaccattcaagtggcctttttaccatcaaggagctcaagaattatagagcaatagagttgcaggaccttgctacacaaaaaaactggattgtaaatggtaaaaggttgaagatttaccttagtggtgacatcgagcgactcatcacagtaatgcacttgagtgactcttaa

SEQ ID NO: 105399 - DNA, 246 bp, Glycine max
  Peptide Sequence Number=SeqID_222177
atggatcaagttcagtgtcaagcctttcgtaagacatatggaaaaatctgggatttggctatgatagaagtttccattgaagccatcacctccctcactcaatactatgaccagccgctaaggtgcttcacgtttggggactttcagttggtaccaaccgtagaagagtttgaagggatattgggatgcttgctaggaggaaggaacttgtatctattttctgggttatacccttccatggcatga

SEQ ID NO: 105400 - DNA, 180 bp, Glycine max
  Peptide Sequence Number=SeqID_222178
atgtcatccattagaaccctgttgagtttggttgttactcttgatttggaggttgagaaagagcctatatggtttgaagcaggctccaagattgtcaactatcttgaaagtagttgggttggctatcaatgtcttgaaaagggctacctacaaagggttttgattggtggagggttctaa

SEQ ID NO: 105401 - DNA, 120 bp, Glycine max
  Peptide Sequence Number=SeqID_222179
atggaagaagaactccaccaattcactaaaaatgatgtttggacacttattcccaagtttgagaacaagaatatcattggaacaagatgggcattcgaaaataagctagatgaacaaaag

SEQ ID NO: 105402 - DNA, 207 bp, Glycine max
  Peptide Sequence Number=SeqID_222180
atgaatgatgatgatgatgttgttgttgttggttggttggttgagcaaagggactgtcatgtctcaagccttgtcttaaatgaggtagataggttgttgaatgaggactttgaggaatcacttaatgagattttacaaatgattcctcgtgactggaggatatttctgttttctgctacaatgactaagaaggttagagttaattaa

SEQ ID NO: 105403 - DNA, 659 bp, Glycine max
  Peptide Sequence Number=SeqID_222181
atggacatcccactgagaagcactaggaagtaccttttcaaaaaaacagacttgttgagattaagggagctagcatctttagtaagtgatccagttgattttcaagctcaccacgggaagttgctcagaattcttagagtagatattgaggagggatgcctagagaccctagttcagttctatgacccgctctaccattgcttcacatttcccgattaccagcttgtccccacacttgaagagtactcctacctagttggcttacctgtgccagacaagatacctttccatggttttgagcctacccctaaaccctccgacatcgcagccgctctccatcttaaaacctccatcatccaagcaaaccttacctctaaaggaggcctccaaggtcttcccacccacttcctctaccaacaagcctccatatttgctgaagcagctagtacacttgccttccattctatcctagccctccttatatatggccttttactcttcccaaatattgacaacttcatcgatatcaatgccattaaaatcctccttacaaagaaccccgtacccactctactcgccgatacctaccactctatccatgaccgtacccaggctggccgtggaaccatttcttgttgtgcacctttactctatctgtg

SEQ ID NO: 105404 - DNA, 219 bp, Glycine max
  Peptide Sequence Number=SeqID_222182
atgcaacggtggccccgaactgctcgggggtatgccacgggaaagggctggggtcctggctctgctgatgcaggtgagaagagatggactccagagattgtggctgccacagaggtggtggtggtgcatctgcatctggctgctgttggtccccctcctgctgctgccgtgccagaccttgcatttgtgcctgccttggcatacaatatttttctataa

SEQ ID NO: 105405 - DNA, 171 bp, Glycine max
  Peptide Sequence Number=SeqID_222183
atgaagacagtacaagtggaggcttcaatccctgctccgtctctcttacgtttgagaactctatcggagcagtcggaggaaaaactggaggaatctcaggaaaccgctagaaatgccgctgtcactgtcgaaagacatgtgagtctgcttagagggatccttagaggataa

SEQ ID NO: 105406 - DNA, 438 bp, Glycine max
  Peptide Sequence Number=SeqID_222184
atgcatccaaagaattcaactacatggctaatccatatcatcaagggttccatcaaggaggacctcttcgatacaatcagggagaaactttttcttaaggccaaggttggagatcccatcctgggaataatttcaataaagatagacaatccatccatttcaccttccaaccaagggcctaatctttatgagaggaccaccaagctagaagacactctgactcaatttatgcaagtttccttgtcaaatcacaagagcacggagttagctatcaagaaattggaggtgcaagtgggccaactacctaagcaactagatgaaaggccaatagggagttttgtagcctacactaagaagaatcccaaggaagaatacaaggcagttctcactagaagccataggagagagaatattaagagagaagaaagagatgagtga

SEQ ID NO: 105407 - DNA, 561 bp, Glycine max
  Peptide Sequence Number=SeqID_222185
atgccgatgatgacgttggcgaaaaggatggcattattcatgcaaatcactgaaaaacatggaggcaatctttgtaaagctcttaaaggctttcttgaagaggtttgtatgattcttgttacgactagcatcccaagtgaagaagagctagatcttgcaattaacaccccacaagatgatagccctggcgcaagtaatcaaaaccctttatctcaatcaagcgcctcacctgtttccccaaggagaaagtcactggggcaaaggatgaaggaagcttataaagcatggaaaaagaagaatgcgggagcttcttcgtcgcagcaaaaggatgttcccaaaggcgctaacgatccagacctactgaacgaagaccctgcgattactgaaagaaaagctaaagaacgagaggcgtaccatgaaagaatttgcagggattataggaatattgaacgagtaattcggatttctgttatcttgccagacaaacttcgcattgcccgtatcttctccaaaagagaaaaacttgaggtagaattagcattagaatatgacgaaaactaa

SEQ ID NO: 105408 - DNA, 777 bp, Glycine max
  Peptide Sequence Number=SeqID_222186
atgataacaaggttttcgcgcgtgctccacgctgctcccgacactcctaatgccttcattcatgacgtttcagggctctacgatttcctcgccgacacacataggaatgatgccatcattcagttccccatccccaaggttctattgtcgccttcgcctcctcttgacattgttcgtattggcatagggttgttactagcgtgtagtggcagtggcgggagtgagaatgactttggacagagcaacatcggtggaaacgaatcaggggaaaccttcatggagggagagagagaacaactggaggagaaggagagcattggagtgaagatatacttcggccttagggcacaagggaactacaatttgactaaacgctacaataacaatgaggtgttgaaggctctctacgctgaagctggttggaccgatgaagaagacgaaaccacctattgcaagtgctacattgggtgtattttaagtgattttagttgtgtggcttgtttaagtagaatactccaggaaatgttactggagaggagcaaggtcaagccaatagaagctatagtcgaatttgcaagtgtggagaaatggaaggaagtgagaaagttcagaagatgctattgtgcaaaagttgtggcaagaagtaccataggaattgcttcagaagttggagtcaaaatagagatttgtttcattggaattcatggactctatcattttctccaattaaagcatttcgtgcttccaattgaagcaatcaagaaaatcaaaatctga

SEQ ID NO: 105409 - DNA, 300 bp, Glycine max
  Peptide Sequence Number=SeqID_222187
atgggggagaggcaaattttgggtaaaaaacataaagaaattgaagagatatggttagaggtacttgagaggatacatgttactaggctgaaagagtttctgtttaaagaaaacaaactaatctatgttagttttggggatgatctagaagaactgggggataaatttatcttgtatttgattgcactaggtgtagtatcatgcaaagggcctaaagattgtgataagtcaacattcacaaattatccaaggatatttgatggttttttgtacgactccaactgtgcagctaatgtttag

SEQ ID NO: 105410 - DNA, 207 bp, Glycine max
  Peptide Sequence Number=SeqID_222188
atgaggatagtgtcaaagcacacaggaacaaatcctaacttaaaggaaggaaatgggttttttgtatcaagtgatccagaactcaaaagaaagaagagaatgaaggcctataatatgttgacagtggagggagagcttaaaacaagtgtcagaaataacttcaagtggatcaagaacaagttcagtgacattcgctatggtgtgtga

SEQ ID NO: 105411 - DNA, 600 bp, Glycine max
  Peptide Sequence Number=SeqID_222189
atgtcgtttcggatatcgtactccattgcccaaaggctcttcgctatgcgaaggtatgggggagggatgttgtacgcagccttacccttgcatatgcaaagaggctgtttccagattcgaacccatgaccaacaagtcaccaaggcacaactttaccgctgcaccagggctcgccctcatgtcgtttcggatataattagaaaaaaaaagatagtgacccggtctaggtccaagggtcaccagtttgactgtaaacccagttgggtcaatttaggctgctccgggtcaaaagcacactcgatcgaacttgtgactcaacccggtccagccacctggtcgcggttcgaccgtgggatattgatggaagcttgcttgagaaacttctatggaatgttccacaagaatatgccaaatgaatattccaagaatatgccaaagaaatattccaagaatatgccaaaggggaggaaaactacacacatctcttcaatagctaagctcacacccatgtcaaaatacacgaaaatacaaaagaaagtccctactacaaagactactcaaaatgccctgaaatacaaggctaaaaccctatactactag

SEQ ID NO: 105412 - DNA, 168 bp, Glycine max
  Peptide Sequence Number=SeqID_222190
atggcggctcgcggcggccaccggtggtcgtgggtggtgaagaaggagatctcacttagtgatcttgtttcgctaaacgggagtccactttcctcattcagtgtgcaaattttcactcagcacaacttcctctacacaatggctcgctccgcgcaattccctctctga

SEQ ID NO: 105413 - DNA, 225 bp, Glycine max
  Peptide Sequence Number=SeqID_222191
atggataagagcttggaggtaagagaagaagaatggagggagaaggagagagggagcacgaaatttgtgcctcaaaagagcatcttccttgttggagatgagttgttcggggtggaaaagttgacgataggtgtcatagactttgtcgatgacggtggatttgagattgacgaagatggtgtgcgggacatgcttgttgaatctggtggccatcgcattttttaa

SEQ ID NO: 105414 - DNA, 411 bp, Glycine max
  Peptide Sequence Number=SeqID_222192
atgtatcggactgttaagaacactaacaaacttgtagcttcttcaggagggtctattctcggattgaagtttctagatccccttgctgaacttctcgtctcaggcatgattttgaaagctggagctgaaacagaagatgaaacttctggtgattccttgctagatgcatcccctcacatgcaaataactcaaggaaactcatccacaactaattttgatgacaatgaccctaggaatgagtgtgtcatatgcatgactgaaccaaaggatactactgttttaccttgtcgacatatgtgtatgcgcaatgagtgtgcaaatgctcttcaacatcaattcaataaatgccctaaatgccgacaacctattgaggaacttattgagatcaagatgaacaatggtgatcaatga

SEQ ID NO: 105415 - DNA, 465 bp, Glycine max
  Peptide Sequence Number=SeqID_222193
atgtggagtcctctgaaggcgagggcgtgcagccctctgatggcgaggacccgtagtcctctaaaggtgagggcgtgtagctctctgaaggcgaggacgtgtagtcctctaaagcggaggacgtggagtcctctgaaggcgagggtgtgcagccctctgaaggtgatgacctatactcctctgaaggcgaggacgtgtagtcctctgaaggtgagggcatgtagccttatgatggtgaggacatgtagtcctctgaaggtgagggcatgtagccctacggaggtgaggacgtgtagtcctctaaaggcgagggcgtgcagccctctgaaggtgagggcgcgtagccctctgaaggtgaggaaatgcattcctctgatggtgaaggcgtgcaaccctttgaaggcgaggacgtgtagtcctctaaaggtgagaccgtgtagcccctttaaaggtgaggacgtgtag

SEQ ID NO: 105416 - DNA, 324 bp, Glycine max
  Peptide Sequence Number=SeqID_222194
ccaacaaatgtgagcaacttacatggtgatgaagatgatgatgatgatgatgattatcttgtgtctaactcatacgttgaagagtctttagacgaagatgatagtcttgacggtatatctgatacacacgatgaagttgccgacatgattcaaccagtgtacaaggaattgaaaatccattttggaatgatgctttgcattataacaatatcaactagagtcatcctgatgaggaagacatttgtggtttggagatgccatcgagttttaatgttggacaagaattatatgttggcatggattttgatactaaagatgcggtaa

SEQ ID NO: 105417 - DNA, 690 bp, Glycine max
  Peptide Sequence Number=SeqID_222195
atgacattgtttgatccatttgctggccaagcttcaaaaagtggcaacgatgttcttttggatcttttgtctattggatcaccttctgtcgaaagcagctcatctacagtagacatcttatcctccaattcgagtaacaaagcaccagtttcctcgttggatggtctctcatctctttcactttctacaaaaacaacttcaaatgctgctcctatgatggatttattggatggatttgcccccatcccgccaacagaaaacaatggaccggtttatccatctgtaactgcatttgagagcagctccttgaggttgacattcaatttctcaaaacaaccaggaaacccacaaacaacagttatccaggctacttttatgaatttgtcctccaatacatatacagattttgttttccaggcagcagttcctaagtttcttcagttgcacttagatccagctagcagcaatactcttcccgcaaatgggtccataacccaaagtttgaaaattactaatagccaacatgggaagaatgttgatcactggcattttgctgcgaaacagctagtttatgctttatttttatatttgatattaagtgctgcaaaactgcttattatttgtgtctgggggttattgagtgatcactacttttctgatcgttcatcaaagccaacaatgatattttag

SEQ ID NO: 105418 - DNA, 957 bp, Glycine max
  Peptide Sequence Number=SeqID_222196
atgattcgggccatacgtgcttgtaagactgcagcagaagaacgagctgttgtaagaaaagaatgtgctgccattcgtgctgcaataaatgaaaatgataatgactataggcatcggaacctggctaagctaatgttcatccacatgcttggttaccccacacattttggtcaaatggaatgcctcaagttgatagcatctcctggatttccagagaagagaataggttatcttggcctcatgttgcttcttgatgaaagacaagaagttctaatgttggtcaccaattctttgaaacagtatccagtttttagtcaaagaaacatttgttcagcagaaatggctcgtgatcttgcaccagaggttgagagattgcttcaatttcgagatccaaatattcggaagaaggcagcattatgctctataaggatcataaagaaagttcccgacttggcagaaaattttatcaaccctgctacttccttactcagggagaagcatcatggggttctgatcactggggttcagctttgtacagatctgtgtaaaattagcactgaagctcttgaacatattaggaagaaatgcacagatggtttggtcagaactcttaaggatctagccaatagtccatattcaccagagtatgatattgccggtatcacagacccatttctccacatcagattgcttaaacttttgcgagtgttgggtgaaggcaatgctgatgctagtgacaccatgaatgacatacttgcccagtgttcatgctgcgatgattgggttatttgcaatttctgcatggctctgctgtgcatgaacttaagatgtttcattacacgtttatgtgctggaaagctatgggcaaaagggggcatgttgaagttgtgggaaaagaagggtgtgttgaagttccacattgtggtgggtagccgtgaccaaaatgggacatgttga

SEQ ID NO: 105419 - DNA, 1014 bp, Glycine max
  Peptide Sequence Number=SeqID_222197
atggcatgggtgacaacaattgctggaggaaaatggagccggggagggggtcatgttgatggtccaagtgaagaagctaaattttctaatgattttgatgttgtttatgttggaagtagttgctccctacttgtcattgatagggggaaccaagccatcagggagatccaactacactttgatgattgtgcttatcaatacgaaaatggatttccacttggaattgcagtgctcattggtgctggcttctttggttatatgcttgcattattacagcgtagacttggtacaattgtggcatctcaggatgctgagggtgcagctatgtctggcatttcaccaagtccatatcaaaaacccttgaattctgccagacctcctttaattccatcagaagatgaatcggataagcaagaagaaagtttctttggatccattgggaagcttcttactaatgctggggcatcagtagtggaaataatgggagccttatttcctggtttcagaaaaaacccaccacagagctatgaatttcaaagcccaccactgttccagcaacctcaaaagcaagtaaatgcttggcctgtgcaagaaagctttgtgattccagatgaagatgagcctccttcaattgaccctagaacaccaacaccacggaaaacgtatgctttcatgtcgaaggatgcagaaaagatgcaacaactttggcaaagtcgcgcattctatagtggatgggacggagatcttcagcagcagcaacaactaaaacaccaacagcaacagcagcaacaacaactaaaacatcatcgccatcagtaccattcatcagtccctcacacttactatgagcaaagccatgaggaaaccaatgagatagtatttggggcagtgcaagagcaggatgggaagaagggcactgtggttattaagcctgtggattatggtcaatctgtctatgatcatcactatattcgacctcgaatcagttctatgggtcatatcaacaagtactaa

SEQ ID NO: 105420 - DNA, 686 bp, Glycine max
  Peptide Sequence Number=SeqID_222198
acagcctcaacactttcctagagacacctgtggtattggctgagggagaatccttacccgcttactccagatactacaggatgcccactgatattagagagattgaggctgctttgtgtatacccggcggggggtgtgttttaaatgctgaaggccatccagggaatatcctcaggaaagatctaacaactcttgctcaggtttggagtgttctctcatactccaacctggctccgacttcccacacctcagatttgactgtagatagagctaggttaatctttagcctagtctctcagatagacatgaatgtaggagctctcatctctggccagatcacatctatggcccagtctaactcttctagacttgggttccctgctgttatcacaactctatgtaggtccagaggggttgcttctgacaacctggtcttcgaacgcttgagcccggtcattaacttggcttatatcaggaaaaactattggaaccctgatgatctgacagttattattagaggggccaggagagcgagggcaaggcctgctgaggctccttccacatttgcagctcctcctccagcacgtacctcagcaactccttctaccccaccttctgcacgaacctttcacttaaagttcgtagaccacgtcttttccagtttttccgacgttttcctcaaataa

SEQ ID NO: 105421 - DNA, 240 bp, Glycine max
  Peptide Sequence Number=SeqID_222199
atgtttccaaaagaagtcacaactcttagatgctacaagtgcaaccaacttggttacatcaaagcgaattgcccctcaaacgagcaatggcctgagaagaaaagccatgaagaaagaaggaccaagaaggcttacatcgattgggatgacaatgattcatccgaaaaatctgaaaatgaggaaatcaatcttctaacaaaagactatgagagtgaagaggacatcactcaaagggactaa

SEQ ID NO: 105422 - DNA, 1611 bp, Glycine max
  Peptide Sequence Number=SeqID_222200
atggaaaactttgaagtggatgctaatagaggccagtataggactacaaaccatgattacaggttggccttcacgaaagcaactagagtgacacaacaagatatgtcggaaatacctaaccatgtttataatttcactgcttttgatgatatactcaatgtaacagcttctcctggctacctaatagatgtgattggtgagattaccgaaattgtgcaatgggatcttgatagaggaggccatcagattccaatgatagacgcagcaagagtgtttgcatctcacggagcaaaatcaaccatcctagcaacaccctccaacgctctccacttccaaaactcgatcacgcgcgaccaacaaaccggtcttcccgtcgccattcacaccttctccgccgacatacccgacacagacatgtctgctgtcggtcccttcatcgactcctcggctctcctcgaacctcttcggcagctcctcctccgacacccgccagactgcattgttgtcgacatgttccaccgttgggctcccgacatagttgacgagctaggaatcgcgagaattgtcttcaccggccacgggtgcttccctcgctgcgtcactgaaaatatcataaaccatgtcacgcttgagaatctgagttcagacttggaacctttcgttgttcctaatctgccacaccatatcgaaatgacgaggtctcaggttcctatttttctgagaagcccgtctccgtttcctgataggatgaggcagttagaggagaagagtttcggcattgttaccaacagcttctatgacttggaaccggattatgctgattacctaaaaaagggaacgaaggcatggattataggaccagtgtccctttgcaacagaactgcagaagataaaaccgagagagggaagacacccactatagatgaacaaaagtgcttgaattggttgaattctaagaaacccaattcagttctttatgtcagctttggaagcttggctcggttaccctctgagcagttaaaggaaattgcttatggtcttgaagcttctgaacaatcgttcatttgggtggtgaggaatatccataacaacccatcagaaaacaaagaaaatggaagcggaaactttcttccggaagggtttgagcagaggatgaaggaaaaggataaagggttggttcttagaggttgggctcctcagctgttgattttggagcatgttgcaatcaaagggtttatgacccattgtggatggaactccactttggaaagtgtgtgtgctggtgtgccaatgattacgtggcctctctcggccgagcaattttcgaacgagaagttgataactgatgttttgaagattggtgttcaagtggggagcagggagtggtggtcgtggaattcagaatggaaagatttggtgggaagagagaaggttgaatcagcagtgaggaaattgatggtggagagtgaagaggcagaggaaatgacaacaagagccaaagagattgcagataaagcaagaagagctgtggaaaaaggtggaacatcttacgctgatgcggaggcattgattcaggagcttatagctcgcagattggcgagacaagattag

SEQ ID NO: 105423 - DNA, 633 bp, Glycine max
  Peptide Sequence Number=SeqID_222201
atggaaagaaagaagcaagatcgagttatgcaatttcttaaaggattgaatgatcagttcagcaatgtcagatccaatgtattgatgatggatcctttacctgttgatagatgtttcaagaagaatggtttccctcaaaactatggtttcaaaggaggaaaaagtaaccagagtggctttggcaaaggaaattccagtgggaaaggaagcaaactttgtacatattgtggtttcattaaccagacagatgatgagtgttacaagaagcatggttatcctcctgcacataaatatcataagtctcaaagctcaaatatcaataatatgaatgtcttgaaagaagaggatatgcagaacctgaaaaggattggtacagttgatatggtgaaaggtctttctaggctgaagatgcttactctcaagcctctcaaggagtatgctcctagttttatcacagcttctattcctgttgtttctgctagtgtttcagctttttcatccttgtttcaagattcactaaagaccaagccttgccttaaaacaaagtgctttcaagacatgcaaggctctggtaatcgattaccaggaagtgtaatcgattaccagaagacagggttgagaaatagctgttga

SEQ ID NO: 105424 - DNA, 960 bp, Glycine max
  Peptide Sequence Number=SeqID_222202
atggcccccaaaatagattcaattaaaattgaattgttcttccctttcctagagggaggccatcagattccaatgatagacgcagtgagagtgttcgcatctcatggagccaaatcaacgattctcaccacaccctctaactctctcttcttccataactcaatcatgcgaagaggccatcagattccaatgatagacgcaacaagagtgtttgcatctcacggagcaaaatcaaccatcctagcaacaccctccaactctctccacttccaaaactcgatcagccgcgaccaaaaaaccagccttcccgtccccattcacaccttctccatcgacatacccgatgcaaacatgcctactgtcagtcccttcatctactcctcggctctcctcgaacctcatcgacatctcgtcattctacacccgccaaactgcattattgtcgacatgttccattgtcgggctcacgaaatcagtgataaactaggaatcatgagcattgtcttcaacggtcatgagtgcttcccttgttgcatcactgaaaacatcagaaatcatgtaatgcttgagaatctaagttcaaactcagagccttttgttgttccgaatctccctcacagaattgaaataacaagtttaaacattgttaccaacaacttctatgacttggaattggattatgctgattacgtaaaaaagggaaagaagacatttgtaggaccagtgtctctttgcaacaaaagtacggtggataaaagtataacagggaggccactcattatcaatgaacaaaagtgcttgaattggttgacctccaagaaacccaattctgttctttatgttagctttggaagcattgctcggttgccccctgaacatttaaaggaaatttcttatggtcttgaagcttctgaacaatctttcatttgggtggtgaggaatatccataacaacccataa

SEQ ID NO: 105425 - DNA, 330 bp, Glycine max
  Peptide Sequence Number=SeqID_222203
atgttgggtgtcaatgaaatcaattttttcctgtatggtaaaggatatgtgcagacgttcaatgagttacaaaagctgcttagtaagactaatggccaagttgttggtgacttgatgactccaactccacttgttgttcatgaatcgactagtcttgaggaagctgctaggctgttacttgaaacaaaatatcgtcgactacctgtggtagatgatgatggaaagctggctaggagatactacatcctgttctttatgcagtctctgataactgacatttatgagttgtacacttggaaatacaggggaatgggaaatattttatcgtaa

SEQ ID NO: 105426 - DNA, 927 bp, Glycine max
  Peptide Sequence Number=SeqID_222204
atgaccaggaaaccggcatggttgttatctccactacctgttcctactcgtccatgggaggacttatcacttgatttcattgttggattatcatcatataaaggaaacaccacaatactggtggttgtagaccggttctccaaaggtattcatttgggccttcttccatctcaatatattgcctatcaagttgctacccttttcctagacatacttgccaagcttcatggcatgcctcagagcttagtctccgatagagaccctttgtttattagcaagttttggcaagaactgtttaagctatctggcacgaagttacgcttaagcttggcttgtcatcctcaatccgatggtcaaaccgaggttatgaaccgcataattgagcaatttctacgtgccttcgttcatcatcgcccatcgtcgtgggaaaccaccgacaatccttcagtatatcataggctcttcttaagtggaggcagtggatacattactcaccacacgggaggtgattgggttatggtcaaactccgtcctcaacgtcagttgtctgtaacgagtcccaacaagaccaagcttgtcaaacattcttatggccctttaaaggttttggaacacataggtattgtggcttacaagctccttctttcgaaggactcacgtatccaccctatctttcattgctcactccttaagccattccggcatgacgtgggaactaaaccgagcccacttccattacctagaaagcactccaacaaccgtcctatcattacccctctaattatcctcaatactcgttgggtagacacatacaatggactttgtttacaggacaatgtgattttcaaaggggccgggagtgatagactagtcaacatgcatgaagcccaacatagaaggcctcagaggaaggtcacacctctgtaa

SEQ ID NO: 105427 - DNA, 1158 bp, Glycine max
  Peptide Sequence Number=SeqID_222205
atggcggaatccactcgctacaaatccaacctcgatcatttggaggatgtgatagccaagctcaccgctactcaagcatcgatgtcaaccaagctcgacgaccttcatcagaaactagcggttatggagtccattcaccattctccagtctcgtcttccacacacttccttgcttcttccatttctttaataataggccttatgcctccttttttattaagctattttatcctcggcctttcactggaaatacgatgggaagtccaggcactccaacctctatcccttagtcaagccaccgctctcgcgcgacttcaggaggagaagttttgtgacttacgtcatctaacccacccttgtgcttactctccgtgttccttcgaccctcgttcccctcaaccaaatatttcaccaaccctaccattactcccacctccacccttattatccacaccaccaaaaccctccatacctttcaaatgcctctcacatgaagaaataaccatacacagagagaatggactttgctttaattgtgatgagcaattcaatcccagccatcactgctcttccaaactttttctactgatagctgatgatgatgaacttttatcagaagagatgccacttattgaagcttttccggttgcacaggaacccgatgatccacctccagctcaaattagcttccatgccatctcagggcacatggcactggaaacattatgcgtgatagggtttatctttgaccagaaagtcctcattctggtggacagaggcagtactcataacttcattcaggaatgcttggtcaccacgctagggctacatgcacagtctactccaccattacacgttatgattggtaatggtaccgagatcgaatgtctgcagatttgcaagcactcattaggtctagtctttacggactacacagacttgactatgaaattcaagcaccacaataggatcatcgaattgcatggtgaacgtgatgacaccattcgcgagatcaatcaccatcaactcaaacggatggttcaaacagatggtgttagtgcttttttccacattcgcctcatggaccctgagctcccttctaaccaacaaacacaacctctaacccaagacccaaccatcatctccctacttcattga

SEQ ID NO: 105428 - DNA, 696 bp, Glycine max
  Peptide Sequence Number=SeqID_222206
atgccagaccctaaggcatttgtttccagggtgaaaggtttagagaaattggagatgaatcaaagtggctactatggtagcatatcctttgatgaagcatctataaaaacctgtgagacccaaaaatccccacagggctttaagggaggtggatcgtggccattgttgaatggaaggtatcttgtcgggaatgggttgaacactggatccaaaaagcccaatccaaatgttgaaggtggtctgcgaatgagcattgcaaaggccaaagggcattacatggaattcgtaatgcccttcgtgagtgcggaatgcggttttatgtacattgtccttgcgcacaagtatttggtgatacccttgcagcaaatcgagtctgatgataccataactcaacatggcttcgacctgagtctcaatctcatgcttttgaaaataggggtatctgtagggtcaaacattaacgggaagggagtttgggagaagattaatggtgtgggtcatatcgcggggtggggggagctcagggtccatgaggcgaatgtggaaaaaagcactaacaccatctgtttgaaccatccgtttgagttgatggtgattgatctcgcgaatggtgtcatcacgttcaccatgcaattcgatgatcctattgtggtgcttgaatttcatagtcaagtctgtgtagtccgtaaagactag

SEQ ID NO: 105429 - DNA, 513 bp, Glycine max
  Peptide Sequence Number=SeqID_222207
atgagcattccaactatgctagttttaccatatccagctcaagggcatgtcaatcccttgatgaccctctcacaaaagttggttgagcatggttgtaaaccctcctttttgatccatctctcagtattttacaacttcattttacctttatcatccttcatggccaaccttagagctagaactaataatggaatttcaacaaaccatgttgagatccctatctatatttcaaatggtgtagagctaaaaccaatccaaaaggagaaaagtgacattgctacttactacgagacagaggcagctggaaacaatggaagattaaagcagcacgaaggggacctcacgacgaaatcaatggtggtcacagttgtggacgaaggggacctcacgtcaaaatcaatgacggtattcctaccgatattggacctcacaatacgaagggcacgaaggacacgatggggacctcatggtggtcgcaacagtaaactcaaagtgaaagtgaaaaatgaataa

SEQ ID NO: 105430 - DNA, 447 bp, Glycine max
  Peptide Sequence Number=SeqID_222208
atgagcacttgcaatttcactccttttggagggggacaaaggctgtgccctggccttgacttggataggctggaagcttccatcttcctacaccactttgtcagtcaattcagatggcaagctgaagaagatacaatagtgaactttcctacaataataatgaaaaagaggatgtctgtgatgtggtttaatgatgtgcattcaactgaaatctctaataaatgtgatgaagcacttaatctgttgtcaaaggctcatggttgtgaaatgatagaaattgttataccagagcttcttcagatgcgaactgcccatgttgtttccattggctctgaatgcttatgttcactgaatcctgattgtgaagacggaccaaggagtatgtattaccacttggacattttcaagaaagtgaatgtcatagtaacaccgaccactagttgttaa

SEQ ID NO: 105431 - DNA, 1860 bp, Glycine max
  Peptide Sequence Number=SeqID_222209
atgggaaggttatatggctttgcttctatagcagagacaattccatctctcttcaggcagtttttggctgcgatgaggcatttgatgaccatggttaaggttgctttccttttagtcattgaactgggggtatttcctttgatgtgtggatggtggctcgatgtttgtaccattcagatgtttgggaagacaatggttcacagagttcagttcttctctgcatcccctttagcaagctcattggttcattgggttgttggtattgtgtacatgctactaattagcatatttgtcagccttcttagaggggttttacgtaatggagttttatactttcttcgggaccctgctgatccaaactacaatccgttccgtgatctgatagatgatcctgtgcacaaacatgctcgcagggttctgttatctgttgcagtttatgggagtctgattgtgatgctggtattcttgcctgtcaaacatgccatgcggatggcaccttcgattttcccgcttgacatatcggtatctgatccattcactgaaattccagctgacatgcttctctttcagatttgtatcccatttgctattgagcattttaaattgaggacaactattaaatccctacttcgatattggtttactgctgttggttgggcacttggtttgactgatttcttactgcctaaacctgatgagagtgttaatcaagaaaatggaaatggggagccagctagacaggaaaggctacaaatagtacaagctggagtgcatgatcagggtttggtgccatttgcaggcgatgatttgaacagggccattatcacagtggaagaaatgaatgctgaagaggattatgataatgatgagcagtctgattctgacagttacgccttcgtgcttcgcattgtgcttttactggtgattgcttggatgactctccttgtcttcaactctgctctgatagttgtaccaatttcccttggacggacactttttaattctattcctcgccttcccataactcatgggattaaatgcaatgatctgtatgcatttatcattggaagctatgtgatctggactgctgttgctggagttagatactcgattgagcaaataagaaaaaggagatcttctgttttgtttggccaaatatggaagtggtgtggcattcttgtgaagagttctgcacttctgtctatatggatatttgttatcccagtgctaattgggcttctttttgagcttttggtcatcgtgccaatgagagttccagtggatgaaagtccagtattcctcctttatcaagactgggcattaggccttatatttctcaagatatggactagattggttatgttggaccacatgatgcctctggtggatgaaagttggcgagtcaaatttgagagagtgagagaggatggtttctccaggctgcaaggtctttgggtccttcgggagatcgtacttcctatcataatgaagctgttgacagcattatgtgtaccctacgttttggccaaaggtgtatttccagtgcttgggtatcccttggtgataaattctgccgtctatcggtttgcatggttgggatgcctctctttcagtttcgtgtgcttctgtgccaagagattccatgtctggttcacaaatctccataattcaatacgcgatgaccgatatctgattggccggaggttgcataactttggagaacatgctgagaaagcaaatgtggcagaaactaattcaggggagaaggacactattttactaggtacaggtttaaaccaacaagatcgcgaagcagatgtcggactacggttaaggcacgtaaatcaacaggtgggctga

SEQ ID NO: 105432 - DNA, 333 bp, Glycine max
  Peptide Sequence Number=SeqID_222210
atgatttacaggcaagctgctaaaatagttacagaatggtatggtcattcattaccatttgcaccatctcaacatataatcctcttctccaaagttatgactaagtggccacactttctcctcacgtttgtgtatgagttactgaatctcctactagtagaagatgtggtagctgcagctggttcaacattaggtgcaggcaaggttgccttagtgagctctctaagttgtgaatgtatgttgtttatgaaagccattgacttctattgtggttccatcattgcttctttaagcttgccaagtgccaaacaatatgcttcctgcatatggtaa

SEQ ID NO: 105433 - DNA, 2040 bp, Glycine max
  Peptide Sequence Number=SeqID_222211
atggagatcgctcacgagccatcgccttccctcgacggaagccccttcgccgccgccgagactctcgcgaattctccgtcgtcctcgtcgtcttccccttcctcctcctcctcctccgcctcatcgccgcgcggcgcgaagggaaaagaggtcgaatccaccgcgtcggggacggcgacatctccggcgccggcgaagtatgacgacgaagatgaggaggaagaggacgtgtgccgaatttgccggaaccccggcgacgccgagaatccgcttcgttatccttgcgcatgcagcgggagcatcaaattcgtgcatcaggattgtctccttcagtggcttaatcacagcaacgcgcgccaatgcgaggtctgcaagcatgcattctccttctctccagtgtatgctgagaatgccccagctaggttaccttttcaagagtttgtggttggaatggcaatgaaagcttgccatgttcttcaattctttttgcgcctgagttttgtgctatctgtgtggctcttaattatacctttcataacattctggatatggcgattagcttttgtaaggagtttaggtgaagcccagaggttattcttaagccatttatcgacagcagttattctgactgattgcctccatggtttcctactttctgcaagtattgtcttcattttccttggggccacttctttgagagattactttaggcatttgcgagaaattgggggacaggatgccgatagagaagatgaagtggacagaaatggtgctcgaattgctagaaggcctcctgggcaagctaatcgtaacatcaacaatggtgatgggaatggtgaagatgctggtggagtgcaaggaattgcaggggcaggtcaagtaattagaagaaatgctgaaaacgttgctgcacggtgggagatgcaagcagctcgtcttgaggcacatgtcgagcagatgttcgatggtctggatgatgctgatggagcagaagatgttccctttgatgaacttgttggcatgcagggtccagtttttcatttggttgaaaatgcatttacagtgctggctagcaatatgattttccttggtgttgtaatctttgtgccattttcattgggccgtatcatactccattatctatcctggttcttctcaactgctagtggccctgtgttgtcagctgtggccccacttgcagacacatctctttctctagcaaatattactttgaagaatgcattaacagctgttaaaaacatgtcatctgaaactcaagaaaatggatcaattggtcaggttgcagaaatgctgaaagcaaatgctagtgaaatgagtgaaatgtcaaacataacttctgcttcagctgttatcttgaaaggagtgtcaattggaacttcaaggatttctgatgttaccactctagctattggatatgtttttatattgactctaattttctgctactttggaattgttgctttaattcgttacacaaagggtgagcctttgaccatgggaaggttttatggcattgcttctatagcagagacaattccatctcttttcaggcagtttttggcagcaatgaggcatttgatgactatggttaaggttgctttccttttagtcattgaactgggggtatttcctttgatgtgtgggtggtggctcgatgtttgtaccattcagatgtttgggaagacaatggttcacagagttcagttcttctctgcatcccctttagcaagctcattggttcattgggttgttggtattgtgtatatgctacaaattagcatatttgtcagccttcttagaggggttttacgtaatggagttttatactttcttcgggaccctgctgatccaaactacaatccgttccgtgatctgatagatgatcctgtgcacaaacatgctcgcagggttctgttatctgttgcagtttatgggagtctgattgtgatgctggtattcttgcctgtcaaacatgccatgcggatggcaccttcgattttcccgcttgacatatcgtaa

SEQ ID NO: 105434 - DNA, 3057 bp, Glycine max
  Peptide Sequence Number=SeqID_222212
atgaaccacaagccatggctttggaggaaaaaatctatggagaaaacaatccttgcagttggcaaagttgtcagttcttctaaaaccattgaagaagaggcacacaaacttccaacaaataaagaaactggattggaaagatcatcaaaaagtctaaatgagaagttggcaacagtcctacttgattctcattctggagatgaccctttagcaaaacaagcccaaaagccccaacaggaaattagaggcaatgacaagacaaaacaggaagtagaatctgttgaagacttagaagaagaagcatctgctgagactgttactccagcagatgcaacattggaggaacctttgcagccaccaagcagtgttcaagtcgaacaagagcaaaagttgagtggtgccactgcaaagatatcaacagagcatgaaaagattcagagagatttggaagagaagttgagggaaacaagtaaaaggctagatgacttaactgctgagaatacacatattgctaatgcattgctaaccaaagagaaatcaattggggatctggttaaatgtaaacaagaagcagatgccgagtttagtacattgatggctagattagacaccacagaaaaggaaaattctttcctaagatacgagtttcacgtgctggagaaggaacttgagatccggaaggaggagatggactatagccgtcagtatgcagatgtctcacataaacagtaccttgagagttctcagaaagcctcaaagttagaggccgagtgtcagagactacgtcttttgctgcagaaaagatcacctggttctgctggtttggggaatatgaagaatgaagttggagtggcgagaataagaaagtcaaatccttccagagaattgatgtacaaaaacaatgatgccagaaactctagtaatgtgtctgagaaaagtttcggcttaatgaccaaacgcttgcaagatctggatgaggagaacaaggctctcaaaagaattttaaccacaaaaaactctgaactagaatattcaagacttatgtacgctgaaacagcttccagattatcacaggctgagattctgcttagaaagatttctgaaaatcagaggtccatggagctggctaggtgttatcccacatcaaatgaacttcctttgatgtcaaattatgatatttatagtgatgatgaggctatctcttctggatcctgggctaatgctcttatgtcggaactcgaacatttaagaacttcagaggctaaaattcataaaagcagcagagccactgaagtttcagacattagtttcttggatgattttgccgagatggaaaaaggagctatagtttctattgatacgcctaaaaggggatacttctctgatgtaagtggtagggagctagtgtcagttaaacaagatcatcttggcattagtgagaggaaacaggagatccaattcaaacatacaacaacagaaaaatcatttgactggcttcagattgttttgaatgcaatgtcgaaggagaaacacatatcgaaacgaagtcttcacgaactgtttgatgacataaaaattgctttggattgtgtaaatcatccaactgcttgtaaatctgataccgaagcagaaagcaaacaacacttcaattctaatttgagaaagtcagtccacagaattgtcaacctcattgaaggaattgctccaaagtcatttatgtgcaacaattgtccagattgcttggaggagattaagcattcagacatatcgcaatcaccaacacccaaagactattttgttcatgttttccaatggaaggtttcagacttaaatcctctcctgcaccaacttgttcacacctgcaaagatctgttaacagggaaagctgattttgaaaattttatcgaggaagtggcatttgctttggactggagcattaataacagtgtcacctccacaaatgctgccattgcaagggataagatcaagaagcaattcagcagtcatttatcacaaaatcaaagtaaaacagatgttgaagataaacagtcttctcgcttgccctcatttgcatatcctgacgaacagtgtgaactcttcaacacacagaatgatcagtgtgatctccttgaagagattagaaaactaaaatatgatttgaggagcacaaaaactgcgaagaaagacttggaagaaaagctgctgtcagtaactgatgagagtcagaacttagcaaaacaatgtcaagaagcacaaaataacatcaaaggtttagaatcagaaatcgaggcactgaaagaatccaaagcaacactagaagatcagattgagaaacagaagattataaatgaagatcttgatacacaacttacaatagctcagaccaaattaaatgacatctttcaaaagttttcgtccttagaagttgaattagaggataaaaagaactcctgtgaggatttagaagcaacatgtctagaacttcaactccagctggaaagcattgcaaagaaggaatctccaacatatggcaaatacgaagtagaaaagatatatcaaactggctgggagatcacaacagcttcatcaaagttggcagagtgccaagaaaccatcctaaaccttaggaaacaactcaaggcacttgcttcatctaatgaagtagcaatttttgacaaggttgtctccacaactaatactatggccaatccaactcagaagaagaacttgatcaaacgatcctctctacgcaatcaaatgcaagcagaggatgaagctaaaggagggatgcataagtctgtccaaactgaagaaactaaaagcgataaagatgtgcagaggccaccccttcttcaatctgaaaccgaaaaatctctgccaagtcccaaaagtctcacttcggagcaacatgatagaagcaaaaccacaggctctttggcaattgtgccagattctggtggaacttgtttttatcttgtattggagatgattgaggttggagttgagacacagagtgaaagagaggtttggtgctgtaaatatagctggtgtaaataa

SEQ ID NO: 105435 - DNA, 258 bp, Glycine max
  Peptide Sequence Number=SeqID_222213
atgttgaaaggctcgctcagcaagttagattggctaagtgaggctcatccgcttggcgagggagccaactcactaagcgagtacaaaaccctagagaatgtcaagtcagagagcagcacacttagcacgcagccagcccgtccattcaaggagttgcgtagaggttatggccttgttgaccttgaaattttttgtgttgttattaatgaaggtggtatcctcatcagtgctgcagatttcatcattgtaggggttgag

SEQ ID NO: 105436 - DNA, 231 bp, Glycine max
  Peptide Sequence Number=SeqID_222214
atggatattttagtgaggatgaggatcaacagttctttgatcacgtcaatgaccaaagtgatgaccaaagtgataaagagggtgttggcagaccaacatcaccttcgttgtaatatcaccaacctaagggacttaaccttgaccatctaccacactacattaatcaacatcatttcgttcagcaacaagataatgtacaaccaccaaccaatgcactcgaggttggcatga

SEQ ID NO: 105437 - DNA, 285 bp, Glycine max
  Peptide Sequence Number=SeqID_222215
atggcaagaagtggtagctcgtggtggttgctggtggcagtgggtggaggaggaggtgggtttagggtttggggaaaagagggggtagaaaatcatatttttcacattgttggacgtatttattacataaggttgccactaagtgaaacattcgtgctaagtataatttctcgtctaattggaattgcgattagcgagctggtgtctttaagagaattattttttattgatggaagtgcgcttagcgagctggtgtcgctaagcaaactgttccaatgcagataa

SEQ ID NO: 105438 - DNA, 3225 bp, Glycine max
  Peptide Sequence Number=SeqID_222216
atggctaatcagcaaataatcaaccatgcttcttcttcttcttgtgtggcctctctcaaaagatatgatgtttttcttagctttcgaggagaggacactcgcaaaatcatcacaagccatctctaccatgctctcttccaagccgaactggcaacctacatagactacaggcttcaaaagggtgatgagatctcgcaagctctcattgaagccattgaagagtcacaggtatccgtcatcatcttctcagaaaagtatgctacctccaaatggtgcttggatgaaatcaccaagattatagaatgcaaggagggtcaaggacaagttgttatacccgtcttctataaaatagatccatcacatataaggaagcaacaagggtctttcaagcaagcgtttgtggaacacgagcaagatcttaagatcacaactgatagggtgcaaaaatggagagaagctctcacaaaagcagctaatttggctgggtgggactttcaaacttataggaccgaggctgaattcattaaggacattgttaaagatgttttactcaaactgaatctcatatacccaattgaattgaaaggactgattggaatcgagggaaactataccaggattgaatcattattgaaaattgactcaagaaaagttcgagtgatcggaatatggggcatgggtggcattggtaagactaccctggcaaccgccttatatgccaaactgttttctcgatttgaaggtcattgctttctgggaaatgtaagggaacaagcagagaagcaaggtttagatttcttacgcacaaaacttttctctgagttgttaccaggagaaaatcatcttcatgaaaatatgcccaaagttgaatatcattttataaccagaagacttaaacgaaaaaaggtttttctggttttggatgatgtggcttcctcagaacaattagaagatctaatcgatgattttaattgcttcggaccaggaagtagagtgattgtaacaactagagataagcacatatttagctatgttgatgagatatatgaagtaaaggaattgaacgaccttgactctcttcaacttttctgtttgaatgccttcagagaaaagcatcccaagaatggatttgaagagctatcagaaagtgtaattgcctattgcaaaggtaaccctttggctttaaaagttttgggtgcacgtcttcgttcaagaagtgaacaagcatggtactgtgaattgagaaagctccaaaagattccaaatgtgaaaattcataatgtgttaaaattgagttttgatgacttagatcatactgagcaggaaatatttctagacattgcatgcttcttcaaaggagaatatagagaccacataataagtctgctggaagcttgcaatttctttccagccattgggatagaagtccttgcagataagtctctcataactatttctcctgaagatacaatagaaatgcatgacttaatacaagaaatgggttggaatattgttcatcaagaatctatcaaagacccaggaaaaagaagtcggttgtgggatcctgaggaggtgtttgatgttttaaaatataacaggggaactgaagcaatagaaggcatcattttagatttgtctaaaattgaggatctacatttgagctttgactcctttacaaaaatgactaactggagtagcaaaggtaaaatttaccttcctaagaatggtcttaagtcattgtctgacaaattaaggcaccttcaatggcatggatactgtttggagtctttgccatcaaccttttctgctaaattccttgttgagcttgtcatgccctacagcaaccttcaaaagctttgggacggagttcagaatcttgtgaatctaaaggacattgaccttagatactgcgaaaacctggttgaggtcccagacttatccaaggccacaaatctggaagatttatctctttctcagtgtaaaagtctgcgtcaggttcatccatccattttgtctctcccaaagcttcagagtctggatttagaaggctgcattgagattcaaagtcttcaaagtgacgttcatttagaatctctccaagaccttcgtctcagcaactgctcatccctcaaggaattttcagtgatgtcagtggaacttcgaagattatggttagatggcacacatatccaagaattgcccgcatcaatttggggttgtacaaaactcaagtttattgatgtacaaggttgtgacaaccttgacggttttggggacaagttgtcttatgatccaagaacaacatgttttaatagtctggtcctttctgggtgcaaacaactcaatgcatcgaatctagattttatccttgttggtatgcggtctttaacatcgctagagttggaaaattgtttcaacttacgaacactccctgatagcattggcttgctgtcatcattgaaactcttaaaactaagcagaagtaatgttgagagcttgcctgcaagcatcgagaatcttgtaaagttgagaaggctttatttagatcactgcatgaaacttgtgtccctgccagaacttccagagtccctgtggttgttaagtgcagttaactgtgcatctttggtgacaaacttcactcagctgaacataccctttcaacttaaacaaggacttgaagatctccctcaatctgttttcctccctggagaccatgttcctgaaaggttcagctttcatgctgaaggggcttcagtaactattccgcatcttccactttctgacttattatgcggcttaattttttgcgtctttctttctcagtcacccccacatggaaaatatgtttatgttgattgctttatctacaaaaattcccaaaggatcgatggcagaggcgccagacttcacgatcagaatttgattttggatcatgtgtttctttggtttgttgacataaaacaatttggagatgattccttgcttaggaggttacaaaaaggtgaagcgtgtgatccttccaacatatcatttgaattcttggtggaagatgaggatggagaatggtcaacaaagaatataaaggggtgtggtatctatcctatatatgtccctggacatggttattcctctaaacaaaaggggttggagttggggattgaggatagctctagagatattgttgagttagaacccgacagttctaatgatattgatgagttacaa

SEQ ID NO: 105439 - DNA, 861 bp, Glycine max
  Peptide Sequence Number=SeqID_222217
atggctccaccggaaatggaatcagaaatccatgacgaagacgaagatggtgatttggctaatagtaaacaaggacctgctaatggaagtgaaatggtggctcaagaaaccctaatcgaagaccaagatggaattgggcgtaaactctgggttgacgtgattagtggaaacagaaatccagctaagggtagagttatgcagtatgtggctcccaaggtggtagatggtgaaatagatgtgaaaattgaggacgaggatgttgccccagaattgaaattttgggaaactactttgatcttgtatgtcttaggtggagatatcagtatgcatatgctgaagaatttcatggagaaggcttggaactttgtctccctgtcggatatgtactatcacgatgatggatatttcatgcttcgcttcaaatctcatgcggatatggatgctgttttgatgaaagggccttatacaatcaggaatatgcctttgattttgcaggaatggaggccggattttgatctcaagaaagacatgttgagcaccatccctatatgggtgaaattgccaaaacttcctttgcatctatggggagaaactagcctaaacaaaatcggtagtgccattgaaattcctctggtgacagatgaatgcactacacataggcttagagtttcatatgccagaatattggtggaagttgatattacccagaagatgcttgatgaaattactattacagataataagggtttaaaaagaaagcaacctattgaatacgagtggaggccaaaattctgtgagaagtgccagacaattgggcatcaatgtgatggagctgctaagcataagatttggaagtcttag

SEQ ID NO: 105440 - DNA, 1053 bp, Glycine max
  Peptide Sequence Number=SeqID_222218
atggcagcgattctcaaaggctttggtaaaagagttccagcgagacttgatccagatcttctagtgtgggttcgagatgtgaggagcaagaatcttaggtgctggaaaataacagagatggtcttgaaaatcaagaaccaggctaggggagaaccaagctatacagtggaagcagagaatgatggaaaacatgaaatagatgtggccaatgaagatcctgatccgccaatggaagaaaatgaacaaatgaaaaccaacaagcaaaacatggattgtaataatcacctttttgggtatcaaacggaggaagtgcctatggaaatggtggccacacctagaagcagcgtgcataggaaggagaagaaagaagggggctgggttggagtaacacaaggggaactcatagtcaggcttgatagaccatgcccaaaggaagccaactcagccaagggatcttcacaatataaccataaaggctctaatgctctgtttcatgacgaactggagtcggagggcgttcacatgcttgaccctggagtaggaggtggctgcaggataagtttgactaagtcgtcatcatggcagcagccacaagctgttcaccttgaggacaaggagaaactttataagaggaggggagagatattcgatcattgtgagattatcaaggctcttgagcattggaatgtgcagacccttgaagttttgcaagtgagacactgcattcaagggagaaatcctgtattctttctaataagataccagttttctgtcaatttccatgacaactttacaaccttcattccaagcatgacaactgtaataaactggcagatgcaagcacgtggggaggagtgggagaaaggtgccctcatggaggattcaacctctgaaatcaatgtcatcaaagaaaattgttcgagctctaatgaagttaccgtggtcgtcctacaagcacatgctgatgtcaaagcagttgtgatccttaaagatggtggcatcaagattgcatttgatgacgtcgaaattcggtggctaccaaacttgagttga

SEQ ID NO: 105441 - DNA, 765 bp, Glycine max
  Peptide Sequence Number=SeqID_222219
atgaccttgttgaccgtggaagatcaaagtttgcatgatatgaacttcttgtgggaaaatcattcatgggatccctccaattctgataattcgggtgaaagtaaagaaaacatgaaatcacttgatcaggtagaagaaaaagatgaagctctcatgaataagaaacgaaatcgagaccaaggcaatattactagtggtgaagggaaaggtgaaaaatgtcgtgaatctgatcatgaaatgcatatatggaccgagagagaaaggaggaagaaaatgaggaacatgtttgccagtcttcatgctttgcttccacatcttccttccaagataggactacaaggtttcaatacggctgataaatcaaccgttgtggatgaagcagtggcatacattaaaaatcttgagaaaaccctggaaaagctagagaaacagaaacaagaaagggtccaatgtgtctccacttttgggtgtgaaccatccatgtttgtgactggtcagggatcttctaataacaacatttccaatgcaataattggaactacttcaaatgcactttcattccctgtagcttttgacaagacttgggcttctgcaaatttggtcttgaacatttttggagatgaagcccaattctccatttgcacagcccataagccaggcctcatgactaccattggttttgtgctggagaagtacaagattgaggtcataactgccaacatttcgtgcattggttatggaaatgcttgcatgattcaagcccat

SEQ ID NO: 105442 - DNA, 1149 bp, Glycine max
  Peptide Sequence Number=SeqID_222220
atgtatagggttcactctaaaatccttaaaagcaatggtgctatcaccaacccccctatttttgctcgatattcttcttcttcttcttcaccctcagtgccttatgtttctaactaccagaaacaaacagctccatccccaacttcttcatctgggaatagaataagccctgcaattcttgtcatcatagtaattttagcagtggtgtttttcatcttgggtttccttcacttgcttgttagatttctcataaagcaaaggtcttcctccaattcatcaatttcccaatcaaatagataccctgacatgtctgaatcagatgcttaccagaggcagttacagcagctcttccatcttcatgactcaggtctggatcaggctttcatagatgctctcccagtctttttttacaaagagataattggcttgaaggagccttttgattgtgctgtttgcctctgtgagttcttggaacaagacaagctcagattgcttcccatgtgtaaccatgcttttcatattgaatgcatagacacatggttgctgtccaattcaacttgccctctttgtagagggactctctattcgccaggctttgcctttgagaactcagtttttgactttgaaagtcaacttaaggaagatggggtgtcaggaagtggtggagttggttctgttaacaaaactacagaaagttacatagtgaatgggaaaagggtgttttctgttaggcttggaaattttagaagcactaataatcaagatgtggtggtggagagaggtgaaggagagagtagtagtgttaatttggatgtgaggagatgctattcaatggggtcttttcagtatattgtggctgattcagatctgagagtggctttaggccctagcagtggcagcatgagacaactactgaagggaagagcagccacaaatggaagttctttccttgatggagatgctgttgagggcaagaaaatcaacattgcaaggaaaggtgaaagcttttctgtttccaagatctggcaatgctctaggaaagataagttgacaggctcatcagatgctcatttccataactctactgtcacttcgactttgccatggatgaataaagtcagagtgacagaacttgtaattgtaccataa

SEQ ID NO: 105443 - DNA, 2421 bp, Glycine max
  Peptide Sequence Number=SeqID_222221
atgatagatggaagcaagctaagaaactcgttgcgagctttttcatctgttaggatgctttcaatgagtgaaaatgaatttaaaggaacaattgttgctggagattttcatgatttaagtaacctagaacatttgacaatggattacagtaataacttgaagaatgaattttttaaaagtattggagaattgacatctttaaaagttttgtctcttcgttattgcaatataaatgacacccttcctcctgcagattggtcaaagctaaagaagatagaggagttagatttatccggcaacgaatttgagggaccacttccctcgtcttttgttaacatgacatctcttcgggagttggaaatttctcataatcacttcattggaaatttcgattctaacattgcaagccttacatcacttgaatattttggttttacagaaaaccaatttgaagttcctgtttctttctcaacatttgccaatcattcaaagatcaagttgatcgacggtggaggaaacagattcatattggactcacaacatagtttaccaacttggattccaaaatttcagttacaagagcttagtgtgtcttcaacaactgaaactaagtctcttccactccccaattttcttctataccaaaacagtttaatcagcctagacttcagtagttggaagttggaaggagactttccttattggttgttggaaaacaacacaaaaatgactgaagctctgtttagaaattgctctttcactggtactttccagctaccaatgcgttcccttcctaacttatcgaaaattgatgtgtctgacaatatcatagttggccaaatccctagcaacaatatcagttcaatttatccaaatttgcaatttcttaacttgtctagaaacaacatccaaggttcaatccctcgtgagttaggccaaatgaactcattggattcattggatctttctgacaatcacttgtctagagaaataccaaaggacatatttggagttggtcaccgactcaacttcttgaaactatcaaacaataagcttgagggacctattttgaatatccctaatggtttggagaccttgttattgaacgataatagacttaccggtagactcccaagcaacatttttaacgcatccatcatttcattggatgtaagcaataatcatttgatgggaaagattccaagcctcgtaaaaaacttttctggattgaggcaactatttttgttcaataaccattttgaaggctcaattccgttagaattggcgaaacttgaagatctaaattatttagatctctcgaaaaataacttgactggttctgttccatcttttgtaaatccttccttgagatttatccatttgagcaacaatcatttgagaggattacccaaaagaatgttcaatggaacatcttccctagtgacactagatcttagctacaatgaaataaccaatagtgttcaggatatcatacaggaacttaaatatacacggttgaacattctccttttaaaaggtaatcactttattggagacataccaaagcagttatgccaattgatacacttaagcatattagacctttctcataacaatttttctggtgcaatacccaattgcttgggaaaaatgtcttttgagaataaggatcctgaacggtttttggaaagattgtccggttggggttctacaggccaaaataaaattttcccatcacaattaccaaatgtggaagagaaagtaaatttcacttcaaagaagagaaccgacacttacacaaggagcatccttgcttatatgtctggaattgacttgtcccacaataaactgaatgggaatatcccatttgatcttggaaatttgacaagaattcgagcattgaacttgtctcataatgatttgattgggcaaattccagctacattctccaatttggtacaaacagagagtttagacctttcatttaacaagttgagtggtcaaattcctcctcaactgagtaagctaacctcccttgaagtattcagtgtggcacacaacaacttatcgggcacaacacctgaatggaaaggacaattctcgacctttgaaaatagcagctatgaaggtaaccccttcctttgtggacctccactgtcaaaaagttgcaatcctccacctagtattataccaaatgattcacacactcatgtagacgatggtagtttggtggacatgtatgttttctatgtgagctttgcagtgtcattctcagcagcattgttggcaacagcaatagctttatacatcaatccttactgcaggcgagcatggttttactacatggaattggtctgctcaaattgctactactttatcgtggacagtttcagtaggttttcaaattttagaaacatgtaa

SEQ ID NO: 105444 - DNA, 399 bp, Glycine max
  Peptide Sequence Number=SeqID_222222
atgaaattatgcagtcaggaactagattctcttgctgccaaggagggtgatatattttataagaaaaaggattatacattgacacagcataatcatctcttgctgccaaattttgactatgagactgactgccaagacctcaccaatacttggaacaaacccaaaaaccagaactctacatattatgctacaattctgcaggactgccgccaaatgttggccaattctcagcatattttaattgttcattcaaagaaagaagcaaattgtgtagcacataggctctctagattagcttttactacttctgaaagatactggatggaggatgtttcatcccagctcagttttgatgtgcagcatgatttagggacaatttttgttcctgatacctcttaa

SEQ ID NO: 105445 - DNA, 354 bp, Glycine max
  Peptide Sequence Number=SeqID_222223
atgcgatcagagaagaaaccatggtcgccactcctctgtgacgaactcatcgaggaaatcttgtctcgtcttcccgtgaaacctttgatccaattcaagtgtgtgtgcaaaggatggaactccctgatgtcagatccctatttcatcaaattgcaccttagtaaatctgctgcgaaggacgatttggaacaccttcaactgatgaaaaatgtatgcctcggatccatccctgaaatccacatggaatcgtgtgatgctaccatctggtcggttcatgtaatgggttgcactgtggggttagcgaaataccagaaggataccgtgtttgtttctggaacaaggcgacaagggtga

SEQ ID NO: 105446 - DNA, 324 bp, Glycine max
  Peptide Sequence Number=SeqID_222224
atgaagagtagtgtagtaggggtgtgttggttgattttggttttgttggaagcgatgtgctgtgaagggtgttggaaggaagagagagatgctcttttggtcctgaattcgggtttctctttggaaggcccagactgttgtcaatgggaaggagtgaagtgcaactcctccactgggagactcacccaactcattttgaggactgatattgcttggctccccgaaccatatattaattactcacattttgttgtcttcaaagatttgaacaacctcgacttgtcatggaatgccatatccggttgtgtagggaatcaaggttaa

SEQ ID NO: 105447 - DNA, 546 bp, Glycine max
  Peptide Sequence Number=SeqID_222225
atgaaaggcccgggcagcgggattaggttcgatcttggaccgcacgtgctggaccaggcgttgcagctgtttggaccgccggtggcgatcaacgtcgacatggctgaactgcgtcccggcgcgcaaaccaccgattacttccacgcggtgctgacttatcccacccggcgcgtggtgctgcacgccagcatgctggtggccgcggaatcggcgcgttttgtggtgcacggcacgcgcggcagctacgttaagtacgggctcgatccgcaggaggaccgtctcaaagccggtgaacgtccgccgcgtgaagagtggggctacgacatgcgcaacggcacgctgacgctggccgagggcgacgtgatggtggagaaagagctgctgacgctgccgggcaactatccggcctattatgcggcgatccgcgacgccattgccggtaacggtgccaacccggttacggcggaagaggcgattcaggtgatggagctgattgagcttggcctgcagtcggcggagaaacgccagaccttgtccctaaagtaa

SEQ ID NO: 105448 - DNA, 4043 bp, Glycine max
  Peptide Sequence Number=SeqID_222226
atggcagagcacgccactcgccgcaccactagcgaccacctcgaggaggccattaccacacttgcggcaaaacactccgagctcgcctctagagtcgacgccatgtgtgagcgtttctcttccgtacctccacatcaacacccatcttcatcctcgcgaatgcatcagcgtccccccgttaagcttgacgtaccccgttttgatggccatgacccactgggatggatctttaagatctcccagttctttgattaccaggcaactctcgaagaagaccggattaccgttgcgtcattctaccttgacggcgccgcactcagttggttccaatggatgtatcgaaatggattcattacaacctggcaagctctacttcatgcaatcgaaactcgattggctccctccatttacgatgaccctcgcggcgctctattcaaactcgtccaacgtggttcagtcacagaatatatgaccgaattcgagaggttggctaatcgtattgttggtctttccctctccgatttgctaagttgctttatttcagggttgagtcctgaaataagaagggaagtacaggccttccagccggtgtcgctgcctcacgccacttcccttgctcgttttcaagaagacaagatcaacgatcgccggaaaaattcacgttctcttccattggtacctcaaaccacgccctcacaaccctcctttccgccccaacaccctcgacccaaaacccccttcatccaacgtactccagaagagatgatgcataggcgtgagaaaggcctatgctacaattgcgacgagaaatggtcgtcctctcatcgatgtaaaggacgcgttctcttgttcatcgcagactccgacgagcccttacttcccaacactaaccttgatgatacccttccgccacctttaacggaaaccgctccggcctacgaccccactccactccaaacccacatcagtttacatgctatagctggtgttccggccaccgataccttccgcttatacggtgttatcaatcatgcatgtgtcactattttgatagatagcggaagtacacacaatttcatacaaccacgtgtcgcgaaattcctcaacctaaccatggaagagacgacggccttaagggtgatggtcggcaatggctccgtcatggagtgccggcagttgtgcccggcaaccacgatactcattcaaagtcatcccttcacggttacactgcgcgttttgccgttaagtggcgccgatgtcgttttaggggttgagtggttacggaccctgggcccaatcattactgattacaccaccttcacgatggcattcacctacatgggccagcccattactcttcatgcagacgtttcttcggataccaatcccacttcagcccaccaacttaaacggagcctccatacccactctatctcgggcttattccacttatccctgttacctgtaactcaacccgacttagaaagcgaaccacctcaccccatttccgccattaacaccctcctcctcaaatatcaagctcttttccaacaacccactgccttaccaccacctcgacaacacgatcaccacattaacctcattccctcagcactcccagtcaatgtaagaccgtataggtaccctcactcgcagaaaaacgaaattgagaaacaggtcacctccttgctcgaatccgggttaatccaaccaagccgaagtccattctcctcaccagtcttattagtgaagaagaaagacggcacgtggcacatgtgcgtcgactaccgggcgttgaacgcaatcacggtgaaggaccgatttccgatacccaccattgaggagctcctggatgaacttggcagtgcttcctggttctcgaagctggatttacgacagggatttcaccagatcttgatggcaaatgatgacgttcctaaaacctcttttcgaacccacaacggccattttgagtacagggtcatgcctttcgggttatgcaacgcaccctccacttttcaagcggccatgaatgcgttactcaaccctttcttgaggaaattcgcggcagctcaatactatctgaagcgctcgaaatgctttatcggacaacggcaactcgactacttagggcacgtcgtctccgggaagggagtacagcctgacccttccaaggttcaggccattattgactggcctacccctcgctccccgaaggatcttcgtagcttccttggcctcacaggcttttaccggaaagtcccagtccaccttcgactctctcaaaaccgcatgaccacagcccccatccttgccttacccaacttcaacctcccattcatactcgaaacagacgcttcgggtagtgccataggagcagtcctccaacaacacggccatcctatagcatacttcagcaagcctctttgccctcgccttcaacacgcttcagcttatgttcgagaattacacgcgatcacggccgcagtacgacggtggcggcaatatttgctaggccataggttcacgatatacacggatcatagaagcctcagagaactaatgtctcaggtggttcagacacctgaacaacagttctacttagttaagcttctgggattcgactatgaaatccaatacaaagcagggacttcgaacatagtcgcggattctctctctcgtatcgattgttcttcccaagctcaatgcttaatcctctcggttccccatcatgagtttatgattcagttgaaggactcattaaaagccagcactgagtttcaacagcaacgcgaagctatacttgcttaccccgaacaatatcccgacttctccgtttccgatgacctcatcctcttccggggagtgatttggttagattccaagaaccccttcatacaatccctattacacgagtaccatgcaacaccaatcggaggccactttggcattaagaaaaccctacaccgcctgcaatcaagcttccactggccttccatggcgaaggatgttcgagcattcatccggaattgcatcgtatgtcagcaagtcaagcacctcacacgaaaacccgcgggcctactccaacccattcccattcccaacggtgtgtgggaagacctctccatggacttcgtcacacatctaccaagctcgcatggcttcacgacgatcctcgtggtagtcgatcgatttacaaagggagtacatctcggagctttacccacccaattcacagccttcaaagttgccagcctcttcatggatatggtatgcaaacttcacgggttccctcggagtataatctccgaccgtgaccccgtcttcatcagctccttttggagagagctctttcgtttgcagggcacgacgctgcgcatgtccacggcctatcatccgcaatcagacggccaaacagaagttatgaaccgcacggtggagcagtatctccggtcattcgtccaccaccgcccggaggactggtacaaattccttgccttagctgaatggtcatataatacgtcacaacattccggtaccgagctcacgccgtatgaagccacttacggcaagccaccaccatctgttcccagttacgtcttgggcagttctaataacgacgcagccgcagtagtcacccaaacaagggcagaagttcacgccacacttcaacacaaactaattaaggctcaagctacgatgaagcaatatgcagacaagcaacgacgagacgttcagtatgaggtagggcagttagtctatgttaaactacggccttatcgtcaactttcagtgcgacaggggcgctccaataagctcaccaagcgttattttggaccattctgcatattagaacgtatcggtcaggtagcttaccgcctacagcttcctccggggccactcactatccttgactcacgattagacacttccgtgtctccacctatccgctccgtactcgttcaatgggagggcttgccacccgaagactcaacctgggagagtgggaggactttcgcgaccatccccaccttgaggacaag

SEQ ID NO: 105449 - DNA, 129 bp, Glycine max
  Peptide Sequence Number=SeqID_222227
atgaatgcagcggagaatgacgattgtgtgatctctaatgacatggttggactgatgctattgctacaaccagtagcatgtccatggaggcgggttggggttgaagaaaacataagggaaacacgttga

SEQ ID NO: 105450 - DNA, 339 bp, Glycine max
  Peptide Sequence Number=SeqID_222228
atggcagaagatcaaggttcacatgctatagacttccatttgggaaaccatttattagtttcctccaattctgataactcgggagaaagtaaaaacaacatgaagccactgaaccaacaaaatgaagaaggtgaagcactcgtgaataagaagcgaaatcgagagatcgccagtgaaaatgagaaagacaatattactagcgatgaagggttagatggaaaacatccagaatctaataacgaaatgtttgacgaccttcgtggtttgcttccgcaacttccttccgagatcaaggaaatagcggtgggaacttgggtaaaagtcaacagtttcaaataa

SEQ ID NO: 105451 - DNA, 447 bp, Glycine max
  Peptide Sequence Number=SeqID_222229
gcggatgaagcaaccgttattaaggtagcagctaactacattaaaggtctggaggaaagccgcaaaaggctagggaaaataactaagagaatgttcccatatgttttcaaagaaataatgggaacttcagatacaattttaatcaatgggaagaagaaattagaatttgacaaagtatggacttcttcaaacatggtcttgaacattcatgccaattgggcccaattcacagtttgctccgcctacaagccacacctcttgaacaccatcacttctgtgttggagaggcacaacatagaggtcattgctgccaacgtttcattcaatcataatgaaaatggaaagacatgcatgattctagttcatgcaaaacaagtttcagatgaaaattcagctgaggagacttacaaggatgcgtctggagagattttctcattgatctcttaa

SEQ ID NO: 105452 - DNA, 384 bp, Glycine max
  Peptide Sequence Number=SeqID_222230
atggataaagcaaccattattgatgaagtggtgaagtacattaaatttttggaggaaacttgcaaaaagctagagaaacagaaacaagaaagggcccaatatgttctcaaagaagtaatggcaacttcaaatgcagtttcaatcactactggaaagaaacaagacatcttgcccacaatcatttctgtgttggagaagcccacaatcatttctgtgttggagaagcataacatagaggtcattactaccagcatttcaagcaatgataatgtcaatggaaacacaagcatgattctagtccatgcaaaacaagctttggatgcagactcaactgaggaaactttcaagaaagtagctgaagagattatgccatggatcgcttaa

SEQ ID NO: 105453 - DNA, 507 bp, Glycine max
  Peptide Sequence Number=SeqID_222231
atggatactatgtcctatattgacttcaaggagttgattaactctctcggggaccccagaaaagcactgagcagagagttgaagccacttaattctgactctgatattttgcaattggctaaagatgtttctggcttcaatgtggttgaagtctatgtggaccagggggttgacgaggttgttgcaattgatggagtagaggctgaggttaaagctgtggtggagggtgaagttgaagctatggtggagggtgaagttgaggctgaggggcaggttgaaggggaagttggtgttcaaggtgacatgggggcgaaggttcaggttgatgaacaaggtttggtggagattcaggtgcaggctcaacatgaggttggtgttgaaggtgagatggaggttgtggttgaggctgtggtggcgagtgatgtggaggatgatgttgaggttaagcaagatgatgatatcagtgattatagtgaagtttcagataatgactttgaagaaaactag

SEQ ID NO: 105454 - DNA, 573 bp, Glycine max
  Peptide Sequence Number=SeqID_222232
atggtgtcgtcacaagggagaaatacatggacagtggatgatctagtgtcgtatgtggagaaaataatcattttatccgaagagcaagagagaatcactgaacttgtgtcacatggtccagcaacagaacatcaatttgcagcacaagagtttcatatgctcctgtcaagtgttgaaactcaaggcatagccagacgaagggaggctgttgaagcggaaccatatttgtacctacagatggtagagcgttgccatggaatgtattacacaccaccaacattttctcagtatccgacacagatgtatcagtatccatttgaaggtcatcaaagtgatacttctacaagcgaacattcattaggtggtgttgcagaaacatatcccaatttttcatggcctactatgacccattcacagcaacatgatgctccaattccaacacctaatgccctattaggtttactaatggatgcagtttatgtcgtgctgaaaaatataataataaataattttaaaaacaaactgatcatggatagctacgatttcattgaagaacacaaactaaatacataa

SEQ ID NO: 105455 - DNA, 243 bp, Glycine max
  Peptide Sequence Number=SeqID_222233
atggaacagaggaacatacccaacaggcacagagaggggactgggcctgccaccgcccctctctctgccccttatctgactcctcccacacgtgtggtggcatgcatggcacctaacttggaatctaaccctggttggggattggggattttggtcaaaccaaatatgccacttgtgggtcccacatttgctgccctaaaatcttactcctgtgaacatcaactaattgcgtcctccttttga

SEQ ID NO: 105456 - DNA, 1152 bp, Glycine max
  Peptide Sequence Number=SeqID_222234
atgcccggtagtttagaaccgttggatttgggtgttcacataccctaccacttcagatgcccaatctcgctcgaactcatgcgagacccagtaaccgtctgcaccggtcaaacctacgaccgcgccagcatcgaggcatgggtcagcaccggcaacagcacgtgtccggtcacacgcgccactctcacagacttcaccctaatcccgaaccacacccttcgccgccttatccaagagtggtgcgtcgctaaccgcgcttttggcgtcgagcgaatccccactcccaaacagcccgcagaccctgccttagttcgctctctcctcaaccaagcttcttccggttctgcccctgctcacctccgcctttcttccattcgccgactcagacaactcgctcgcgactcggacaagaatcgttccctcattgcctctcacaacgttcgccagatccttctccctatcgttttcaacaacggttcggatgagttgaaaaacgaatcgctcgcgctactcgttatgtttccgcttggtgagtcggaatgtgcttcgctcgcatctgattctgtgaagattggctatctatcgcggatgttgacgcataactcgttcgacgtccgagtcaactcggccgcgttgatcgagatcgtcgtcgccgggacgcactcgccggagctacgcgcggagcccgatctcgcacccgcgcgcgctcaagatcgggatcaaggccttgttcgcgctttgtttggtgaagaatacgcggcagaaggcggtggacgccggcacgccggcggttctagtcgaccggctcgcggacttcgagaagtgcgacgcggagagggcgctggccacggtggagctgctctgccggattccggcgggatgcgaggcgttcgccggacacgcgctgacggtgccgatgctggtgaagataattctgaaaatctccgaccgtgcgacggagtacgccgccggagcgctgctctcgctgtgttcggaatcggagcggtgccagcgcgaggcggtggcggcgggcgtgctgactcagcttctgcttctcgtgcagagcgattgcacggagagagcgaagaggaaggcgcagatgctgctgaagcttcttcgggattcgtggccgcaagattccatcggaaataa

SEQ ID NO: 105457 - DNA, 168 bp, Glycine max
  Peptide Sequence Number=SeqID_222235
atggctaagcccagcaccagcgcgcttagcgagcttagcacgagattagtgctaagctcaaattcacttactcgcgctaagcgcgagaatggtgttaagcgcgacgtcaagattaggaagccctttttaagcttgattttcacaaaattaaaggagagtgctgaatag

SEQ ID NO: 105458 - DNA, 1878 bp, Glycine max
  Peptide Sequence Number=SeqID_222236
atggaatcaaaatcaaacggggcagagacgtacccgaaacgtagcgggttccacccctctctatccgttctacacgtgccttcaccggcacaaccgttgaatcataggggcgtaaggaatggtgggttgtgttcaaaatttgaaatttttgttgcttgcattgggatgttggattcatttctgcattggctcttgattttgcactggtggattgaaggttgtgtcgttcctggatcgttctttttctgttgcggagacatgttggacggtcgttcctgcgttgttccgaggttgttttccggcacttgccaggcggagaacgaatggtcttacatgaagtgcttgctggagttggacatcaagaatggcaaacgccctatggggattgatgatgttgaggaggatgagccccaccagccaaggaagtgtactaagaagttggattcttgccatagagttgaaatggctcgaatttcatttcaacggcaatctattgaggccaaggattctgtagttgttccccctttggatcaagagaccattgagccattgagtgtttgtcaaggagttgttggagaagaaggagctttgactgaccggctattgtgtgagaaagaacatgagggtgatggtgatttgatggattttggtgaccatcaatctgataaacagcagcaggctcagccgggggatttgtcagatttcggtgttcggctatttgatgaagatcagttgcagcatgatgataatttattgaatttgagtgagcagcaatccgaggggcggcagcagcagcaccaccatggtggggattcttcggattccagttctctcttgccacgcatgaaccgggacagctcaatcacctgtctcagccgctgttcgaggtcagattatggttctctcgcctcgctgaataggagcttccggaacataatccgaagtggtgagctctatcaatggaggagactgaatggtatcatggagcactggatttatttttcctgcgccctcctcgaatgggaggcctatgatccgattcgccagcggtggatgcatctgccaaggatggcttctaatgaatgcttcatgtgttcagataaggaatctttagctgctggcactgagctgcttgtgtttgggagggagctgagatcccatgtcacttacagatacagtctcttgacaaactcgtggacctctggaacaaggatgaatgctccaagatgcttgtttggctcagcaagccttggtgagattgcaatattagctggtgggtgtgattcagagggacacatccttgactctgctgagttatataattccgagactcaaacgtgggaaacactcccaagaatgaaaaaacccaggaagatgtcctctggggtatttatggatggaaagttttatgttataggggggattggggggagtgactctaagctcctcacatgtggagaggagtacaatttacagactaggacatggactgagattcctaacatgtcccccggacgtagtagtaggggtcctgagatgcctgcaacagctgaggcaccacctctggttgctgttgtaaatgatgaattgtatgctgctgattatgctgacatggaggttaagaagtatgacaaggagagaaatgtgtggtttaccattgggagactgccagaacgagcagtgtcaatgaatggctggggtcttgcattcagggcatgtggagataagcttattgtcattggtggacctaggactcatggtgagggttttattgaactcaattcatgggtgcctagtgaagggcctccacggtgggatctacttgctagaaaacgttctggcaactttgtctataattgtgctgtgatgggatgctga

SEQ ID NO: 105459 - DNA, 574 bp, Glycine max
  Peptide Sequence Number=SeqID_222237
gcttttcgtcttacagatagcaaaaaggaatgtttatacggataaccactcgggtatttccgcccgtcagcgtgactcaaaagtcagtatgacagatcttgtgagcgcggaagatgatgtaaatctccgcgtgcttttcgtcttacagatagcaaaaaagaatgtttatacggataaccactcgggtatttccacccgtcagcgtgactcaaaagtcggtatgacagatcttgtgagcgtggaagatgacgtaaatctccgcgtgtcaacgggcttgtcggccgcgattgacgaagggcgcagaagacgaccaaaaaagaatgtttatacggataaccactcgggtatttccgcccgtcagcgtgactcaaaagtcagtatgacaaatcttgtgagtgcggaagatgacatagcacaagaaagttttgaaagtgcggacaaccacttgggtatttccgcccgtcagtgtgactctagtgtcagcatgacagaacttgtgaaggtgaccgacaaaagcgaggctcttgctcctacgtatcctccaatgaggaactcagacctacgtagttcttga

SEQ ID NO: 105460 - DNA, 465 bp, Glycine max
  Peptide Sequence Number=SeqID_222238
atgggaggatacgtaggagcaagagcctcgctttggtcgaccgcaccgcctttggttgccatgactcaagagctggtagcccgcggagacaccttacggttatccgcacctcgtcattcagtgaccccaaaggcggcgggcccaatgatacgcggagataccttacggttatccgcacccttttgtcatccagaggcggcgggcccgatgacaagcagagacaaaatttggtcattctgcacccttgtatcatccagaggcgacgggcccgatgatacgcggagataccttacggttatccgcacccttttgtcatccagaggcggcgggcccgatgatacacggagataccttacggttatccgcacccttttttcatctagaggcggcgggcccgatgacaagcagagacaaaatttggtcattctgcacccttgtgtcatccagaggcggcgggcccgatga

SEQ ID NO: 105461 - DNA, 103 bp, Glycine max
  Peptide Sequence Number=SeqID_222239
tattgcaaacctgcatcggtcacacgtcagctttacatgatcagtattatatgtgtgctgtcataacgggccagcctggcccatgtgggctggcccgcaacag

SEQ ID NO: 105462 - DNA, 798 bp, Glycine max
  Peptide Sequence Number=SeqID_222240
atgcaaaacgcattcaaaacggcgttgaaagccggaaagccgcagattggtttatggctggggctgaccagcagctacagcgctgaactgctggcgggggctggcttcgactggctactgatcgacgccgaacatgcgccgaacaccgtgcagaccgtcttaacccagctgcaggccatcgccccttatccgagccagccggtcgtccgcccgtcgtggaacgatccggtgcagatcaaacagctgctggatgtgggcgcgcaaaccctgctggtaccgatggtacaaaacgccgaagaagcccgtctggcggtccgttccacgcgctatccgcctgcgggtattcgcggcgtgggcagcgccctggcgcgggcctcacgctggaaccgcatcccggactacctgcaccaggccaacgacgccatgtgcgtgctggtgcaaatcgaaacccgcgaggcgctaaaaaacctgccgcagatcctggatgtggacggcgtcgacggggtgtttatcggcccggcggatctgagcgccgacatgggctttgccggtaatcctcagcacccggaagtgcaggcggccattgaacaggcgatcgtgcagatcctgagcgccggcaaagcgcccggcatcctgatggccaacgagcagcaggcaaaacgctatctcgaactcggcgcgctgtttgtcgccgtcggcgtcgacaccaccctgctcgcccgcagcgccgaagcgctggcggcacgttttatcgatcacccggttacgtcagtcaataacaataaatccgtctactga

SEQ ID NO: 105463 - DNA, 489 bp, Glycine max
  Peptide Sequence Number=SeqID_222241
atggagaagatctcagttatctatgttctgggtatgagtggaaactggaatcaaacaaagtatggagatattgaatttggtttctatccaactgttgcacctaaaactgtggaccacatttataagcttgtgcgacttggaggctataacactaaccatttctttcgggtggataagggattcgtggcccaagtagcagatgttacaaatggaagatcagctccaatgaacgaggaacaaagaagggaagctgtaaagactgttgttggtgaatttactgaagtcaaacatgttcggggtattctttccatgggaagatatgatgatccagacagtgcttcatcttcattttcaatactacttggagatgcccctcatcttgatggcaagtatgcaatatttggaaaagttactaaaggtgatgaaacgttgacaaagctcgagcaactacctacccgcaaagagggtatatttgtaatggtatactag

SEQ ID NO: 105464 - DNA, 972 bp, Glycine max
  Peptide Sequence Number=SeqID_222242
atgaagaacaacaacaacaacaccaagctcatcctccttcacccttccctccacaaacaaaccctgacacccaccaccgccgccgccgcctccacactattctcttcccaccgtaacctctggctctttttcttcttcctcctcttctccaccctcctcttcacctggaccatcatctcaaccacaatctcctccgccacttcaaccacttcctccaccgttacctcccctctctcaccctccgtcacaaaggccctcctccactacgccgccgccgctaactcctccgccaaacccatgtcccccgccgaaatctccgccgtctcctccaccctcctccgcctccccccgcgccccaacctcttaatcttaggcctcacccacgagtccctcctctgggccgccctcaaccaccgcggcggccgcaccgtcttcctcgacgagaacgaatacgccatctcgaaattcgagtcttccaaccccggcgtcgaagcttacgatattcaattcacaacaaaagtcagcgaatacccaaaactcctctcccaagcccaatctcaggcccacggcgagtgtaggcccgtccagaacctcttgttctctgaatgcaagcttgcaatcaacgacttacctaaccacatttacactgtcgcgtgggacgttattcttgttgacgggcccaaagggtattttcaggcggcgccagggcggatggcgccaatcttcacggcggcggtacttgcccggagtaaaaaattcggccagactcacgtgttcgtgcatgactacgggagagaggtggagagggttttcagcgaggagtttctgtgtaaggagaatttggttgagttggtggattcgttggggcacttcgttgttaagagcgaggctcacgacggagaaagcgcggttttttgtaagaacttgtcggcgttgcggtcgtcgaaggttgtcggcgacgaagaggagtag

SEQ ID NO: 105465 - DNA, 978 bp, Glycine max
  Peptide Sequence Number=SeqID_222243
atggaaagtagtgaatatcatactctacacattttcttcttccccttctttgctcatggtcatgtgataccaacccttgacatggccaaattatttgctgaaaagggtgtgaaggccactatagtcaccacacccctcaatgcacctttcatctccaaagccattggaaaatccaaaactaagcacaacagaatccatatccaaaccattgagttaccttgtgcagaggctgttttacctgatagctgtgaaaatactgactcgatcacttcacaagatttgtttgaatccttctgtatggccacatgtttcctacaagagccatttgagcaactgatagaaaagcaacatccagattgcattgttgctgatatgttcttcccatgggcaactgattctgccgccaaatttggaattcctaggcttgtgtttcatggctatagttttatctccttgtgtgctacctcgtgtatggaactctacaagtctcacaacgacgctgagtcatcatcgtttgtcattcctaatcttccgggtgaaattagaatcgaaatgacaatgctgccaccttatagcaagaatcattccaggaacgtgcttggaagaaaagcgtggcacattggtcccttatccctttgcaacaaagataacgaagagaaagcacatagaggaaaggaggcatctattgatgagcatgaatgcctaaagtggcttgacacaaagaaacccaattcagttgtttacttgtgttttggaagtgcggtaaagttgtctgattctcagcttcgagagattgctatgggacttgaggcatcgggacaacaattcatttgggttgcggggaagacgaaagaacaaaagggagagaaatggctacctgaaggatttgagaaaagaatggaagttaagggactaattgttagaattaatgtctcatgtgaaaaaagacatgtgacttatgtagggactaataaataa

SEQ ID NO: 105466 - DNA, 1458 bp, Glycine max
  Peptide Sequence Number=SeqID_222244
atggccaaattgtttgctgaaaagggtgtgaaagccactatagtcaccacacccctcaatgcacctttcttctccaaagccattggaaactccaaaactaatggcaacaaaatccacatcgaaaccatcgagtttccttgtgctgaggctggtttacctgttggctgcgaaaacgttgactccatcccttcaccaaatttgtttcaagccttcataatggccaccggtttactacaagagccgcttgagcaactattgctcaagcaacgtcctgattgcattgtcgctgattttttcttcccatggacaactgattctgccgccaaatttggaattcctaggcttgtgttccatgggaccggtttcttctcctcgtgcgctaccacgtgtatgggactctacgagccttacaacgatgtttcttctgattccgaatcattcgtcattcctaatcttcccggtgagattaaaatgacaaggatgcagctgccaccttttttcaagggtaaggagaaaacaggcctggccaaattgttggtggaagcaagggaatcagagtcgaggtgctatggggttgttgttaatagcttctacgaacttgagaaggtctatgcagatcatttcaggaacgtgcttggaagaaaagcatggcacattggtcccttatttctttgcaacaaagataccgaagagaaagtgcatagaggtaaggaagcatcaattgatgagcatgagtgtctaaaatggcttgacaacaagaaacctggttcagttgtttacgtatgcttcggaagcgtagcaaagttctcggattcacaacttagagaaattgcaataggtctagaggcttcagggcaacaattcatctgggtcgttaagaaaagcagagaagaaaagggagagaaatggttacctgatggatttgagaaaagaatggaaggtaagggactaatcataagagggtgggcgcctcaagtgttgattcttgaacacgaagcaattggcgcgtttgtgacgcattgtgggtggaattcaaccttggaggcagtgactgcaggggttcccatggtcacttggcctattgctgcagaacaatttttcaatgagaagttgttgagtgaggtccttaaaattggtgtacctgttggtgctaaaaaatggttacgattggagggggatagtatcacatgggatgctgtggagaaggctgtgaagaggataatgattgaggaagaagcaattgaaatgaggaacagaacaaaggtgctttcgcagttagctaagcaggccgtggaaggaggaggatcatccgattctgatttgaaagctttaattgaggaaggtgaatggcatcttcggaatcaaggagaagcaaagaagtcaacagcaaaggggaaggaagttgcagataggagggatgagagtctttctgttgctcttctagctctaattgatgtg

SEQ ID NO: 105467 - DNA, 1116 bp, Glycine max
  Peptide Sequence Number=SeqID_222245
atggggtcaaactcgagccgtcgaagatacaagagatgcttgattggcttgttcccactctccttaggtctctacatgggttccttggccttactagcttgccacaataatttcgttgctgatgctttgtctcgcattcatgaaccagcaactgaggctttttggatcctcaatttccctcatttccagttccttaatgaccttgaaagggaattgtccaatatggtggaatttgtcactttgctcaaggctgtccgagataaaccacatgatcaccttgattttagaatccaggatgagctactcctttacaagggccacatttgggtgaataaaagcaattcctttattctgcttctgttggaagagtaccataaatcccctctaggtgaccacatgggcctggctaagaccttgagtcatcttcaacataatttcttctggaatggtatgaagcaagatgtccgagaatacatcctgcgatgttctaactaccagcataccaagtatgttactcaaaaaccttttggcctccttcaaacaattcctcctccatttagcccatgggaggacatggcattagatttcattactgggatgcccaattaccaaggagctactgtgattttattagttgtggatcatttttcgaagggagctcatttcgacatgctccctaccaattttatagtacacagggtagcctggttattcattgagatgaagaaactccaacgagcccaagaacagatgaagaagactactgatgctcatcgcatggatgccagttttgctgttggtgattgggtatatgtgaagttgtgtttctactgccagacctttttatcgagcaccacctatcagaagttgggtagggtttactatggaccttatcagatcaaggagactattggctcagttgcttacaagttggctccttttgattccgctaagattcacctggaagattgggttgagctacaaactacttaccaccttgaggacaaggtgcttcttgaagcagtggagaatgatagcactcagaaccaaatgagagatttcaagcccaaaaggatctccaaaaggctgggaagaatatatccactaggctactag

SEQ ID NO: 105468 - DNA, 579 bp, Glycine max
  Peptide Sequence Number=SeqID_222246
atgagtagtgatcatcgtcctttacacatattcttcttccctttcttggcacatggccatattatcccaacagttgacatggccaaactatttgctgctaaagggattaaggccactataatcaccactccaatcaatgcacctctcatctccaaagccataggaaacagtaaaaccttaacacacaacaatgaaattcatattcaaaccatcaaattccctagtgtagagttttgtgttgattaccgggccttaaacaccattatcgtcgaagacaggttcctttttcctacaattaacgaactcttggacgatttgggtcacgctacttggttctctaaagtggaccttgcgcaaggtttccatcaaatctgtatggcaaaggccaacatctccaagacagccttttgtacccatcaagggcactatgagtatgtcgttttgtcatttagcctttgtaaccccccatctatgttccaagccaccatgaagacttgtttcggcccttcattcgcaaattcgtcttggtgttttttgacgacattttggtgtatagccgcaatttcgacgaacacctag

SEQ ID NO: 105469 - DNA, 1116 bp, Glycine max
  Peptide Sequence Number=SeqID_222247
atggatcttttctctggatacaccagtcatgaagctatcaattcaacttgttcttcaaatctttgccatgagaactatcatgatgactccaacaattccgagacaaaaattgaggctgaagaagatttttttaaatattccgaagatgaagagttgaaaactgaaggattggaggaaattactaatgctattaaatttaaacaagagtgtagtcatcaaaatgaatcaaatggttctgaaccagaagcaaagttcaatgaggattgttctgaaacagttactattacaaactgtgctggaaatcttggccttgatgaagaagaagaaaaagagaaactgaggttggttttcaaattccggtatcaaacttggaagtgttgtgaaacttttgattctgtgaacactgataacgttaaggcttctgaaagcaccaacaagcatgagttcctatcaagtaagagtttcagcagcttcttggatgaaccatgcgtttgttcagaatattttcctttggaaaatgattctgttgatgaatcagagagaaattttgaacctgaaagttgtgaaagaaggtgtgttgatgcagcagtggagctcaagactgtgccatctgtagaacaagctgatgaacatctagtggagaatctgaataacaatgtgttatttgaaaaaatttcagctgataacaatttcctttctgaagatgatttcatttgtgaaagcacggagtcaaattctatgatcagttctataggagatgaatttttgtcagacacagattttggaaccactactaatgttcacactttgggaaaccatgatgaagaaaatgcagtgttaacaaaagaagatttgaactttgagggtgagaaaagatcagagagttttgatgctgaagatagagatacaacaatggttaggataagaagattggaagaagaaactataatgcaagatattgagaacataaagttgaaagggaattgttttcaagataggcatggcatgaacttgttgcatagttcaacaggttcagatcttgaggattcgtaccggtttgatgcacaatgggaacatcaagatttgatagaacagctcaagatagagcttaacaag

SEQ ID NO: 105470 - DNA, 1107 bp, Glycine max
  Peptide Sequence Number=SeqID_222248
atggaggagaggaatgagatggaaagaattgatgatgtgatgccaggatttcgttttcaccccactgatgaagagcttgttgatttttatctcaagagaaaaattcagcagaagtctcttcctattgaactcattaagcaagtggatatttacaaatatgatccatgggaccttccaaagctggcaggtactggggagaaagagtggtatttctactgtccaagggacagaaaatacaggaacagtgcacgtccaaatagagtcacaagagctgggttttggaaggccactggaactgacaggcctatatattcctctgaaggaaagtgcattggtttgaagaagtctcttgtgttctacagaggaagagctgctaaaggaatgaaaactgactggatgatgcatgagtttaggcttccttgcatatcagactcatcccctcccaaaaaactctctgacaaaagcctccctccaagtgattcatgggcaatttgtaggatattcaagaaagccaattccttctccatggcacaaaaagcattatctctcccttggatctctcagttacctggaggcatggtatctgacatgttcacacaaggtttaaactgccataacatagaatcaccagccattcaattttgtggtgacaagcaggatgagttacaccaagtctccaacaatgccatcaacaccaacttcacagcctcagatattcccacttacaagcccatcaacaacagcacagcttccaaaagtcctgtttcagatggagaccttgctgctgacaacttcatattctacacagggcccaccaagtgctgcagcacactacttgatgccactaattccatgctttctcatcccaaccctgactacatagcatttgaagagccaaaccaacaacattatagtggcttctcaatcaatctacctcaagatatgcaacaaaacatgagcacagaaacaggaaccactggatttcccttcagtttgagtcctccttatgatgctgcttggaaggcttcttctgtggcatgggattcacctccttgccctagtgacatgtccctacctattccactaataaatgctacacttaattaa

SEQ ID NO: 105471 - DNA, 408 bp, Glycine max
  Peptide Sequence Number=SeqID_222249
atggacataggaaaagaaagatcccttgaagaaacgccaacatgggctgtttcagtcttttgcttcttctttcttatgatatctttgatcattgagggtggactccacaaattatctgagattttgaggaaagggaaaggaaaatcgctagggaaggctttgactaaaaccaaaacagaaatgatgaaattcggtttcatgtcctttattctcacaatatcggaagtgccaatatcaaaaatctgcatcagcaagggtgtggcaaattcatttctcccgtgtaaggatgttgtgggcttcacaggatcagctactcgtacttcaacctcaggattggacgtagcacctgctaccaatgaatccacaattgaagtcaactattgtgaagcaaaggtgagattgatttaa

SEQ ID NO: 105472 - DNA, 819 bp, Glycine max
  Peptide Sequence Number=SeqID_222250
atgccctctgacctcttcccaatgccctctcttcaccttctccttgacgctaagggccactgcctcctgaaaatgcccaccggcacagggaaaaccatcacactcctctcattgatcacaagctacatcctttcgaagccccattcctcgctcaagctcctctactgcacttgcaccgtccacgagatggagaagacacttgccgagctctgtcttctccatgattaccaactccgccacatcagccccaccaccaagatcctcgccctcagcctctcatccagcttcctcagtcttccctatgagttccaagtcgagatccctgctagggtccccagtgctagagaaagaaagtgtaagactttcatgaagggtggtgaagaagatgatgtagccagaactttgtttgaaactagtgcattcgggttggtccttattcttttaatgttaagtatgccaggcagaaatagagaattgcaaggtctggctcgtgctatggtgaagcggtgggaaacaagtgctattcaaaaattgccatcaaacgagcttttcctaattcatgtaatgaaacactactgttttgaagaacttaggccaatagcagatgcctatggactgctcatgcataggaatggacccttgcacctggagtttccccttcaccaaggattagacacagccgctggggtttggttagatagaaatggcattttgtactcctcacgctcaaacaaaggtcatgattatgacccttctttggagattatgcgtgttgtcgtcatgcattttaaaatatttcttgcgaagccacaaatctaa

SEQ ID NO: 105473 - DNA, 285 bp, Glycine max
  Peptide Sequence Number=SeqID_222251
atgaggaagcgccaagtggttgtgagaagagaggagcctcagaggagtggcgttagggcggtgaaatacggcgagtgccagaagaatcacgccgcgaatgtgggagggtatgctgttgatggctgcagggagttcatggcaagtggcagtggcagcggcggcggcagcggcggcggagaaggaacaagtgctgctctcacttgtgccgcgtgtggctgccacaggaacttccacaagagacaggaagctgaagtgctactcgatgaagcagttggttcagtttga

SEQ ID NO: 105474 - DNA, 1053 bp, Glycine max
  Peptide Sequence Number=SeqID_222252
atgggctggctttttgagaagatacttgaaggggataatgaggtgttgatcgccaattttgaaaaaaaaggaggtgaaggaagcaatatgggagtgtgggagcacaaagagtccaaggagtttcacacaaatggtgttttcccaatggggacaaatgcttcttttgtcaccttcatcccaaaggttgtggatccacaagattttggcgactttaggcctatatccttggttggatgtatgtataagaggttcttgttacatagtgtacttgtggcgaatgaggtgttagatgaagctaaaaggaaaaaaggcaagtgttgggtgttcaaggtagactatgaaaaagcctacgatttggtctcatggacctttttgctttatatgctatggagattaggcttttgtgagagatggattaagggtcttaggcaaaaagatcctttggtgcctttcttgtttactattgttgggggaggatcgagtggccttgtgagagaggccttttccaaaaacctcttcaaaggctattttgtggggagggataaggtgaaagtgaggaaaattccttgggtgagttggaaaactttgtgtaaaccaaaagcacatagagggttaggtattagagatgtagatgtgttcaatgagtctttgctagctaaggggggaggggctctcgaatcattcaaattggtggagggacttgagaaggtgggaagtggggctataacaaagttttggttagctaggtggatgggtgatgaatgtttggccctcaaatatccgaggttgtttcttacatcatctcaacaaaatgcaaacattaaccaagttagtttggttgttgataatgtatggaaatggaacctccaatggagaaggcaagattttgaatgggatggtcttcaattgagacaactactagatgaattgaacgcccaaaatattcttgggttcacgatttgtatcacaaccagaggaggtattcatagagatgtggaagctgaaagtgctgaagaaagtacaatgctttgggtgaaggcatttcttggatag

SEQ ID NO: 105475 - DNA, 1212 bp, Glycine max
  Peptide Sequence Number=SeqID_222253
atgagaaaatggaaaagatgggaggacgagactcaaacacttgaatatcagatagctaatgatccaagaaggttccagtatataggccaaacattgattggcaagcgtcatttgaaattctggagctatcattctcctttgctttggatggtttgctttattaggcagttctatggctcagtatcaaaagatgattacttcactctacgaaatggtttcattgcagctaatatttctttaggctgcaatttcaacttcaagaaatttctttgtcgcacttatgatgaagattttgagaaggttatgggaatcaggatttggatctggattttctccatacttttcatattttttagcgcacatgagttctataattacttctggcttccatttattccgcttgtggttgctttgcttgctgggacaaaattgcaagtcataataacaaagatgtgtgtggatagttgcaaggaaaagccagtgatcaaaggaagtctacttgtaacacctagtgatgctcatttctggtttcatcaacctgaatggcttctccatttactcaagttcatccttatccagaactcctttcaacttgcattcttcacctggacttggtatgaatttggtccaaggtcttgcttcaatcgaaaaagagaggacattggcattaggattgtcatgggtgtagctgtgcagctattttgtggttatgtgacactgcccctttatgcacttgttactcagatgggttctagcatgaggagagaaattttcactgagaaggtttctagggggctcaaaaactggcacaaaagggctaaacaatctctgtccaaaaaaaactcaatttctaacaaacactcagattctttgcattccaaagaatgtgacaattcagttagagcatcagtggatagtgtgcacaccccagataatgtagtactcacaagccctccttttcacatcacaagtggagaagaagaaaaaggcattgcaccaaccacaaagcaagagatatcgattcactccacaactgaaacaattaaaactactgatgaggaagagaatcccaagatcatcaccagaggaacctatgacggtgagatctcatttgggagcagctggaagaatgtgggaagtagcaggggcattggagaaattggttcaataattgaagatgatgctgaaaaattgcctaagttgattccatag

SEQ ID NO: 105476 - DNA, 270 bp, Glycine max
  Peptide Sequence Number=SeqID_222254
atgaggaccgtcaatacgagtgcggacaaaggaaaggatgagtccttgcttaaaaagggctttttgacctcaaaggcacgcttagtgccattttcgcgcttagcgcgagtaagtggattttggctcagcgagccaggtgcgctaagcactagaagagacaaacttctcgctggacgagctgatgacgcgctgagcgcgtgctggcgtggcagatttccttcaagattcctcttactcgctaagcgaactgctgcctcgcttagcggatga

SEQ ID NO: 105477 - DNA, 192 bp, Glycine max
  Peptide Sequence Number=SeqID_222255
atggtggttcatcgacaagtgacagttgtagcggtggttggtttggccattaactgcggtccgacggaggacaatggcaccacgattgtgggggcgatccctgggggcacaaatgggggcaccaaccacaaccacggaagggtgacgaaaaacaaacaccagccgagggagaagagatgcgcgagttcttga

SEQ ID NO: 105478 - DNA, 171 bp, Glycine max
  Peptide Sequence Number=SeqID_222256
atgcatgaaggaatgcatatgacacagatgcaatctaggaatgcgggggcccgaggaattgtctccttcttagatacaacgtctagaggtagcaaggtgccccaacaggggatcaagacagaacccatatgcgatgcatatgcaaaagacgcaatgcgggaatgtacatag

SEQ ID NO: 105479 - DNA, 582 bp, Glycine max
  Peptide Sequence Number=SeqID_222257
atggttggagcattctcgcaaaacatcgtgaccctgactggtctccctatgatcttacttagtgagagtgacctgacaaacccattgtgtggtgtgtcttgttatgtactcctaagcgccccagggtggtttttcactgacatgggagagaaaacagcagaagaggttggtgaggatgtgattgaagagcttttgaaatttaatctgattgtaccatatggtaacggcaagtgtccccttgtcaacaagtttaaaattaatcctggtatccgtcctgagttcgagaaatatgtgtcaagagataagcaactgcatgctggtggacaagttctgtttttaatatgttggattagttatctgaattttggatccaaatggttgcctgaaaggaaggatttgctagtgcttcaacttggtcgttggcaagatttaccttcacatcacattgaagtagggaatgaagaattcctaaaggagttgagggatcataatcgattgaagtatcttaatcttcgtggaatatcaagaatatatgagctctcaccctccattgcaaaacttgagagcctagaaattccttga

SEQ ID NO: 105480 - DNA, 465 bp, Glycine max
  Peptide Sequence Number=SeqID_222258
gatgaagacggagaagaagaaaatgataatgctgaagaaactaagaaacctgtcacttctattgtggtggcatataagttacttacgccatcagtaaagtatgcaatggagatcatacttgctgaatcaagccttgtcacggaatactattttatttggacaaccagcaacgtatccatttttctcgcatgccttggtcttactgtgcttccagtaaatattgttgttggaaactacatcagcaatatgtttgaagaaaggcaagttctactgacatcagaaatcatggtttgcattggactactcttaagcttccacataatgattccttactctgtgactcaatatgttggatcagcccttatcacatttgtgtctgctgaagttcttgaaggaaacccacttaaaagatcattcaagaacatggaagtgttgcatgaacaaagtccatcaattgttgaatag

SEQ ID NO: 105481 - DNA, 230 bp, Glycine max
  misc_feature (15)..(15): n is a, c, g, or t
  Peptide Sequence Number=SeqID_222259
ttgaaccggttcaancgatagaggtgtcatcctctgaagaggatcttgaagaggatccagaggagttacctcttgaacctgctatggatgcccttgacttacctgtggatgatgaagacccactccctaatgttgattctccagaggatattatgtcagcatctgaggcagactctacagaggagagtggccctagagggacagcgaatagtgacgactcttcatcatag

SEQ ID NO: 105482 - DNA, 831 bp, Glycine max
  Peptide Sequence Number=SeqID_222260
atgctgattggtcaagcagatcacatatcggagtcaagatcattgaaggatcagatacttggctactctgggtctgaattaagtgatgatgaagaggaagattgtttggaacagatactatactcagcatcctttgaagagcttgcaagcaattacgttaaatatgacacggtcatatggcttgctatatcattacttctagttttagcttggggaattggccttcttatgttgctttacctgcccatcaggagatatgtgcttcaaaaggatttgtcttctcgcagattatatgttacatgtaccgaagtagtttacaaggtatcaagaccttcatttataccattttgggggactgtaacaattgagaggcgtgtacctctttctctggtgattgatattatcattgaacaaggttgcctgcagtctatatatggtatccatacttttcgagttgaaagtattgcacatggaaaagctgctcctgtagatgaactacaagttcagggagtttctgatccttttgttttgaggaagatgattgtaacagaggcttcaaagatcacacaagatgtgagtacaagtgggaagcatgctggtccaagcacagatgaggaaaacatcgctcgtatgccaggagcaactgagggatcagttgttttgagatcaccgtcaaaaagtttgaagatggtaggctcgccacatacttcttcacttgagtgcagggtagctggaggactgctgcttaataaacttgaagaagtcaataaatcagtgaagagacttgagttgcttatcgagaagttgcatgcttcttcctccatcaactga

SEQ ID NO: 105483 - DNA, 783 bp, Glycine max
  Peptide Sequence Number=SeqID_222261
atggataagaaagagcatattgcaatttttactactgctagccttccatggttgacaggaactgctgtgaaccctttgtttcgtgctgcgtatcttgccaaaagtggggaaagagatgtcactttggtgatcccttggttatctctgaaagatcaaggactagtatatcccaacaatattaaatttgcttcaccctcagagcacgagaagtatatccgccaatggctagaggagagagttggatttacatgtggtttcagcatacagttttatccaggaaagttttctagagataaaaggagcattcttgctgttggggatatttcggagattatccctgacaaagttgcagatattgctgttctagaggagcccgagcacttgacatggtatcaccatgggaaaagatggaagactaaattcaggctagtaattagattatctgccgccacccaggattacactggctccatcatctgtaatgttcatggagttaatccgaaattccttgagattggcaagaaaaagagggagcaacaacagaagggagagcaggcctttaccaaaggtgcctactttattgggaagatgatatggagcaaaggctacaaggaactactccaacttcttaaagatcatcaaaaggaattatctgctcttgaggttgatttatttggcagtggagaggactcaaatgaagttcaaaaagctgcagaaaagttggaactagcagttagcgttcacccagctcgtgatcatgctgatgctcgatttcatgagtaa

SEQ ID NO: 105484 - DNA, 249 bp, Glycine max
  Peptide Sequence Number=SeqID_222262
atgggaggtggcggcggcgatcacggccatggacacggacacggtgatttcaggaacaaggtctggagtatgagcggtggcccttactgtcgcccaaagcactggaagcgcaacaccgccattgccatgttcggcgttgtcctcatctgcatccccatcgctatgaaatccgctgaactcgagcactttgacccctcccttatctggccaggctctgataggctacaagctcgccctaatttggcctga

SEQ ID NO: 105485 - DNA, 330 bp, Glycine max
  Peptide Sequence Number=SeqID_222263
atgcctaggcaagcgcagggtgatgcacatcaggccgcagacgcaccgccaccacctcggcaggccgatcccactggatcactaggcatggagcgttatctacaacatttggttcgccagcaagcggccaaccactgtgggcagggttctgccccttttgcatgccctactccggagcagtttgaggttgaggtcgcatggcctggagactggcccgaggcccaggcaggggaggagcctgcaggatcccctggtgaggcagatgagtcccatatggatgaagagatgactgacctgctcggtttcttgggagggagcggagccacgtga

SEQ ID NO: 105486 - DNA, 267 bp, Glycine max
  Peptide Sequence Number=SeqID_222264
atggcaggtggtaataggcaaaagaagtcatcttcgggtttcttctctatgttcaacatcttttcatcaaggaagcccagaggagggtactatgatgcccctgattcgtggaggagggtgtggcctagcgatgatgacaaaggtaattggggtgttgctgagcccaatattgatatgaaagctgaagcttttattgccaagtacaagaaacgtgtttcagaatctgcactctatcaacttgatcctgctgctgctgagaatgcataa

SEQ ID NO: 105487 - DNA, 595 bp, Glycine max
  Peptide Sequence Number=SeqID_222265
atgtatctaaacaataacgctgaaaaaattgaagcaatcaaacacctgaatctgggctcaatcaacaagccaactgaaattccaaaatcacttctaataggctgcgaaaaaaatttaagtatttactatgcgccatttgaccacgtaaacaacaaagccaaagtggtgattgttggaatcacgcctggattcactcaacttaaaaacgcttatgcctcattacaaaataacttgcgctcaggtaaaacaattgatgagtcattagccaaagtaaagtctgacgcatctttctcaggcagtatgcggagcaatttgatcgagatgttgaattatgttggcatccacgaatggttaggtattccaagcaccgcacaactattttctacacgctcggacttattgcactcaacctcttgtttgaaaaaccctgtatttgtgggcggtgcaaactacaacggcactcctaacatgctcaagagtaattttctgagagatcacatatatgaaaattttgcgcaggaagcgaaaaacgttaacgatgcgattttcatccctctcgggcctaaaccctctgaagcacttgaacacttggcaa

SEQ ID NO: 105488 - DNA, 198 bp, Glycine max
  Peptide Sequence Number=SeqID_222266
atgccagaggtaaaactaaggtatgctgttgttacttgggcaaacaaagggataggattggagactgtgaaccagttggcctcaagtggagtcaaggtgttgctcacagccagagatgaggacagaggccatgaagccattgagagattgaaagagtgtggtctctctgatttggtgattttcaccagcttgatgtga

SEQ ID NO: 105489 - DNA, 660 bp, Glycine max
  Peptide Sequence Number=SeqID_222267
atgggttgggactcatttgcgccagtgtgccactgccaccagcccaccactaaaaaatttgtacgtgtcaaaaagaatgaggctgtggaaaaaatgtatgccgttgttaccagggcgaacaaagggataggattagagactgttaaagttttggactcaaatgtaatcaaggtggtgctcacagccagatatgaggacaaaggccatgaagccattgagagactgaaagagtgtggtctttctaatttggtgatttatcaccagcttgatgtcactgactctgctagtattgcttcattagttgactttgttaagagccagtttgggaaacttgatatcttggaatcagtgatcagtgatgtcaatctggatgaagtgaacatagcgaacgaatgggcaaaaggggtgcttgatgatgttgaaaatcttacagaagagagaatagccctgaattcttacacaaggtttctagctaagaagcaccctaacatgtgcattaatagtgtgtgccctggttttgtcaaaacagacataaatagaaacactggcatctattccattgaccaaggtgctgctaatgttgtgaaatttgcattgttgcctgatggttccccttctggcctcttctatataggcaagaattgtcagacttctgaatga

SEQ ID NO: 105490 - DNA, 243 bp, Glycine max
  Peptide Sequence Number=SeqID_222268
atgagtggaacagagaaagcaggatcaggaaccacgaaaacccctgccgattttctcaaatccattcgtgggaggccggttgttgtcaagctcaattctggtgttgattacagaggtatacttgcttgtctagatggctatatgaatattgcaatggagcagacagaggaatacgtcaatggacaattgaagaacaagtatggtgacgctttcatccgagggaataatggtactgatgtttga

SEQ ID NO: 105491 - DNA, 264 bp, Glycine max
  Peptide Sequence Number=SeqID_222269
atgggtgaacaagatagtggtgaaggagatgttgaaggtctcaaacaagcagagtggaatcaagccttcactggaaatcagtgcgatgtgttggaaaatgagaaatgtatagtaaaagacgtatcaaatgacattgtcgttaaagatttatgtcgttatggatttatgtctcaagaagatatagatgcatgttcgcaattagaactagacatgcaagtaagcccactcgcgaagcttgcattcagcaaattccacaacccgtaa

SEQ ID NO: 105492 - DNA, 273 bp, Glycine max
  Peptide Sequence Number=SeqID_222270
atgggggaagaagcaaaaaggtatgctgttgtgacaggagcaaataaagggattggttttgggatgtgtaagaaattggcttcaagtgggattgtggtggtgctaacagctagagatgagaagaatggcttcaaagctgttgaaaaattgaaagagtttggtctctcggaccttctggtttttcatcagcttgatgtggatgaccctgctagtgtttctgccttagctgatttcatcaaaaccgaattcgggaaacttgatatcttggtatga

SEQ ID NO: 105493 - DNA, 282 bp, Glycine max
  Peptide Sequence Number=SeqID_222271
atgaacaaagacacggagagaattaccctaactcaaatccaatccacttgggggcaaattcacttaaagcaacaccaagaagaagaagctcacacagtaggttgtggacggcgtcgccgagggatgcagagcttggagaatctcgttgcgatgcgttgcctcgctgcgaaagcgaaggaagaagtagaagccgaagtcggaactccaagtgctgctggctgctgctatgctacgaagctttgctctcgttgtagcggtggcggcaacggactaagcctttaa

SEQ ID NO: 105494 - DNA, 2169 bp, Glycine max
  Peptide Sequence Number=SeqID_222272
atgtcttcaacagcaattgttcttccggaacagagtcttgcggcagagaaggcaggtttggctgtaaacaagaaaggtttgactttaaaagaacttctccagcaaacatctcatcacaatccaaaagttcgtagagatgcattgattggtattaaggatttattcaccagatatccagctgaacagaagttgcacaaatatgctgctgtagaaaaacttcgtgagcgcattggtgatgatgataaagtggttcgaaaatcattatatgatctttttaaagtagtgattttaccttgctgtaaagaggacaatcaagagctgatcgtttctttattgatgccttacatttttaatgcaatgactcatttggtggttgatgttcggatgatggcatttgattttttagacctcattcttgagttttatcctccttccttttcaccatcttatgcagaaaagatttttcagaattatgaggatattctagtgaggaaccagtactatttacaggacaaaggaaaactaaaggatgctcttgctgggctggttcgctgcttgtcactcctgccatggaataaagaagaaactgatttgcacaataaggatgctactggacaaagggtgttgcatgcctttgaagttgatgtgtctatgagctctaatggtttttcttgtatcataaagaatttgaaggatctagtgccagtattaataaatagtttcctggaatttattccattggttcattctatggaaagtcttgaagggaagtcttttggttgtatgatatccattcttcatagcatatatcttatagtcaggtctattgcttatgggactgataaggattcagaatccccaagttctcaaggtggacctgatgcagctgtatgggatgttaacatctcttctgcattcttgaagaaattatttcctcgtttccccctcaacccggttgatcatctttctgaaaaggattgtgataggttgtttgacttgaacatgatcgttgccaaaatattttttgaattaaatgaatggacgagtcttcctcctaatttgttggagacatttctagaattttttgaaaatgctttgcttgggaagttctgcagggctacacagtctggtaaggctgtctgggaagagtgtttagttcagctcctttcatttattcctaaatttctttcacgtggggcaagctcttggacatcacgtcttcttcaggcttttacccagacatttagggaaagcaagccaggttccttgctgaaattggcctgtgtttctgctattgaagatatgctaactcctattgaaagcatgctttccatagagacaagcaatccagaaaatttagaacttcaagatgctttactcgcatggattagagagctccctctgttgcttatccagcttggagataaacacccaacctgctcccaggttgtgttacgccttcaacttcgtattggacaatgctctttgttgaattcatcacttgtttgtatgtatgacaacacacagtactcattgctagatttttattgtacatgtcaaggaggacagatatgttatggtccttttctcaggcttcctagagaatctcaagagctctctttatgttccctttactatttctcttatttggacctgcctattttaaagtcaatagcttgttgttgcctaagtgcagatctagatccctatgtgttatttaggatcatagaggttctccattcagcctatagagatggacatataaaaattgcagattacttgagtgttttcatcaccttggtcttgcgtttcaaagtttcccctgaaatcggttctgctggttttaagagtgatccactctgccaaactttgaagtcaatgacaactgttctttgctcatacatggcacagatgggtgacaattctcttgttctgcagatagtagagaaagtgataattgatcagataccacaaaagccttctttggataatagttgctctctcctgagaatgcttgttacagtggattccaagcccacaagactttctgaacaaagcattatcattctaggccagcatctttctgaatatctgatggatgctgtgcagagatatcaacatcacccttttaaccgaagtgagaattctttcagaaaaatgtcgacttga

SEQ ID NO: 105495 - DNA, 558 bp, Glycine max
  Peptide Sequence Number=SeqID_222273
atgactagttgtgaattgccctcttttcagagcttgaagtcattccttggtgaagaaaagctcaaggagtttattaactttacacttcattatattgctgatttggacatccccattaagaggggaacatttatggagttccgtagtgggatgctgaatgtgtcacctattggccgaaactgtagccaagaagaaagagatgagtttgagaaatatgacaaggtgtataactttaccctaaaagtttgcaatttaagttctcaggttcacaacatacgcccaaaaatggtttctgtacttcgtgagaagtttgctcatcttaacttgacattctccattggaggacagataagttttgatgttttccctcaaggttgggacaaaacatactgcctgagataccttgatggtttcaatgaaattcacttctttggtgacaaaacttacaagggtggaaatgaccatgaaatctacgaatctgaaaggactattgggcacacagttacaagccctgatgatacagtgaagcagtgtaaatctctgttcctagaaaattaa

SEQ ID NO: 105496 - DNA, 216 bp, Glycine max
  Peptide Sequence Number=SeqID_222274
atgtttgtattcaacggtgctttgaaaggacttgacgatactccacaaagtaaatccaaggttgttgttgctaggtggattgttgttaaaatgtcaactataatcctaggaagcttcaagaataattgggaaacggttttggaacaaaatgacgattggtattctaccttgcatttggtctttggagtagactttgttgccacaacactcgcttag

SEQ ID NO: 105497 - DNA, 501 bp, Glycine max
  Peptide Sequence Number=SeqID_222275
atgccagagctgcaatcgaagcccgaaactgccctagctccggctccggttgcggctgaggtgccatctaacgacgctgttgcaaagaaagcttctgaaacagaggaatccaaggctactgttgttgcatcagagaatatcgctctggcagaagtagagaaagagaaaaagctgtcctatgtgaaggcatgggaagaaagtgaaaaggccaaagcagagaacagagctcaaaaacaactctcagctattgctgcttgggaaaacagcaagaaggcaactcttgaagctgagctgaaaaaaattgaggagcaactggagaaaaagaaagcagaacatggtgaaagaatgaagaacaaggtggccttagttcacaaggaagcaggggagaagagggcaatgatcgaagccaatcgttgtgaagaggttctcaagacagaggaagtggcggcaaaataccgagcaacaggaaccactccaaagaagaccatagggtgcttttga

SEQ ID NO: 105498 - DNA, 660 bp, Glycine max
  Peptide Sequence Number=SeqID_222276
atgtcattcacaggaactacagataaatgcaaggcttgtgataagactgtttatgtggttgacatgttaactcttgaaggtataccttaccataaaaactgcttcagatgcagtcactgcaaggggtgccttacgatgagcacctactcctcaatggatggtgtcctctattgcaagccacactttgaacaacttttcaaggaatctggcaatttcagcaagaactttcaaacagcaaagtcttctgataaacaaaatgagacgcataagacccccaacagactctcatccatgttcagtggaactctagacaaatgctcagtttgttcaaaaacagtctatcctctggaaaagatgacacttgaaggggaatgctatcacaagaattgcttcagatgtgctcatgcaggttgccacctcacacattcctcctatgctgccctggatggtgtcctctactgcaggcatcatttccaacaacttttcatggagaaagggaactaccatcatgtactccaatctgctaaccacaagaagaatgccacacaatctcctgctgaacctgctgaacctgcagctgaaggagaagaagagcctccaaagccagaagaatctgattctgagaaacacacagaagaaaagcctcaaaatgaagcatag

SEQ ID NO: 105499 - DNA, 1644 bp, Glycine max
  Peptide Sequence Number=SeqID_222277
atggcggcaccgggcaccgaggaagctgttagttgtgttagcaacagcacacactcagcgatggaaaacgacgacgagcacaagctccataatcacacggaacaagtacaagaacaagaacaagaagaaaatgaagaagaagaagaggtttggagttcttcggattctgaaatcggtgaagcgttggactggttggattcgaaggaggaagctgaaggctcctccttttccctcactttgtggcgccccaacgctcacggcggtcaccaccaccattcctccactctccaacctctcgccaatcgcaaccagaagttctcccatcacattcgtgcttcacccttggaggaatgggaagggaggatgaatgttggcatgtctaattctgtgaccacagcaattcgtggaagtgttcgagacatggccattgggaagactaaaactactgagaaagcagaccgggctactgttgagcaggcaattgatcctagaactcgcatggttttatttaagatgctgaacagaggtgtctttcatgatatcaatggatgcatttcaactggaaaggaagcaaatgtttatcatgcaactaaatctgatactcaagaacttgcaattaaagtatacaaaacatctgttctggtatttaaggatagagatagatatgtgcaaggagacttccggtttcgaaatggatactgcaagcataatcccaggaaaatggtaaaaacatgggctgagaaagaaatgagaaatcttatgaggcttaaggcagcaggaattaggtgtcctacgccatatcttctgaggctacatgttctggttatggaatttataggaaaatctggttgggctgcgcctcgtcttaaagatgcagctttatctttagacaagttgcgggaaggctatgttgagggtcacttgtatatcattgatgtttctcaagctgttgatcctgaacatcctcatgcccttgattttctgcgtgaagattgtgttcatgtatctgacttctttaaaaagcatggtgtagcagtcatgacaataagagaattgtttgaatttattgtcgatgcatccattactgatgatgccgtggatagttacctagaagaggtgcaacaaaaaattttggcgagagatgtgtctgctgaggatgagattgcagactctgtatttgtgcagtcctatattccgaagacactagaggatgtgaagaatgctgaggaggatgtacaacggataacaagtgggaaggacaccaaagatttatactatcagaccattactggacttaaacatgctctgtcattaacacagacttcacagcaaaaaacccaacagcagaaatcaagtcccacaaaggattcaccggttatttctgatgataaatctaacctcttagaggatgatgccgagggtcaatctggcaaggatgaagacgatgaaagtgattctgaagaggattcatgctcagaaagtgaagtagaggatcctgcggatataaaagctgctagaaaagaggctaggaaagagaataagaagaaggtgaaggaggagaaaagagaagcacgtaaaactaaagttcctaaggctgttaagaaaagaaagaaaaagttggctaaagcgaaaaagaccagatag

SEQ ID NO: 105500 - DNA, 450 bp, Glycine max
  Peptide Sequence Number=SeqID_222278
atgactctttcatcatggcagaacaagctaaacaagtattttatgttcaagacccttgtgatgaaaggtgataagtggttctacacggaaaaacaattggtgttaatgttgaagattatgattcatacattgatacttatgaaaatggctacaccacccagctctcctcctcctcctcctcctactgcaacatcacaatcgccatctacctcgaagtggacaagaaaagacacacggctaagatcattggcgactagaccagttggggcaaagagacatgtggtggatgtgacatacgagaattggaaacaagtcccaactgctcagaaggatttaatatgggaggatattcaggcggaatttgatatccctgaagcatctgatctgaagacgaaaaagaaaatacttcagactgtggggagcggtggagacaatttaagtttgatttga

SEQ ID NO: 105501 - DNA, 246 bp, Glycine max
  Peptide Sequence Number=SeqID_222279
atgaaagaaacaagtaacactggattgcaggctctacgggtggttaatgtaatttcttttcaggttaaggcaagcagtgtcattagtgaagccgatcaagttcagaaagggattgttgacttggttactgtgcataatatcagcaagcttgttattggagcaataccagaaaacataagctcggagacccttatcattttgttgcttgcatcatcattgatgatattcattgttggagactactga

SEQ ID NO: 105502 - DNA, 240 bp, Glycine max
  Peptide Sequence Number=SeqID_222280
atgaaaaattttccttccttctttttcaaaacaaaacacccaaataaaatgatagagattaaggaaggtcctcaagaagagatgaaagatgcacgtaagaagaaggatcccttaattggctcaaaggacttgagaaaggaagaactcaaagagacaactatggttgggttagaaataccaatgagagcaagaataaaagagacaaaagaaaaatttagagattatcaacatattatatag

SEQ ID NO: 105503 - DNA, 783 bp, Glycine max
  Peptide Sequence Number=SeqID_222281
atgaccaaacatcaaagatcaacaaagcgtgatctatcttactgggagtatgttgatgcattacattctgtgcaaaatagtaattttttagtcaaacatagtgcatcatcatctgaccaaggaattccaagaaggacaatgccgatgttggatcaatttcatctgtgcattcatgattccattgaaaacattgttgatatcaaagctgacggtaactgtggatatcgtgcaattgatgccttattagatatgggtgaagattcatggtctttggttacgatggataagtggatgaatataaccgacatgggatatgtcattgcatcaagagcacatgcaaatcgcaggagggaatggcgcgttccttctcgacgcgccacctggcagtggtgtcgccatcttcaatggcattttgcaggagcttggactcgccagtcaaactggcgagttgagggtgcagagttcctagggtgcaggcagcagaggttgtttccaagggggttgcagtctgcaacgctgcaggaagtcgccagcttcaatggcgttttggttggccaaaagcgccagcaccagcagcgatttgcgttgcctgagttgcttaaatcccccctccccgtagaccattcacgcgagaaaaaaaaaagaaaagagaagcttattggtgctgtgtttgagcaaaaacgaagaaggagtgttgctgtggtgtttgtgtttgagcaaaaacgaagaaggagtgttgctgtggtgtttgtgtttgagcaaacttcttcatttttttattaa

SEQ ID NO: 105504 - DNA, 561 bp, Glycine max
  Peptide Sequence Number=SeqID_222282
atgtctggttcagctgggatgggattcactcctcatatcatcaacattgcaagtggagaaggacctagagttgtatgcattttgtcagccaatggtgctgtctctactgtcacacttcgtcagccatcaacttcaggcggcactgtcacatacgaggggcgcttcgagatagtgtgtctgtcaggctcttacttggtcactgaaaatggtggctcacgcactcgaactggtggatcgagtgtgtcccttgctagtcctgatggtcgtgtcattggcggcggagttggtggagtgcttattgcatcaagccctgttcaggtggtagttgggagctttctatggggaggatcaaagacaaagaacaagaaaaaggaatcctcagaaggtgcagaagttgctgtggagtcagatcatcagggagttcataatccagtttcactgaatagcatctcacaaaatcaaaaccttcctccaactcccccatctctaagtccttggtcaacatcacgtccgttggacatgcgtaattcccatgtggacattgatttaatgcgtgggtga

SEQ ID NO: 105505 - DNA, 2994 bp, Glycine max
  Peptide Sequence Number=SeqID_222283
atgtcgaattttctaaatggaaccacttccttgtggttcttcctatttatgctagcattgttcaccaccatagctaatcttttattatcaaaattgaataccaaaagtaatttagcaaaaaaaaactcacccccttctcctccaaagcttccaataataggaaatttgtaccaatttggcaccctcacacaccgcactctccaatccttggctcaaacctatggccctttaatgctacttcactttggaaaggttccagttcttgttatctcaaacgccgaagcggcgcgtgaggttctgaaaacacaagaccacgttttctccaacagaccaaagcttaagatgtatgagattttcttgtatggtttcagaggtgttgcatctgctccatatggaccctattggaggcaagtgaagagtatctctgtcttgcatcttctgagtcccaaaaaggttcaatcttttcgtgaagtgagggaagaggaacttgtggcaatgatagagaaagttaggctaagttgttgttcttctgcctccttaatgaaagtactgaacttgaccaatttgttgactcaagttactaatgatatagtgtgtaggtgtgttattggaaggagatgtgatgagagtgaggttagggggccaataagcgagatggaagagttgttgggggcttcagttttgggggactatataccttggcttcattggttgggaagagttaatggggtctatggtagagcagagagagtggctaaaaagcttgatgaattttatgatcgagttgttgaggagcatgttagtaagagaggccgtgatgataagcattatgtgaatgattttgtggacattttgctgtccattcaggccacagatttccagaatgatcaaacattcgtgaagagtttgatcatggatatgttagctgcaggaaccgataccatccttgcagtcatagagtgggctatgacagaactcttgagacacccaaatgcgatgcaaaaactacaagatgaggtgagaagcgtggtggccaccggggaagaggaccgaactcacataaccgaagacgatttgaatgacatgccatacttaaaagcagtcatcaaagaaactctgagattacatcctgcaactcccgtattgattccaagggaatcaatgcaagacaccaaagtgatgggttatgacattgcagctggcacacaagtactagttaacgcgtgggcgatttcggtggatccttcatattgggatcagcctctggagtttcaaccagagagacacttgaacagttcaattgatatcaaaggacatgattttcaatttatcccttttggagctggaaggagggggtgtcctggaatagcatttgccatgcttctgaatgagttggtccttgcaaacattgtgcaccaatttgattgggcagttcctggtggacttttgggggaaaaggcattggatttgtctgaaactactggattgtctttgacgtgggagttaaacaagataaaggaagtgttcatgagagtgaagaagaacgaagatgaactgcttgacacgctaacagagatcgatggccatcttcgaaagttggacaggaagatgttggatgaagacatggatggcatttgcaaaagaataagagattgtgctcacaagttgctcccaatggatgcctttgatgactcattacatccatcttcatcttcagtccaacacaagaatcacttgttggatcaagacctatatctgcttcagaaaaggtatcgcgagctaaaatatcatccaccgagtctttgtttgatgtatcttgtaattttccccaaagatgctgttctaaagaaaagttacacaatttatcggtggattggagacggttatattggaaaaacaaaagagaaaacggcagaggaagtgggtgaggaagtgattgatgagcttttgaagttaaatatgatagtaccctatggtaataccaagtgtccccttgtccataaatttcaaattcatcctcacatccatcctctcttggagtcatcattctcaccatacaaaaaaaatgcacatcatcttgggtattatcttgggttgactcggttagtacttgagaaacaaaaagtcatgctaggtgatggggttgcgtgtgtctttaaaaatgcttcaatgcaacttggtcgttggcaagattcaccttcacatcacattgaagtggggagtcaagaattcttaaaggagttgagggatcaagaatttttgttgtatcttagtcttcgtggaatatcaagaatatctgagcttccaccctccattactcaacttaggaacctacaaattcttgatctcaaagcttgccacaatttagaaacattgcccaatgatatttcatcaatggaacgtctcacacgtctcattctatcccaatgttacttgttagacgacatgccaaaggggattgagacactcactaatctccgagtgctcaagggatttgtaataggtaaccccaaaaagactccctgcacaatatcagatcttgcaaatttgaaagaactaaggcgactcagcatacatataggaattgaggctgtcatcaaagatggagagtttgaaagcttggaagagttgtcagcacttaagcatctcaaaatatcatggggtatgtcaaggtacagtgatattaagatcattttgccttcaagcttgaaaaagttgcatcttgaaggttttcctggacaaaacattccagaatggctcatgcctgacaagctagccaggggattcaaacagctaaaaataatcggaggaaaactccaaagtatgaatcatgacaatgatgtcaataagtggggtatagagattctgcatctcaagtacctaaagcatttgaaagttgacttaacaaatttgcaacagttatttcctttgctgaaatatgcagaaataaaacaagtctcaaaccattcatacattgaatggagtgctgattga

SEQ ID NO: 105506 - DNA, 687 bp, Glycine max
  Peptide Sequence Number=SeqID_222284
atgtacctgatcaagaggcctctatatatacaaattaaatctccatatccaagcatcaaacacttaaacttaaccatctccatacaacaaagagaagaaacaaggaagttcagggacaaaatgaagaggttttggtcaaatgcatccatcattttattagccactctcatcttatcaagttgtttttactccgaagctcaaaagtgccaccccagtggaagaattagaggaaagaaagcccctccaggacaatgcaaccaagagaatgattctgactgttgcaaagaaggcaaaatgtacacaacatatgaatgttcaccaccaatgtctagccacaccaaggcctacctcactcttaacagttttgagaagggtggagatggtggtggtccttcagaatgcgacaaccagtaccattccgatgacacaccggtcgtggcactgtccactggatggttcgaccacaagagaaggtgcctccacaacatcacaattagtggcaatggtagaagtgtggtggccatggtggttgatcaatgtgactcaagaaagggatgtgatgcagatcatgactatcaacctccatgtcccaacaacattgttgatgcatcaagggctgtttggaaagccttaggagtgcccaaaaatgattggggtgggtttgatattacctggtctgatgcttga

SEQ ID NO: 105507 - DNA, 1044 bp, Glycine max
  Peptide Sequence Number=SeqID_222285
atgacttatacctgcccaaaggattattaccctacaaagtttgcgcaagatcaagattcatcaacagcatcaacatgtccagagtacttcaaatggatccatgaagatctaaaaccatggaagagaacaggaatcactagggaaatgatggagaggggaagaaatgtttcatactttaggcttgtgattatacaaggaaaagcttatgcaaaaaagtatgcggattcgtatgagacaagggatgtgttcacagtatggggaattctacaacttctaaggttgtatcctggagatatacctgatttggagctattattagagaccggggacaagcctatggtggataaagaacaatcccaaggaccaccaccacctatttttcattattgcgggcataaaaatgcttatgacattgtttttcctgattggatcttccggggttgggctgatcttgcaataaagctagatgaaagcaacaagaagatcaaatggaaggataggttaccctatgctatttggaagggaaaaacatgggtgtcccacaaaaggaatgatctcacaaagtgcaacgcttcagaccaacatgattcgtacgctcaaatacatcctctgcactgggataaggaaattgcacaagggttccagaacacaaagctagatgaccagtgtatacaaaggtacaagatttatgtggaagggatagcatggtctgtgattgagaattatatattagcatatgactccatgaccttgttcatagagcctatatattatgatttctttacaagaagcttagtacctaggaagcagtactattggccaatcagtagtaagaaccaaagcatgtgcaatgatattaagtatgttgttgaatggggtagtgccaatccagacaaggctaaagcgattggaaaagcagggacaaatttcattaaagagaacctaaagatgaaatttgtgtatgattacatgttttatctattgactgaatatgcaaggctcttgacatttgaaccaaccatacccgtgggagtcaccaggtga

SEQ ID NO: 105508 - DNA, 195 bp, Glycine max
  Peptide Sequence Number=SeqID_222286
atggacactgttaagatttctcatgggattgggaatatggccaaactaatccttatacaactagggcaatcctctcacactgaactcgcgtttgagattaagatgacaagttctgcagaacatcatgctatagagttcagttttgggatgaagggaatgcatcaagatctcatatcagctaggaatatggcctaa

SEQ ID NO: 105509 - DNA, 567 bp, Glycine max
  Peptide Sequence Number=SeqID_222287
atgaagaggtttatctcaaatgcatccttcattttattagccactctcatcttatcaagttgttcttactccgaacctcaaaagtgtcgcccaagtggaagaattagaggaaagaaggcccctccaggacaatgcaaccaagagaatgattctgactgttgcgaagaaggcaaaatgtacacaacatatgaatgttcgccaccaatgtctagccacaccaaggcctacctcactcttaacagttttgagaagggtggagatggtggtggtccttcagaatgcgacaaccagtaccattccgatgacacaccggtcgtggcactgtccactggatggttcgaccacaagagaaggtgcctccacaacatcacaattagtggcaatggtagaagtgtggtggccatggtggttgatcaatgtgattcaagaaagggatgtgatgcagatcatgactatcaacctccatgtcccaacaacattgttgatgcatcaatggctgtttggaaagccttaggagtgcccaaaaatgaatggggtgggtttgatattacctggtctgatgcttga

SEQ ID NO: 105510 - DNA, 2973 bp, Glycine max
  Peptide Sequence Number=SeqID_222288
atgaacaatctcaagctaggagtagaggttgtgagtgctcatgaccttgtgcccaaagatgggcaaggatcatctagtacttatgtggaactccactttgatggccagagatttcggacaactactaaagacaaagatttgagtcctttttggaatgagagcttttacttcaccatcactgatccaagcaagttacctagcctcactcttgaagcctgtatctaccactacaacaaaggcaattgctccaaagtactccttgggaaggtccggctcactggaacctcctttgttccgtattctgatgctgttcttttgcactaccctctggaaaagaaaaatattttttcgcgctccaaaggagagattggtttgaaggtttttgtcacagatgacccttctttaagatcctcaaaccctattcctgctgtggaatcctttttcaatacagaccaaaatgaaaatctaacacaagaccaaacaccaccaccggtatcatttacagactcaatcctcaacagcgtctctagaaagaaaaccgagacaaggcacacgtttcataacattgcaaaatcaagtagtgaacaaaaacagcagtctaagcctgcagcagatgccaaccctagtgtaacatttgggattcatgagatgaaatcatcacaggctcctccaaaagttgttcaagcatttgcaggtccacaagagttttcggtgaaagaaacaagccctactcttggagggggaaaagttgttgggggaagggttattcgcgggagcatgccggccacatccagcagctatgaccttgttgaatcaatgaagtatatttttgtaagagttgtaaaagcgcgcgaccttccttcgatggatatgacaggtagccttgacccctatgtggaggtaaaggttggaaacttcaaaggaactaccaaccactttgagaaaaaccaaaaccctgaatggaacaaggtgtttgcctttgccaaggacaatcagcaatcatttattcttcaagttacggttaaagacaaggacaagatatcagatgatgttgttggaactgtgacgttttctgatctgcatgatatccctgaacgtattccacctgatagtccattggctcctcagtggtataggattgagaacaagaatggagaaaagagaggggagttgatgcttgctgtttggagaggcacacaagctgatgaggcttttcaagatgcttggcattctgatgcagtagtctcccctgatggaagcactatatctaactatgctcagattcgatcgaaagtttacatgtctccgagattatggtatgtacgcgtcaaagtgatcgaggcacaggacttagtttcatctgacaagtctaaagttccagacgtctatgttaaggtacacattggcaaccagattataaagacgaagccattaagggacatgaacccgcagtggaatcatgaggcgttgtttgtcgccgctgaaccttttgaagagcctttggtcttcacagttgaagaacgcagtgccaacaaggatgagactattggcaattccatgtcatctgctatggaggaccaagcgaaaaagaaagagaaagagaaggagaaggacaagttctatagcagaatccgtgtcattgcctttcttgatggtggataccatgtgctagatgagtcaacttattacagtagtgatctaaggccaaccacaaggcaattatggaagaagccaattggtgtgttagaacttggcattttgaatgctgatgtattgccaattccaaccaaaaatagggatggaaggggaacagcagatacatactgtgtggcaaagtatgcccacaagtgggtgcgcactagaaccattgttaacaatctaaacccaaagttccatgaacagtacacttgggaagttcatgacacagctacagttctcaccttgggggtatttgataatgcacagattactaattcttcaaatggtaacaaagattccaagattggaaaggttcggataaggatctcaacgctagaagctggtcgtgtttacacccactcttatccattgttatcagtgcaaaactctggcctcaagaagaacggggaagtgcacttggccatacggttctcatgcacctcaatggctaacatgatggctttgtatttaaaaccccatttgccaaagatgcactacacaaagccccttaacatcatggaccaggaaaggctgagacttcaggctgtgctcattgttgcatctagactaggcagggcagaaccccctcttaggaaagaagtggttgagtacatgtctgactcagaatctcatttgtggagcatgcggcgcagcaaggccaacttcaaccgtttgaaggaggtgttttccgggctacttgcatttggaacttggtttggacaaattgcaacatggaagaacccttttgtgacagtgctgctgcacattctctacttaatgcttgtgtgttttcctgaacttattctaccaaccgtgttcctatacatgtttgtaatagggatgtggaaatggaggttccgcccgagataccctcctcacatggatgctagtctctcttgtgcatatgtaaccagccctgaggactttgatgaggaaatggacacttttccaaccacaaagagctttgatatcgttcgttggaggtatgataggttgagaagtctggcagggaaggttcagagtgttgttggacagatagcaactcaaggagaaagaatccatgctcttataaattggagggatccacgtgccacttcgatattcatggtgttttgccttgtgactgctatagttttgtatgtgacaccaccacagatgttgtttattctatctggattttacctaatgaggcaccctatgcttcggggtaagacgccaggagcaccgatcaatttcttccgcaggttgcctgctctcacagatagcatgctgtaa

SEQ ID NO: 105511 - DNA, 471 bp, Glycine max
  Peptide Sequence Number=SeqID_222289
atggacttctcaacaaatctaggctctagcttgcaaaaactcaggacatggaggttcttatcttggattgaaacagaagcttcagaagctagacactgtcaacagataccaaaaggggagtcaccaaacaaggaattggtagagaaagcagttgaagtcaagaaagaggtggaagaggtgttgaaatcagctaacttgaagattgttggagtaatggagagaagtgtgatcatgaatgaaattgatagagtggtaaatgaggaagatcttaagggcaaaatcaaggagttggagagtgagatagctcaaggctcaaattctgaggatatgggaaaagatggaggtgttaaaagagagtattcttgctgcattgttgtctcaacactgaaggaaaagattgagagactaagggaagatttggaatcctcatccaaggatgtttatgtaaagcaattaagtgttcagtcttga

SEQ ID NO: 105512 - DNA, 848 bp, Glycine max
  Peptide Sequence Number=SeqID_222290
gtcgtgggcatgggggtgggcgtatatcggccaatttctcttcctgcaaacatgctagccctgctgcttgcactaatgtgagtggttgtaaagcctggacttcacggcgtatctccggcgagagtcccgagatgaaacaactgagaatgaagggaggaggaagcccgataatacgattcgccaaatcctcaaactccgacagaggtgaactgagcattgctggtcatccattggaaccacgcaagtgctcgtccctccatataaaacgaagcaattgtgagacgatcgcgttccggggtgccgtgatattcaaagtagaggttggattggggttggctgagggtttggggaagaagagcttggggataggtatcgtgagaatgggagtctggcatggtgacaaggacaacgagagcaccaaaattgttaggactctagtatcaagagctagagttcgaggtctagcacctccagaaataagggagaaacagagcacgaagaaggagaaagaagcttcaggatcacaattccaagcaaggcgatttgggaaggatttgcagaagcttttgttttggcagttttcttcaaacgaagtcgtgaagtcttctcaacctcctcaacaacattggtgttggtcccaccacttaactggtcctttctcaaccattgtcgttgttgttgatgatgatgatgttgttgtcgttgctgctgatggtggtggtggtgatggttatgttgatatggttgcagatgatgtcgatgttgaaccatatgcctctgcacatattgttgtggccttggttgaaacccacgattcgagttcaaccctcgccctaaacccatcctag

SEQ ID NO: 105513 - DNA, 1140 bp, Glycine max
  Peptide Sequence Number=SeqID_222291
atggaagtacttccttgttctggtgttcagtatgctgggggatctgattgctctcagtcaagttcaggaacaatgtttgtaaaccagggagaaagtggtggtcaggctaagttggaagatgatcgactgaatgactcattacaaacggaagggcctcagatagaaagacaaggccaaacacaacagaatatttgtgaacccttgattaatatagcttgccaatgtggtggagcttcatgttgtgactgccaagtggaaggccagaaggaatccattagtttccgtgatgttgaagatgatggaataaatgagccttgcttagcctttgaaaacttagtctctattgcagatacaaatgaaagtgaatcaccaaatggtagtagggaagtagagctgtcattttctgaaccaacttggctgaagggagatgagcctgtggcattgtgggtcaagtggagagggagctggcaggctggtatcaaatgtgcaaaggttgactggccattatcaactttaaaagcaaaaccaactcatgaccggaagaaatattttgttatattttttcctcacacaaggaattattcttgggctgatatgctgcttgttcgatctatttatgagtttccccagcctattgcatacaaaactcatcaagccggattgaaaatggtaaaagatttgactgttgcacggcggtttataatgcaaaagctaaccattggtgtactgagcattgttgatcagcttcatcctaatgccttgctagaaactgctcgtgatgtgatggtttggaaggagtttgctatggagacttctcgttgtaacagttattcagattttggcagaatgcttctagagttacaaaatgaagttccatgtcgcctgcgtcaattctttgggtgcaatactgttgggcaacttcacttagtgccaattggttttaagttgaaatctaacatggtatcagagcctataggggaggtgttaggaagtcctgcatcaactgcctcaattctcaggagcatagtgaagcactacacagatgctgactggatacaacattcatcttactcttgggctgaacgatgccagaatgcaaatagtgctgaatcagtagagctactgaaggagtactcataa

SEQ ID NO: 105514 - DNA, 297 bp, Glycine max
  Peptide Sequence Number=SeqID_222292
atggggcgacaacagacgtgtcttgttgaggatcctcctaccgctgtggaggaattaaacgaagaggagcaacaaccacctgttgaagaaggtgttactgatgttgagagtttttcaggcagaccccatgacacatcaattttgagagattttgaaaatcacatgagaatctgggatggagaggaacatcctgagctaaagctatcttcccatggaaggaagatggctaagtttggcaggtctactctagagattgaaggccttgtggctgccagtggacgatcacgtgttccctag

SEQ ID NO: 105515 - DNA, 852 bp, Glycine max
  Peptide Sequence Number=SeqID_222293
atggtcctgtttggaataggccaaataggttgcagcccaaatgaattggccaaaaacagcccatatgttagttcagaaattgacatagcatttgccagggattcaaccattttaactccagaacctctagttgattatcctgccccatatgaaattcctcctactgattcagctgaaccaccttcactagataatagcccttctgatggcttagctgaatacattgagttatattcaacgctattagaatatttcgatctacctcgttatggagcagtgactaatgggaggacagattctagctctgctctaaggactacccttaatagcataattgataggagagggggtaaaggctatggaattgatgtaattgtaatagctatcaaatgctatcccttagaagtaaaatctcataattgttacatgttagaaaaataccagaacaacaacccaatactacagagaggtccaaaagaaagaccatacacccaagttacttgcaagattacgagacttgaagcaacaccaaggttgcatggaatgagaaatacagagaagtttaatccaagttcttatcttaggaggaaccttgtcctcaaaacaaagtgtttaagtgccctctgcccttatcattacagctatcaaaagttgaagacaaaaattacagaatcaatagtgccaaagagagcaacctacgaaacaacgaactcaccagcccgcaaacccaccaactcaggaactcgcgaacccaccaactcacgaactcaagaacccaccaaccaggagccaagactatgtctaaaacctacaaaacaacgaactcaccaacccgaagttaacattctatag

SEQ ID NO: 105516 - DNA, 144 bp, Glycine max
  Peptide Sequence Number=SeqID_222294
atggaacatgcaaggcccgagaaatggtgtgaggcaaggtgtcgcgcgcccagcttgttggggtggggtgctgtttgggtcgcctcaaaggggcttaggatggtgatcggaattgttgatgttgagccagcacggaaaatatga

SEQ ID NO: 105517 - DNA, 426 bp, Glycine max
  Peptide Sequence Number=SeqID_222295
atggaggaggcataccaacgacacttgactgtgacagcaacggtggtgcttaacctgggcttcgcttactttgatttaactcaatctacaaacctgatgagccaagatacattattggagcctcctctctctctctcatttcttcctctactcaaactgggtgtcggaacctcatcgttgggtgctaccacgagtgcgggagttttcagtgcgagaacaggtggagagctcaccggaataggaccaagtggagaactcatcggaactggcgctggcggcaaactcactagagtcacgataggaggtgtggctgtcggtggtctagccgcaggaggagtggttgcgggaggtgtagccaccggagctggagcggcagctttagacggaggagatgctaccgtgggagatgaagcgggtggggttgca

SEQ ID NO: 105518 - DNA, 546 bp, Glycine max
  Peptide Sequence Number=SeqID_222296
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggggaagattttggctgttggtaatggatttgacaaagaggataagccatcaaaggttgaaggtggggcaaaaaatcaaactgaaaaagaaattattctgcctcctccacctcccataaagaaaaatcctcttcattcaatagagaaacaaggcccagctgttgctagagcagaagatgatgacatttttgttggtgaaggggttgactatgatatacctggtaaagacttgagccaaagtcctgtctctgaggacatggaagagtctcctaggaacaaagaaaaaccttcatatttcacagaacctacttatggtcctgtccaaccttcaatggttcctcaagggtggcaagaaacagtgaatatgattagaaaaagattccttactcctgtttcatccttaagttaa

SEQ ID NO: 105519 - DNA, 336 bp, Glycine max
  Peptide Sequence Number=SeqID_222297
atggataagagcttgaaggtaagagaagatgagtggagggagagggagagagggggaacgaaatttatgcctcaaatgagcataagtgttgtcccaacctacccttcggcgggatggcaacgcgaggctcaagggtgcgtcttccaaggagggaaaacgtgcagagtcaccaccaatgtttattcgaggaaagcgtcgaaaaaaaaatcaaaagcaggtctacgaactttaagaataaaaggttcagcagttgtttttacgcatagggaaggtattagcaccccatgcgtccgtcacaagggacgacagcctttaattaaaagtgcaaaatcatga

SEQ ID NO: 105520 - DNA, 714 bp, Glycine max
  Peptide Sequence Number=SeqID_222298
atgagtaacgtaaaagtaacggccccgcaggccaccgaacagagttctttcttcggcaatctgcgccataaactgccgaaagacaccggcatctttgtcgtgatgttaggcattgcgctgatttttgaaatagccggctggtacgtgcgtgaccagtcatttttgctcaacaccaaccgtttagtgctgattgtgctgcaggtagcgatcatcggtattatcgccgtcggcgtcacccaggtcattattactaccggtatcgacctgtcgtccggttcggttatcgccctgacggcggtggttgccgccagcctggcgcagacgtctgacagcctgtcgccgatgtatccgtcactggtcaatctgcccgccgccatcccgatcgtcgccggcatcggcgtcggcctgctgtgcggcgtggtcaacggtgtgctcatcaccaaaaccggcattccgccgtttatcgccacgctcggtatgatggtgtcggcgcgcggtctggcacaatattatacccagggcaacccgatcagcttcctgtcggacggtttcacctccatcggtcagggcgcgatgccggtgattatcttcctggtggtcgccttcctgttccacatcgcactcaaacacacccgctacggcaaatatgtctatgcgattggcggcaacatgacctccgccaaagtatcgggcatcaacgttaataatacctga

SEQ ID NO: 105521 - DNA, 1779 bp, Glycine max
  Peptide Sequence Number=SeqID_222299
atgacctctgatgggttgttccaagtaagccttcaggttggtagaaaaaggcccaaacttgaagttcgccgtgcagatacgcatgctacactggtggaaacaaatggttcagatcagccaattactctcaaaactgacccaggtttctataggaatcaggacacattgaatacattagaatctgagacctctacactcaaagatattaaagaggtacctgtggcaactgatttacctagcaatttgaccaataaatggaatgaaattgtagttgaggctaccgattctgagatcttgcatggcaatggaacacaatcaacacctatgaatgagatggctggtaaaaaagttgtagaacctggtgctaagaatcgacaatgcatagcttatgttgaagccaagggaagacaatgtgtgagattggcaaataatggtgaggtatactgttgtgcgcatttgtcatctcaatttttgggaaactcagggaaagctgaaaaacctgtttcagttgatactccaatgtgtggaggtacaactgttcttggtactaaatgtaagcatcatgcccttcctggctcttcattctgtaagaaacatcgtccccatgctgaaacaaatgagatctcaaatttaacccataatacgctgaagagaaaacataaagaaaatcacattggttcagggggcttgatcagcaaaggcatggtattgataaatgctgaaagttcattgcaagtagaaccagtgcctgccattgatggtaattccttccttgagagaagcaacttagatgagaggcccgccctttctggtaatgatcagattgcaatggaggcacttcactgtataggctctcctccttatgatgacaaggacccctgtttggaagcaccaaagcggtatatcttgtattgtgagaagcaccttccaagctggctaaaatgtgcaagaaatggaaagagtaggataatatcaaaagaagtgttcacagaaattttaagggactgctgctcatggaagcaaaaggtgcacctgcataaagcatgtgagcttttttacaggctagtcaaaagcattttgtcacaaagaagcccagtttctaaggaagttcagttccagcaggctttaacagaagcctcaaaagatactagtgtcggggaattccttacaaagttggttcatagtgaaaaggagagaatcaaattgatttggggattcaatgatgacatagatgtatcctcacttttggatggactacctctcgttccttccacagataatgacagctttgataatgaaaatgtcattaagtgtaagatttgctgtgcaaaatttcctgatgaccaaactcttggtaatcattggatggacaaccataaaaaggaagcacagtggctgttcagaggttatgcttgtgccatttgtctggattcttttacaaacaagaagctattggaaacccatgttcaggagagacatcatgtgcagtttgttgaacagtgcttgcttctccaatgcattccttgtggtagtcattttggaaatatggagcagttatggctgcatgttctatcagtccaccctgttgaattcaagccattgaaagctcctgagcagcctttgccttgtgaggacacttcggaaaaacttgagcagggaaattcagcttttttggagaataattccaagaatccaggtggtttgcggagctgctcatatgggccgcaatctaggtaccagccgctctacaaaaaggagtgtttgttattatacgcatag

SEQ ID NO: 105522 - DNA, 300 bp, Glycine max
  Peptide Sequence Number=SeqID_222300
ggatgggcattaagggctggtgaggctatccttcgtggaacatttgtgtgtgagtacattggagaggttttagatacgcgggaggcacaaaaccggcgcaaaagattgattgaaggacaggcccattatgtcattgatacaactagatttggaaatgtctctaggtttatcaataacagctgctcgcccaatcttgtgagttaccaagttcttgtagagagcatggattgtgagcgtgcacatattggtctttacgcaaatcgagatgtaagaacccttctctatatgacgttcccttga

SEQ ID NO: 105523 - DNA, 294 bp, Glycine max
  Peptide Sequence Number=SeqID_222301
atggagatgaaaaagctggtgttggtgaaggatccttcatcattgcaggtgacaattacaacctcaaatcgacaacctcagcatgctgtgatgcatgtgcttgcaccaaatcaattcctcccatatgtcattgtcacgattttggggaaacatgccactcagcttgcaacctttgcatctgtacggcatcatatcctcctcagtgtcgttgtttggatcaaaccaccttctgctatgacaaatgtgactcctctgaagacaaagctcactcagaatgagcatgtgtttcagtaa

SEQ ID NO: 105524 - DNA, 186 bp, Glycine max
  Peptide Sequence Number=SeqID_222302
atgttgaatatcactttctgggaactggggcttactatgaatgggtttattctggtggcattccatcgccaggagagacaccatttctttgttactttacatggcaaggtgcctctcactccactgatttgtgcgtcccagataaagataccggttgccaatttgccgattgggaaatcaaactaa

SEQ ID NO: 105525 - DNA, 2166 bp, Glycine max
  Peptide Sequence Number=SeqID_222303
atggcaactgatatgcagaggcttgttggaaccagtgaggatgatgaagaaatgggaatggatgtgaaagatgaggatgatgaggatgatgattatgaggaaaatggaggtgaacaggggaatgcttcagtatcagggatggtagagattgatgatgggaatgggataggaactgccactggtgacaacaggtttcagcagcaccagcagtttcaagagcaagtaggcaccccgggtggaggtactcgaagatctaggccgctagaagagaaagagagaacaaagctaagagaaaggcgccgcagggccatcactgcaaggatcttggcagggcttcgcaggcatggcaactacaatctaagagttagggctgacataaatgatgtcattgctgctctagcaagggaagctggatgggtggttcttccagatggttctactttcccatcaagatctcagggtcaaaagccagctggtggtaattctacaattgtcacttcatcatcttcccttgcggcttcacaacagactccatctgcttctctcaggggagttgcttctggctataggagccctttagagtataatgcatgtcaaacaaaaggtgtttttatgcctactccgtctccttatgatctatcctcaagttcccggtctcaaacatctatggtgggggatggagaagcacaaagagacaatcgtcctctgattgctggttcaatggataatgctgatgataagcagattgctgacttgccccccagattaccagagcgtgatttggctggtaccccatatgttccagtttatgtgatgctatcgttgggggtgatcaatattaaatgtgagcttgttgatcccgatggtctactaaagcagctaagggtgttgaaatcagtacatgttgatggtgttatggtagactgttggtggggaatagtggaggcacatgctccacaagagtataattggaatggttacaagagactctttcaaatggtgcgagagcttaagcttaagctgcaggttgtaatttcatttcatgaatgtggaggcaattttggcgatgatgtttgtattccactaccgcattgggttgctgaaattggtcggagcaatcctgacatttttttcactgataaagagggaagacacaaccctgaatgtctttcttggggaatagataaggaacgagttttaagaggccgtactgctgtggaggtttactttgatttcatgagaagtttccgggtagagtttgatgaatactttgaggatgggtttatctccatgattgaaattggactgggtccatgtggagagttaagatacccatcttgtcctgtaaagcatggttggagatatcctggtgttggtgaattccagtgctatgatcagtatatgttgaaaagtcttaggaaagcagcagaagtaaggggccattctatttgggctagagggccagataatgctggtacctataattctcagccacatgaaacaggtttcttttgtgatgggggtgattatgatggcttctatggcaggttttttcttagctggtactctcaggttttagttgatcatggaaaccgggtactttctctggcaaaattagcttttgagggatcttgcattgctgcaaagttatcgggtatttattggtggtacaagactgcaagtcatgctgctgaattaactgctgggtattataacccatgcaatcgtgatggttatgctgcaattatgacaatgttaaagacaattggagtcagcttaaacattccttgtgttgacttgcacacatttaaccaacaacatgagggctttccagagacatttgcagatcctgagggaatagtctggcaattgttgaatgccgggtgggatgttgacctaccagttaccggtcagaatggatttccttgcctaaacagagttggctataacaaggttttggataatgccaagcccatgaatgatccagatggaaggctcttttcatcctttacttacctgaggcttagtccacttcttatggaacaacaaaactttgtagagtttgaacgatttgtcaagagaatgcatggggaagctgttcttgatctacagaataggagaaatagaattgttatttgctgcggcacatatttgttagttgagtag

SEQ ID NO: 105526 - DNA, 1242 bp, Glycine max
  Peptide Sequence Number=SeqID_222304
atggccaaggaagatgtgtttgagttcctcgggaacgttcctctgctacagaggcttcctggctcgtctgtaaggaagatatctgagcttgtgattctcaaacactatgagccgggagagtatgttgttcgtgagggagaacgtggggatggtctttacttcatctgggagggagagctttctgacttgcaggctgaggttgttggctctgttaatgctgacgatgataatcatccagagtttcaattgaaaagatttgactattttggttttggtttatcaaatgaagttcaccatgctgatgttgtagctttgacaaagctatcatgcttggtgctgccccatgagcactcagcattgctgcagccaaagtctatttggagtgcagaaaaatctcatgatacatgctcacttgtggagcatatattgcatttggaccctatagaggtagacatcttccgaggaatcactcctccagatgctccaacatttgggaaggtatttggtggacaaatagttggacaggcactggctgcagcatcaaaatctgttgattgtcgtaaagttgttcatagcttgcatgtctattttcttcttgtgggggattttaacatacccattatatatcaagttaagcgtctccgtgatgggaagagttttgctacaaggaaagtggatgcaattcaaaagggaaatgtcatattcactttgttggcttcatttcatcttttatcgttggaagagcttcgggagcaacgtcttactgaccctcgtcttccaagaacttaccggaacaaggttgctacaattgaattcattccctggcccatagagatacggttctgtgaacctaaaatttcaacaaatcagaccaaatctcctcctagtttgagatactggtttagagcaaggggaaaactttcagatgatcaagccttgcataggtgtgtggtagcatatacatcagatctaatcttccttcaagtgagtttgaaccccaaccgtaggaagggaaggaaggctcgtgctgtgagtctggaccactccatgtggtttcacagacctttaagagctgatgattggatactatttgtgatctttagtcctactgccaataatgcccgcggctatgtcactggccaaatgttcaatcagaagggagagcatcttgtgtctgtggttcaagaaggtgtaatgagggaagttatttctgctaagtcagccatcaaatctaatctatga

SEQ ID NO: 105527 - DNA, 816 bp, Glycine max
  Peptide Sequence Number=SeqID_222305
atggcagaaattaggctcaccagggttgagcaaggccaaaccaagattaagaatgttcctatagctgtcaccccagaagggttttggtgctgcccttcccctgtggtgtttcagaaaagcctcaaaactcaaaatcctctcaataaacacaaaccctcttcaccacccccaccaaaaaccggtgttcagaaaaagccagtggccgtgcctgtgtctgtgtcagtgagtgagagaagaactgcatcatctgccccttcaagattggtgctttctgatgaaaaacaatgttcaactgctccagaaaggcctccacctaccaccacatctgtggctgctgcagagagggcacccaggcaaaaaattgaatctttgccaaagaaggttgctattgagtttggtgagcctggaacttgtgatatgaaagtggttttgttaggaaagcaggggttttgtgtcaagttgagtgttcacagggatgttttgacccagaagagtggtttcttttctgaaaaactctccgaacaatcgggtttgtcgtgcctccaaatcgctgactgcgaggatgtggagatatatgttgaaactgttggtcttatgtactgtaaggagatgaagcaacggcttatgaagcaaagtgtttctcgcattcttcgaatacttaaggtcttgattgttttgacttcattacttcttttcaactctggtcttaaaagaggaggtgcttccattacacaggttggtcaaactttgattgagaccaaaaacaaaacagattttgaggagttatatgctgggcttttttgtcaacatatgtag

SEQ ID NO: 105528 - DNA, 6945 bp, Glycine max
  Peptide Sequence Number=SeqID_222306
atgcaaaggtatcatgctggcagctgcactagtgcagttaataacagtgcaattggtgggccatccactagggacattggaagaactgattcatcttctttgccggctaactttcctgtgagttcaaggcgacaaccaccattagccccatacaagttgaagtgcgataaagaacctctgaactctaggcttgggcctcctgactatcacccccaaacaccaaattgtcctgaagagactctgaccagagaatatttgcaatctggatatagggacacagttgaggggcttgaggaatctagagaaatttctttgacccaggttcaaaattttggcaagacagttgtccttagttgcaaagaggctattagaaaacgtctacgggcaatcaatgaatctcgtgtgcggaaacggaagtgggccctacgtgctatgaaggctggtcaagtatatggagtggctctttctgggtcacaacttgctaagcctggtgttttccctgaacaaaggccttgtcctgaagactttcggaagaaatggattgagactactaagtcaagtagtagtgctgccagtacaagctcaggccctctgactaaaactagtaaccttggtattctaacagtttttatcaagtttttgctgaatttatatttacaaaagcatgagtttaatctggctggaagaagtgtgcaagtatggatggaaatagaacatgttcacatgctaaatacaccagtacaggctatagctattcatgatttcaggagagccattggcttatctcaacagcacaagcgattacgatctttggcagatcttgttcctcatgttagaaggaaatcacttttagaggttcttattaggaataatgttccattgttgagggctacctggtttataaaggtttcttacctgaatctggttcggctgggttctgctagtattccttctgggactgctgacaaaactcagctgtcttgttctgagctttggacaaaagatgttattgagtacttgcaaactcttcttgatgaattcttctcaaaaaatacttctcattttactcctcataatcgggaccaatcgccccaagtaccttatactgcgtcgcttcagcacagaagtgaccagttattatctgttgctgatggtgaagaaccatctttacattttagatggtggtatattgttcggcttttgcaatggcatcatgctgaagggcttcttcttccttctcttatcattgactgggttttgcgtcaattacaggaaaaacaattgcttgagatttggcagctgctattgcctattgtatatggctttttagaaattgttgttctatctcaaacatatgttcatactcttgctggtgtagctcttcgtattattcgtgatcctgctcctggtggatcagaccttgtagataattcccggagggcatatactacttctgctctgattgagatgctccgatatttaatatttgcggcttcagagacttttgttgctttggattgctttcctttgccatcctctgtagtttcacatacaataaatgatgggaattttgtactgaaagcaactgaagctgcaggaaagataataaatagttcagaagatgttgtgtgtttatttagaagtaaaggatttgatgcacaattccagtcattggcatttgatcatgtcatttcgtgcattcaagaacgtgtagaagatctcacaaaggctgtaagcccaggttatccaggtcaatgtctggctaaagcttcccaagccttggataaatcccttgtacttggtgatatacatggagcatacaaatttctttttgaagatctttgtgatgaaactgtatctgaaggttgggttgcaaaagtcagccattgtttaagggattttcgaaatgctcctccttgtgacgtaaagttcactggcaggaaagatctttcccaagtccatatagcaattagacttttaaaggtgaagctaagggatatgcagatttcaccaaagcaaaagagtggaagcactcgtggtcatggagtcagttatttagcaaaatgttcaagtctgcagagtaatcagaattttgtgaacaatgcattcaaaataaaatctagttcaagaaatttggatcagaatatctgttcttcagctatatttgaaagcccaggtcctctacatgatattattgtttgttggattgatcagcatatggtgcataaaggggaaggtttcaaacgcctacatctatatatagtggaactcatacgggcaggcatcttttacccactggcatatgtacgtcagctgatagtgagtgggatcatggacatgaatgtaaatgtggttgacttggagagacagaagagacattgccgaatcttgaagcagcttcctgggaagtttgtgcgtggtgctttggtagaatcagggattagtgaagggccatggctcactgaagcattgcgggtttacttgaatgaacgccgcctcatacttcgtggttccttatgggagaaccacgacaatgccaataatgtgaatatatcttctctcaagcgaaaacactgtacaacttcaacaaaagacagagcttctacggtgtcaattgatccatggaagagtattttttctaataaaatatcctctaaaaatgcaaaggatgacaattgtgttgaagaactgaagacattcatctcaaccctgttacagctaccaaaaagtttaactaatttgagcactacaggattggatgaatctcaaggcagtgtcagaaaacctattgggtctcacaacaagattgatctagtggaggctacacctgggtgtgaagaatgtagaaaatcaaagaggcaaaaattgagtgaggaaagaagttcatttgttcaagctccgtctctagtactgtctgatgatgaagacacatggtgggttaagaaggggctaaaatcctccgagcctctcaaagttgatcaaccacttaagtcaactaaacaggttactaagactcggcagaagactgtccgtaaaacccagagtcttgctcaactggcagcttctagaattgagggtagccaaggggcatcaacaagtcatgtgtgtggcaataaggttagctgccctcaccatagaactgctatggatggagatacaacaaggtctgttgatggaattcgatcaggtcactgtgaagatattgtttcaattggaagggcactaaaacagctgcgctttgttgagagaaaggaagtaacactttggctgatgactgtatttagggagcttattgaagagagtgaaaaagatgttggtaaagttagccagtttggcaggccttttgccactgtggatgataaaagttcaatacggtggaaacttggtgaggatgaactttctgctttactttatttgatggatgtctcagacgatttagtatcagctgtcaaattcctcgtatggttgctgccaaaggtttatattagcccaaattctacaattcatagtggaaggaatgtggagaaccaagcttgtgatgttggcgaggcttttctgttatcatcgctgagaaggtatgagaatattcttactgcagcagatcttcttcctgaagctctgtcatctataatgcatcgtgctgcggctattatagcagcatctaatgggagggtttctggttcaggtgccctaacttttgctcgttatttattaaaaaaatatggcaatgtggtcagtgtcattgagtgggagaaaagttttaagagtacatgtgataagagacttgcttctgaactagagtctggacggtcagttgatggagagttagggcttccacttggtgttcctgctggagttgaggaccctgatgactttttccgtcaaaagataactggtggccggttcccgtccagagtaggttcaggcatgagagatgttgtacagcgtaatgtggaagaagcatttcttgatctttttggaaaagacagaaagctctttgctgctggtacaccaaaaggtcctgcttttgaaaaatgggataatggatatcaaattgcaaaacaaatagttatgggtttgatagattgcataaggcagactggtggtgctgctcaagaaggggacccctctttggttacttctgctgtttctgccatagttggcagtgttggtccaacattagcaaaattgcctgatttttcagctggcagtaatcattcaaatatgtcattggctacaagttcattgaactatgctaaatgcattctgcgaatgcatataacttgtttgtgtttgcttaaggaagccttgggagaacgtcaaagccgtgtatttgagattgcacttgcaatggaagcttctactgctcttgctggagtttttgctccaagtaaagcatctcgagctcagtttcaaatgtcacctgaaacccatgatactggtactatttcaaatgatgctgcaaacaacagtagtaaaattgtggttgcaagaacaacgaaaattagtgctgctgtttctgcacttgttgttggtgcaattatatgtggtgttaccagcctggaaagaatagtaaccattctcagactaaaggagggcctggatgttgtacaatttgtaagaagcacaagatccaattcaaatgggaatgcacgttcagttggggcttttaaggtggatagttcagttgaagttcatgtccattggtttagattgcttgttgggaactgcagaaccatctgtgaaggcttagtggtggatctcttgggtgaaccgtccattgttgctctttcaaggatgcagcacatacttcctctaactttggtctttccacctgcctattcaatatttgcttttgttatttggcggccctttgttatgaatgccaatgtagcagttcgtgaagacatgaatcaactttaccagtctctaacaatggccataagtgatgcaataaaacatttgccgttccgagatgtatgcttaagagagtgtcagggcctttatgatcttatggctgcagatacaagtgatgcagagtttgcaaccttgctagagttgaatgggtctgatatgcattcaaaatctctggcatttgttccgctccgtgctagacattttctaaatgccatgattgattgtaagatgcctcactctatttatacaaaggatgaaggaagccggaattctggacatggtgaatccaaaattgattttactgatagtgaatctacacttcgggataaacttgtagatgtgttagatgctctgcagcctgccaagtttcactggcaatgggttgaactaaggctgcttttaaatgaacaagccctcattgaaaaactgaagacacatgatatgtctttagctgatgctatacagttgtcctcacctagttcagagaagggcactgcttctgagaacgagaacaattttattgaaataattctcactaggttactggttagacctgatgctgcaccccttttctcggagttggttcatctttttgggaagtcactagaggattcaatgttgttacaggctaaatggttccttgcaggtcaagatgtcctctttggtcggaagaccattaagcaacgactgattaacattgcagagactaaaagattttctgttaagacacagttttcagaaccctggggttggtgcaccccatgtaaagatccagttgctgtcaagggggataaaatgaaagttgattctatgcctcttgaagaaggagaagttgctgaagagggaatggatgtgaaaaggtccataaaagggttctcccaagtggttgactctgaaagctcaaccagtaagcagcagcatgggactgagagggctcttcttgagttaattcttccttgcatagatcaaagctctgatgaatctcgtaattcctttgcaagtgatttgatcaaacaattaaattatattgagcaacaaatagctttagttactcgaggaccaagtaagccaatggcaagtactcctgttactgaaggtcagacaaataaagtaaataaccgcaaagctataagaggtggcagccctgggttagccagacgaccaacacctgcaccagattcttctccactttctcctgctgctttgcgagcatcaatatctttacgtgtgcagttactcatgagatttcttcctattctttgcacagacggggactcttctgtatggagcgtgagatacacacttgcctctgtacttcttcgtctccttggcagccgggttgtgcatgaggatgtaactgtgaaggcaatgtactatactccattgagaagggaggcagagtcacatgctgaagctgcttttgtagattcttctgttgagggcctgtttgatcatctgctgttgattttgcatggattgttgagtagttctcctccaagttggctcaggtcaaaatctgtttcaaagaccactaatgaacctacaagggagttttctggatttgaacgcgagccattggaggcattgcagaatcatcttgataatatgcaactgccagacactatccggtggcgtatccaagctgccatgcctgtgctccctccctctatacggtgctctttctcatgccagctgccaactgttccagcttctgctcttgcatctcttcaacccagcactacaaattctgggtttaactccagctgttcaactgtccctcagaggaacctggtttcatcgtcaaggactacagcatcagggaggtcgaaactgcaggacaatgattcggatgttgacccttggacacttttagaagatggcgctggatcttgttcatctgcaagtaatactgctatcataggaagcggtgaccgtgttaatattcgagctgctagctggcttaaaggggctgtaagggtgcgacgaactgacctttcatatgttggtgccgtggacgaggatagttga

SEQ ID NO: 105529 - DNA, 2925 bp, Glycine max
  Peptide Sequence Number=SeqID_222307
atggcaaagaggtcccaaagattccctgtgaattatgagaaagatcagtcaggatgtatgtggggttttattagtatatttgattttcgtcatgcccgctttactcggaagttgatcgcggataggaggcatggcagcaagcatgctgttgctgctgcacttaccaagaacaagttcgaagtgttgagcaatttagatgaagaatatgaaggcaatattgacagagtagagagtaagagactaataccagcaactgatgctgataagcttagtgtaaagaaactcatagaagaagagatgatcattgaccaggatgaaataaaggatcaaggtaatgctgatgtagaatcaaagcaatccagattagggcatgaagaccccccaaagaaagaatccaaaagaaaaaagaaatctcgcaagaaaagccgtgatatggatagtcatgatttgaattcagctgcaaccttgaaatctgaattttcacataaacagcattcaagacaacagtcaaaagataatctagatttggacaaaataatgaatgatttttgtcatgttgaagctgcttgttccatgatgaatgacaatgatggcaaaattgatgcacagtcaaaccaaaagcatgctatctctgaaaaccttgctaatgcaatccatgaatttgcaaatcagatgagattgaatgggaaagatctgcctgaagatggacaattcctgagctcacgtgaactcatggaagcacttcaggttataagttcagataagcaattgtttcttaaacttctacaagacccaaattcacatttattgaaatacattcaggagttggaaagtgctcaagggagaggtggtaaagaatgcagttcagttgtcagctccaactgctctgaacaagaacttgttaatctgaaagaaactagggagatttccaaccgcaagcatcgtaactttttcagaaaaagggtgaagtctcaaccaaaagattcaacaaatgaaaatgggaaaactgaattttcaaatagaattgtcattctgaaacctgcactaacaggcatgcaaatttctgaaagtggaaacaaccttgcctcatcactagattctcatgacattgcccagtacaggaatccttcagtgagagttggttcacatttttctcttacagagataaaaaggaaattgaaacatgctatgggaaaggagaggcatggaaaccctgaattgatcccacgcaaactccctgttgaacgtcaaaataaggtgccaagaggcaaatgcaaagataatgctggaatgagatctcctaataaagaccatttcttcattgaaaaaattgcaagacctatgtttgatgttgtgaaaggaaacaagactggtacattgaaagactctgaattgaatgtggaacatgaaagtggtattcccaaccaaagtgtttcaaacatatatattgaggctaggaaacatctgtgtgagatgctagataatgctgatgagagcacaaacatttcaagcaggcagatgccaaaaacccttgggagaatactttctcttcctgagtacaacttttctcctctagaaagtcctggaagggatttagagcatcattctgtgactgcacaggcaagattttcttcctcagacaaaactagggagattagtgaggataatttgtcccccaaaccagcaacatgtattggtcttgcagatcaggaaatcaacaagtcagagaagcagtcaaacatttgtgatgaaagctctaacaataaagtacaagaaattaagacggtgtcgaatctctcccatgatgttgatcatgtcgatacatctgaagcccgttatcctgttagagatgagatagttactgaaggtaatgtagaatctgcgaaagagaaaaatgatttggaattgtccttgaatccaaatggcttcatcacaggaaaggaccaaaatattgatatctcggaaattcctgatggtgcaggatgttctgaacgtttgaatcaggacataacagaagagaaccagccatcatctccaccgccatctcctcacttttctgtcactaagaaaattgaagagctagaaaatggtacagatgtatctgagcgaccgagtcctgtatctgttcttgatacatcattctcggatgatgacttttgccctgggcactccagatgtgagcctgttaaattaccagtacaagcccgacaaattcaatttgaagaacatgactgttcacctccagaacaatttgacagaggaaaatattgttttgaagaaagtgaattgatatatgactacattaaagctgtcttgcatgcctctggcttgactacggatcagttgttgatgaaatgcctttcctcagacaagatactggatccttccttgtttgatcaagtagagtacttctcgaacctgctttgccacgatcagaagctcctatttgactctatcaatgaagttctcatggagatttgtcagcattactttggggcctcaccttgggtttcatttgtaaatcctagcacgaggctaactccaagtatgaaaagggttactttaaaggtctgggaaggagtgtgctggcatatccttcccttgcccccaccgcgcactttagagcaaattgttaggaaagacatggcaagaagggggacatggatggaccttggacttgatgcggaaacaattggttttgaaatgggtgaggacatacttggtgaactgatggaggacaccattttgagcctttataatgtgaacaaggatacaaaaaataagtcacaagaagtaaatgaggagccagtggcaattgcttcttgcaaaagtgaaaagctaagcttgtttacaatgacaaacagacaaagcaacagttttattcagtgtgactcacttcacccagtgaaggccaaaggtgtttga

SEQ ID NO: 105530 - DNA, 312 bp, Glycine max
  Peptide Sequence Number=SeqID_222308
atgacattgcaaggccaaggggtcacgggaagaggttcagggctcagagaactgaagaaggagaggaagaaacacagaaagagaaagagaagaaaaaaaagtaaagccgaagtgttgccgaatagcaaccgtggatcattccctacattatttctctcgctagccttgtaccccgtgcaacagtcgaaaggggggaattttatcgaacaatttgtaggcggcagatgcaatcctatcccccaagggcattggatagaaaactccaagaagatcaggccagagaagcaagagaaggccctaggattctcatga

SEQ ID NO: 105531 - DNA, 183 bp, Glycine max
  Peptide Sequence Number=SeqID_222309
atggctgaacaagcattggaaggtagccaacctgtggatttaacaaagcacccttctgggattgtgcctacccttcaaaatattgtgtcaacggtcaatttggactgtaagttggagcttaaatcaattgcacttcaagctcgaaatgcagaatacaatcccaaggcaagttttgcttgttga

SEQ ID NO: 105532 - DNA, 237 bp, Glycine max
  Peptide Sequence Number=SeqID_222310
atggatttttggaggaaggtttggaattatcgtttcaagcctcaagatagttgcttcatttggaagaattaccttcatgctcatttgatggaggttgatgaggagaggagatctttgtttgttgtcaggctgaatatcatatggttagctccaaaaaagcttgtgtttaggaatgaagattttgatgtggacaatattgcctacaccatcaaggcccaggttgtttttcaagcctaa

SEQ ID NO: 105533 - DNA, 476 bp, Glycine max
  Peptide Sequence Number=SeqID_222311
atgatcggtttttacggggtgatcgccctgctgctgctgtcgctgttcggcagcctgctggcgccctacgcgctggatcagcagttcctcggctatcagctgctgccgccgtcctggtcacgctacggcaacgtgtcgttctttctcggcaccgacgatctcgggcgcgacatcctcagccgcctgttgaccggcactgccgccaccttcggctcggcgctggcggtgacgctggccgcggcgttctgcggagtgatcctcggcgtgttcgccggcgtcacccacgggctgcgttcggcggtgctcaaccacatcctcgataccctgctgtccattccgtcgctgctgctggcgatcgtggtggtggcgtttatcggccccaaacttgaacacgccatgctggcggtgtggctcgccttgctgccgcgcatggtgcgcaccatctacagcgcggtgcacgacgataagcagaaaga

SEQ ID NO: 105534 - DNA, 171 bp, Glycine max
  Peptide Sequence Number=SeqID_222312
atggagagtcaaattcatcctcaaattgccttgttgtttatagctagctttccaaaggaccccaagcttcaagacaaccatcattccaaaaggtttgagcttgatgatcacgaagacacagacctgctccaaatgattgctggtctttcatcgacattaaacttaatataa

SEQ ID NO: 105535 - DNA, 1434 bp, Glycine max
  Peptide Sequence Number=SeqID_222313
atggctgtggtgagtcctgtgcctgcaacaacacaaaggatgggttcagtgaggttactttctgatgctggtggagaaattttggaggagccaaatccaagggtggttgatcagccaatctatgttgctgtgacaaaagaggtgaaggagagcaaattaaatctaatatgggcaatacagacctccggaggaaagagaatttgcattctttatgttcatgttcgtgcaacaatgattcccctattgggagggaaattccccgcaagtacactaaaagaggagcaggttgaagcatactgggaagaagaaaggcaaggcatgcatgggattctggatgaatatctttgtatctgtcagcggatgggggtgcgagcagagaaactgcatattgaaatggatagcattgaaaaaggaattttagaactcatctcccagcatggcatccgaaagcttgttatgggagcagcatctgataagtactataataggaaaattgatgatgatattgcaagaaatattaaagatggtagtattttgagaatgatggacctcaaatctaagaaagccgtctctgtgtgtaaacaagctccagcttcttgtcatatacagtttgtctgcaaagggcaccttatacacacaagtaaccagtgtatagcaccttcaatgcactcaggacttagttccaatgcttccattgcacatcgaaacctcattgccaccactgttttgttgccgccagcttctttcctaccagcaagcctaccaggaggtgcatcttccccggctcaaccagacctccaaattccccaccaaaagcagcctcacacgctggatcgcagttcggatgaaggtaacgcagaggttgcatctcctttggtgcagcaagtgccaaactctttgaaatctttgagatctctgtctattacacttgggcaagattgccaagcaaatataaccaatcctgctctagagttatttcgcagagtaaggtctgccaatgatggacatggagcaagctttatggctgtttcttctccagaagacactgaagggctttcaactccacgtgacaggatgggtacagaagtaagttctgatgaatcagataggctgtctaggatgagtccttctggcttgtcaacatgctctgacagtgcagtcgaactagcattgaccccaagtttgataaacgaaagcagtgagaatgcattagagttgactttgagtcacctgattatagaggatcttcatcattcatctcctcccagtacactggatggtggaatggatgatactatctacgaccagcttgaacaggctagggctgaggctgagaatgctacactaaatgcatatcaagaaactgtaaggcgtatgaaagctgaaaaagatgcatttgaagctatacgcaagatgatcatgtttatgatgtga

SEQ ID NO: 105536 - DNA, 162 bp, Glycine max
  Peptide Sequence Number=SeqID_222314
atgaccttgtggcagggaacctattgggtgagaacttctaatctgcccctaggttcgcttgaggttcatgcacggtgcccttcattgcccccgtgtagggctatgaggctttgtaaaaggagttttacaaagagagtgaaaaatctcaagtgggttgcttga

SEQ ID NO: 105537 - DNA, 883 bp, Glycine max
  Peptide Sequence Number=SeqID_222315
agccgattctgcgaagctttgtttcttctgtgaccgtaaagttcacttcccaaaccagcttttctcgaagcacaagcgcgcgcagctctgtgatgcgtgtggagattcccctgcctcggtgctctgttctgcagaaaactctgttctgtgccaaaactgtgattgcggaaagcaaaaacatttggtgtctgaggcgcaccaacggaggccactcgaggggttctcggggtgcccttctgtgactgagttgttaacaattctgggtctcagtgaaaaatctctgctttcaaatgagggaacttcccagattgatgatgacctttcggatttgcacgtgtggagtgctccttctattaatggtcttgaagatttgatcactaccacagcttcttctcaaaaggtgattgtagattctatgggtggtaaaaggtgcacattgaaaatcctcgagtattgcaacgattttgacatgtttcaggacattgttattgaatcagaaactgatcctagaaatcaaattgttccttccgatacgtcaccattgagagattatggcgatatagtttcagctgaagatggaagttttacgatcactgtgactcacgccaattttaacaaccaagggaaaccatcaaattcttttaacgctgaaaacttatctcctactcctaaagctactccatacgagttgacaagtcatgaaagagattcagcattattgcgatacagagagaagaaaaaatccagaagtgcaactaaaaccaaggacagcagctgtatgatggtgaaagaacttctatgtactgcgaatgcttcagaatattatgctgaaaagcctcaattgagggctttttataaagaaccaaaggtccaaaacagatga

SEQ ID NO: 105538 - DNA, 1116 bp, Glycine max
  Peptide Sequence Number=SeqID_222316
acgctccgcctcaaccgtgctgtgccactagacaggcttgccactcttcttcgcggtgctcctcagttggttgagttgggcaccggagcttacacgacagagatgcgaccggaggtcttcacaaaccttgcggaggcattttctgggtgcaagcaattgaagggcttatctggattttgggacgtgctcccttcctaccttccagctgtctatcctatttgctccaacctgacttcactgaacttgagttatgcaactattcaaagccctgatcttatcaagcttgttggtcaatgtgagagtttgcagcggttatgggtgctggattacatagaagatgctggccttgaagtgattgctgcatcctgtaaggatctaagggagttgagggtgtttccgtccgacccgtttgggttagaaccaaatgtagcattgacagagcagggcctcgtttcggtgtctgaaggctgcaccaagctccagtcagttctatatttttgtcggcaaatgtctaatgctgccttagatacaattgccaggagcaggcctaatatgacacgttttagactatgtattattgagcctcgagctcctgactatctcacccatcaacctctggatgctggttttggagctattgtagagcattgcaaggatcttcagcgactttccctttctgggcttctaactgaccgtgtttttgagtatattgggacttatggtaagaagcttgagatgctttctgtggcttttgctggagatagcgatttgggactccatcatgtgctgtctgggtgtgacaaccttaggaagctggagatcagggactgcccctttggtgacaaagcccttttggccaatgctgcaaagctggagacaatgcgatccctttggatgtcctcttgcttggtgagttatggagcatgtaaattgctgggtcagaaaatgccaagacttaatgttgaagtcattgatgaaagaggacctccagattcaaggccggagagtagtcctgttgagaagttatacatatacaggactgtttctgggccaagattggacatgccaggctatgtatggagaatgcaagatgattctgcattaaggatttcttga

SEQ ID NO: 105539 - DNA, 1032 bp, Glycine max
  Peptide Sequence Number=SeqID_222317
atggcagacaatgaggatggaggggataagacatctcgtgggaatgaatgggaggttgtatctctcacagcatcaacatatgcagctgctcctggtcctgatgaagttgagatgaaggatgatgggaaagaagatgtatatgggcaggatgaaggagaaacgtcacatgctttattcatgtctagacactttgtctttccacccagtcagcatgaaaacttgcccgtggaacctgactatggtgagattcatgatgattttggagacaaagatgttgcctctgaagagactcctgaagaagtgaccatacctagtggaaaggatgaagaaaacttgacattaccaggattagaagttgcagaggagtttgagggcatgcggtattttgacgagaaaatcaacagattatctgttcgtggtaaacagtttgaggaaggtacaactctaccagcatttggcttgactgaaaagggggagagtatgtatgaccctgcaaaatacacttcttttgagggtgaaacagctattggtggcgtaacagcatatggtgaaagcatagttgatcctgaagcaactgaaatggaatatcaaggttcaaatgtatctcctgatttgtcactgtcaaagaacttgtccaaagataacgaatacaacacttcagatcttccttgtggagcttggtggaagcggagagctgcctccttatatgctcatgcaaaagaggcaaatgcattctggtctgttttcattgcagctactgtgatgggccttgtaatgcttggccaacgctggcagcatgaaagggctttacaacttaaatggcaaatcagtataaatgatgagtatgtcatgacaccggacaaaatccagtggtggctgtatagtgaatcagtgatgaatgatattgaagattgttcaatgtctttggcgaggagcagggtgcttgctcccatatatcggctcaaagatgtgattgttggtggcaaccgccgtggctccttgatcaggagaagctcctctggtgaaagttaa

SEQ ID NO: 105540 - DNA, 201 bp, Glycine max
  Peptide Sequence Number=SeqID_222318
atgacatggaccgccggagatgagatgacggagatcataagaggcggcgacggagaagacaagggatttgagtttccaaatgagagatcttgtagcgtttcctcaaaagaggtcgtcgttgttgtcagaaaagaagccaccttatttgtgttggagaagaaaaaaccactaccattgtcggagaaagagcagcgaaggtga

SEQ ID NO: 105541 - DNA, 1026 bp, Glycine max
  Peptide Sequence Number=SeqID_222319
atgaagccttatatctggcttgagacatccgatggttcaatccaacaagtggaacaagaaattgcaatgtattgccctctgatttgtcaagaaataatacaaaaaggcatgggatcttccaagaattgtgcaatatgtcttcctcaacgagtcagtcctgcgacgttgagcttaattcttgattattgtcattttcatcaagtaccaggtcgctcaaacaaggaacgaaagtcttatgatgagaaattcattaggatggacacaaagcggctatgtgagttgacatctgctgcagacagccttcagttaaagccattggttgatcttacaagtcgtgcacttgctcggataattgaaggaaaatctccagaggagatacgcgagatatttcatctgcctgatgatcttactgaggtgtctggtgcttgtgagaactctgaagagaagttggagcccttgaaaaacacaactgatgacccaaggatcaggcttttgaatagattgtatgccaaaaagaggaaagaactaaaagagcgtgagaggttaaagaatgttgaagctgaagaagagcatgtagatgaacgttcagttgatgaccttttgtcttttataaatggaaatgatggagatccaaagggagttaaaacttctaagaataaaaagaaaaatagaagaaaaaaagagcaacagcagaagaactcttctctgaaggaagcttctgaagtgaataaggaagtaaatggtcaaaatatcagacaccaaagtgctgaagctgatagaattgctgagacctcaaattcacatacagaagacgtttttgctcatagagagtttgatgatggagatatagatgatgggattgatcctgcattaaaggaaaaaattgacaggtggggctgcattgtaaatgcatgtctgtttcagatatcagctatatatatgctgatcatagtagccagagttggttacaacatagaactgcctatactaactgcattaaagctgtacaaacctgtcagctattga

SEQ ID NO: 105542 - DNA, 1767 bp, Glycine max
  Peptide Sequence Number=SeqID_222320
atggatgaagataaaacccaacaacttcccagaagaatgaccaggtcttcagcttcatcgtctccatccacttcaaataacatagttgcagcaaaagtaactagccttgaacctctaacaatcaatgaccttttagttgggggagatcccatcagcctagatgacataatttctagctttcctggtagaagtagccagattcttgaagttgtgcgtcatttgggacctttgaattcaccaatgcttcctttgttcgtatatggaagttcttctaccggaaaaaccagtatcattcttcaattattcaggcatctcaacaggcctattgttttttctagttgtaggacatgttataaccagaacatcttgtttgaatctattctaaatcagctacttctccacagaaaaaatgctgccaatggttatttgaatgcaaaacgctgtgaaagaccatctgattttgtcaattttcttcgagaagcattgaccaatgttataagcaatctgaaggagaagtcagagaagttgatctcaaatgaaatgactcaagggaaaattggaaatatgatctacttggtatttgacaattttcagcttgttagggagtgggataagagttctactatattgcccttgctgtttaatctctatgatctgctaaatacgcctgaggtgggtttgatttttatcagcagtacttctccagataccttttactctaacatgggctatgttgagcctatccccatttactttcctgattacacagaagaagatattcgtcaaatattattgagaaaccaagtgaaccagaagctatattcctcatttctggatgtatctctgaaatctttctgtggaattactaagcagattgatgatttatctgctgccttaaagccactatatgaaaaatattgtgaacctttaagtgataagggaaagggagttgctcctaatcaagaaatgaagcgaaggctgcttgctcatatcaaccctcatattgcctcctctttgaatgagatatttaaggtttcatctctttcttcaactgaagttgagacccgtaaagaggaaaagtggaagggaaatcttaggagattggagcaatctaaagagcttgtcagtcttgattttcatatatctactagtgcaaagtatcttctgatttcagcattccttgcctccagaaacccagcaactcttgatgcttcactttttgattccaaaggtggttctgataatcggaaacgaaagaggaagccctctgagaaagcgcaggaacggaaggaaactttagaacaggaactactaatgaaaggacccggaactttcccattggagaggttgttagccatctttcaatgccttgtatcagttgcagaagaaccatccgacgaggaggaacaaaataatgatggattaggagttgaaggtggcaatggtggactgatgtctgacattcttttgcagctatccagtctctgcaattctaattttatatttaaaggaagaagctgtcccattgaaggctcaacccggtatcgatcaaccatatctgaagaccttgctttgaaggttgcaaggagcttagagttcccattatcaaaagtgtatactacctctactatgccctactgttatcaacatgaaatggctggaatcccctatgaatgcttgaagcaaaaccaacggtatagaatggataattgtgaacatggcggttcatgggatggatggactgagcattttacaatggacaactga

SEQ ID NO: 105543 - DNA, 378 bp, Glycine max
  Peptide Sequence Number=SeqID_222321
atggaagccatatccaaacggtttgaaaagcttgatgtcaaaacaaaaggttctcaaaagaaacagatgaccaaacaacaaagaccagcgaagcgtgattcgtcttaccgggagaatgtggatgcattacattctatgcaaaatagcaattatttagtgaaacattgtgcatcatcatctaaacaaccaaaacctaagagaaagatgccaatgctggatcaatttcatccatgcattcatgatttcattgaaaatattgtcgatgtaaaagttgatgcagaatggagaaggaagaaagatgattggcgacaccacatcaaggacaagatgagtcaagagcaagctcaccaccataggaagccatggataacagcttga

SEQ ID NO: 105544 - DNA, 444 bp, Glycine max
  Peptide Sequence Number=SeqID_222322
atggtttcagaggggctcacagttgaggacatattggaaaactggttcaaactgaagcctattattatggaagaatggaatgagaatagagaagaactgatagacctttttgggaaggtcagagatgactggttgtatagcagcaaacagtcccaaggtagaagtgttaaagaagcttcagaaaatgccagaacaccaagggctgacactacagttaagattttatgctttcagaggccattttatttaatatatcctttgttaagctttgtggaagataggcttgcaatccttaagaatgtcgtcaaagagccagagttagataactggaatttatatctagtgaattgggggttcaacactcagaaagagagagaagaagcagaagccaaccccaggattcaagttattgagctctctgacttcagtagcaagctgaagtag

SEQ ID NO: 105545 - DNA, 753 bp, Glycine max
  Peptide Sequence Number=SeqID_222323
atgggggagctttacgcgatggagtcatctgcgatagctgcggagaaagctctctctctgctctcaaggttggctgccaaagtgagatggcctggtttgtttgatggggtggattcagccacagaagattggattattgatcagatgcacacattcttgtgcaaggttgcagaggggctaacagttgagggtatattggagaactggtcaaagttgaagcctattatcatggaagaatgggatgagaagaggaatgatctgatagatctttttggaaaggtcagagatgaatggttggagcaggattttgctacttggattggtgcaaacagattatatcccggtgtttctgatgcattaaaatttgcaagctcaagagtgtacattgtaaccacaaaacagtacccaaaccccttgtttctcttatttcaaagccactttgctgatgctttactccaagagcttgccggagtggctataccacctgaaagaatatttggccttggaactggtcctaaggtagaagttctgaagcagcttcaaaaaaagcctgagcaccaaggactgacactacactttgttgaagatcggctagctaccttaaaaaatgtcatccaagaacctgagttagaccaatggaatttgtatctaggtaattggggttacaacacccggaaagaaagagagggtgctgcagctatccccagaattcatgttcttgggctctccgacttcagcaagaagttaaaatag

SEQ ID NO: 105546 - DNA, 360 bp, Glycine max
  Peptide Sequence Number=SeqID_222324
atgacaacaatgtccggtcctcaccggagtacggcgagaccctggccggagcttgacgaatccgatgacgggtccggcgtggcgcttcatcatctcctgctggatctgcgagggatcgagcttggagatatcggaggaagggaaagggggttcgggtttcttgccccattctcgccacgcgtcgtcctcctcgtcgtcgaacacgtcgtccaactcgtcggggatgtgaaccttgcgctttccggcgagggcaaaatgggaatttgcggacgcgaggaggagaaggagaaggagagtggggactggttggaaggtcatgggggaagagaggatcaaatgaggaatgatgcactctcgtga

SEQ ID NO: 105547 - DNA, 316 bp, Glycine max
  Peptide Sequence Number=SeqID_222325
ggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctg

SEQ ID NO: 105548 - DNA, 417 bp, Glycine max
  Peptide Sequence Number=SeqID_222326
atgccacaaaagtgcaaagatgttgacattttcaccattttcacatttgcagatgccatgctggatttaggtgcttccattaatgtcatgcctacatttttttataaatccttgaagcttggtgatttgaggccaactaaagtggtcattcggttagcaaatcggagcaccgttcaaccacttggagttttggaagatctacttgtcaaagttaatggtttcgttttccttgaagatttttacattttggatatggaagatgattcatctagatatgagattagtgttgctcttgctgcaggtgcagaattccaagaggttgatgttgtagtagatgtggttgtatcaacaaatgaaattgtggttgcaagccaacctccattgccttccatactccagccaccatctttagactaa

SEQ ID NO: 105549 - DNA, 237 bp, Glycine max
  Peptide Sequence Number=SeqID_222327
atgagactgagcgtgctaagcgcgagaagagacaacgtcctcgctgaacaggctggccgcgccctgggcgagcacatctctgacttatcctcttctaggatttcccaacccattaagcaagttgtatgcctcgctaagcggatgccactcactgagcgaatctgtctcgctgagcgagtcatcaactacttgaaccttctcttctttggcctgaaactgagttggattcaccattaa

SEQ ID NO: 105550 - DNA, 2094 bp, Glycine max
  Peptide Sequence Number=SeqID_222328
atgggttatctgagcaaagcttccaaaaccctaaggcaatcgaattacctatcgttgttgtgcaattccaatttcaatttcaatccattaacgaacagaataacccatgaacgtttttctgtgacgcgtgcactgttgtgttcccagacacgccaaaacagcaccacgagagagaaaagcaccatagatttgagccaatatccaaaagagctcgttagaaacttctcaatcattgcacacgttgatcatggcaagtccacactcgctgatcggcttctagaactcactggaaccattaagaaaggccacggccaaccccagtatcttgataaactgcaggtggagagagaaagaggaatcacagttaaagcccagacagcaacaatgttttataagcacggtgtaaatggtgatgattgcagtgatggaaaggagtcacctaagttcttgctgaatcttattgacactcctgggcatgttgactttagttatgaggtgtccaggtcactggcagcttgtcagggtgtgcttttggttgtcgatgctgctcagggagtccaagcacaaactgttgctaacttttaccttgcctttgagtctaacctaacaattgttcctgtcataaacaagattgaccagccaactgctgatcctgatcgcgttaaagcccaattgaaatcaatgtttgatcttgacccaagtgatgtgctgctaacatctgctaaaactggagagggtcttcagcaaatccttccagcagtcatagagcgcatacctgcccctcctgggaggagtgattctcctttacgcatgcttttgcttgattcatattacgatgaatacaaaggggtaatatgtcatgttgctgttgttgatggtgtcctgcgcaagggggataagatttcttctgcagctactggtcagtcatatgaagcttcagatataggcatcatgcatcctgaacttacacctactggaatcttgcttactggacaagttggttatgttgtaagtggcatgcgttcaactaaagaggcacgtgttggtgatacaatttatcatactcgaagtactgtagagcctcttccaggcttcaagccagcaaaacatatggtgttctctggcctttatccagctgatggatctgattttgaagctctaaatcatgcaatagagaggctgacatgcaatgatgccagtgtctctattgctaaagaaactagcactgctctaggtctggggttcaggtgtgggtttttaggccttctgcacatggatgtttttcatcaacggcttgaacaggagtatggagctcatgttatatcaactgttcctactgtgccttatatatttgagtttcatgatggaagcaagttagaagttcagaatcccgcttcattaccctctaatcctaagcataaagtgacagcctgttgggaacctacagtattagctactataatcattcctagtgagtatgtgggacctgttattacccttgtctctgagcgtaggggtcagcagttggagtactcattcatcgacagtcaacgggtattcatgaagtaccgcctgcctttgagagaaattgttgttgacttttataatgaattgaagagcataacatcaggctatgcatcatttgattatgaggactcagaccactcctatttgccttggttcattgatgatgtactgtgctatgtagagtttggaacaaatatctgttatcaacaagctgatatggtgaaactggatattctcttgaatggacaacctgttgatgcaatggctaccatagttcatagcgcaaaagcatatcgtgttgggcgtgaactgacagagaaattgaagggcgtcttagacaggcaaatgttcgaggtaaacatacaagccgccattgggtcaaaaatcatagcaagagagacgatttccgctatgaggaaaaatgttcttgccaagtgttatggtggtgatattactcgaaaaaggaagctattggagaagcaaaaggaaggaaagaagcgaatgaaacgtgttggttctgttgatataccacaagaagcatttcacgaactattaaaggtttcttag

SEQ ID NO: 105551 - DNA, 2634 bp, Glycine max
  Peptide Sequence Number=SeqID_222329
atgatggatttcatagggccagtgttggagctcataattcgcatgtgggactgttgtgcctgcgtccgcgagtttgaagagaacctttcttgtttgagggacatagcatctgaccttcgaggtgtttggattgatgtgagtgtgagggttgaagtggctgaggcacagtacctgaggcgtctgaatgaagtgaatgattggttggataaagttgaagccatgcaaagggaagtcgaagctattcagcagaaagtttctcaagttcaagaaacgcatagtagatgtttgggaagtttctgtcccgggaattttccaactagctgctggatgggaagggttatagctcaaaaaattggcgagattcgtgaactaattgataaagggcattttgatgtagtggctcaggaaatgccacatgctttggtagatgaaatacctctagaggccacagtaggtctagaatcaacctttgatgaacttggtgcatgttttgatgacaatcatgttggagttattggcttgtatgggatggggggtgtaggaaagacaaccctgctcaaaaagttcaataatgagttccttcccacagcattctatgatgtggtcgtttgggttgtggtgtctaaagaagcagatgtagggaatgttcaacaaagcatactggaaaaattaaaagttcccgatggtaaatgggttggtaaggccattaatgagagagctattgttttatacaacatcttgaaaaggaagaagtttgtgttgctgctagatgatttatgggagcgcatagatcttctgaagttggggattcctcttcctgatacgaacaacggatctaaagtgatattcacaacgcgatccatggaggtttgcaggtacatggaagccaacagatgtatcaaagtagaatgtttagcaccaaaggcagcatttgaattgttcaaagagaaagtgggtgaagaaactctcaactctcatcctgaaatatttcatttggctcaaattatggccaaggggtgtgagggacttccactggctcttatcactgttggaagacctatggctagaaagtctctccctgaatggaaacgagcaatacgaactttgaagaattatccatcaaaattttcaggtatggttaaagatgtctattgtttgcttgaatttagctatgacagtttgccaagtgccatacacaagtcttgtttcttgtactgttccatcttccctgaggactatgatattagagaagatgaactcattcaactgtggattggggaaggtctcttagctgaatttggtgatgatgtctacgaagcacgtaatcaaggagaagaaatcatagcaagcttgaagtttgcttgtttgttggaggacagcgagagagaaaacaggattaagatgcatgatgtgatcagagacatggctttgtggctagcatgtgatcatggatccaacaccaggtttttggtgaaagatggtgcaagcagcagttcagctgaagcatataatcctgcaaagtggaaagaagtagagatagtatcactctggggacctagcattcaaaccttctcaggaaaaccagattgctcaaatctctcaactatgattgtcagaaataccgagctaacaaactttcctaatgagatctttctgactgcaaacactcttggagtgttagacttgtcaggtactgatatacaagaattgccaagggagctccagaaattgaaaaagttgaggtgcttgctgctaaattatatttgcaataggattgtcttcccgaggagtttgatatcaagtttgttgtcattgcaagtgtttagcaaattaccttgggaagatcaatgcattcttcctgacttaagggagcctgaggaaactgttttgttgcaagaattggaatgcttggaattccttcaagacataagcattgctctcttttgcttttcttctatgcaagtattacagaaatctcccaaattacaaagattcattagactgagagtaatttctcatttcaattcaatgccacatgttatattattctcattattgagaaaaatgcaacatctagaggttttgtccatatcaatttcttcatctccaagtttagtttctgacatgaaaaaggagtctccatcgcatgattctatgtctgagtgtattccaatgagttcgaagcttactgagcataattatactgttaatcttcgtgagttatcccttgaagggtgtggcatgttcaacttgaattggctcacttgtgctccaagccttcagctccttagattatacaattgtccctcattggaagaagtcataggtgaagaatttggacatgcagtaaatgttttttcgagtcttgaaattgttgatctagattctctaccaaagttaaggagcatatgctcacaagtattgcgatttccttgtctcaaggagatctgtgtggcagattgtccaaggctgctaaagctcccttttgattccagtagtgcaaggaacagtctgaagcacatcaatggacaaaaaaattggtggcgtaatttgaagtgggaagatgaagctacaagggatctctttcgttcaaaatatgtacctttccgtagtaaaattcgccgaaaaaattga

SEQ ID NO: 105552 - DNA, 741 bp, Glycine max
  Peptide Sequence Number=SeqID_222330
atggacacctcagccttgaactcctcctccccacccctcgacctctacaaccttttcaccaccacaatcgaagcatcactcaactccccttcaaacacaatcctaaaccctccatgctcaatattctccaaaaaactcacgcatcgccaactgaagctctgtgcacaaacccatcttccttctcctcttcctcctccaacccctttctttcacaaccccttttcttcttcaccatcaccaacaaagtcttcaccaccaccctcaatcttctccaaaaaactcacgcatcgccaactgaagctctttgcacaaacccatcttccttctcctcttcctcctccaacccctttctttcacaaccccttttcttcttcaccatcaccaacaaagtcttcaccaccacccccaaaaccccaacaaccccaatcacaaccccactccacgccaccattagagaaacatccaagctcgaaatacccatcttcaacaactaaacctgatgaaggtcatgtgctgctgcggagcttatcgagggcaacgacgacgaggagaacgaggtcatgtggtttcattgcttgggatttgtcaaggacgatgggccctacgatagtgatggttgtgcatggtccttttggagaagaagggggtgacgattttcactttcttcggcattccactccctcgcctccgatgaacacttctaggttattttgcatcataaaacccaaaccccacttctag

SEQ ID NO: 105553 - DNA, 177 bp, Glycine max
  Peptide Sequence Number=SeqID_222331
atgacaaagattgaaatgtatagaagaaagagaaaattaacagggagaatcaatttaaacccattccaggacaatggtttagatactgtcgtcggcgccgcagtcgtgaacggtgatgtcgaagcggtggtttggcagctggcgatgttcaccgcctatgattttgaacgccagtga

SEQ ID NO: 105554 - DNA, 5223 bp, Glycine max
  Peptide Sequence Number=SeqID_222332
atgcagtcatttcaacagcaactgcttagaaaacctgaagggagtgaagcatttttggcatatcaagctggtcttcaaggagtatttgggagtaacaatttcccatcgagttccatgcagttacctcagcaatctcgaaaatttgttgatttagctcagcatggctccaaccagattcaaggtgttgagcagcaaatgctaaatcctgcacaagcagcatactttcaatatgctctgcaggcttcgcaacaaaagtctgctttggaaatgcagtcacagcagcaaccgaaaatgggaatgctgggcccttcatctgtaaaggatcaggaaatgcgaatgggaaatttgaaaatgcaggatcttatgtccatgccggcagtgaatcaggcccaagcatcatcgtctagaaattcatctgaacattttactcgtggggaaaagcgggtagagcaagggcagcagctagcacctgatcagaagagtgaaggaaattcttcaagccagggtgctgttggaaacttaatgtcgggaaatattataagacctgtgcaagatctggcaactcagcagagcatcccaaactctatgaacaaccagattgcaatggctgctcaattgcgggctatgcaggcatgggcacatgaacgaaatattgatctatcacatcctgcaaatgctaacttaatggctcagctcattccactgatgcaatccaggatggttcaacaaccaaaggcaaatgatactaacttaggttcactgtcatcacctatccctgtttcaaaccagcaggttacttctccagcagttgcaagtgagagttcagcacatgctcattcatctagtgatgtgtctgcacaatcaggttctgcaaaggccaggcagacggctccacccagccatttgagcccaccaattagtgccggtatagccagtagctctagtgacatggcagcgctgcaatttagtcttcatggcagagacgctcaaggatctttgaagcaatcagttctaactgtaaatggaatgccttctgtgcatccacagcagtcctctgcaaacatgaacttaggtgcagatcatcctctgaatgcaaaatcttcttcatctggttcagaaccagtgaaaatgcagtacatcaggcaattaaaccaatctgcttctcaggctggaggtctgacaaatgaaggtggatcaggaaatcacaccaaaactcaggggggaccatctcagatgcctcaacaacgaaatggttttaccaaacaacagcttcatgttcttaaggcacaaatactagcatttaggcgtttgaagaaagcagaaggtgcactcccccaagaacttcttcgcgccatcattccaccacctcttgatttgcaagtgcagcagccaattcattctgaaggagcacaaaatcaagagaaatctgctggaaatattgtggcagaacaaccgaggcagaatgaggtcaatgccaaagagtcgcagcctatctcatccattaatggaaagatctcttcaaagcaggaagtctttgtcagagatgagaactcccctgtaacagcagttcatttgcaacccacacctcctgtgacaaaggaatctgctggacaggaagagcagcagtctgttgcatgcgctcctaagtcagatcaggaaagtgaacatggaattggcagaaatgagttagtattagataagggaaaagctgttgctgctccccaggcttctgtaaccgacgcgatgcaactcaataaacccgcacaagcaagcactgtttcccaaccaaaggatgtggggtccaccagaaaatatcatggacccctatttgattttcctttcttcactaggaaacatgattcctttgggtcatcaatgatgataaacaacaataatttgtcattggcatatgatgtgaaagagcttctttttgaggaaggcatggaggtccttggcaagagaagaacggagagtttaaagaagattgaaggtttactggcagtaaacttggagaggaaaagaattaggccagatcttgtgttgaggttgcaaattgaagagaaaaaacttcgccttttagatcttcaggcacgtttaagggatgagattgatcaacagcaacaagagataatggcaatgccagataggccatatcgcaagtttgttaggctgtgtgaacgtcagcgtatggaacttgctaggcaagtgcaggcatctcaaagagctttaagggagaagcaactgaaatctatatttcaatggcgcaagaagcttcttgaaacacactgggccattcgtgatgcccgtactgctcgcaacaggggggtggccaaatatcacgaaaggatgttgagagagttctcaaagcgtaaggatgatgacagaaataaaaggatggaagccttaaaaaacaatgatgttgacagatatagggagatgttgctggagcagcagactagcatcgaaggtgatgctgcagagagatatgctgttctttcaactttcttatcccagactgaagagtatctccataaattaggaagtaagataactgctgctaagaatcaacaggaagtggaagaggcagcaaaagctgctgcagctgctgcacgattgcaggcatgcttcatcatctctcctctcattaaaagaaaaagaaaaattcagtggcctgggagaaaacctttatttttgtgtgcattttttttaggtctttctgaagaagaagtcagagtggcagcagcctgtgctggggaggaagtgatgattagaaatcgtttcatggagatgaatgctcctaaagacagttcatctgtcagcaagtattacagccttgctcatgctgtgagtgagaaggttgtatgtcaaccatcaatgttacgggcaggaacactgagagactatcagcttgttggtttgcaatggatgctttccttgtataacaacaaattaaatggaattttggcagatgagatgggtcttggcaaaactgtacaggttatggcattaattgcatacttgatggagtttaaaggaaactatggcccacatcttataatagtcccaaatgctgttatggttaactggaagcttttgttcaccatgcagagtgagttgcatacttggttaccatctgtgtcatgcattttttatgctggagggaaggattaccggtcaaaattatattcacaagagattatggctatgaaatttaatgtcctggtgactacttatgagttcatcatgtatgaccgggcaaggctttcaaaaattgattggaagtatatcataattgatgaagcacagagaatgaaggatagagattcagttctagctcgtgatcttgatagatatcgttgtcaaagacgcctgcttctgacaggaacgcctttacagaatgatttgaaggaactgtggtcgcttttaaatttacttcttccagaggtttttgacaataagaaagcctttaatgattggttctcaaagccatttcaaaaggaaggtcccactcaaaatacagaggatgattggcttgagactgagaaaaaagttatcattatccaccgtcttcatcagattcttgagcctttcatgctcaggcgtcgtgttgaagatgttgagggttcactaccaccaaaggtctctatagttttacgatgtaagatgtcagctgtccagagtgccatttatgactgggtcaaatcaactggtacccttcgtcttgatcctgagggtgagaacagtaagattcaaaagaatcctcattaccaggcaaaagagtacaagactttaaataacagatgtatggagctacgtaaaacttgcaatcatccatccctgaattacccattacttagtgaattatctacaaattcaattgtaaaatcttgcgggaaattgtggatcctggataggatccttataaagcttcaaagaactggtcatcgagttttgctgtttagtaccatgacaaaactcctagacctcttggaagattacctgaattggcgaagacttgtttacagaagaattgatgggacaactagtttggatgaccgtgaatcagctataatggactttaatagccctgattcagactgtttcatcttcttgcttagtattcgagctgctgggagaggccttaaccttcagtctgctgacacagttgtcatttatgatcctgacccaaaccctaaaaatgaggagcaggctgtggccagagctcatcgtattggacaaaaaagagaagtcagagttatctacatggaagctgttgttgacaaaatctctagccatcagaaggaggatgaggtgagaagtggaggcactgttgatatggaggatgaacttgtgggtaaggatcgctatataggatccattgagagcctcataaggaacaatattcaacaatataagatagatatggctgatgaggttattaatgctggacgttttgatcaaaggacaacacatgaagagagacgtttgaccttagagacattgttacatgatgaagaaaggtatcaagaaaatgtccatgatgttccttctcttcaggaggtaaatcgcatgattgctaggagtgaagaggaagttgaattgttcgatcaaatggatgaagaactggattggcctgaggacgtgatgcaacatgatgaggtgcctgagtggctccgagccaatacaagagaagagaagggacggcccaagggaaaaaaacatcctaattataaagagttggaagatgaaaatggagagtattctgaagcaagctctgaagacagaaatgaagattctgcacaaggggaaattggagagtttgaagacgatgtgtgtagtggggctgatggaaatcgattggaagaggatggtctaacttctgatgctggatatgaaattgctcgttcttcagaaaatgctagaaataatcatgtggttgaagaagctggttcctcaggatcatcctctgacagtcaaagattgacaaagacagtttcaccatcagtttcttccaaaaaatttggttccctttctgcattggattccaggccaggctccatttcaaaaattatgggagatgagttagaggaaggggaaattgcagtatctggtgattctcacatggatcatcaacagtcaggtagttggatccatgatcgtgatgagggcgaagatgaacaagttttgcagcaacccaagattaagcgcaaacgtagtcttcgt

SEQ ID NO: 105555 - DNA, 472 bp, Glycine max
  Peptide Sequence Number=SeqID_222333
atggactcctctaaggacaatagcatcatttcttgcattgaattgttgggagcgcctgagcccggggctaggagggcgggggcaaggccagctgagcttccttctacttctgcagctcctactccaacatccactttagtagccccttctgtcccagtggtggagccttcaggatctattccttcgatggagcagttcactgagatggtagcctggtgtcgcaacatgcccttttgtgggcgagcgaggcgaggctcacgagtgcgctttccaaaggaggaaagatgcacggagtcgccacaaacgtttatttgtggaaaatgttggaaaaaccaaaggaaaccggtcgaaaagaaaattccaagttcaggagttgtatttacgcttgaggaaggtattagcacctctcacgtcgacaaaagcggggctcttgctcctacgtaccctccatcgaagaggaaatcagacctag

SEQ ID NO: 105556 - DNA, 684 bp, Glycine max
  Peptide Sequence Number=SeqID_222334
atggggtctcttcctgattctgggtcctctttgtcttttgttttccgtaggatgatgagtgattacaaggtcgagatgattaatgatggaatgcaagaattttatgtgcaattccatggacccaatgacagtccttatcatggtggtgtgtggaaagtaagagttgagttgccggatgcttatccttacaaatctccttccattggatttatcaacaagatctatcacccgaatgttgatgagatctataagaataactgtgtcggtgtgtctggtctgatcatctgggatgacattaatttcaggtcaggatcagtttgtctggatgttatcaatcaaacctggagccccatgttcgatcttgttaatgtgtttgaggtgtttctacctcaacttctgctgtatcccaatccatcagaccccttgaatggagaagctgccgctttaatgatgcgtgaccgaccaagttacgaacaaagggttaaagaaacaattaaggtttattttttatttaattcacaattgactgatgtgtcattggcttcgatgtcagagtactgtgagaagtatgctaaacccgaagacataggggaagccacagaagagaaatccagtgatgaggagatgagtgaagatgaatatgattctagtgatgaacaggttgttggtaaagcagacccctag

SEQ ID NO: 105557 - DNA, 2061 bp, Glycine max
  Peptide Sequence Number=SeqID_222335
atgatgagtaatggtgatccattggatttgtataagcttttcatggtggtgaaggagaagggtggttatgatgctgtttgtaagaacaagttgtgggatttggtgggggaggaatatgggttgggtgtgaaggttggttcctctgttgaacttgcttatagtaagcatttgagttctcttgaggcatgtttgaagaatgttgctgatggtaagcttcccgagtgtggtttagtggatgatagggttaagtttcacaagcatttgatggaggcacaagctgaatccttgttggatgattctggtgagaaagaggtgggggatggactcgagaggagagcgtgttgctgtccggatgggaggaagttgggtggtagtaatagagtgaagggcgtgaagccggagtcaaatgtggctgaacttgagagggtatatgagtatttagatgggacaaagtcgtgtgttagtgatagtgtaaagggcaagaaatcggattataatggggatgaatttgataatgtatgtgattttctagatgggagggagttgtgtggtactaatagggtgaagggcatgagtccagagtctaatggggacaagaaagtccagagcgaaggacttgttgatttggatatgctggaccatgggacagatgagcatattatcagaaacttgtgcagccttaatactgagagggatatactggaagagtttgatggggggaaaatattaactgtggatgcatctgatgcagaaagcaacatgcctagattgtcggatggaagcaagagctgtgataacgatgatgatgacgatagtgatgatgtattgatattggatccatctggggttgacaaagagatatttggtcgtaagaggaagagagagtctaagtcagaaatgctaagttggattactagcattgctaaaaatccttgtgatcccacagttggttcgattcctgaaaagtctaagtggaagtcttacagtagtcaggagatctggaagcaggctttgctgtttcgagaagctgtctttttgaagaaagattttgagacaatcagtgaacagcttagttggcagaaaacatctttgctggagaagaaagatgggtggcggatgagaaattactccaggagtgggatattggcacaccgccgctctggcgtgttcccatgccactacaggggacagaaaatgcatccttccatgtatgatgatcgtgttggggcaatatacaatcttagacagaggttgaaatgtgacaagagagttttatttggaaaagctacatctgaaggagtctcctcagcttcatctggaggaacacatggatatttggagagaaccccaagttctcgtgctgaagattgtgctgagaaacagttgcctgactcctgtactgcacgctcaagtcttgatatatgtgccagagtgcccatccctttggggccaaaccatcaagctgaagtgccagaatggactgacataacttatgaggttgattctaagtggttggggacccaaatatggcctctaaaaactgtaaattccaagcatcatctttttgaaagggaccccattggagagggaagacaagattcatgtagctgccgagtacaaggttctgttgagtgtgtccggttccacattgctaagaaaagggctaaagttaagttggaattgggtgaggcatttcaccaatggaatttacataaggtaggtgaagaaattgggggttcatggacagagaaagaagagaagaagttcaaagatgtggtgaaatcaaaccctgcttcacttgagaaatgtttttgggatcatcttttcaaaacatttcctaagaagagcagagaagatttagtcagctactatttcaatgtctttcttttgcagcgcagagcatatcagaataggcatactcctgataacattgacagtgatgatgatgaatcagaatgcacaccattgaggaaagtttttggacatcatccaccaaaagcacgcagcttcaccttgttatcgccaaaaaaagccacattcaaaagggaaaataacaagtga

SEQ ID NO: 105558 - DNA, 1005 bp, Glycine max
  Peptide Sequence Number=SeqID_222336
atggtaatgaacaccccagagaaagttgggaggggaagcatctcaatccaaatggatcttcagctcatggcactaagacgactgaaatcatccagagaggatttttttgcctgcctgttcagttgcaaaaatgtaattagcaagctccaaaggagaatcgacaaggaaggccatcaaattgtacctttgctaacagatttgtggaagaggattgagaattctgggcatgcaggtggatctgggaacagtctgttggatttacataagattgaccagcggattgatagaatggattatagcggagtaatggagcttgtgtttgatgtacagttcatgttgaggggcgcaatgcatttctatggatactcatatgaggtaagaactgaagcaaggaaggttcatgatctcttctttgatattttgaaaattgcgtttccggatacagactttgtagaagcaagaggtgcactatctttctccagccaagttcctgctggtactgcagcatcatcccctaggcaagtgacagttggccctagcaaaaggcacagagtgaccaatgatgcagaaaccgatccatgcccgtcacaaaagccgtcacaaagcggatcaactaccaacggcgaaaacaccaggttcaaaggtcatttgccacagaagaactcaagaaccggaagcggcagtgcacgcgaacaacctcagcaggataaccctccactgcttgctcatccaggtcaattggttgtatgcaagaagaaaagaaatgaaagggataaatcattggggaagggtaggactggatcaactggtcctgtttctccacctagtgctgctataagaagtccagggtcaggttcaaccccaaaggatgctagattggctcaacagggaagggttagccagccatctcaacactcaaatgggtctgctgggtcagttggttgggcaaaccctgtaaagcgtttgagaacagattctggtaagaggagaccaagccatatgtag

SEQ ID NO: 105559 - DNA, 309 bp, Glycine max
  misc_feature (16)..(16): n is a, c, g, or t
  Peptide Sequence Number=SeqID_222337
atggagcttagttggnctgttctcattagtgaatcacgctatcctgacgagctttcgattgaatatatccatgtaagttttgaggatacttggggtgagaaatttgtgaaggtgagactaagaactagtaaaaaatgctctgaactatcaaaatatggccggagcatgccaagacatggctcggaggatagaagcaaatggtttaaggatattctttgggaagaaaaaatgaaaactgcttatgagcaaggaaggcttatgctacttcaaaacttggatccatctttatcttcatcagaggtacagtag

SEQ ID NO: 105560 - DNA, 120 bp, Glycine max
  Peptide Sequence Number=SeqID_222338
atggatgacatgttcaattctttgatcaacctgatcaccagtaaggaagaggccagaaggttggccttaaggattacttcaagaaaaattcttgtgcagaataacaccaagttgggatag

SEQ ID NO: 105561 - DNA, 453 bp, Glycine max
  Peptide Sequence Number=SeqID_222339
atgcagcatagaaatttgacttctggaaggccttctggaactgatggctccgattactcctaccgtatggtagtcgattcaaggtatcaactggttgcaaaggggaagaaacgcctgtctctctactttatcactgaggctgtgttgctgttaataggagtgacacttacatatttaccaggaatagaagcagacgctccaaatacagttgcctattcatctgttattgttagtgttgtttcactaataattgggaatataggtcgaagacgaagccggtctggtttgttgagattttatgctgctgtatcatctatagcaatgcttctcttgattgcttctcttgcccaacagcatttgctgctgaaggtaaacatgtcagtgtttgacaggagattttataagaaaaacttcattaactatcaagaaagaaacatggcagctaagaagtaa

SEQ ID NO: 105562 - DNA, 1767 bp, Glycine max
  Peptide Sequence Number=SeqID_222340
atgcccgccggtgtcatgcaccaccaccaccgcagccccatccccctctccatcgccgaggaggacgaagaggaagaagcaacccccaagcaggcgaagaaaaccgccggatcgccgccggagatgaagacaccgccgccgccgcctccggagtcgaagggcatggcttgggattacttcttcatggtggagaacatgcctggaccttctctaagtgctgaagatgataatgatagtcatattcatgatgatgatggtgagggtaaaatggagaatgtggttgaagatgaggttgagcctaagacaccagagaaagtgcaggagcatgaaaatgtaaacgttcatgaagagcatgatgatgagataagtgaggcgaagaaacacattgagcactctaaaactgctccagctgagtttagaagagctataaaggtggttccttctgttactcttatgcagattctcaatgtccttgatgatcacttcttgaaggcctccgagggtgctcaggaagttaccaagatgcttgaggccactaggttgcattatcattccaatttcgcggataatcgcgggcacattgatcattctgctagggttatgcgtgtcataacgtggaataggtccttcagaggtgtgtccaatggggatgccgccaaagatgacattgattctgaggagtatgaaactcatgccactgttttggataagttgttggcatgggagaagaaactttatgaagaggtcaagcaaggtgagcttatgaagtttgaatatcagagaaaagttgcaattctaaacaagcagaagaagcgtggtgccagtgctgaatccttagaaaagactaaagcagctgttagtcatttgcatacaagatatattgttgacatgcagtcaatggattcaacagtttcagaagtgaaccatattcgagacgcccagttgtatccgaaacttgttgctcttattattgagatggcaaatatgtgggaaaatatgtgcatacatcatgacagccagctgaaaatagtaacagacctcaaatctcttgatatttctcaagctcctaaggaaacaaccaagcatcattacgatcgcactgtgcaacttgagaaagtcatccaggaatggcatttacaatttgagaagcttgtaactcaacagaaacattacatcaaagctcttaacagctggctaaagttaaatctcattcctattgaaagcaacctaaaagagaaaatctcatcccctccaaaggcacagaatccaccaatccaagcccttctccatgcatggcatgattatgttgacaagcttcctgatgagcttgccaaatctgctatttcctcctttgttgccgtgataaagacaatcatacttcagcaggaggaagagatgaagttaaaggagcgatgtgaggaaaccagaaaggaatacttcaagaagaaacaagcatttgaggaatggtaccagaagcatttaatgcggagagggcctgatgaagcagaacatgaaagaggagaggaagtaaacgcaaacaatcctgtctcagagaggcagtttgttgttgagagcttgaagaagagattagaagaggaaattgaatctcaccaaaaacattgtgttcaggtgcgagagaaatcactgcagagtctcaaaactcgcttgcccgaactcttccgtgctttgtcagactatgctcatgcctgtgctgatgcttatgagaaactgaagttaatcacacagtcacgaggtggtgaggcatga

SEQ ID NO: 105563 - DNA, 1563 bp, Glycine max
  Peptide Sequence Number=SeqID_222341
atggagacaccattaatgttcaacagtgatctcaattccacggggaccacagagctccaatatgctcctgagggtctagttgacacaaatggaggagactacactgaaatgagtggccttgcagatttcaaaaatgtgttctctgtggaatccgtaaagctctggacaattgctgcacccattgccttcagcatactatgcaattatgctgtcaattccttcacaactatctttgttggccatcttggagatttagaactctcttcagtttcactctctctctctgtcgtttcaaatttctcttttggcttcttgcttggtatggcaagtgcactagagactttatgtgggcaagcatttggtgctggacaagtagaaatgttaggggtctacatgcaacgttcttggttaatcttattgggtgcatgcatctgcctcacaccaatttacatttatgctgagccaatcttgttactccttggacaagaacctgaaattgcagagttagctggtgtatttaccattcaatccatccctcagatgttttctctagccatcaatttccccacccagaagttcttgcaggcacaaaccaaagtgggatttcttgcatgggttggttttggagcctttatttttcacattatacttctatggattttacttaaagtgcttgcattgggtacaactggtgctgctgtagcctatagcacaacagcttgggttattgctttggctcaaacagcttatgtgattggttggtgcaaagatgggtggagaggcttctcgtggttggcattcaaggatctttgggcctttgtgaaattgtctgttgcttcagcagtcatgctatgcttagaggtttggtattttatgatcttaattgtgctcactggacaccttgacaatgcagttattgctgttggttctctttcaatatgcatgactatcaatggatttgaaggcatgttatttatagggatcaatgcagcaattagtgtgagggtttccaatgagcttggatcaggacgcccaagagcggcaaaatattcagtcattgtcacaattattgagtccctcgtcattgggttaatttgtgcagccattattttaataacaaaagatcattttgccatcattttcactgagagtaaagagatgataaaagcagtttctaaattagcaggccttcttgggttaaccatgattctgaatagtgttcagccagttatatcaggtgttgctgtgggaggagggtggcaggctttggtggcttacatcaatctattttgttattacatcatgggactccctcttggcttccttttgggttacaagttgggttacagagtggagggtatttgggttggaatgatttgtgggacaatattgcaaacgctcatcttgttgtacattgtctataaaacaaactggaacaaggagggcaaattctcagcaaccagtcacacattaatctctttcaaaccaagagatggctgcatagagatggctgaagtggactttatctctcttaacgaatattttttcatatatagtcagtga

SEQ ID NO: 105564 - DNA, 309 bp, Glycine max
  Peptide Sequence Number=SeqID_222342
atgatttattcaatgtggttgcgacaaaattttcaagaacttcctattgatgttgatgatgttgtgattgcacaacatgctagagctcatatcatgatgctcataggcagatgtttgatgcctgagacatcgggagcaagaatgcatgacatgggtcatgaggatgaggaggaagatgatgataacaacaataacaacaacaataatgataatggtgatgatgataatcatggcgatgctcatggtgcagcaccaaatttcaaaaacagatgtgatctacctcaagagaaagaggtcggaagagggtga

SEQ ID NO: 105565 - DNA, 492 bp, Glycine max
  Peptide Sequence Number=SeqID_222343
atggaatctgcacttttcttctccttcatcttcgtattttgcttcctctgtcttgctttgcttgttctcctatttgtttgtttgtttttcattttctatggtgttgtagaagctttgacgattaatgagaagtccatatttttgaagaggtcactgcaaacatcgagaagggagggtgaaaaaaatcgtaggagagctagacaacatggagttcagtggggccatcttggccaacttctccaaggtgttgaccgcgcagaacaagattcaacaacagcagtggaaagagagcaaacttgtgcaacagctgaaatagctcaaccaagtgcagcacctgaagtaacagttatttcaaactcaaattcagcctcaccgactcaagcttcacaaaggttgagtagtgctcctggtgtcaacctagttgagatcatcggccctattttgatgcctctcatgttgcaacccttaataaaagaaaagaagtttgggtga

SEQ ID NO: 105566 - DNA, 2241 bp, Glycine max
  Peptide Sequence Number=SeqID_222344
atggatgggataaatggtctagatgtggagcagtgctttcctatgcagaagaatatcaccatgaaattgacaaacaatcagatatctccaggtgtttggtacattggtcttttcaatggcattggacctacaaggacacagtcaaagatgattatccgcggtccatcatattccttcattgctaatataagtgtggaagcatgcacaaattcaatgatgaggggggatttctgtaacagttcagtttatccactttcatgtgcagcatctgttgtgtctaatgctttggaagctaaagtgaacaagtcaatgttggaaaacttggtgacatgcaaaagtaattttgaagctttttgtgttcatgaaggtgtgccaaacttcttctccctggacataatgaatgtggcagaagaaataatcattacagcaacaaatatcagattcaatgttactggatcaaatgatattagtttaatgtgttttgtccgccatggtgcaatgccgtctgtgacttcaaatgattattccattgatatttctaaaagcccactggttattcattcaccattaattggccgttggtacattagtatagtaccagtcaatcttacaaagactcaggataacaacgtaagagtttgctattcagtggaatctcaagtgcctcaatgcccactagggaaagctggaccgaattgtacaatggatagctacttgcttcagtgcttgtcccttgggagttcacttattggcttcttcactgggataaatttctttttgagatcttggagatttaaactactttatgcccagtgcttacagaaaaggttcaagaatttgttcaggaagtactacctactacccaactggatactgaaacattattttttcttgacatttgtaaggagagggtcaaccccctttgagtcatattatttaccagttgttggaggagtatcgtatgattctgccaatttccctctcgagccacttttagaaaactcatcatacattggagaacctgataacgtatggacttactttcttttggacattcctcgtggtgcagctggaggaaatattcacatacagctatcctcagatatgaagatcagttatgaagtgtatgctagatttggtggattaccatctcttgatagctgggactattattatgctaacaagaccaggagaagtgatccatccgtgtttttcacgctatatgactcaagtgatgccaaagttaatttttatattatgtatgctagagaaggaacttggggtatcggtctaagacatcttaataccagcagtgattccatgaaagggctaactagcatgtctatttcacttgagcgatgcccaaaacgatgttcctctcacggagaatgtaaattttcttttgatgctagtggattgacatcgtacagcttctgctcttgtgatcgaaaccatggaggctttgactgtagcattgagattgtaacacatcaagggcatgtacgtcaatcaatttttctcattgtatcaaatgctgcagccatacttcctgcctattgggcccttcggaagaaggcattagcagaatgggttttatacacatccagtgggatttcaagtggactatatcatgcgtgtgatgtaggtacctggtgtgcattgaactataatgtcttacagttcatggacttctggctctctttcatggctgtgattagcacttttatttatctagctaccattgatgaagtacttaagagagcaatccacacagctgttgctatccttactgccctaatggctgcaacgaaagcaaccaggtcttccaatgttattcttgtaattgtcattggtgctcttggtctgtttattggatggttgatagaaatctcaacaaagtataggtccctttccttttcaattggaatctcatttaatttctctcagtgtttccaaactattaagcggtggatctataatcttgccaagacacttttgagacggtaccactgggcttttgccttggctggttttcttgcattggccatggcagcaataagctggactcttgaaaccagtgaaacgtactggttttggcatagcatttggcatattacaatatacacatcttctttcttcttcctttgttcaaaagcaaatattgaggatacagagaatcagcttcctacaaatggaaactatgaactgactcatcaggattcacttccaagaactggttag

SEQ ID NO: 105567 - DNA, 138 bp, Glycine max
  Peptide Sequence Number=SeqID_222345
atggcatggacaagcatcaagggaccaaaaaataggctaagtacaaagaaatggagaaggaagtggcaagctagtagtaccctgttcgcaagggctgactggccttttatcaaatttgaaagcaaaactaactcgtaa

SEQ ID NO: 105568 - DNA, 270 bp, Glycine max
  Peptide Sequence Number=SeqID_222346
atggagtatggagagtgggatacgctagttagggaattgggatggcctaatttttcatggcctgctatgaccccttcacaacaacatgatttcccaattccaacacctaatgtcccattaggtactcaatggaatgtaccaggagcaatacctgatatggaggaattgttagctgttgatttacgtcaccaattttctactgaggctgaccaagttgaagcggggggacatcgaggcaaaagaaattccgataggcaagcacgaagataa

SEQ ID NO: 105569 - DNA, 1468 bp, Glycine max
  Peptide Sequence Number=SeqID_222347
aggattgcacatcctcaccttcaaaggactacatctacttgactttagagggctacacgtcctcgccttaagagggttgcacatcctcgccttcagaggactacaggtcctctcctttaaagggctgcaagccctcgcctttagaggactggatgtcctcgccttcggaggagtacatgtcctcgactttagagggctacacgtcctcgccttaagcgggctgcacgttctccccttaagagggctgcacgtcctcgccttaagaggaggactacacgtcctcaccttcagagggcttcacgtcctcgccttcaaaggactgcacatccttccctttagaggactgcacgtcctcgcctttagagggctacgcgccctcgccttaagagggcagcacatcctcaccttcagagggctacacaccctcactttcaaaggattgcacgtcctcgccttcagaggactacatgtcctcgactttagggggctacacgttctcgcctctagagggctgcacgccctttcctttagaggattgcacatcctcatctttagaggattacatctcctttactttagagggctacacgtcctcgccttaagagggttgcacatcctcgccttcagaggactacaggtcctctccttcagagggctatgcgccctcgccttaagagggttgcacgtcctcgtcttcagagggctgcacgcgcttgcctttagaggactggatgtcctcgccatcagcagagtacacgtcctcgactctaaagggctacacgtcctcgccttaagtgggctgcacgtgcttgccttaagagggctgcacatcatcgccttaagagggctccacgtcctcgcctttagaggactacacgtccttgactttagagggctgcacgtcctcgccttcagagggttgtacatcctcgccttcagagggctacacgtcctcactttcagagggttgtacgtccttgccttcacagggctacacatcctcgcctttagagaacttaagtggttttcttttatcagttcttgggccatcccctttgatcttggaggagggccaactatgcgagcacaaccaaaggaggaggctattgcccaactactatgcataccggggcaagatttcgcccagaccgttggcgaggcaccacagcagcctggggatggccagcagtgggtgatagacacaccgccaccacctccagagtccacctcagctcatttacaaaggttgaagcattgcctacgacacatggtccaccagcagatggctaaccaccggggcagctccccacgaagcgatccaggaagggcaccattgaagagggttccagtgcggccccacaagccgacacaggctttgacaaacaccaattctagagtgcagaacatcagtagcgtttccaggccatcgagggatggtcattcctcagacagagacaggggtagctga

SEQ ID NO: 105570 - DNA, 352 bp, Glycine max
  Peptide Sequence Number=SeqID_222348
gggtacgttttgtgatgaagaaatgaccatgtgtgatgggacaaactccttctggtgtgaacatggggcaacttgtgaggagattgttcaaggagagaagtactcttgcaaatgtccccctggatttgctggggagcattgtgagcattctggagcatcttgtggtcagactttttgcttccataatgctgaatgcttggctgaagcaggtgatgtttgccagtgcccttctgaatggaaaggcagtgccgattgctctcttccaaccacaccaacaggttctactctcccttcttcctttcacaaattacaaccaagtttggatgctgttgaaatgaagagagttatatga

SEQ ID NO: 105571 - DNA, 174 bp, Glycine max
  Peptide Sequence Number=SeqID_222349
atgggaaggggcacgtcgacgcgggaagcgttgtcggcggcggtgcttgctgatcgggccagcctaccaggcgtgaccaaagacggcgtcaggcgaggcgctgtcagacgcgtcggtctggcgcaaccagacgcgtcagtctgctgtgcatacacaaattcacacggacgataa

SEQ ID NO: 105572 - DNA, 384 bp, Glycine max
  Peptide Sequence Number=SeqID_222350
atgggtgtgacttgcattgttattaaactaataaatgcacgaagaataaataggaccacgggcgcgctccgccacggggccaagctagggttcgatttgttcaagccgcaaggtgaggccttggatttcgtcaccaacggatcacggtttgcctgcaggagcacgacactcacgagggtgattttaggctatgctgcgctggggaacatggcgctgctcctcatcgcggcgagtgttagaatcaccaaagggagaggtaggggcagatcgatgcaccagagagagagagcgagagcaacgacgtggtggcacgatggagggagagggcaactgaggaaaaggaggactaggggtgcgagcaacagaggagacaacaaggcatga

SEQ ID NO: 105573 - DNA, 1917 bp, Glycine max
  Peptide Sequence Number=SeqID_222351
atggtgatggatgtgtacctagattatatgctgcttacatatagaccatttgatgtccacatattccatgtgaaattatttggtgaattaactccttcaggaaatccagatttacagctttctgcagtacgagaactttcaattatgactgccaagagccatcctgcagcaatgcgattcattcctgatcaatttccaagagaatctatttcaaacatttcggtttcgtcagattcattaacaagagagccagcaagatgtttgatattgagagcaaatggggagctttcacttcttgacttggatgatggacgggagagaaaccttactgattcagttgaactattttgggtcacctgtggccagtctgaggataaaacaaatttgattgaggaagtttcatggttagattatggtcatcgaggcatgcaggtttggtatccatctccaggtgctaattcttttaagcaggaggatttcttacagttggatccggagctggagtttgatcgtgaagtataccctttgggacttcttccaaatgctggtgtggttgttggtgtttcccagagaatgtcatttccagcaagtgctgaatttccatgttttgaaccatctcctcaagcacaaacaatactgcactgcctactccgccatcttcttcagagggacaaaattgaggaagccttaaggcttgcagagctatcagctgagaagccccatttttcacattgtctagagtggcttctttttacagtatttgaagcagagatatccaggccaaatgtgaacaagaaccagatctcagttgttaatcatgctaaaaggtctcttttagagaagacctgtgacctgatcaggaattttccggagtaccttgatgttgttgtaagtgttgcaagaaaaactgatggtcgtcattgggcagatttgttcactgctgctggaagatcaacagaattgtttgaggaatgctttcaacgtagatggtatcgcactgcagcttgctatatacttgtgattgccaaacttgaaggtcctgctgtcagtcagtactgtgcattacgattactacaggcaacacttgatgaatcattgtacgagcttgctggggagctggtgcggttcttgctaagatctggtagggaatatgaccaagcatcaaatgattcagataaattgtctcccagatttttaggctattttctttttcgttctagtgagcagaagcaatcactggataaaagcacctcattcaaagaacaaagtgctcatgttacctctgttaagaatattttagaaaaccatgctagttacctgatgtctgggaaagagctctccaagcttgttgcatttgtaaaaggaactcagtttgatttagtggtacttattctaatccctgagtatctacaacgtgaaagatatggaagtgctcggttggagaattttgcttctgggcttgaactaataagccaaaagcttcaaatgggaacattacagagccgtttggatgctgactttctcctatctcatatgtgctctgttaagtttaaggaatggatagttgtcctggctactctcttaagacgttctgagcctctttgcatatgcaagggtaaggctgcgtacaacatccctcccccataccttcgcatagcgaagagcctctggacaatggggtcttatagttgtgtggttctttttgacttattccgtcatgatgttcgtctgtggaaagcatacagcaccaccctggaggttatatgtcttgacgtcattgtatccttgaatgaacaaaatatgatgttcctgtcggttttctatgaacagtcacacccagcatttacagaatatcaagatttgctggaagacctggaagagagcctttcatcagttgcaaatgtggaaggaaaatga

SEQ ID NO: 105574 - DNA, 1728 bp, Glycine max
  Peptide Sequence Number=SeqID_222352
atgtcattctcattctcattgtcaagaaggttaagctcttctctctctcattccattcccaactttcctccttttcttccaaaccccactttccctttttactttcactctcagcctccatccattcacgatgttgtccatgatgctgtttcccagttcaatggcatgctccttatgcgtaataccccgtcgatcatcgaatttggcaagattttaggatccctcgtaaagatgaagcattttcccactgccatttccctttctaaacaaatggaagtcaaaggaattgagccagatcttgttactttgagcatcctcatcaattgtttctgccacttgggccaaatggccttttctttttctgtattgggcaaaattctaaaattaggttatcagccgaataccataatcttgactacactcatgaaaggtctgtgtctcaagggtgaggtaaagaaatcactgcactttcatgacaaggtcgtagcacaaggatttcagatgaaccaggttagttacgggaccctgctcaatggactatgtaaaataggagaaacgagatgtgccatcaagttgctgagaatgattgaagacagatcaactaggcctgatgtggtaatgtacaacaccatcattgatggcttatgcaaagataaacttgtaaacgaggcttatgatttttatactgaaatgaattctagaggaatttttcctgatgttatcacttacagtactctaatatgtggcttttgccttgcgggtcagttaatgggagcattcagtctattaaatgaaatgacattgaagaacatcaacccggatgtttatacctatactatattgattgatgcattatgtaaagaaggaaagctgaaagaagcaaaaaatttattaggtgtgatgacgaaagaaggagtaaaacctaatgttgttacttatagtactttaatggatggatattgtttagttggtgaagtgcataatgcaaaacagatattccatgctatggtccaaactgaggtaaatcctagtgtttgcagctacaatataatgattaatggattatgtaagggtaaaagcgtggatgaggccatgaatctcctaagagaaatgctacataaaaatgtggttcctaataccgtgacgtacaattctcttattgatggtttgtgtaaatcagggagaattacttctgctttggatcttatgaaggagttgcaccacagaggtcaaccagctgatgtaatcacctacacttccttattagatggtttatgcaaaaaccaaaaccttgacaaggcaattgcactattcatgaaaatgaaggaacggggaattcagccaaataagtacacatacacggcacttattgatggattatgtaaaggtgcaagacttaagaatgcacaaaagctttttcaacatatcttggttaaaggctgttgtatagatgtctacacatataatgtcatgattggtgggctttgtaaagagggcatgttggatgaagctttggccatgaagtcaaaaatggaagacaatggttgcatccctgatgctgtaacttttgaaatcattattcgttctctttttgagaaggatgagaatgataaggcggagaaacttctccatgaaatgattgctaaaggcctattacattttaggaattttcatggtgagcgatctccggttacaaataaagttattgtgaattttcatggtgagtga

SEQ ID NO: 105575 - DNA, 165 bp, Glycine max
  Peptide Sequence Number=SeqID_222353
atggttactatagcatgctataataatcgtcattatgttgttggaagaagaagcagcttggtggaccgtgtcaattatagtcaaccttggaagaccatgtcaagacaacattgggtgcatgctatagtgatcgctattgttgacatatgggtagtaggaatatga

SEQ ID NO: 105576 - DNA, 705 bp, Glycine max
  Peptide Sequence Number=SeqID_222354
atgccagatggcatgcatctaagctgcgacatctgttacataattttggcatcctattcattcatactttttgatgtatatggcaacgtgtttggactcctagcagcacatcccattacacccctagtttccatgcatcatttggacgtggttgagcccatatttccaaacgtggaccgtgttgaggccctaaagcggctgattgggcccatgaaactggactcatatgggctgatgcaacagtccatttgctacgacaaagcccggcattggaccatatccgtgtcttggggctatgcggttcaaatattccggggcattttcttggcccgggacatggagattccggccagaacctttttgaattggtaccggcggggagattataccagttttccgttcaacacgcgccctttcagtcgcaattcttgccagaaaccttttgttttttacctgtcaaatgcaacctttggtggagttggtgatgaaactatgagtgagtatattcgggtccagcccaacccggactgtaaatggaaaatgcccgatccgacccaaatccaagtaataaaggtccataagaaacctgacccacatttgtgggacaagtctcctagaagaaattgttgcagggttcaaccgtcaaagaaagatggaactctggtgattgacgtgggagaatgcagaaaagatgattgctcatga

SEQ ID NO: 105577 - DNA, 228 bp, Glycine max
  Peptide Sequence Number=SeqID_222355
atgcaagtagagttcaccttaaacaacatcggtcgattgaattttttcgacatgaacctcatcgatagttacaacctctccatgaccattgaactatgggccagaactggtttaaaaaactacactgccatgggagccaaaagagccaccatcatcggtaacgcgagtttaacgtggtttgggtttaaactatcagaaggacaaacgtactactacgagtatctttag

SEQ ID NO: 105578 - DNA, 1908 bp, Glycine max
  Peptide Sequence Number=SeqID_222356
atggcgaggacggaggaagagagagtcgtgggaaacgagtcctcgtccgacgagaaaaatgacctggtggaggagatccaacaggtcatcgaatcggtggttcaattcggcgactaccggaggacgcagaggaaggaaagccacaacctcgtgcgccgtttcaagctcatgttgccgctcttggaagagcttcgtgacctcccacaacccttccccgaaattggcgtcgcttggttaaccaaactcaaggacgcactcttgctcgccaaggatttgttgaaactatgcagccaaggaagcaagattcacctctctttggagaccgaggcagttatgatcacgtttcggaaagtgtatgaaaaattaagccaagcgtttgatggtgtgccttttgatgaattgggtatctcagatgaagtcaaagaacagcttgacctaatgcacgtgcaactcaggcgagccaggagaagaactgatacgcaggacatagaacttgcaatggatatgatggtggtgttctctgatgatgatgacagaaatgctgatagtgctatcattgagaggttggctaaaaaattggagcttcatagtgttgaggatctcaatatagaaacattggctattaggaaccttgctgcagaaagaaaagggcaacagactgagagtactcagaaaataattgaccttctcaacaaattcaaacgaattgcaggcatggaagaaaccagcgtccttgatgatcctgtcgtgtccaagatgcttgagaggtgcacctctttggtcatccctcatgagtttctctgcccaattacactagaaatcatgacagatcctgttattgtaacaagtgggcagacatatgaaagggaaagcatagagaagtggttccaatccaaccataacacatgccccaagacaaggcaacctttggaacacttgtcattggcaccaaactgtgccttgaaaagcttgattgaagaatggtgtgagaacaacaacttcaaactccctaaaaaatacaattcttcaggtaaagaaagctgtcctatagacagcaaagaggaaattccagccttggttgagagcctatcatctattcatttagaagagcagagaaaagcagtggagaagatacgtatgctatcaaaggaaaatcctgagaacagggttttggttgctgatcatggaggaataccaccactagtgcaactcttgtcatatccagattcaaaaatacaagaacatgctgtgacagcacttttaaatttatcaattgatgagggtaacaagagtcttatatccacagaaggtgccattccagctatcatagaagtgttggagaatgggagttgtgtggctaaggagaactcagcagcagctttattcagcttgtcaatgcttgatgagattaaagagattgttggtcaatcaaatggattcccccctttggtggatttgttgaggaatggaacaattagagggaagaaagatgctgttacagccctttttaacttatgtatcaaccatgcaaataaaggtagggccattagagctggcattgtgacacctttgcttcaattgctcaaggacacaaacttaggcatgattgatgaggcactctccattttgttactccttgtatcaaattcagaagcaagacaagagattggacaacttagtttcatcgaaacccttgttgacttcatgagagaagggagtccaaagaacaaggaatgtgcagcatctgttcttcttgagttgtgctcaagtaattcatcctttacattggcagcacttcagtttggagtgtatgagtatttaatggagataaaacaaaatggaacaaatagagcacagaggaaagcaattgcaatcttagatctcattagcaggagcgagcaaatttaa

SEQ ID NO: 105579 - DNA, 540 bp, Glycine max
  Peptide Sequence Number=SeqID_222357
atggtgatgatgatggtgttagtagcgatgacattagagatactagtggttgttgtgatggcactaacagaagaggcgacaccgatggtgccaatggtgtcggcagttataatggtggtggtaatgacatccaatggtggcaatagaggtgctagcagtagtggtggtggtgacaatgatgacggtggcggtagtgataataatgtcggtaaaaatggtggtggcactcactatgttagtagcggtggtggtagcagcaacatggtggcaaagatgatggcggtgacaattgttgtagcggtgttagtgttggcagtcaacggtggtgatgacgaaggtagtattaattgtggtgacaatgacaatgttaatgacggtaacaacgacactaatagtgacattgacgatagttatgatggtggtagtggtggtgacaaaaaaaagtgtgatggtcaaatatgggaaatgcctcttgaaactaaaccaaattttacaaaatcttttttcttggttttgaaaatcaacgtaaaagtgttttaa

SEQ ID NO: 105580 - DNA, 330 bp, Glycine max
  Peptide Sequence Number=SeqID_222358
atgttttcagagaggcagaaacatggatggagaggaacgagaaggatcacttctttatacttttctcgtttccctgaagaatatctagaatctaatctatcaaatgtcttcagcagatggggtaaagtctgtgatttgttcattgctaagaaaggtttcagatttggatttgtcagatatgaaggtgatcacaacgaaaaggagcttgaatggaatctcgatcaaaaaattgtcaatggaggcaacaaaatgcacgttaatgctcctcgatacaggaaaatgaatggaaaagaatatcagaacatggaaaggatagaaggaactcattag

SEQ ID NO: 105581 - DNA, 429 bp, Glycine max
  Peptide Sequence Number=SeqID_222359
atggcatccttaggacttcatccagctgatgtttatcgccagtttcatcatccaccacccttaccttctctggcttctcactcggaaccgcaaagagatgtaagcaatttacatgatgatgaagatgatgatgatgattatgttgtgtctaactcatacgttgaagagtctatagatgaagacaacagtgttgatggtatatctaatatcgatgatgaagtcaccgatatgattcaactagttacaattgttcacccaagagaaggtgtagaaggaattcaaaatccattttggaatgatgctttgcattataacaatatcaattggagtcatcctgatgaggaggacatttgcggtttggagatgctatcgagttttaatgttgggcaagaattatatgttggcatgaattttgatagtaaggatgcg

SEQ ID NO: 105582 - DNA, 306 bp, Glycine max
  Peptide Sequence Number=SeqID_222360
atggagtcaggtgacatgcgggggtaccgtattgttactcgcaccttttgtcaaccaggggcaaacgaacccgttgacgcgcagagactaacatcatcttctgcaccttttggccatccagggacaacgagttttttctctcgtcgtccgaacgcattcaagcccgatgacgcacgagattcttctctgatgggtggggacgatcaagttcgatggcatagggaagtgtcgtggttgtcccgctttatcgctttcaaagacactgaagttttgttgacacttctgatgccttttctttctttttga

SEQ ID NO: 105583 - DNA, 750 bp, Glycine max
  Peptide Sequence Number=SeqID_222361
atggccagaggaggaaccaggtgcgatgggtttgatgaggaggccatcgctcagttgctatgtataccggggcaggattttgcccggactgctgctgggagacgggtgcagatcatgcgcaccaacatgaccaccctgacccagatatggatgacgttgctgctcagcaacatccagcccagcgatcataattccgacctccccctaccgaagtgtcagctggtgtacgccgtcctgacacggatgagcattcacgtggctcagttgatcgctgatgccatttatctatttgcaggtatggcgccgactaggcaccctttggacccggataagtccaacagggccctgggatttcccgcattgatcacaggactttgtcagtcgttcggagtccccgtcgcacctagcaaggtgattcgtccacccatcacccgggcttttattgagaagtattgcacgcagagaccggcccagggtgattcaccacaggccgcagacacgccgccacctcatcaggctggtccagctgggcgaccaaccaccggggcgcacgtgcagacccatgactgtcttttaccagctgagcctcagcctgcagagccaggggcagaggtcgcatggcccggagattggcctgaggcccaggcaggggaggcacccgcagaggctcccggcgaggcagatgaggctcgcgaggacgaggagatgaccgatttgcttgatttcttgggagggagcggagccacatga

SEQ ID NO: 105584 - DNA, 195 bp, Glycine max
  Peptide Sequence Number=SeqID_222362
ctcagcaattggactaagcgtgcatccaccgctaagcacagctttagcgcacttagcgcgatagaagaatttggcagggcatcaatatcaaggctgcacgctaagcgcgagatcagtgcgctaagcgcagcaagtgccttcagccaggctaagtgcaagactggctctaagcccaatttcacttacccgcgctaa

SEQ ID NO: 105585 - DNA, 1023 bp, Glycine max
  Peptide Sequence Number=SeqID_222363
atggctcttgagtcagctcctgcttcagctgacatcagaggagttcacactcatggtggaggctatgttcagtataatatctatggaaacctctttgaggtctctaggaagtatgtccctcctattcgccctgtgggaagaggagcatatggaattgtttgtgctgctgtaaatgcagagacgcatgaagaagttgccattaagaaggtgatagcccttaaagacattattcgaccaccacaaaggtataacttcaatgacgtgtacattgtttatgagttaatggatactgatctgcatcaaataattcaatccaatcaacaattgactgatgatcattgtcggttgttacgaggactcaaatatgtacactcagcaaatgttctgcaccgtgatctaaagcctagcaacttgctactgaatgccaactgtgatcttaagattgcagactttggtctcgctagaactacatctgagactgatttcatgactgagtatgtggttactcggtggtaccgagctccagagttacttcttaattgctcagaatatactgccgccattgatatttggtctgttggttgcatccttggtgaaatcataacaagacaacccctatttctggggaaagattatgttcatcagctcaggctgattacggagctcataggctcacctgatgacactagccttggatttctacgaagtgataatgctcgtagatatgtgagacagcttccacaatatccaaggcaacaatttgctgctagatttccaagtatgtctcctggtgctgttgatttgttagagaagatgcttgtctttgatccaaataggcgcatcacagttgaagaagctctgtgtcacccatacttggctcctcttcatgatattaatgaggaacctgcttgcgttagacctttcagttttgattttgagcaaccatctttcactgaagaagatatcaaggaactcatctggagagaatctgtgttattcaatcctgatccacctatttattga

SEQ ID NO: 105586 - DNA, 1356 bp, Glycine max
  Peptide Sequence Number=SeqID_222364
atgtcaatcttcgacggagctttcatgaacacgcaactctccaagcacacttcgatcttcggcctccgtctctgggtcgtgatcggaatcctcattggagtcttcatcgtcttcacgctcttcctcctctccctctgcctcgtctctcgccggaaccgccgccgctccgtcgccgtccccggctacaaggtcaccggagacgccgacgcggcgaaggacatccacacgatcgtgcaccttcccgggccccacatgctccggccggtggcgccggagatccacgtggagatggggaagaagacggagcaccgggtggtggtgcagtgcgatggggtttcgagcgaggagagtaaggtgacggtggggagtgggtgtgaaacgacgtcgtcttttggaagtgggagtgttggtgggcttgggcttgggtctggacctgggcttgggcctgaggtttcacatctcggatgggggagatggtacactctgagggagcttgaggatgccactggaggattgagccctgaaaatgtggttggtgaaggtggctacggaattgtctatcatggagtactcaatgatggtaccaaaattgctgtcaagaacctcttgaataacaagggacaagctgagaaagaatttaaaatagaggtagaagcaattggtcgagtgcgacacaaaaatcttgttaggctgcttggatactgtgttgagggagcctacaggatgcttgtgtatgagtatgtagacaatggcaatctagagcaatggctgcatggggacgttggagctgtaagccctttgacatggaacatacggatgaacattatattgggaactgcaagaggattggcctatcttcatgagggtcttgaaccgaaagttgtccaccgagatgtgaaatcaagtaacatacttattgatcgccaatggaactccaaggtttccgattttggacttgctaagcttttgtgttctgagaatagttacgtcacaactcgagtgatggggacatttggttatgttgcaccagaatatgcatgcactggaatgctgactgagaagagtgatatttatagctttgggatacttatcatggagataatcaccggaagaagtcctgttgattatagtagaccgcaaggagaggttaatttaatagaatggttgaagactatggttgggaatcgaaaatccgaggaagtagttgatcctaagctccctgagatgccattttcaaaggctcttaaacgtgctttgttgattgctcttcggtgtgttgatcctgatgcaacaaagaggccaaaaatgggacatgtgatacacatgcttgaggcagacgacctgttattccatact

SEQ ID NO: 105587 - DNA, 251 bp, Glycine max
  Peptide Sequence Number=SeqID_222365
taattaaggatcatggaatccaaacacagtctgagctaccagttgtagacttcaccaacaaaaatctgaaaccgggtactgatgcatgggtttcagcttctcaagtagtgcgtggtgcacttgaggatcatggtggtttcttggcactctatgataagaaacaaaacggaggaaaaccactgaaaagcctatattcagctattctgggcaacgacctgggattcctttatatgaatctgtgggtatcatga

SEQ ID NO: 105588 - DNA, 960 bp, Glycine max
  Peptide Sequence Number=SeqID_222366
ataacagatttgcccttttctctgtactcaacttttgtgattgaggcccgtcatggttttaataagcaaacaccatggttattctttagggacatgcttaaaggaattttcctttctgtaataattggtccacctattgtggctgcaatcattgtaatagtacagaaaggaggtccatacttggccatctatctttgggtttttacgtttggtctttctattgtgatgatgaccctttatccagtactaatagctccactcttcaataagttcactccaatcaataactgctgggttaaagctgtaaacataattagcaaattaacggggttgggttggcttccagatggtcaactcagggagaaaatcgagaaacttgcttcctccctcaactatccgttaaagaaactatttgttgtcgatggatccacaagatcaagtcacagcaatctgaatagcagtggaatagattacagaacacaaagcacgtatacagcagggagtcatgcctatatgtatggattcttcaagaacaagaggattgtcctttatgacacattaattcaacagtgcaaagacgatgaggaaattgttgctgttattgcccatgagttgggacactggaagctcaaccatactgtgtacacatttgttgctatgcagattcttacacttctacaatttggaggatatacactagtgcgaaattcagctgatctgtatcgaagctttgggtttgatacgcagccagtcctcattgggctcatcatatttcaggctgatggctttgccaagaagcttggatatgcatctggattacgcggtggtcttgtgaaactacaggaggagaatctgtcagctatgaatacagatccttggtactctgcttatcactattctcatcctccccttgttgaaagattggctgtgctggacgaaccggataagaaggaagactaa

SEQ ID NO: 105589 - DNA, 456 bp, Glycine max
  Peptide Sequence Number=SeqID_222367
atggaaaaattgctgcacctcatttctagagcagtagaagttggtgattgcaaatctataacagtgggtagaaatgggaccaaaattttgcatttaatgtttgcggatgacttgcttctttttgggcaagtgaaggagaagcaaatgcagtgtatgcacgatattattgtagattttgaagacatgctaggtgaagaccaagctctcaagttgaaagagtcaacagttatctcttgtaggaaaaataactattgccaaatctggcatttagtctatcccggtgtacactacgatgaatacaaccatccccaaaatggtgttgaaagaaattcagaagatggaaatgggtttcatttgggtgattcgaatgggcaaaggaaatttcatgttgttaattcgaatagtatgatcaagtcaaaaagtattggaggaatacctattgtgcttctgatataa

SEQ ID NO: 105590 - DNA, 123 bp, Glycine max
  Peptide Sequence Number=SeqID_222368
atgggtctttcaccattgcagaaatgcactgctgctatccataatgcttataggggtgggaataggccagatcggcctacaggggcctacgacctgacctacataaagcctggcatgaactga

SEQ ID NO: 105591 - DNA, 312 bp, Glycine max
  Peptide Sequence Number=SeqID_222369
gaatcgcacccacaaagacacccagtggacccggagaagtccaacagggccctagggtttccagctctggttacgggcctctgtagtcctatagggtgcccgttcccccccggcaaggtcacatcatcatatggatcgcacctgcaagacacccagtggactcgaagaagtccaacagggtcttggagttgtcaagctctaattacgggtctctgtcagttctacggagtacctgtcacctccagcaagggcatcaggccccttactaatcaagctttcatcaagaagtactgcgtccccaggcaggcgtag

SEQ ID NO: 105592 - DNA, 1185 bp, Glycine max
  Peptide Sequence Number=SeqID_222370
atgagtcccgttataacctttcatatcaagtcaggatacgaatcatacaattcatgcgattctaaccacactgaaaatgataatcagggtgaaagatttccgttgaacgcaaaagctacatttccttccagtcatgttcacttcctaggagagtggaaaattgtcttggaaagtgtgaaggagatgcctaacgtgttgatacttcctcgaagtgcagattacagtgaagaggtttggatggaaataagggagaaagctatatctatattgcaaacattcttcattgatggaattataccaaagaatgccatgtcagatgtggaagaagagagtgaggttgacaatgaaagcgaacaatctgatcagcaatacaacggaaatgctctccagattattgttagagagcaaacagatgatgttcatgtaagtcctgacaattcccaaaagaaaataagtactcaaatgaaagagtcttcgtcccagcatcaggtttcaagtttgtctcagagtacctctgctagatctgaaggaaggcgcagcaggtcaggtaaaaaggccaaaaaaaggcatacccgtcacaagtcccaacaaaaacatgaagatccttctgcactggagaaagaaggcacatctcagagagatgatactgctatgagtggcactgaccaagctttgagctctagctctgaagactcaagaaatagaaaaactccaatagaatctatgcaagaacccactggtgctcaagtcataaagtcaagtctgagacttagtggaaactgtactgaactattgaaagatggatatattattgctctgtatgcaagagactgttctgcacttcatgtctcaaggcaaagggttaaaggtggaggttggatcatggattccatgtcaaatgtgtcaaaaagagaccctgctgcacagttcctcatcatcttcagaagcaaggacacaattggattgcgatcccttgctgctggtggaaaattattgcagatcaatagaagaatggagtttgtatttgctagtcatagttttgatgtttgggagaactggactctagaaggttccttacaggaatgcagactggtgaactgtagaaacccatcagctgttttggatgtacgcgttgagattttggcaactgtaggcgaagatggagttactcgttggcttgaatag

SEQ ID NO: 105593 - DNA, 147 bp, Glycine max
  Peptide Sequence Number=SeqID_222371
atggaggaaaagtgtggtattgcaaggatgaagcatcactttgctagaataaaggagaatgttagtgcttgcacatctattcatgatgaagttagagagatatctttgaagcttttagataaagaagaggcaaataatcaagaataa

SEQ ID NO: 105594 - DNA, 642 bp, Glycine max
  Peptide Sequence Number=SeqID_222372
atggcacaagtgaacatgtacctccccctcgtccaaagagaaaagctgctcatccatacccacaaaaggcttctaaaaattgttagtgttgctaacttcatttcagctcctactatatcccaagttgcacggccattccaatcttcatctgctttatctgaatcatcaaacatttataggccagattcatcatctgtgcttagaactccagttagcagtgtaccattaccatcttgggatgatatggtggtagtgattcaacaagccaatcctttcagttactgctatagcagtagtaatgagagcactcctaggggttggccaagtagcaaagagagtgatcaaggaaagtcaattatagtaatgccagattttgcacaagtctatagattcattggaagtgtatttgatccaaatgcgactaatcatctacagacactgaaacagatgaacccaataaatgtgaaaactgtattgctatcgatgagaaacctctccaccaatttgaggagtcctgaatttgagaatgagagaaggttgctgtcgttgtacaatgctaacttggagaagggaaaatctggtagtcatcatcgcaaccaacccctcagtgacagatcagagagtgccgtcttatatgcttaa

SEQ ID NO: 105595 - DNA, 2910 bp, Glycine max
  Peptide Sequence Number=SeqID_222373
atgcttctcaagatcggcagagaagtacaggtggtttgtcagtgcatagttttagtcgacgtattgaatatagttcatcccctcccaccagaggtgatagcttttcacggggaatacatggaaaatgggaaactcgatcttcaggacgatctgataaagatagtgattctcaatctgaattggattcaggtttttacacttgatcagcaagaatatgcctattctggaaaacgttttggcaatcaattgcgtagatcttggcaaggtcctgagcatgatgggcttcttggtagtggttcttttcctcggccctctgggtatacccctgggttggctgccctgaaatttcgagctaatgacaactaccagctaaatcggtctaatgagccttatcatcctcctcgcccttataaggcacctcactcacgtcgggagactaatgactctcttaatgatgaaacatttggttctttggagtgtacaagtgaagacagggctgaagaggaaagaaaaagaagagcttcttttgaattgatgagaaaggaacaacataaagctttccaagaaaagcataagttgaacccggacaagaataacgacgattttgacataacttcacttgctgacaacgatgagaaaagggtagttaataggagcaacgagtatgtggagcctaatgtgactctatcagtgttaagcaatgatgagaaatcttcttccctttcacagactccttcagcagcaagaccacttgtaccccctggttttgcaagtgcaaagttggaacgcaatttggcaaccaagacatcccttaacactcattcaacagaggttggacaacctgcgcctggtgatactggaggtaaccatgtattcagtataaattctgacaataaagaaggaaaattattaaccaagcaagtgaataatgatcaacagaatcttcaaaatacaaatctaaatatttcaattaactatgagaaagaaaacattttaaatttaccgtcaattttggatattgccgacattaaaattggaatgggtgatcaattgaggaagagatctgctctttcagtagtcttggaagcatcagatgacaatgaatttattaatcttaatgctgaagtaaaaggaaaggaggctgtgggagcttttagtccagacaattcaaattctatcctatacaagctttttggtaacgcttcaacactagaccgtgacaaatcgactagtattgttgagcagcctgatcagaaagcagatgagacatggagtccacacgccttccaatcttccaagtttgctcattggtttgttgaagaagaaaagaagccagtggatgacttgacacataggccgaatgacttgctctcacttatcgttggtggagaaaaaggggggttgcagacttctaatgtagaaacaccccagcctattgcagctaattttgctttcctaaattctgaaccaactggtgagcatatgacatcaaatgtagcacatactactattgacaactctgagctattgtacaagagtgataaacctgaggttttagcagcagttctaacgtgtgaagatttagaacagtcaattttgtctcaagttggtgaaaatggctcatcacgtccacagcccattcaggacaaagattttgatgcaaaatctgagcagttgactccagttgataatcatgcatcccaccacctcctttctttgttacagaaaggaacctcacacaatgatatggaactttcatctattctagattcttcagacaaggtgcctaatactgaaggagtcactactggcaatgttcttgataatcctggagaagcaaatgtagatgtttccaattcatcaaagacattgacactggaaacactttttgggtcagcttttatgaaggagcttcaatcagttggagcgcccctttctgttcaaaggggttcagttggatctgcagggcctgatgtttcagagtctcttttgtttcctttccctacctcagacaatgttcaccctcctacaggtgaacttacactgaacaggcacggaagtggtgtcctgccatcagaacaaacaaatcatcccaaatctaatagatttgaagagcagtggttggggtatggtgattctcagggagatggtaattcatcgttacttcagagtgaaatttccaaagctagtggtttcaaggggcctcgtgatattcaccttccagaagaagatagcttgattacagctagtgatcctctgcaaaactttttatctgctggaaatttagttaaaacagatttgtcccaagacactacagttgacattactagaaaactggcagctctgaatcctgcatttagagatgaccgactcgttacgagaaatcaagaaggtttagcattccctcgtggtccatatgatatgagggaacctggtattccatatcagaatcttaatgtccaaagatctccacagatccaccctcagttgaatcacggtggtccaatgtttaaccaactggattctcatccccctcatataagttcttatatgaagcttccaactcctgagggcatggttcatcatgactcaccaccaaatcatcaatttccaggaaatatgcttcgtcctccttttcgtcaaccaaacagtggacttgcagggccagggtttgatcctccagttcatcattctatgttacaacaacaaatgcatatgcaaggaaaccttcccccacctcatttattacgtggattcccaaggggtgcacctatgccatctcatgctagcaatccaatgactggcttcatgcaggaaccaaacccaatgcaaggccaaggcttcccatttagtggtcaccagcatcctacttttggtggccctggaatgcaatacaaggtagaaatttaa

SEQ ID NO: 105596 - DNA, 474 bp, Glycine max
  Peptide Sequence Number=SeqID_222374
atgaaatcaaatcctctggctcaggtccgcttccttgctgtgtctgctacaattccaaatattgaggatctagcgaagtggcttgaggttcctgatcaagggatcaaaaggtttggagaagaaatgaggccggtaaagctgacaaccaaggtttttggctatgccccagccaagaatgacttcctctttgagaagcgccttcaaaattatattttcgatattctcatgcaatactcaagagggaaatctgctcttgtattttgttcaacaagaaagggagcacaagaagctgctcagcgactctctcaaatagtaatgacttttggtcaatcaaatccattcattaagaacagagaacaacaagatcggctgagagaggcttctttatcttgcagtgacaagcaaatgcagtcatatattctttacggtggtatgaaaggaatctatatattgttctgggatttggctaaataa

SEQ ID NO: 105597 - DNA, 2328 bp, Glycine max
  Peptide Sequence Number=SeqID_222375
atgtttgcttaccatagattgctgtcatgtgtgacggagcatttacttgcggaaatagttcaactgacagtatctgatattacaaaagcaattgaatggctgaaacgctcctacttgtacgttagaatgaaaaaggcaagtgacccaggatatcaattagttttgttcattagtctcccatcccatctgatgcaattttttatgcacaatcagaaccctatgaactatgcaattaagaaaggaatttctggcgatcgtttagagaagcacgtgcaagatatttgtgtgcgtaaagttaacgagttatcacagaatgatatggtctgggttgatgaagatggtttcctcttgcgaccattagatcctggaaggttaatgacaaagtactatttgagatttgacacaatgaaacagataatgcggactcctgaaaattgcagtttggaagatgcacttcatgttgtgtgttgtgcagaagaaattgcatgtgcggatatattttgtgaactttttttaatacacaatgtattgacatcaaaacttgacacaattctgcactgggaaaatgaagggatacagctcagacgcaatgagaagaaactcttaaatgagatcaatgctgataaagatggtcggcttcgctttcacattcttggagataaaaggaaaaagaagaagcgcattcaaacaagagaagaaaagatatttatattagcaaatgactgcttaaccggtgatccatcagttcatgacctatcgttgattcaggacatgaattctatatgctcaaatggatgtagaattgcaaaatgcttgaaagactattttgtttataaaaggaattacaaaggaactgtgaattcagcccttctggccaaatcactaggccagaagctttgggatgacagtccataccttctgaaacagttacctggaattgggatggttacagcaaaggcactgcattcaatgggagttagatcgtttgaggaacttgctgatgctgatccgaggagaatagagctagtgactggtcgaaaatacccatttggtaaccatattaaagattctctactgtctctacctccaaaagttgatgtgacgcttgcagagattgaaagccatatacaaggaaattccaagctagtagtaacattggctaggatatcacagtcaggccagtcagttaaacgacattatgctgatatgatcgttggttcggaggaggacaacactattctctttcatgaaaaaataagcccatacagtgcaacaatttttgtgcccatcgcacaagggaagcaaaccatcaaagttgattttatatttgaggaatacattggtattgatgtccaccaaaaactttcctttacgagagagagcaattcaattgtgcttttaaaaagaaacaagaagcaggcttcttgtcctccacctgaagagatatatgttatagaagatgataacataactgtacctcgtttaccaacaaaagagctatgcaaattgaacgaggacagggattccattccaagtttcgacctcttggatgaaagttttgaggaaggtgtgcgtgcttttggggttgtagaggacgaatgcaaaagcatcaccgagaaaacagtctttgaccacattcgggagaaagccaaaaacttttctctcctgtctgcatatgataacattcactttccatcactagaggtccttctttcaagaaatcatgcccgtgagaagaggcctgatcatcgtcatgaggtagttgttctggatgatgaagacagacctgaagttcctcaacgaaatgatgtcaatttgcaagttgagctgaggaaggcagaacaagatgatatcaaattttatctgaacgatcattgtacaactggaagctctaatatagttgatacaggtgttttccttcctgaacctgaagcaataactcatgaaaaatcaactgaagaaacagtttttgaccatatacggagaaaatctaaggatttcccaccgattaataagcttaattgtgcggaatcaataatccataaaacggaattattctcaaagattaatcctagtcctcccagttctttgagcgatgcttttggtgtggcaagagagacgaattccttagaggtcaccgataatatgcttacttcatacatgaaaactgctgctgaagtagaaaaatatacatccagtattcagtttttcaatgtcaggaggagagaaaaaggtcttcagatcccggaagctttccagagagtagtaagaagcagcgttgcgcttctagagactctaaagaagagaagcatagttcaagtgaaataa

SEQ ID NO: 105598 - DNA, 114 bp, Glycine max
  Peptide Sequence Number=SeqID_222376
atgattgctagaatcctagagttcaccttcaatgggcacttcaaagtgatgattcctgaggccatggatatgcaatgtgttcctcgacttgaccctccatctgaggattcttaa

SEQ ID NO: 105599 - DNA, 822 bp, Glycine max
  Peptide Sequence Number=SeqID_222377
atggctactgctactatttctactactaatgccacaatggtgagcatggtaatgcctactataatgacaatgtcatttattaggcaacaaattgatataggcatacatgactctgttacacataagcctaaatcctttaaggtaaaggccaagaaaagtaatctaatgtatatgtctagctcaacccttcgtgtgagaggccatcatggcttaggttacatggctcctgagtacctaattcgcggacaacttacagataaagctgacgtctatggttatggagtgcttgttctggagattgtgagtggcaggaggaataatgccttcagagaggacgctggctcgcttctagttaatgagttcaacaacttttgtttgaaaaaaattatccttttggcaccaggtttggaaactataccgatcaaacactttaaccgaagtgttgatcctgacttgggagatgattttcctccaactgaagcatcaagggtgcttcaaattggattgcttttcacacaagcttcagcttccttaagaccatctatgtcccaagttgtttacatgctaagtaattcaaatgtagatgttcctacaccaaatcaacccccatttttgaacactggaatgctagactcagatagttccatcaagtcttatagcactaacagcttcatatccaatgccttgaaaaagattggatctccaatcgcaattttgaaggttcctgtgactgtcataactctcgcatcgctcgcatttgtctgcaatctatggcaagatcatgattttgaaggtctccacagggtaacaaccgcaatttaa

SEQ ID NO: 105600 - DNA, 1296 bp, Glycine max
  Peptide Sequence Number=SeqID_222378
atgaagataactaatttgtgttttgcggatgaccttctccttttttccaggggtgatatcggttcagtgcagattatgcttgacaagttcaacactttcctccgttctatgggccttcatgtgaatccttcaaagtgcaacatatactgcggatctgttgatattaatgtcaaagagcaattattgttgatttctggttttaaagaaggaaaaatgccctttaggtatcttggtattcctttatccagcaagaaactcaacataaagcattatcaagttcttatagataaaattgttggtcggattactcattggagtgctggtcttctctcttatgctggtagagtgcaacttattcaaagtgtcatctttgctacaatcaatttttggatgcaatgtctgcccctgccaaaatttgtgatcatgagaataaatgctatttgtaggagttttctgtggataggtaatagcaacatttctaggaagtctccaattgcttgggaaaaagtctgcagtccgaagattaatggtggtttgaacatcatcaacttagctatatggaataaaatcagtatcctgaaattactttggaatgtctgtaataaatctgataatctttggattaaatggttgcacacgtactatattcgaggtcaatcaatttggagcatggttttgaagaagagtcactcttggattatgagcagcatgatgaagttgaggcccctgttgctgcaataccagtccagaatgcaggatgtttttaaaatgaaaaaaatttatttggctctgtttgaggaaagtgagaaaatgagttggaggactctaatgtgcaacaatctggccagaccgcgggctcttttttgtttgtggcaggcgtgtcacttcaggcttgctagcaaagatcgcctgataaaatttggtttgaatgttgatgctaactgtgctttttgttcctctatggaatcccatgaacatctcttttttggttgtattgagttgaagactatttggactgcggttcttaattggttgcagataattcatatgccaagtacttggtcagaagaattgaattggattactaggaagtgtaaaggaaagggatggcgtgctatgttactcaaatgtgcttttactgaaacaatatatcatatttgggcttatagaaaccatagggtttttggtggaaatgtaaataacaggaaagttgaggattcgattatcaatacgataatctatagagtgtgggatagaaagaggtataggaggtatattgctgagttgatgacatag

SEQ ID NO: 105601 - DNA, 282 bp, Glycine max
  Peptide Sequence Number=SeqID_222379
atgacgacgtataccaccacacctgaccacaacattcaattaacgacacaaggcatgacccaggccctccgtgtcggcgaacacctccgtcacgtgataggcaacgacgactgcttccctaactggcgggtgcagttctatgtgtccccctacacctgcacccaatcgatgctccacgagcttaaacggtgtttcttaaagaagaggattatcgacgtgacagaagagtcgcgaattcgagaaaaggatttcagaaactttcatgtgaaagaaaggatgaat

SEQ ID NO: 105602 - DNA, 534 bp, Glycine max
  Peptide Sequence Number=SeqID_222380
atgaagaacaaaaatatgatattcacagcattcacttttgttcttttacaggcacttgacttaattcgtggcaaaaactttttgatgttgatggattctgccttagagggtcacttttcaaaggatgatggaactgagttggttcgtttggcttctcgttgtttacaatatgaagctcgtgagaggccaaatgcaaagtctcttgttgcatctcttttgtcacttcagaaagaaacagaggtcccttcatatgttctgatgggtctccagcaagaaactgcatcctcagcaaagcaattgtcattgacaccttttggtgaagcttgtttgagactggaccttactgcaatacatgaaatattggagaaaactggttacaaggatgatgaaggaattgccaatgagctttcctttcaattgtggaccagtcaaatgcaagagaccttgaatttgaagaagcatggagatactgcttttagagctaaggactttgttactgccattgactgctacactcaaagttgcaatgactga

SEQ ID NO: 105603 - DNA, 438 bp, Glycine max
  Peptide Sequence Number=SeqID_222381
atgggcactcttccttactactgcactcttgatcctcttcctctatcttcttcttctaaattaaagcctatgttcatctttgtccatgctcttccacaccttctcgctctattccccaattcccctccaaactacaacgccaacccaaggctgctgacggaagtgtgtatgctactttctgacatgacattgtgggtgatccggtgccttgtcagcgctgtgctggcagcggctttataccaagaatatgaggaacattttaaaatattaggacttgggttatgcttgattgagcatgtggattgtgagaggatggaaaatactaaaaatttacctcatcttcatgtttttgtcatatcaatcaaatgcgtagtgtttttcatgttaaaatctcatatgcaacgatggcaagatgaagcaagaaatgaggttaattaa

SEQ ID NO: 105604 - DNA, 2328 bp, Glycine max
  Peptide Sequence Number=SeqID_222382
atggaaatctgtctcatctctcttccttttggccatgtgttcagtgttggaagccttgggaaaaaaggaacttgtgaaacagcggagcatgttcatgtaaacaactgcaacttcaagggagcagataatggaatgaggataaagacatggccgggtggatgcgggtatgcaagaaatatcaagttcgagcatatcgtacttacaaataccaaaaatcctataattattgaccaggattatgaaaatgtacagaatgaagacaaaaaacagacatctgaagttcaaataagtggcgtgacgtatcgttatgtcaatggctttgaagtacggacactccagccctttgtcgtgtccggtgtccgacacgcgtccgtgtcagtgtccgacaccgacacgacacccgtcaatggaacttctaatagtgagacagccattattttgaattgcggtgcgggtgcagggtgcactgatatcttcatggatgtagtcaacataacctcaacttcatcaggatcaaacgttcatgcatcctgcaacaatgctcatggagttgctgcttctacttcacctcctctttcaacccttttgattcatagagtaggatcctcattttttatggcatttgaatgccctaatggtactgaggtttctcaaagtttagcacactttgtagcaaatccaggcataggcatagttgaatctaatctccagctttgtcccaaatccttcactgaaggaatagcaacctcaaaatttgtgcctgataccaaacctgaatctgggaagggtgtgaagttaaagggagcatccaagattaattccaagaaaggcatcaaagcccctgtcagtgctttgaaccagtcctcaatacctggtgatgtggttttcaattgtggtttgtccatcaccgaccttcctccagcattgatatccgagattctcaattgccttgatcccaaggatcttggtgttgtttcgtgtgtctccccgattttacaaagagttgcgtccgagcaccatgcttggaagcaattctattgtgaaaggtggggacttccggcagcttccttggctgtgggttcaggtgttgtggatgatgacaagtcatggagggaacttttcgtggaaagggagtttaggagtaagacttttatgggacgatatagtattgatgtgctgtatggacatactgaagcagttcggactgttttcctattggcttctgcgaagctcatatttacctctgggtatgactctgtggtgagaatgtgggacatggagaatgggttgtcaattgcatcatcacgacccctaggctgcaccatccgtgccgttgctgcagacagaaaactattggttgctggtggtactgatggattcattcattgttggagggctgttgaagacctacctcactcatttgaatttagagccacacaaaaccaaaatactgaggttcgactctggggacatgaaggtcctataacttcacttgctttagacttgacaaggatttacagtggttcatgggacacgactgttagagtgtgggaccgtcattcaatgaagtgtactgcagtgttgaggcacagtgattgggtctgggcacttgtccctcatgatactactgttgccagcacatcaggttcagatgtgtatgtttgggatactgatagtgggactttggtgaccattgtccataatgctcatgttggtaatacttatgctttggcacggagccatacaggggacttcctttttactggaggtgaagacggtgcaattcacatgtatgagattgttaatgatggctatgagtctaaagcttggcatgttgctgtttgggttcctcactcggctgctgtgtattctcttgcctttgagtttccatggcttgtttccgcatcaagtgatggcaagctggctctaattgatgtgagaaagctgttgaagattagcaagcgagctctggggaagagagtctcaaaggtaaagcatttgggtggagacatagtagagcctccacagaggatgttgcacggatttaagagcaatcttttctctgtggatataggagctgaacgaattgtctgtggaggtgaagaaggtgttgtcaggatctggaatttcacagaagctttggaaattgaacggagagcccgtgcattaagaggaatacgattagacaacagaatgaggcgacggaaactccagacagagctgagcaataaaagtggtcggagtgatcagtgttcagttgcagcgaagaagaatgctgtcacttgtatttggcccaaacgtggtatgagtggaaagttgaaagcatag

SEQ ID NO: 105605 - DNA, 1920 bp, Glycine max
  Peptide Sequence Number=SeqID_222383
atgtcttatatcagagagagctctttgtcattgttaaccaatctgtcttcctctctcatctctctgagtctctcattcaccgaattgcaagggaatctatcgagtgacatcctctctttacccaatcttcaacaactagatttgagttttaataaagacctgggaggtgaacttccaaagtccaactggagtactccactaagctacttggatctctctaaaactgctttctcgggaaacatttccgattccattgcccatttggagtctcttaacgaaatatatctggggagttgtaattttgatggactgattccctcatcattgtttaatctaactcaattctcctttatagatctatcgtttaataaattagttggccccattccatattggtgttattctttgccttccttgttatggttggatcttaacaacaaccacctcacggggtcaattggtgaattctcatcttattctttggaattcttgtcactctctaataacaaactgcaagcaccacttgaagatctggtcgcactagatctttctcataacagcattcgtggaagcattccccagtggtttcatgagaagctcttgcattcttggaaaaacattagttatattgacctcagtttcaacaagttgcaaggagatctcccaattccacccaatggaattcactactttttagtctcaaataatgagctgaccgggaacattccttcagcaatgtgcaatgcaagctccctcaaaatactcaacttggctcataacaacttgacaggccccattccttcagcaatgtgcaatgcaagctccctcctcatactcaacttggctcaaaacaacttgacaggccacattccacaatgtctcggaacatttccttctctttgggcattggatttgcaaaagaacaacctttacggaaacatacctgcgaacttttctaagggaaatgcattggagactataaagttgaatggcaaccaattggacggacaattacctcggtgtttggcccactgcacaaatctggaagttttggacctggcagacaataacataaaggatacatttccccattggctagaaagcctccaggagttacaggtactcagtttgcgatcaaataagtttcatggtgtcatcacttgtttcggtgccaaacatccatttctcaggctgagaatttttgatgtctcaaataacaattttagtgggtccttgccagcatcatacatcaagaactttcgaggaatgatgagtgtgaatgacaaccaaactggttcgaaatatatgggtaaccaatatttctataatgattcagtagtggttgtaatgaaaggtcaatacatggagctccagaggatattaactatttttacaaccattgatttatcaaataatatgtttgaaggagaacttctgaaagtccttggcgaattgcattctctcaaagggcttaacctttcgcacaatgcaatcacgggtaccattccacgatcctttggtaatttaagaaatttggaatggttggacctctcgtggaaccagttgaaaggagagattcctgtgtctttgatcaatttgaattttctggctgtgttgaacctttcacaaaaccagtttgagggtatcatacctacaggtggacagtttaacacatttggaaatgattcctatgcgggaaatccaatgctatgtggattccctttgtcaaaatcctgcaataaggatgaagattggccaccacattcaacatttcacattgaagaatcaggatttggctggaaagctgtagcagtgggatatgcatgtgggtttctatttggaatgcttttgggatataatgttttcatgactgggaaaccacaatggctcgcgagacttgttggatgtgtgcttaattaa

SEQ ID NO: 105606 - DNA, 1908 bp, Glycine max
  Peptide Sequence Number=SeqID_222384
atgtggactatttgtccatacacacagcaccaattcaatgcgcgggaaagtgattggggtttcacatctttcatgccgcttggtgaattgtatgatcctagtagagggtatcttgtgaatgatactcttgtagttgaagccgaggttcttgttcgtagaattgttgattactggacttatgattcaaaaaaggagactggctatgttggacttaagaaccagggagctacatgttatatgaattctctactccaaactttgtaccatattccttattttcgaaaggctgtataccacatgccaacaacagagaatgacatgccctctggaagcatccctttggctttgcaaagtttattctacaagctccagtatagtgacaccagtgttgcaacaaaggagctcactaaatcttttggatgggatacatatgattctttcatgcagcatgatgttcaagaactgaacagagtcctctgtgaaaaacttgaagacaagatgaagggaactgttgttgagggaactatacagaagctatttgaagggcatcatatgaattatatcgaatgcatcaatgttgactataaatcaactagaaaggagtcattttatgaccttcagcttgatgtgaagggctgtcctgatgtttatgcttcctttgacaagtatgttgaagttgaacgtcttgaaggggataacaaatatcatgcggaacaatatggtttgcaggatgctaagaagggtgtcctgttcattgatttccctcctgttcttcagcttcaactgaaaagatttgaatatgactttatgcgggatactatggtcaagattaatgaccgctatgagtttcccttgcaacttgaccttgatcgtgagaatggaaaatatttatcacctgatgctgataggaatgtccgcaatctttacacacttcatagcgttttggttcacagtggtggtgtgcatggtggacattattatgcttttatcaggccgactctatctgagcagtggtataaatttgatgatgagagggtgactaaagaagacactaaacgggcattagaggagcaatatggtggtgaggaagagttaccacagacaaatcctggatttaacaacactccttttaaattcaccaaatattcaaatgcttatatgctggtgtatatacgtgaagctgacaaggacaaagtaatatgcaatgtggatgagaaagacattgctgaacatttaagggagaggttgaagaaagagcaagaagaaaaagagcacaaaaaaaaagaaaaagcagaggctcacctttacactattataaaggtggcacgagatgaagaccttgcagagcagattggaaaggatatatattttgatcttgtagaccatgacaaagtgaggagtttccgtgttcaaaaacagacgtcttttaacctttttaaggaagaggttgctaaagagtttggcataccagttcaattccagcgcttttggctatgggcaaagcggcaaaaccatacgtatcgtccaaatcgaccattgacacacatggaagaagcacaatctgttggacaattgagagaggtatcaaacaaggttcacaatgcagaattgaaattgtttttggaagtggagcttgggctggatgtatgtcccattgcaccgcctgacaagacaaaggatgatatattacttttcttcaagttatatgatcctgaaaaagaggagctacgttatgctggaaggctctttgtgaagagtactggtaagccatcagaaatcttaaccaggttaaataaaatggctggttatgatcctgatgaagagattggactatatgaggaaattaagtttgagccaaatgttatgtgtgaacccattgataagaaactaacatttcgagcaagccag

SEQ ID NO: 105607 - DNA, 675 bp, Glycine max
  Peptide Sequence Number=SeqID_222385
atggatagagctaggttgatttatggcttggtaacccacatggatatgaacattggcgccctgatctcaggtcaaatctcttctactactcagagtaactcctctaggctcgaatttccagccttgattactgctctctgcaaagctaagggggttacttctgatagcttgacctatgagagcctgagccaggccattaatttggcctacattaaaaagaattgttggaatttgggtgatctgacagttaacatcaaagggacaaggaaggcaaggactcgaccagctgatgttccctcttcttctactccatcagctccttctacttttgctactcttaaaccagctcctcaaggcccatctactcatagttctcagcactttgagtctatgcttcaaagtttatttctgggacagaccatgcaggatgtggttttacaaagacccattatgtcagtagagcagtttttagagaagctagcagaccctcctacaccagtgaatgagatgccagcagaccctcctaccccaatacttgagataccagaggaccctgccacaccagtcctgggactgactaccactcctccagtcactcctgtgttacactttacagatgaaaaggatactcaggatcaggacatccagcagcaggaccagtcacaggagttttaa

SEQ ID NO: 105608 - DNA, 201 bp, Glycine max
  Peptide Sequence Number=SeqID_222386
atggacgatacacttgaggtaagggaatcggtctcaaaacaaatagattgtaggttcatgtctttggctaattggataccggatttaaggagacagtgcccagttggatttataagaaccatcaacattaaatttgtaggtcagaaagctagggggtttccaggaagtagaatcctgatggttaaccctttttgtggctag

SEQ ID NO: 105609 - DNA, 177 bp, Glycine max
  Peptide Sequence Number=SeqID_222387
atggctaggagcatgatgaaagggaagagaatgccttattacttctggggagaggcaacttctactgctataatatttggttcactgttgtcataccctaatttcgttcggggacctttgcttggtggcatgcaacttgtgtttggtcattttgaggtgcttggcacccatcattag

SEQ ID NO: 105610 - DNA, 240 bp, Glycine max
  Peptide Sequence Number=SeqID_222388
atgaaaattggaggtgacattggtggtggttgcaatacaaatgatggtggcagtgatgatgtggtggtggctgcagcagcgatgatggtggtggtagccaatggaaatgacattagtggtggtggtggtcttgatgaaggtgatattagtggtggcgaagatgttggtggtggcggcagtgacgaaggtattgttagtaatggaggtggtcaaggttgtcagactcacgattctacgtaa

SEQ ID NO: 105611 - DNA, 387 bp, Glycine max
  Peptide Sequence Number=SeqID_222389
atgaaaaatgacacgatattctgtgtctcaaacattatttgtggccttccatatttttgtgttgatctgagtaaaaaaggaagccgacagaagccattcggggaggaagggctatccaaaaagcataaggacctagaaacacttcatgagttgaagggtccaatgacaaggtccaaagccaagtttctacaagaacaaatagccaagaggatcaaggatggattactcattaaagcaatggttttcgaaagtgatagtgatccaccttcccctagatccgctaagctaatggcttcattggctaaacacatggataagttgcaaagaaatgttgagtggaggatggggagagatttaatgagatacaaagaagcactcaagagttga

SEQ ID NO: 105612 - DNA, 207 bp, Glycine max
  Peptide Sequence Number=SeqID_222390
atggcggatgatggaacacagtggaaggccaaaattctgccgtataagcatgccgttgaggcctatggcactgccatggcagacctcccttcacaaattatttatggtgctccatataaagtgcaggccatgattcttgatgttgtctcttcaagtgttgttgcttttggttacaatagaaggtttgtctgtggggatgatatttaa

SEQ ID NO: 105613 - DNA, 267 bp, Glycine max
  Peptide Sequence Number=SeqID_222391
atggctctttcaacctttccaacggtgaacaagtgtacctctattggtagggaacaacacacggtggttgcggacatggatggaactttactcataggtcgaagttctttcccttattttgctttggtggcctttgaggctggtggggttcttaggcttttgttctatgttttggcttcccctattgctgcccttctctattacttcatctctgagtccgcgggcattcaggatttcagagtctttggctttccaattggacactaa

SEQ ID NO: 105614 - DNA, 719 bp, Glycine max
  Peptide Sequence Number=SeqID_222392
gatcaccacctggtggtgagaaatctggtcgttcatgtgcagtgtctccggtgccaattggcccgacaaggcagttggctatattagggttcgatgtctcgtccccttgttcttcatctgggatgagaaggaagaatcatgaggcgcaacgatggcccctcgtgaacttcttatcacaattaaaacacaatcctcactctctccggcttgcgagttcctcagggctcaatcgtttgacggacctttgcggtgctctaggagtttctcctcctgaagatgggccaagtcggtggcatgcaccagcgtcaacggctaaagagcttggaattcacgccggatccaggtattctctcactgaatctttctgggttaatttaaagaggagtcctgttggatcttcatatagggactgggcaaagcgagcttctatggcttgcaaaaaaccagaccatgtgtcaggggttgagtggtattcaaagaattgggtaatcttgaatacccaactagaggggtcagagccatcgaatctgggtaccgcggatgaagaggagggtgaagggagtggttctagaattcgaggtttagggcctccagaacaaggaattgagaaattgcacttcattgctagcaggagacagcctctaacggccaaggaatcttggatagcttctagaacgttgttgacctggctgcaagctcagcttcaccttgctacgtaa

SEQ ID NO: 105615 - DNA, 1137 bp, Glycine max
  Peptide Sequence Number=SeqID_222393
atggtggaacctttcttgaaggagtttttgggagctgacatggttttgggcactgagattgcaagttacaagggaagagcaactgggttggtttgcaagccagggatacttgttgggaagaagaaagctaatgccctaaagaaggcttttggagaggagaaaccagatattgggcttggagatagacaaactgatgctcccttcatggctttgtgcaaggagggttacatagtcccacccaaactcgaggtgaaatccgtgtcaaccgacaagctcccaaagcccataatcttccacgatggaaggctagtacaaaaacccacacccctcatcgccctcctcaccattctttggattcccatagccttccccttagcatgccttcgcattgccgcaggctccctcctcccgatgcacatggtctactacgccttttgggcccttggcgtccacgttataattaagggcactccacccccaaaagtcacaaaatctaaccctaaccctaacaacaacaactctggtgttctctttatctgctcccatcgcaccctcctcgaccccatttttctctcggctgcccttggtcgccctatccctgctgtcacctactccgtctctcggctttctgagatcatctcccccatcaagaccgtccgccttagccgcgatcgtgccaccgatgctgccatgattaagaaactcctccaagaaggagacctagcaatatgccctgaagggacaacttgtagagaaccatttctccttagattctcagctttgttcgccgaactcactgatgaactagtccctgtggccatggtgaaccgcatgagcatgttccatggaacaaccgcacgagggtggaaagggatggatccattttacttcttcatgaaccctagtcctacttatgaggtcacatttttgaacaagttgcccaaagagttgacttgtgcgataggaaagtcaagccatgatgtggccaactatattcaaagggttattgccgcgactttatcttacgagtgcactgggtttacgaggaaggacaagtatagggcacttgcagggaatgatggggttgtggttgagaagggtcatgtgttgaaggctaataaagttatgggttgctga

SEQ ID NO: 105616 - DNA, 1107 bp, Glycine max
  Peptide Sequence Number=SeqID_222394
atggcagaagaggcacgtattattcttctttcgccgaagatttattctgtgaagcatgtttttcttagggttttttcagcagtttcaggagttcaagttaagatcaaaggactccatgaaaattatgttgtcataatctcgtgtgtcattttgatggtccttttctccattcaacatcatgggacacatagagttgccttcatgtttgccccactacttgcaacatggcttttgtgcattagtggtattggtgtatacaacagattctactggaaccgacacatataccgtgcactttctccactctacatgttgaagttcctcagagccactggcattgaaggacggatgtcattaggtggagttgtgctttcaatcacagaaactgtattttggccagttttcgtagtggccactcttgctgccattgttcgaagtcaagcagtgatttcggctaccttttccattgtaagccagtgttgcgcacttaattgttttcctccggttaagattgttcatacttcaagcagaatatatggacagatttatgccccagaagtcaattggatattaatgtgcctttgtttagctgtcccaattggcctaagggatattgacatgatgggtcatgcatgtggactggccaccaccactattatgtttgtgacaacatgcttgatgacactagtaatgcttgttgttaccataacccatcagagtcatctatgtccacttcctctgactgtacaacccatcacctggaattatgaccattgtctttatctttatccaactccacacacgatagttttgggtgatagaagttcatatgctacggtgacaagaagcattacaaagaatcccaactctaatcttgaaaagctccaaattcttatagcttcaaagggaaagtcattgtcacagactgtagtcaatgctcttatgcaaaagagaaatgccctgagaactgaacagttgggaataagatgggcctcttcttctagaagaggtggtatgattgttttaaggaaagttgcaattccaaaacctatcaacttacccgtattaagagttacaaaggaagttgtaatcgtggtcataatttaa

SEQ ID NO: 105617 - DNA, 1770 bp, Glycine max
  Peptide Sequence Number=SeqID_222395
atggcgtcggaggacgtgagcaaaacgacatttcgaatgcatcatggccattatgagtttatggtgatgccatttggcctctgcaatgccccttcctccttccaggctactatgaatacaacctttggaccatacttgcgtaaattcatcatcgtcttcttcgatgatatcttgatatatagtcggaccttccccgatcatctcgagcatttgaaaacaacttttcaaactctcacagacaatagctttgttcttaaactatccaaatgttctttcgcgacccaacaagtagaatatctaggattttatcatcgtttcattaaggggtatgctaccctagctgcccctcttacgacattactgacaaaggaccacttccaatggacctctgaagctgatcaagctttttcaaaactgaagaaagctctgtgccaagctcctgttctaggctcaccagactttgattccctttttgtagtagagaccaatgcatcagggataggcatgggggcaatcctttcgcaacaccatcatccttttgccttcttcagcaaaccattttgctctaagttacttcgtgcttccacctacatgcgagaactcgccgcaatcacgatggcggtaaaaaaatggtggcagtacctgttaggccactgttttgtgattctaactgatcaccggagcttgaaggagctaatggctcaagcagttcaaacccttgagcaacaagtttaccttgcacgattaatgggttatgattacaccatccattatcgcgtcggaaaagccaatatggcggcagatgcactctcgcggttaccagacccacctcaaggacaattttttgtgctaactattcctaattggtcatatctggttaccacggcagatccaattactgccgacaattttgctgaactcccttccactcccaccagcggccacataggagttatgaaaaccttggcccgagtccatgaaaactttgtgtgggcatctatgaaacaggatgttcaccgctatgtcaccagttgtaccacataccaacaaacaaagtatgatcaccggcagccaccaagactcttatgtcctcttccgattccggaacgaccatgggaggacctctccctggatttcatcaagggccttccctcctatcgtggcaactcagttattttagtcattgtggatcgcttttcaaagggagtccacctagaatggtcatacaacacttctacccatttagccaccggtatttcaccatacgagatcacctttgggaagaagccgccaagcttaccgcaatatctagaaagaacattgaatgttgaggatattcgtcagtctaggaaagaagctattcaaagcacaacaaagaatgaagaaattcgtggaccaacggcgctgagatgtgagctacaaagaaggagaccaagtgctggtcaagctacgacctcgcaggcaaacttcaactacaggaggggtgtactccaaacttgcaaaaagatagggagcgttgcttaccaattgaacttgccgccaacctctagaatccacccagtgtttcactattccttattaaatccatatcattcttctaccaatgaggtccctctcgacttacctgctttatttgaagataaccagcccttcatcacaccactcacgatcttggatgcaaaatggaaaaccacaacttccggcaaaaaattgttggtcttagttcagtgggccggattattcccagaagatacattgtggaagcagtga

SEQ ID NO: 105618 - DNA, 768 bp, Glycine max
  Peptide Sequence Number=SeqID_222396
atggggctcacttggtttgcaagctcaagaaatcaatatatggactacaacagattcaatttgaatcaatgtcctaaaaatgagcttgaaagggaacaaatgagaagcattccttatgcttccattgtaggaagccttatgtatgcgcaggtgtgtacaagaactgacattgcttttgtggttggaatgcttgggagatatcaaagtaatccaggaatagagcactggacaactgcaaagaaactgttaagatatcttcaaggaaccaaaggttacaagcttacatatcaaagatttgacaatttagaagttgttggctactcagacttggattttgttggttgcgttgactctcgcaagtcaacatctggatacatcttcatgatggctaatggagcaatatcttggagaagtgcaaaacaatcattagttgccacttctaccatggaggctgagtttatttcattatttgaagcgacatcacaaggtatttggttaaaaagtttcatggctggtctacaagtgattgattctgttcctagactgttaaagatatattatgataatttagctgctgcttttctggctaaaaacaacaaaagtggaagtcgaagcaaacacatcgacattaagtatttagccatgagggaacatgttaaagaaaatgaaatcatcattgaaaacatcagtactaaactaatgattgcaaatccattgacaaaaggcatgcaaacaaagtcatttaaggatcatgttaagagtatgtga

SEQ ID NO: 105619 - DNA, 447 bp, Glycine max
  Peptide Sequence Number=SeqID_222397
atgggggaaaactataagcaatggaaggaacacgttcttttccatttaggggttgccgaccttgactatgctctccgtaaggatgagccaattgagcttatggattctagcacttcagaagaaattgcattatacaaacgatgggaaagatctaaccgtctttccaatatgttcattaagacgcgtatctctgctagtatgcgtggttcaattctgaaatgccaaaaggtcaagaatttcatgaaagccatagatgaccagtttgaaggttctgagaaggccttggctagcaccctaatgtctaagttttcatctatgaggctcattggagttgaggaatggagacttgctccagaaattggcgaaggtgatcttaccgtgactcaagataaggggaagaaggaaaggaaggaaaagaaccatattcctgctattaccaaaatttag

SEQ ID NO: 105620 - DNA, 243 bp, Glycine max
  Peptide Sequence Number=SeqID_222398
atgacagtgaggtgtgaagaagatttcatggtgaaattggaaggggaaaatgtgaagttgcagaaagtggagggaaagcgaaaacggaggaagaagcatggtgtgcatgggagtgtatgggaatggagaatggaagatgtcactattcactgttcttcgttgaaaaacctcatatttacaaaattatcaccgccttacatactaagacggttttcgagaaccgtcatagaaggtgcatcataa

SEQ ID NO: 105621 - DNA, 231 bp, Glycine max
  Peptide Sequence Number=SeqID_222399
atggttgcttctcaagaacagctagcttctcaaggaactggagcacctaccgaaatggtcaggaagtctgaaagatcaacacctcttcaaaatcaacaaggagttagaagggttagggccaaggccaaagttattagcccatcaacaagagtcacaagaagcaaaggcaaaacaaaatctgaaggcaatagtcattctatgggacaacaaggaacatattgcaagaaataa

SEQ ID NO: 105622 - DNA, 198 bp, Glycine max
  Peptide Sequence Number=SeqID_222400
atggcattgcagttgaacctgaatgcgtctggagctggagttttagctcctaattcagccttctttgggagcagcttgaagaacgttattgcctcaagggtccccaacaccaagatcccctacgattacattagcactggacttcgccattacaatgggggaaaactcaaaattataaggaaaaactatccattctaa

SEQ ID NO: 105623 - DNA, 1590 bp, Glycine max
  Peptide Sequence Number=SeqID_222401
atggatggttcatttggagaagatgacataatatcacccagggattcaaatggccatggaactcactgtgcatccactgctgctggaaactcagttgagtccacaagcttctttggccttgcctcagggacagcaagaggaggagttccatcggcacgaatcgcggtgtacaaaccttgttggtcatctggctgcgatgatgccgacatccttcaagcattcgatgaagccatcgcagatgatgttgacgtcatttccatttccttgggacctgtgagtgtcgatcaccgcaactattttgaagatgtgttcgccattggggctttccatgcaatgaagaaaggaatattaacgtcccattctgctggtaatgagggtccagagctttctacaatgtctgtttatgctccgtggttactttctgtggctgcaagcactacagacagaaagctttttacccttgttcagttgggtgatggcacagtctatgagggagtttcagtcaatacatttgatcttaaaaacgaaagttatccattaatttatgctggagatgcacccaacatcactggtggattcaatagatccatatccagatctttgggattggcttctggagcagccggtattttactaagaagtttggcgtcaaaagatgttgcaaatacatttgcattaccagccgtccaccttagctcaaacgatggggcactcatacactcttacataaatttaacaggtaatccaactgccactatatttaagagtaatgaaggcaaagactcgttagccccttacatagcttcattctcatctagaggtccaaatccaatcactccaaacattctcaagcctgatttagctgctcctggagttgacattttggctgcatggtctccaattagtcctgttgctggggtcaaaggtgatgagagaaatggaaactacaatataatatcaggcacctcaatggcatgccctcatgttactgcagcagctgcctatatcaaatcatttcatcctgattggtctcctgcaacaatcaaatcagcattaatgactactgctaccccaatgagcattgcacttaatcctgaagctgaatttgcttatggtgctggacaaatcaaccccatcaaagcattgaatcctggcttagtatatgatgccaatgaaattgattatgtcaagtttttgtgtgggcaaggttatgatactaaaaagctaaggagtattacagctgataatagcagttgtacacaagccaataatggaacagtttgggatctaaatctcccatcctttgcactctccatgaacaccccaacattttttagtcgcgttttccatagaactgttaccaatgttggatctgctacatcaaaatataaagctagagtaattgcacctccatctttgttaaacattatagtggagccagaagttttgtccttctcatttgtgggtcaaaagaagtccttcactcttaggattgaagggagaattaatgtgggtatagtttcttcttctttggtttgggatgatggcacttcacaagtaaggagtcctattgtagtgtactctgaataa

SEQ ID NO: 105624 - DNA, 732 bp, Glycine max
  Peptide Sequence Number=SeqID_222402
atgggagaagaacaacgtaaagtcgtcaaagaagaagtcaacaagctccccaatgacaaatggcgaatgtctaatgactacaccgatctgaacaaggcatgccccaaagatgcatattgtctgcccagcatcgataggctagtcgatggattgtttgggttccaagtgttaagcttcttagacacctactccggatacaaccaaattagaatgcatccttcagacgaggagaaaacgacatttatcactgaagatgccaacttttgttatatggtggacgacatggctgtcaagtttcaaagcatatcccaacacgtggcagacctggaagaaggaattgaagccaaccccaacaaatgcaccattatattggagatgcgcatccccaccaacattcaagaagttcagaaactaaatggtaggctagcatccctgtctaggttcctcttgaagcttgccgaaaaggcgaagcaattttacaaagtgctcaagaaaactgagtccttcctttgggatgaaaattgtgaacgagccttcctggctttcaagaaaatcatagccataccgtcagttttgagtcaacccaggccaggagcaccactgctcctgtatctctcaatagctgacgaagccattagctctcatccttcgtacaagaggaagggaagcaccagttccctatctatttcaccaatcacatgctccatgacaccaagaagcactaccaaatga

SEQ ID NO: 105625 - DNA, 1011 bp, Glycine max
  Peptide Sequence Number=SeqID_222403
atgaagtccctactgagtcgcgcgcactacccagatttaggtccgagttgcagctggacaagcgcttcattgggttttaggcctttgttagaggtgtcgtctcacggatctatgtcaaattcactgcctaggctagagattacccagaccgaaggtggtcataaaatccatgtagcctctggtctcgactctttcgcctgcaaagccgaggaatggactgacgtgagggtggacagtgttgggggagacctcgagtctctggaagtttttctagtacaatatatcaatagaactgccctggtcgataacaccatgaagtttgcaatgatgatggagacaaccattaggtcgtcctggttggcggggttgatgcccttgaagtccctattcgtaaagaaaacgtttttgggactggctagattgtcccccataggaaaagctactagcggtggtgttgattacacctctgatgtgttaggcgggctagcgcttgtctggcttgtgcctcttgtccggcttgtgcaagtcagccttggtgtttattttgcacttgtcacgcttctatctggcttagtggacttcattcttggtcttttgcacaaactgtctgtgaacttgtcgaggaataatgtgaggagcattgaatggaacactacctcgggactaaccaaggtggttgaggtcatgcgatgggacctgttggtggcgttttgcacattgaatagttcgacaagggtgtcaaagctgtctatggacataggtttaccagtgttaggaaggcatccaaatgttgttgtcccatcgtaccgctcgacgttgagtggtttccaccccaaggttatgcctatctccataatgcagtcgacaaaagaatgtcgacggatagttcgccctgcaaggtgtggggggattgctcgtcaccctggaaatgtcttaaacaagcctccagccggtcatggtcagcctttatctttgtcaactcctccttatggtatcgctccatcttcgtga

SEQ ID NO: 105626 - DNA, 114 bp, Glycine max
  Peptide Sequence Number=SeqID_222404
atggcgaatgacacatatgcaaaagcacgatgcccaaacccaagtcaaacaattccctcattcatactccaaagggcttgcaaaacccatggtcctccattgctaccccaatga

SEQ ID NO: 105627 - DNA, 492 bp, Glycine max
  Peptide Sequence Number=SeqID_222405
atgttactcgctgtgggtggcatacactggggtcatgatattggtacactcttgcatgcatgccattcatcgtggatggcatacaatggagacttagtagggtgcttgtgcgcacatgccgtgagtgacatgttagctgaagtagaacttcaggtgggtggtattccatgttcttggaattgctttgctatccggctcttgcaatcggtacgctctattgtcgaggttggttgtgaccccgaatgggccttcctagttagggccaagctttcccgctcagggatcttttctggcatcacctcagactcgccatacgaggtcgctaggttgaaaggctcatggtgtttgacaccagttaaagcgcaaggccaaggggtcgtgcagggttttgatggttgtgtgtcagttcctgaaacaaaagccacaaggaagggtaaaaatggtcatttcctagagttttctgaccctaaactcgcccagaatagcatctag

SEQ ID NO: 105628 - DNA, 210 bp, Glycine max
  Peptide Sequence Number=SeqID_222406
atgatttctctgagcttgtggcatctcctcctcgtactttcatgtgttcttcttttgactcagacatattctgaagatgaccaaaagacctacattgtctacatgggtgatcatccaaagggagtaattcaatccgcagaatcacttcacatcagtatggttcaaaatatcctcggcaggttattcaattgcatattcatttatgtttga

SEQ ID NO: 105629 - DNA, 879 bp, Glycine max
  Peptide Sequence Number=SeqID_222407
atggcttccatatccagcaaatttgcaccggatgctttgctacatagctacaagaagagttttaatggatttgttgtaaagctaacagaagaggaagcagtgagaatggcagaattggatggtgttgtttctgttttcccaaacaaaaagaacgaacttcatacaacaaggtcatgggacttcataggcttatctcagaatgtcaagagaacaagtatagagagtgatataattgttggagtaatagattcaggaatttggccggagtctgatagctttgatgacgaaggatttggtccaccaccacaaaaatggaaaggcacttgccataacttcacctgcaacaataaaatcattggagcaaaatattttcgcatggatggttcatatgaaaagaatgacatcatatctccaagggatacaattgggcatggaactcactgtgcatccactgctgctggaaactcagttattgagtccacaagtttctttggccttgcctcagggactgcaagaggaggagttccatcagcacgcattgctgtatacaaatcttgttggtcaagtggttgtgatgatgctgacatccttcaagcatttgatgaagcaattgaagatggtgttgatatcatttccatttcacttggacctagagaagttgaatatagtgactatttcaatgatgtgttcgccataggggctttccatgcaatgaagaaaggaatactaacctccatttctgctggtaatagtggtccagagttttatacaatatctaaaaatgcaccatggtcactttctgtagctgctagcactatagacagaaagttttttacccgtgttcaattgggtgatggcacaatctatgaggtaatttag

SEQ ID NO: 105630 - DNA, 711 bp, Glycine max
  Peptide Sequence Number=SeqID_222408
aatggagttgtggaaaggaagcacaaacatgtagttgaaattgccctcactatgttatctcaagcctttatgtctcttgagtattgggaccatgttgttacttctgttgtgtatcttatcaattgtcttccatcatcctctgatcaagaggctattctctctctctctcacaagggtaacaagtgcctggctgaagatggaaggatgtatatttcaaaggatatcttacttattttttctacacatccaccaggtgtcactccttccattcttgacaaccatactcctataggtcaaatggataatgattcctcatgcactatttcatcttcagtgggagcagattttgtttctgatgttgactctcaatcaacttcaacatcaacacccactgtagtttctcccactccaacagttcttgtcaaacctgttaacactcatcttatgtgcactcaagccaaggatggtgtagttaaacccaggttgcagcccactatttttttagctcatgttaagcccaaatctacaaagtctgctatttctagtccacaatggctggcagctatgaaaattgaatatgaggccttgatgaaaaatggtacttggtccctccaggtcttccttctaatagatctcctgtgggttgcaaatgagtttttcgagtcaaggaaaatcttgatggcattgtcaataaatacaaagctagactag

SEQ ID NO: 105631 - DNA, 724 bp, Glycine max
  Peptide Sequence Number=SeqID_222409
tgatccaactgccactatatttaagagtaatgaaggcaaagactcatttgcaccttacatagcttcattctcatctagaggaccaaatgcaatcactccaaacattcttaagcctgatttagctgctccaggagttgacattttagcagcatggtcaccaattgtccctccttctaatgttaaaggtgataagagaatagcaaactataccatacaatctggaacttcaatggcatgccctcatgctactgcggcagctgcctatatcaaatcctttcatcctaattggtcacctgccgcaatcaaatcagcattaatgactactgctaccccaatgagtgttgcacttgaccctgaagccgaatttgcttatggtgcggggcaaattcatcccatcaaggcattgaatcctggcttagtatatgatgccagtgaaatcgattatgtcaactttctatgtgaacaaggttacgataccaaaaagctaagaagtattacaaatgataatagtagttgtacacaacccagtgatggaataggttgggatttaaatctcccatcttttgctgtagcagtgaacacctcaacatcttttagtggtgttgtttttcatagaaccgttacaaatgttggatttgctacatcaacatataaagctagagtaactataccttcatcttttttgaagttcaaagtggagccagatgttttgtccttctcattt

SEQ ID NO: 105632 - DNA, 288 bp, Glycine max
  Peptide Sequence Number=SeqID_222410
atgtcggctattgtcttttctattcaatccctgaataatatttggatgatgcctattaggaaatgttcgatcggcgtcatccggcgatgcttctttttcaaacctcgatcgttcacctttcctggccgaagtccgctagcatttttttcgatcagtgccggggaatcatgtttttctgccgaggaaatgtgcgatcggtgccttccggtgaggcttcttttccaaacctcgatcggtcttctttcctggccgaggtcggtttgcattgttttcgatcagtgccggtga

SEQ ID NO: 105633 - DNA, 582 bp, Glycine max
  Peptide Sequence Number=SeqID_222411
atgactataatttgtctctgcgtgtcatcgggcccgccgcctctggatgacaaaagatgcagaatgaccataatttgtctccgcgtgtcatcggccccgccgcctgtggatcacaaaagacgcagaatgaccataatttatctctgcgtgccatcggacatgattgtgtctggaaggcaaaaggtgagcggaatgaccataatttgtctccgcgtgtcatcaggcccgccgcctctggatgacaaaagacgcagaatgaccataatttgtctctgcgtgccatcggacacgattgtgtctggatgggaaaaggtgagcggaatgaccataatttgtctccgcatgtcatcgggcccgccgcctctggatgacaaaagacgcagaatgaccataatttgtctctgcgtgccatcggacacgattgtgtctggatggcaaaagcctctggatgacaaaagacgcagaatgaccataatttgtctctgcgtgccattggacacgattgtgtctggatgggaaaaggtgagcggaattaccataatttgtctctgcgtgccattggacacgattgtgtctgaatga

SEQ ID NO: 105634 - DNA, 555 bp, Glycine max
  Peptide Sequence Number=SeqID_222412
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatggtcattacgaccgtgctggacgaagacaccttcctggagatccacgaacttttcgcccccaacgtcatctgcggattcggacgcattgaaggtcgtgcgatcggcatcgtcgccaaccaaccgatgatcaatgccggcaccctcgacatcgacgcatctgagaaggccgcccggttcgtacgcacctgcgactcttttatcaagcttatcgataccgtcgacctcgagggggggcccggtaccagcttttgttccctttag

SEQ ID NO: 105635 - DNA, 141 bp, Glycine max
  Peptide Sequence Number=SeqID_222413
atgatgcatgcacctgactcaacactcagatgcaatgtgggaactgtgctgagtttgtcgagaccacccggttgtgcacgtaacagcccccctcccataggtgatcagcctgggagcccaaaggtgttccctaccaggtga

SEQ ID NO: 105636 - DNA, 219 bp, Glycine max
  Peptide Sequence Number=SeqID_222414
atgggagattcagctaaagttgtgataaaacaagacatgaagggaagaaggcataaatatgggtttaacaacaatgagcgtgagaaggcacagaagaaaagggtggtggatgatgaaactgctgacaaacatcagctggatgaacaccaagagcggctacgcaagaagtttgcacttgaggagggaaggatatttgcagctaatgaacaagtttcttaa

SEQ ID NO: 105637 - DNA, 351 bp, Glycine max
  Peptide Sequence Number=SeqID_222415
atgaactacatcgtgaccactgcacaccgcagcgaatttccgcacccgatcaccctgcgccgtggccaggcgctggtggtgggcgaacgctatgaaggcccggagggctgggacgactggttcctgtgcgaagccgaagggcagcagcccggtttcgtgccggcgcccgtgatcggtcgcactgcgcagggtgacgcgtttgccaccgaggattactgcgcacgggagctggatgtggatcccgggcaggtgctgcgtgggcagcgcacgctcaatggttgggcgtggtgcgtgccggagaccggcgaaccgggatgggtgccgctggagaagctgcgggccatgcggtaa

SEQ ID NO: 105638 - DNA, 1635 bp, Glycine max
  Peptide Sequence Number=SeqID_222416
atgccctacatccgcaccctgcagggtgagcgggtgaagagcctggaagagtgcgtgatcgccgactggctcttctacaacggcgtgacgtacgactacgagcggcgctacgaattcgatacggcgaccgacacccatcgccagtatcgtccggacttctattacccggacgccgggctgtatcacgagcactttgcgctggatgccgatggccagccgccggcgcacttcgcccattacgccgagggcatgcactggaagcgccagcagcatgcggcacggggcaccgcgctggtcgagacgacgtcgtttggactgcgcagtggacatgccctgcaggatcttgcggagaggcttgacgggtccggtgtcgaactcgaccccaaccccgaccgcgagctacccgagcagggcgcaaagcccatgccggacgcggacctgatcgggctgatgcgcacgttcattgcccacgccaagagcaactgcctgacgctggatgacatggccgagcgcctgcgacagatgcccgaagatcagttcaaggaacggcatcgacgcttcctggaaatcgccagccctgttttccaggcctgggacaaggcactggctgacgagcacggcatcgacttcgaggacatgctcaacatggcggccggactgctggaacagggtcgctatgaatcgccctacgaactggtgatggcagacgaattccaggacgcctcgcgcgcccgcgctcgcctctgccgcgccttggtcagtaaaccagggcgctacctgtttgcggtgggcgatgactggcagtcgatcaatcgcttcgccggcgccgacgtttcagtgatgaccggattccgcgaatggatgggacatggccaggtgctgaaactggagcagacattccgctgcccgcaggcgctctgtgatgcgtccagccgcttcatcagccggaatccagcacagattgccaaggcggttcgttctactacaccggcgatgggcccggtgctgcaggcgttccagatgaatcgacgcgaggagctgcaggatggcgttcgccagtacctcaccaagctgcatcatcaattgttgtccggggcggtgccacaagggcgcaatggacgcgtgacggtgttcatcctggggcgctaccgcgccgatcgcagcgcgatgccttcggattggaagacagcctttggcagcacgatggacgtcgagttcctgaccgctcatcgctcgaaggggcgcgaggcggattatgtgatcctgccgggaatggtccatcgaggcttcccgagcctgcgtgcggatgatcctgtgctttccttggcgatgccggatggcgacacctatccactgagcgaagaacggcgtttgttctatgtggcgctgacgcgagcgcgacggtcggttgcgatgttcaccctgcagggcaagcactcgccgttcctggatgagctggtgaaggacggagcagtggaagtgaccgcgatttcaggcgcggccatccacgaagaacgctgcccagtgtgcaaggtcggcgtgtttgtggaccgcaatgggccgcatggggctttccggtcgtgctccagctacccgttgtgccacaacaagccgaggggtgggcgacgcgggtaa

SEQ ID NO: 105639 - DNA, 937 bp, Glycine max
  Peptide Sequence Number=SeqID_222417
aatcgccggaacggctggcttcgactggctggtgatcgacggtgagcacgggccgaacgacctgcgcagcatcatcgaccagctgcgcgcgcttgccacctctgccgccgagccggtggtgcgtgtgcctgtcggcgagagctggatgatcaagcagcttctggatgctggcgcccgcacgcttcttgtgcccatggtcgattcagcggcacaggcggaagccctcgtcagcgccatgcattacccgccgcgcggcattcgcggcatgggagcggccgtcgcccgcgcttccgcttttaatacaataacggattatgccgacagcgcctctgccagcgtatgcctgctggtgcaggcggaaacccgcgcggcaatcgaagatctcgacaatattcttgcggtggacggcgtggatggcgtcttcatcggcccggcggatctcgccgcggacatgggttatctgggaaggattgacgaagcggcggtgcaggcggttatcgaagcggcgatcgtgaaaatcgtcgcggctggcaaggccgccggcatcctcaccttcaatgaaacctataatcgccgttatctggaactcggcgcgtcgttcgttgccgtgggagccgatgtcacggaattcgccaatacgctgcgtgcgctttccgcacgctacaagggtgggccggcacttctccggcggaataccttcctcgccggaggcgagataaccgccattgatgagggcggagcggacgatgcgctggattgcctcgtctctgtcgatgccgtgatcccttgcaaaatcagacaatgccgcctcaaggtcgtcgctgaaccgcatattcgcccccttcattcctgccgtttttaccaatgcataaaggcaaggcgggcaaacccgccttgccttgatttaatgcccgttcgtcatcagcgccagcgataa

SEQ ID NO: 105640 - DNA, 321 bp, Glycine max
  Peptide Sequence Number=SeqID_222418
atgcataatcatggatcaataggacctgttcgggaaaatgcctttggtgggaaactcggctctggggcgaaagagtcatcggcgcaaaagattttggttggtaatcaagaagaggaccgcttcatgtgtcacaagccatggtttcctttcttttctttcttgcttgtgacaattctcttaatagtgaacaagtcttctttcttgggagatccttctattccttcttccgagggcaaaggtaaaaattcctatcctaggtcaaggtttatggccgatgagctgaggttttggctcaaaaggcttgtagaaggtcgaacatga

SEQ ID NO: 105641 - DNA, 1038 bp, Glycine max
  Peptide Sequence Number=SeqID_222419
atggccctgagaaagcttccatcaaagaggtcaaggaaggagaccgccgaagaaggctccagcactgccccacaggctgacactgacttcgacaggcatcaatttcggagcgcagagcatcagcaatgctttgaggccatcaagggatggtcattcctaaaagagaggcgagtacaactaagggacgatgagttccttgactttcaggaagagatagcccataggcgttgggcaccacttgtgacacccatggctaaatttgacccggagatagtcaaggagttttatgccaatgcttggcctaccgaggagggagtccgagatatatgctcctgggtgaggggccagtggattcctttcgatgcggacaccctcagccattgcccagctattgtgcataccggggcaagatttcacccggaccgctatagagagacgggtgcggatcatgcacaccagcatgaccacccttacccagatatggatgacgttgctactcatcaacattctgcccaacaaccacaacatgcacgtggacacttacctgtgtcagttggtttatgccatcctgacacaggaacggcgcctatgagacaccctatggacccggagaggtccaacagggccctgaggtttcccgcgctgattatgggcctctgtcagttctgcggagttcctgtcgccctcagaaaggtcatctggccgcccatcactagagccttcatcgagaagtattgcaccccaggcaggtgcagggcaatgcaccacagcagcttaggacggccagccacaggcagccgatgcgccaccatcacccccggagtccacctcaacccacttgcggaggcagccaaccacagtggacaggtttggctgaacaagagtttctaccagtacactctacgccagcagggttgggattctaggccttacacatggcctactccagagcagtttgaggctgcggggacttctagaggtggggacgaagcccaggatgatcaggacatggccgacttgatagacttcctcctgtga

SEQ ID NO: 105642 - DNA, 165 bp, Glycine max
  Peptide Sequence Number=SeqID_222420
atggttgtggtaaatcaactcgatcagcatgaacgaccatgtatgggttactcaggaaaccagatttttctatcacagaaagtgaatggaaacaaacagatttccatttttttggtcggtcccggggtttgttatctagtgcgatcgcccaaggctaatgactaa

SEQ ID NO: 105643 - DNA, 554 bp, Glycine max
  Peptide Sequence Number=SeqID_222421
atgggtatctcctttagggccaacctaggtgtgagaggacttagggagcctatcttggaaaaaatctcaaacaagttggcctcttggaagcataagcaattctcacttggaaggagagtatatcttctcaattcgatgctaacctctttatccctattttatttatccttgttcaaaatccctagaaagatgcctatttgcaaagtgagggagcataggggtttgggggtgttggggtctaagtatgctggatggagggagttaggtatggagggaggaaaaatataccaatctatatggtggagtcttaagcttgggtgtggtgtgcaaaatcatgagaagtacgcggtggaggaggaagagggtgaacccaatggtggattttcagtcaaatcgacatattcctacttatatgatgagaaatatgatagtcaagaggtggatatttttgagactttgtggaaattaaaagttcctccaaaagttgtttttgtggagtggcttggtccatttggaggcataggaatgcacttggatttaggagccaaaacatg

SEQ ID NO: 105644 - DNA, 177 bp, Glycine max
  Peptide Sequence Number=SeqID_222422
atggaacgaggggtgggaccgaagggcaccttacctgagactgtgaagggggtttgtggaagcaacgatggtggctttagagggaatgtccatgacgagcttgcgacaagtattgaaggtcacaacggaggttgtggcagactgcggaggtcatggcaggatgaagggtgcgagtga

SEQ ID NO: 105645 - DNA, 222 bp, Glycine max
  Peptide Sequence Number=SeqID_222423
atgtttcggaaagtgaccatccagctcaagcttgtggagggtgactctgctggaactgaaccatttctatctcaatgcattgagcttttctcaagtgcagacaacccgatttgcatcaatgaattgaatattaccagtttaggcatcatggagattcctatttgcttaggtggctccatttcatccactggctccactttatatatgctcatgttttcctga

SEQ ID NO: 105646 - DNA, 2871 bp, Glycine max
  Peptide Sequence Number=SeqID_222424
atgggtgacaagtcccaagtattggaggctgtgttgaaggaagctgtagatttggagaacattcccattgaggaggtttttgagaatctgagatgtagcaaagaaggtctcagcagtgaggctgctgaggagaggttggtcatttttggccacaacaaacttgaagagaaaaaggagagcaaattcttgaagttcttggggtttatgtggaatcctctgtcttgggttatggaggctgctgctataatggcaattgcacttgccaatggaggggggaagccccctgattggcaagattttgttggtatcattaccttgcttatcatcaattcaactatcagtttcattgaggagaacaatgctggtaatgctgcggcggctctcatggctcggcttgctccgaaagcaaaggttcttcgtgatggtagatggaatgagcaagatgcctcggtcctggttcctggtgacatagttagcattaagcttggtgatattataccagctgatgctcgtcttcttgaaggggatcctttgaaaattgatcagtctgctcttactggtgagtcccttccggtgacgaagggccctggtgatggagtgtattctggttctacctgcaagcaaggagagattgaagccgtggtcattgccaccggcgttcataccttctttgggaaagctgctcaccttgttgataccactaatcaagttgggcactttcaaaaggtgttgactgcaattggaaacttctgcatatgttcaattgctgtggggatggttattgagattattgttatgtatcccattcaagatcgagaatatcgccctggaatcgataaccttcttgtgcttcttattggtggaattccaattgccatgcccactgtcctctcagtgactatggccattggttctcacaggctatcacagcagggggctatcacaaagagaatgacagctattgaagagatggcaggcatggatgtgctttgcagtgataagactgggaccctaacactaaataagcttactgttgacaaaaatcttatagaggtttttgcaaaaggagtggatgcggatactgttgttttgatggcagctcaagcttcaagacttgagaatcaagatgcaatagacactgccatagttggaatgttggctgatcccaaagaggctcggcttggtatccaagaagtacattttcttcctttcaatcccactgataagaggacggcattgacttatattgatcgtaatgggaaaatgcatagagtaagcaaaggtgctccagaacagattcttaatctcgcacacaataaatcagacattgagcgtagagttcatgcagttatagataagtttgcagagcgtggtttaagatcccttgcagtagcattccaggatgttcctgatggaagaaaagagagtccaggtggcccgtggcagtttattggtcttttgcctctgtttgacccacctaggcatgacagtgcagaaacaatacgcagggcactaaaccttggagtgaatgtcaaaatgattacaggggatcaactagctataggaaaggaaactggccgtcgcttgggaatgggtaccaatatgtatccctcatctgcattgctcgggcaggataaggatgaatctatatctgctttacccgttgatgaactaattgaaaaggctgatggatttgctggtgtttttcctgagcacaagtatgaaattgtgaaacgcctgcaagctaggaaacacatctgtggaatgactggtgatggagtgaatgatgcacctgcactcaagaaggccgacattggtatagctgttgctgatgcaactgatgcagctcggagtgcatctgatattgttttaacagaacctggtcttagtgttattattagtgcagtgttgacaagccgtgctatcttccagagaatgaaaaattatacaatttatgctgtctcaattacaattcgtatagtacttggctttatgttactggctctcatatggaagtttgattttccaccttttatggtgcttattatcgccattctaaatgatggtactatcatgactatttcaaaagatcgagtaaaaccatcacctctgccggatagctggaagctagctgagatatttacaactggcgttgtgcttggaagttacttggcaatgatgacagtcatattcttttgggcagcatacaaaaccaatttcttcccgcgagtatttggagtttctactcttgagaaaactgctcatcatgatttccgaaaacttgcctctgcaatctatcttcaagtgagcactattagtcaggccctaatatttgtgactcggtcacggggttggtcttatgttgaacgtcctggtattttgcttgtgacagctttcgtgattgctcagctaattgccactttgattgcggtatatgccaactggagctttgctgccatcgaaggcataggttggggatgggctggagtgatatggttatacaacataatattctatatcccacttgaccccatcaagtttttaattcgatatgctttgagtgggagggcttgggagcttgtcattgagcaaaggattgcattcacaaggcaaaaggactttggaaaggaacaaagggaacttcaatgggcacatgcacaaagaacattgcatggattacaaccacctgacaccaagatgttcaccgagcgcccacatttcaacgaactcaaccaaatggctgaagaagctaaaaggagagctgaaattgcacggctgcgagagctgcatacactgaagggtcatgtagaatcagttttgaaattgaagggtattgatgtagacacaattcagcaagcatacacagtctga

SEQ ID NO: 105647 - DNA, 1743 bp, Glycine max
  Peptide Sequence Number=SeqID_222425
atgggtcatgcagtgttgattttggtggtggtgatttccagcattgtgttatgcccttcttctcttgctctaacgcaagacggattgacattgttggaggtcaaaagcactttgaatgacacaaggaattttctcagcaactggagaaagtctggtgaaactcactgtacatggactggtatcacttgtcatcctggggaacaacgagttcgctcaataaatttaccttacatgcagctgggggggattatatctcccagcattggcaaactcagtagactgcatagactggcacttcatcaaaatggcttacatggaattattccaaacgaaattagcaattgtactgagcttagagcactaaagttcaaatacagggatttatcaagcaactcattgaagggtgctataccttcttctattggccgtcttacacagttgcgagttctgaacttgtcaacaaatttcttttctggcgaaatccctgacattggagtactgagcacctttgggaacaatgcgtttattgggaatttagatctttgcgggaggcaagttcagaaaccatgccggacatcacttggtttcccagtggtgctaccacatgctgaaatccctgacaaaagatcttcacattatgtgaaatgggtgctagttggtgcaataactataatgggccttgcacttgttatgacactttcattactatggatttgtttgctatcaaagaaggaaagagctgccaggagatacatagaagtgaaggatcaaatcaatccagaatcaagtaggaagaatgacggtacaaaactcatcacattccatggtgatctgccgtacacatcattggagatcattgaaaagttggagtctcttgatgaagatgatgtggtagggtctggaggatttggtaccgtttaccgaatggtgatgaatgattgtggtacatttgctgttaagcggattgatagaagccgtgaaggttctgatcagggtttcgaaagggaactagaaatattgggtagtatcaagcacattaatctagttaacctgcgtggttactgcagactcccttctactaagcttctaatctatgattatttggccatgggaagtttagatgatctcttgcatgaaaatactgagcaatcactgaattggagtactcgcctaaagatagccctcggttctgccaggggattgacttacttgcaccatgactgctgcccgaaaatcgtgcatcgcgacataaaatccagcaacatccttcttgatgagaacatggagcctcgtgtctctgattttggtcttgcaaaacttttggtagatgaagatgcccatgttacaacagtggttgctggcacatttggctatctagcaccagagtatctacaaagtgggagagccactgagaagtcagatgtttatagttttggagttctattgctagaacttgtaacaggaaagagacctacagatccttcctttgcaagcagaggtgtaaatgtagttggctggatgaacacattcctcaaagaaaatagattggaagatgtagtagacaaaagatgcattgatgcagatttggaatctgttgaagtaattcttgaactagcagcaagttgcactgatgcaaacgcggatgaacgtccgtcgatgaaccaagtgttacagatactggaacaagaggttatgtctccatgcccaagtgatttttatgagtcacaatcagatcactgttaa

SEQ ID NO: 105648 - DNA, 675 bp, Glycine max
  Peptide Sequence Number=SeqID_222426
atggttgtgattgcagacatccaagatgacttgggtaacctagtagcagcatccattgcctctcacaggtgcagctatgtccgctgtgacgtgacagaggaagtgcaagtcaaaaacctcgtggactccacagtcaacgctcacggccagttagacatcatgttcagcaacgcgggcatactcagttcctctgaccagacaatcctcgacctcaatctctccgagtacgaccgtctcctcgccgtcaatgcgcggggcatggcggcgtgcgtgaagcatgcggcgcgggcgatagtggagcggcgcgtgaggggcagcatcgtgtgcacggcgagcgtctcggcgtcgcacggcggcctgtggcgcaccgactacgtgatgtcaaaacacgcggtgaaggggctcgtgcgcgccgcgagcgcgcagcttggggtgcatggtgttagggtgaactgcgtctcgccgagtgggttggccacgccgttgacacgtggcgcgcatgcggcgatggagacgcatgagttgcagaagcagtacgcgcagagctcttggttgaaaggtatcgttttgacgccgaagcatattgcggatgcggtgctgtttcttgcgtgcggtgatttggagtttgtaaccggacacgatcttgtggtggacggttgttttcacggtgcttag

SEQ ID NO: 105649 - DNA, 313 bp, Glycine max
  Peptide Sequence Number=SeqID_222427
gcatgacaattttcaaaccttgaaaggttcctgttattttgaagtgaaccccctgaccaagactgcgatcgcagcagaggtgaagtatgaccttgcagatgatgagactactggtgtcaccgttggtgctcagcatgcattattttcttggacattgctaaaggctcgacttaacaacaatggcaaggtaggtggtctaattcaacaaaagtttgggacaaaattttccataaccgtggcgggagagataaatttgaatgagaaagctaaagaaaagtttcccaaggttggagtctccatggctttaaaataa

SEQ ID NO: 105650 - DNA, 309 bp, Glycine max
  Peptide Sequence Number=SeqID_222428
atgggaggagctgaagagaatgacaagcatgagggtgaagttgagaaggagcataagaaggaaaagaaagagaaagcagaggatgctggagaggaatctaaagagaagaagaaggagaagaagaataaggaagggaaagagaagaaggagaagaaccctgaagataaaaaggatcctgcgatattaaagcaaaagcttgaaaaactagactccaagatgcaagctctgcaaactaagagagaagaaatattgaagctgcttcaagaagtagaacaaggtgcagctaattcaagtgaagctactgcataa

SEQ ID NO: 105651 - DNA, 438 bp, Glycine max
  Peptide Sequence Number=SeqID_222429
atgagccagggtccgggcttatattttgatattggaaagaaggccagagatgttctccacaagggctatgctcaacaaccaccaatccactttaactacagattcttgaattggaatttagatctctcctgtcaagaagaacttgtgcatggactaaggggccttttcacatgtaacatacctgactcggggaagttggaaattcaacactttagtagattcagtgggtttagtgcaagcattggattatcgggagaagcagaaaaaggatataaccctgttgcaaacatctctggtcatataggaaccagaattctcaccctgggagctaatcttgcctgtgacttatcaggaagctcatcagctaggacaaccaacaatctgaatgctgggttgagcctgaacagtccctaccttgttgctgccgcaaccttgtga

SEQ ID NO: 105652 - DNA, 387 bp, Glycine max
  Peptide Sequence Number=SeqID_222430
ctcgtagttggaccttgggttgggtcgatcggtccgcctccggtgtgcaccggtcggctcgtccctttctgccggcgatgcgctcctgtccttaactggccgggtcgtgcctccggtgctgattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 105653 - DNA, 1467 bp, Glycine max
  Peptide Sequence Number=SeqID_222431
atgttttacttctatggtagtctacttctcttctttgaacatatgattctttggcctcaacaagtaggtggttcatttgcttacttgagagtggagcttggtgatttcgtagcattcatagcttcaggcaacattcttctcgaatacgtgattggtggtgcagcagtggcacgctcatggacatcctacttcgccactctctgcaaccaaccctccgacaagttcctcatccaagtccacggcctcgcagcagactacagccagctcgaccctatcgccgtcgtcgtgctcgtcgtcatcggcttcttcgccgtcttcagcacgaaaggctcctcccgcttcaactatatcgcctccatagtccatgtcattgtcctcatcttcatcatagttgctggcctcaccaaagccgaagccaaaaactactccgattttctcccctttggccctcgcgggatatttcaagcttcggcagtgttgttctttgcctatgttgggtttgacgcagtttcaaccatggctgaggagacaaagaaccccggaagagacattcctatcggtctcatcggctcgatggcgtgcacgacgttcttgtactgcatgttgtccgtgacgctttgtttgatgcagaagttttcggatgttgatgagaatgctgctttctctgtggcgtttgaagctgttgggatgagttgggctaagtacattgttgcatttggggcattgaaggggatgactagtgtgctccttgttggggctgtgggacaagccaggtacctcacacacattgctagaacccacttgttgcctccatggcttgctaaggtaaatgagagaactgggacacccatctatgccacggttgttatgcttagtgccactgctattgttgcatttttcacaagccttgatattctagctaacctactttcaatctccactttgttcttgttctcccttgtggccttagccttgttggttcgccgctattgtgctagaggggtggctacacagttgaatgttgtgaaattcattgtgtgtattattctcatagtgggctcttctgttgcctcggcggtttattgggccaataccacaaaatgggttggttacaccataatggtgcctctttggtttgtgggaacagtggggatttggctattggttccactaacaaagaagccgaagatttggggtgtgccactagtgccatttttgccatcagcttctattggcatcaatattttccttcttgggtcgttggataaggcttcgtttagaagatttggagtgtggactgcgattttgttggtgtattacctgtttgtgggattgcatgcatcttatgacatggcaaagatacagaagaagcagagattagaggccaagactgagtcaaagttggatgaagaaaatgttgctccatccgtgacagggtctggtacaaataatgaagatcatatatag

SEQ ID NO: 105654 - DNA, 147 bp, Glycine max
  Peptide Sequence Number=SeqID_222432
atgaaatctattactttttggcccaaacataggttcagaatcaaacgtccccgacaaactcaacaacatggcttccgaattcacctttctctcggattagcttggtggacggagaagatgaagcatgttagggaagaaggaggttag

SEQ ID NO: 105655 - DNA, 370 bp, Glycine max
  Peptide Sequence Number=SeqID_222433
atggaggggaatgacgcggaaggcgtgataaagttggagtcatttcagagtgcatggaattatggcaaagcactgttggagacaccgtgtcggctggtggatcgggtgacgggtcggtccatggacgaggtggagttgaaggaagtgaagaagcggagcgagcacgagatgaagaaaacgctcacgtggtgggacctcatatggttcggaatgggcagcgtcataggttcggggatctttgtattaacgggattcgaggtcaagaatcacgtggggcccggtgtggttctgtcctacgttatctctggaatctctgccatgctctctgtcttttgctacactgaatttgccgtggagattcccgtcgctg

SEQ ID NO: 105656 - DNA, 183 bp, Glycine max
  Peptide Sequence Number=SeqID_222434
atggcttcaagagcggaactacccatcaatgaagtcaagcattcaagtggagaatggcatggtggtacaaatgttgggaattttgttgctgcaataaaggtggaagaaccgcaaaatgttaaagaagaacctaaagcaatagttattagctttgatgatgaacttgaagctcttaagggataa

SEQ ID NO: 105657 - DNA, 345 bp, Glycine max
  Peptide Sequence Number=SeqID_222435
atgtgtaacacttgtcataactttgatgaatgtgaaacttgtgagacacacttcaaagttcagtttctgtacctctttttctctgaggtacaacaagcaaaaaggagcagaaataaagaaaaagaagaagaaaatcagaagaagcccaagtccagcaaggcgctaagcgcaggatgcgcccagcgtgcaagaaggcaaggcgctaagcgcacgacacgcgctgagcgtgaggcttcacgctcagcgagcttacgaaggcccaaacccaagtttgcacctataaataagagggtcagcctaggaaaacgaacacacttcctcagagctcagttttcaaacttctga

SEQ ID NO: 105658 - DNA, 3606 bp, Glycine max
  Peptide Sequence Number=SeqID_222436
atgacaacacgttcatcaaattctccacataaatcgttgtattcttcgggtggtcaacaaaatgaccactccaattacactgtgatgatgcctctcaccccagataaccaaccaggaacctctgattccaagcaagacaatgtaggtggcacaacaacaaggtttgccacagaatctcaacaacgtgggggtgggggtggcggtgagcctaaaatggaaagaagaatgtcttctgttttgagctcagtgaataacaagtccatgttgttgaggagccaaactcaagattttgatcataaccggtggttgtttgagaccaaaggcacatatgggattgggaatgcgttttggcaggacgattcgaattccttcggggacgaaggagtcagcatgtcggatttcatggacaaaccttggaaaccactaactaggaaaattccaatttctggggctatacttagcccttacaggttgttggtggttgtccgtataatagttctagctttctttttaacttggcgaattcggaatccgaactatgatgcattgtggttgtggggaatatcaattgtgtgtgagatttggtttgctttctcttggctccttgacatcctcccaaaactgaatccaataaacagaactgtagaccttactgcattgcatgacaagtttgatcaaccatctgcttccaacccaactggtcgctcagacttgcctggcattgatgtttttgtgtccactgctgatgctgaaaaggagccacctcttgttactgccaacaccattctttccattcttggtgtggagtaccctattgaaaaaatctcatgctatatttcagatgatggtggtgccatacttacatttgaagccatggctgaagctgtcaaatttgctgaggtttgggtacccttttgtagaaaacacaacattgagccaaggaatcccgatgcttacttcaacttgaagaaagaccccacgaagaacaagaaaaggccggattttgtgaaggaccgaagatggatgaagagagagtatgatgaatttaaggtcagaatcaatggactacctgaggtaatacgtgaaagaagcaaaatgcacaactctaaggaggagaagaaagcaaagcagttagctaaggagaaaaatggtggaactctaccacaagattatacaagtgatgtccctaatgctacatggatggctgatggcacacactggccagggacttggtatggccctacagctgatcactctaagggtgaccatgctggaatcttgcagataatgagtaaggtcccagatcatgacccagtattggggcatgcagatgagaaaactctagatttcacaggtgtagacatcagggttccaatgtttgcatatgtctctagagagaagaggccagggtatgatcataacaagaaagcaggagccatgaatgctatggttcgagcctcagctatattgtctaatggaccctttatactcaatttggattgtgaccactacttcttcaactcccttgctttgagggagggaatgtgcttcatgatggaccgtggtggtgatcgagtatgttacatacagtttccacaaaggtttgaagggattgatccttctgatcgatatgcaaatcacaacacagtcttctttgatggttatatcagtatcagaaacgtgtccaacatgacgaacaagagaggaaatatgagagcattggatggtctccaaggtccaatgtatgtggggacaggttgcatgtttaggaggtatgcactctatggatttgaaccgcctagattcattgagcacacaggcgtgtttggaagaacaaaaaccaaagtgaaccgtaatgcaccacatgcaagacaaagctttgatgatgatacacaacccttaacatctgattcagaaatgggttatccacagaagtttggaagctcaactatgttcatagaatccataacagtggctgaatacaatggaaggcctcttgctgatcacaaatctgtgaagaatggaagaccacctggagcacttatagcgccgcgtccaccattagatgctcccactgttgctgaggcaattgctgtcatctcatgctggtatgaggaccagacagaatggggagatagggtaggttggatttacgggtcagtgacagaggatgttgtgactggttataggatgcacaaccgtggctggagatcaatttattgcatcacaaagagagatgccttccgaggcacggcacctataaacctcactgatcgcctacaccaagtgctgagatgggccacaggttctgtggaaattttcttctcaagaaacaatgcctttttcgcgactcgacgcctcaaattcttgcagagaatttcatacctcaacgttggaatctaccctttcacctcagtgttcttggtcgtatattgcttcatccctgcactctcccttttctctggacagttcatagtcaatggcttgaatccagctttcctaatctatcttctgctcatcacaatctgcctcactcttctatccctccttgaagtgaagtggtcaggcattgcccttgaggaatggtggcgaaacgaacaattttgggtcattggtggcactagtgctcaccttgttgctgttgtacaaggtttgctaaaggtcatagctggcatagagatttcatttaccttaacatctaagtcagcaggagatgacgaactcgatgagttcgctgatctttacattgtgaagtggactagtctcttcatcatgccactaactattctcatcgttaaccttattgccttagtcatggggatcttaaggactgtttatagtgtgataccagagtggaataagctcttgggaggaattctctccattaccattgcattgctttggattacaattgatcctccaagtgactctatccaagcaggaaatcttgagtctggaactcatacgtgcatgcttcttcaccctaccctgacctccgcacatctcaccctcgctcttcaccctgccgtgagctctgcaatctgccacaacctccttcgtgacctccgatacttgccgcaagcttgtcgtggacattccctctattgcagcctcgtcgacggtgtccctgacatctttgatgccgctagtgatggcagacaaggagacgaagcagtaagagttaatagaaggggtggagttgacgatggctttggcgatagtggtcttgtcgcgaagaagggagttgggggcaaggagatgctcttgacctacgatgtcgtcaagggttctgggatgcaaacgctcgtacaagggttcgtgaatgtgggtgttggggtgtttcttgtctgcgatcttaaagaagaaagagggctattgttgtggttgtgctggagaaggagaaggagaaggtttggggaatttggaggggaggaaaggttgagagcaatatgtccggtttgcgggaagatcgcatatcaaaatccgaagatggagtattcaaccatctcaattaggaccctttctgctggttatttggaaattggagagtctgctgtggaaggtgccattagggaaacaagggaggaagcaaatgcagacgtataa

SEQ ID NO: 105659 - DNA, 760 bp, Glycine max
  Peptide Sequence Number=SeqID_222437
atgtacagatcattaatgaaaaacctgtggctaagcaagtgctatctcgctaagcccagatggcatccaggaagaggaaaagcactgcttccagacctcaagcttagtatgataccaggcgattccattctttggacgcttatttatcatactgagtttgacgagtttaaagtggaattggagaggcataatctacacaaatgcctcgccaatctccaagatggaagcatagatgtagctgtggtgaaggagttttatgctaatttatacaccacagaggagcaagcacccaagcaagccagagtacgagggcacctgatcaaaatagatgcaggcagcctgaatgagtgccttcatacgccagtggtattggaagagggggaatctttacccacttactctagattttgtaggttgaggacaaatcctcaggagattgaagctaggctctgtattccccgcaaggggtttgttttgaatgctgagggtcagccatggaagcttcttagaaaagatctgaagacactggccaagacatggagtgtcttcccttactccaacctagctcccacatcccacacctcagatctagatatggatagaggtaggttggtctatggcttagtgactaacagggacatgaacattagagcccttatcttaggtcagatttattctattgctcagagtaactcctctaggctcagatttccagccttgatgactgccctatgcagagctagaggagttacctctcaca

SEQ ID NO: 105660 - DNA, 258 bp, Glycine max
  Peptide Sequence Number=SeqID_222438
atggccaggatcagggaagaagctaccaagctccgagcagcaaggagatacaatacaaaggttcaaccacaagcctttcaacttggtgacctcgtgtgccaaatccgaggtgaagccagaaaagatcctagagcgggaaagcttggtcccaattgggaaggcccattcaaggttacaacaagcctagacaacaaagcatacaagctacaggaactggatgcaaagcaattccaagagcatggagcgcaacccatctaa

SEQ ID NO: 105661 - DNA, 612 bp, Glycine max
  Peptide Sequence Number=SeqID_222439
atggcgtatgggaggtcccagtatgtctattccccacatggcaaagggccaaggggatcacaaactgtgaagattgttaggaagggtgcgcggaatgtctgtaaactcttggcattgtctgcatctctttgtgaagtcaagggtgtctgccttgaatgttggcaagtagtagcaggaacgcaccacctttgttgcaagggatcatccccttgtatggacaccgcaaattcctttgtggagttctctcatgacataatctgcttggggtcattcaatttggttcctcctcttctcttggataatagtcttgaggtacccgatctttttagtgccagccagcttggagagcagtacttgagcaacactatttccttggtctggtatcttttagtaacctgcctctggacaagccacgagtctgtgcagcatcatagcttcttagccctgacttctcttgctagttttagacttgcaatgaatgcctcgtactcagcttggttgtttaaggctttgaagttgagcttaagggcttactctaaagtgacattgtcaaggccttcaagaatgtttcctaccccgcttcccttcatattggatgcaccattaacatag

SEQ ID NO: 105662 - DNA, 192 bp, Glycine max
  Peptide Sequence Number=SeqID_222440
gcattctctgaagaactcgctaagcgcgcctaccctgctaagcgagttcatcttttgaggatgaatactcatcctcttgttgagatgcctgtggctaagcgaggcggaatcgctaagcccagatggcatcaagaaagagggctagaatcgacgacatcccttcatcatccaccccagctcctcagtgattga

SEQ ID NO: 105663 - DNA, 1008 bp, Glycine max
  Peptide Sequence Number=SeqID_222441
atgaatgctaccaatagacaaattggaggaatgtttttcctgtatggatatggaggtactagcaaaacctttatgtggaagacattagctgttgcactacgttcaaaagccttattgttattacctaatggcagaactatgcattcgaaatttggtattcctgttcctacattagagaactccacatgtaatatccaccaaggaataaaacatgctcaacttctaaaggctatcaagttgatcatatgggatgaggctcctatggctcataagtactgttttaaagcattagataaaacattgaacaacatcatgctcatgtctaattctaacaatgttccatttggtggaaaagttgtagtctttggagatgttggtgatggaaaggtaggaactagtgatgataggctatatcaaatagaaattttgaatgaattgcggattacaaatttcagcaatcctattgaagtaattgttggtcatacttatccaggcattcaacacaattataaagatgaggaatttctcaagtctagagctattctagcttcaaaaaatgagattgtggaccaaataaatgactacatattaaacattatcctaggtgatgaaaaagaatatttgagttgtgattcaattgacatgatagatgctgcatcaagtgaatcttataaagctgttacaccagaatttctacattcattgaagacatcaggcatgcctaatcataagataaggatcaaaatagatacacctattatgttgattcggaatttagataaagcagaaggcttttgcaacgaaacaaggctaattgtgtctagaatggccaatcatgttattgaagcgcgaatagttacagggaaaaacataagaagtttggtgtatcttataagcaagcttcatgatgaatcaagattgattcaaggagttctgatgataacaaagatgatgacaaaagctcaaaagtcaagatcacttcatgataacaaaggagttcaagaatga

SEQ ID NO: 105664 - DNA, 405 bp, Glycine max
  Peptide Sequence Number=SeqID_222442
atggtgatgtgcaatgttaaggataatttatgtttagtttgggcaaaaattgttggattcatggataataaaccttggtgggaaatagaaaatggtgaacgattggtcaactatgatgacaacagatattaccatgttgaactcagtgctccactaattcccagttgctttgctgacttattcatgcaggatcctgattctagagtgtatccaccacagcaagtgctaaggatgtttcattcgaaggagttcttaactgtggcacaggagcctgctccacttgcaatgttaattgattggatcaagaagcaaaaggaggacctcgggtgtgaaggttttggcggaagcagaaataatgcatcccaagctacactaatttggaatgaggaatttgcatcttcttaa

SEQ ID NO: 105665 - DNA, 915 bp, Glycine max
  Peptide Sequence Number=SeqID_222443
atgtggagcatatcaagatcgcctaagtctattgttgagctaattttagttgacaagaaggtcaggcatgtttctggtcctgtggtgttgttgctcagtctggctaaaatcaaagaagcaaaaggttattgtttcattgcacttatccaacaacaatccataattcaatgttatggttctcaaatttttgtgaatattgacatgaaagaaattttggagttcaaggatagatcggtttctcctaatgcccaagtgaaatgctttgatgaacttagccaattgaaaaaggagtgtatgtgcgtcactgtggctacgataagcaagttgttggtagcgaatgggtggatttatgatgggtgtcccaaatgtaacaaaaaagttgatggagagggttcgtcatttgtatgtgttgggtgtggtaataagagtgcaagtacagttgcaaaagaatgttgtgctttgataaaagagactatagatgagcttaagcagaaaatgattgatgaggatggagtatttgatgcaagagatatactagaacaacttgatcgtgttctaggcaaaaaactagcattcagatttaaggttgtccctgggaatacacgccattcagtgtctcagttatctgatgatgatgaatttatcaagtttgttatttccaagcttccaaccttacaacatcaggatgaagctttgccttcagtatcagcgatgcacgagattaattatgttggtgatagtcaatgtttatcagccattactgagtttgatccaacactgatgggatccatcacaccgcctaagcacattttgccattatctaatagtcaagtggatgaaataccatttgaagatttatcatccatacaactatcctcaactactctgggcaaaaagcatatcaagattgaatga

SEQ ID NO: 105666 - DNA, 288 bp, Glycine max
  Peptide Sequence Number=SeqID_222444
atgtggatgataggtgttgaactgataaattgctctggactgccagattatggtctacaggggaagcctatatacaagaaagaaaatggggcacccacttttggagggtccacatcttctgcacctagtgtgctgggaaataagacgaaattgaaaaccaagtctgaccatctactgagtgattctgtggttactgaaaaaacatatgcatttggcatcgatgatggaccatcgtcatcatcacaacgtgcaggattgcaatctgcatggatagggaatacaggtcaa

SEQ ID NO: 105667 - DNA, 885 bp, Glycine max
  Peptide Sequence Number=SeqID_222445
atggcaaacctgtggctaagcgagtgttgtctcgctaagcccagtgttgctcgcgctaagcaccgcctctgtgggctaagcgctatttgttacagcatgcataaggctaagccagcgctgctcgctaagccattgtttgaaataaaaatggcatccaggaagaggaagagcactacttctaggcctatagctcaatacactgacaacattctcggctggaatatcctttcagagagaaatgtgaagctttatcatactgagtttgacgagtttaaggtggagttggagaggcgtaatctgcacaaatgcctcgccaatctccgggatggaagcatagacatggctctagttaaggaattttatgctaatttatacaccatggaggaacaagctccaaagcaagccagagtaagaggacacctgatcaaaatagatgcaggcatgctgaatgaattccttcagactccagtggtgttagaggagggggaatctttacccacctactctagattttacaagttaaggactaaccaccaggagattaaagccaggctttgtattccccgtaaggggtttgttttgaatgctgagggccaaccatggaaaattctcagaaaagatctgacgacactggcccagacatggagtgtcttttcttactccaacctagctcccacttcccagacctcagatttgaatatagacagagctaggttggtctatggcttggtaaccaacatggacatgaacattggagcccttatctcaggtcagatttcttctattgctcagagtaactcctctaggctcggatttccagccttgatcactgcccatgcagagctagagaagttacctctgacagtcttacctatgagagcctga

SEQ ID NO: 105668 - DNA, 2323 bp, Glycine max
  Peptide Sequence Number=SeqID_222446
cgtcactggtggattgaggagtgacgacggttgcactagggagtggggttgtcgcggttgcgagggagtagcactagttgctcatgaggtagtcatggttgcacgagggagtgacgttggtggctcatggggtggcaaggaaagtaacattcatgtaattatacttgggatcactgcagctaatgagagttctgaggttgagggcataataggagctattttagatagtagttcccgcattggccaagagcattcagtggctataaatctggcattggaagactttaatataaaaaacaatctgagttttgctctgcatgtaagaaactctcaaggagatcctcttttggcagctattgcagctagagatctaattgataatcagaaggtgcaagcaatcattggaccacaaacatgggcagagacatctttagtggctgaagtatgtacccaaaagagtatacctctgctttctcaagcagatgcaactccagaatgggcaatgaagaagtggcccttcctgctgcaatcctcacctagccaaattatgcagatgaaagctattgctgaaattgtgaagtcttggaaactctataatattaccatgatatgtgaagatggagactcatcatctattgaagttttgtctcagctctctggagctcttaaagaagttgggacagaattaagcaatgttatagcaattctgcctctagtttcttcttcgttgtctcaacaacttgagaagctaagagaaggacaatgcagagtccttattgtccatttgtcctttcctttggcactacacctgtttgaaactgcaaaaagaatggatatgatgggggaaggtaatgtatggattactactggtacctttacaagccttgtttattccttgaatgcatccactatctccaatatgcaagggattattggagtcaagagctatatccaaagtctctggtaccaaaatgcaaacttctaccatagatttcggaaaaattttagctcagagaattttgaagagtttaattatgagcctgggatctttgcagcccaggcttatgatgttgcatggattgttgttgatgcaatgaggaaaaccaaccaaaaagggggtcaacttttgctagataagatattacttagtaattttactggcttaagtggaacaattcagttcactgacaataaattaactccagcacatacttttcaaataattaatgtgatagggaggagctacagggaaattgggttctggtcagatggacttggtttctcaaaatctttggaacaaagtgccttttacagttcaacagtgaaggaattaggaaaagtagtcaatccaacatgtgccatacgactaagaattggtgtcccctccacatcaacattcaaacagtatgtcaatgttattcaagaagattctggaaatgacacttccttcaagttcgagggatttgctatagatcttttcgaggaaacagtaaaaaaattgcaagggatttaccatgtggaatatgactatttaccctttaatggcaccacatatgatgaactggtgaagaaagtttattggaaggaatatgatgcagttgttggtgatgtcgcaatagtgtccacgcgttatgaatatgtttcattcactcagccctatactgatccaggagtggtgatgattgttcctgttaaatcaaaaacaggcaacagagcatggctatttttgaagcctttcacgaagctcatgtgggttctaatattggtcatcattgtctacaatggttttgttgtatggttgattgaaagaaaccactgcgctgaacttaagggccctattctgcaccaaaccacaactatgttgtggttggctttctgttctttgttctctgtgaatggtagggtggcaacggtggtctggctttttgtggctctaatcattacacagacttacactgctagccttgccagcatgttgactgttgaacagtttgaaccaactgtagacagcattcagcagctaaagaacagcaatgccatggtaggatatgatagaggatcctacttgaaaatatatctccaggatgtattgggcatcaaagctgaaaacataaaacaatttgactcacagaagagctatgctgatgccctaagaaacaaagaaatagcagctgccttccttgatatccctgaggccaaaattttccttgcaaagaactgtaaagggtttgttcaagcaggacctacatacaaaattggaggatatggatttgtattgcttcaacatttctttcactttttccctgtatttgttgctgagtaa

SEQ ID NO: 105669 - DNA, 3408 bp, Glycine max
  Peptide Sequence Number=SeqID_222447
atggcggagatgtcggaaaagactgaagcagagaagaaaattgatttggtgaaaaagatcccttcaccatatgatctgaactctagtgataatccaggaaacctgattactaaggttcagctgaaaggggaaaattatggtgagtgttctagagctttgcgtacttctcttcgtgcaagatgcaaatgggggttcgtggaaggaaaattcccgcagccaaaggaaggttctcctgatttggaagattggtggacggtgcaatccatgctggtctcatgggtactgaacacaatagaaccaagcttgtgttctaccatttcgtatcaagagaacataaaagacctatgggaagacattaaggagcggttcttagtagtgaatggaccaaggattcaacagataaaggcagaactggcagagtgtcgacaaacaaagatgaacatggtaacatactatggaaagctgaaaagcttatgggatgaattggcaaattatcagcagattcctctctgcacttatggaggatgcaagtgtgacgttgggatcaaaatggagaaacaacgagaagaagagaaagttcatcaattcttgatgggtctagatgatgttttgtacggtacggtccgctctaaccttcttgcaactgatcccttgcctacattaaatagagtgtatgccactttggtgcaagaagaaagagtgagaaccatatctcggggaaaggaggaacgaggagaggttgttgggttctctgcacaggcccgtggaagaaccaaaggactcgctgaatcaaaagacagaaatatggtatgtttgaactgtaatcgaacaggacatgaagctgaaagttgcttccagttgattggttatcctgaatggtggggagatcggtcacgaggtgaagagaaagccaatgggagaggaaaaggacggcaacgaggaggagctgcacctagcagaggcagaaacgggggtgttcgagccaatgcaacactcactaatggagaaaccagtgttgcaccaactaatgcaaacaatgcactgaccgggctgagtactgaacagtggcaaacactagtggattttttaaatagccaaaaagggaacataaatgacaagatgacaggtaaacatagtgtgtggattgttgacacaggagcttctagtcacatgactgggaacttgaaattcttgcatgggctgagagaaatagcaggatgtccaattggacttccagatggaaaacaagtgttagccaccaaagaagggacaacaatacttggtggaggattgaaaattaagaatgttctttatgtgccaaaattgaactgcaatttgatatctatctctcaactgattgatgaaaaaaattgtattgtccatttcactgataccttatgtgttatgcaggaccgcacttcgaagatgctgattggagcggaatttccttttgctcatacaagcaaggaaaggaacatttcatctgtggtttctcctgtagtgttccccttgttggttggtgataatgatagcagatcccatgatcaaattgacatagaagaagaagtaagcccagacaatggtgttgatatgggtcctaccgtaagggggcgtacaaatgactcagacaatgaggcaagtgaatattcaaatccaaataatccttctgtcgatcctcctacattagatttggttgctcacaacaatgtggaggagttgggaagaggtcaccgcattaggatgccttcagtcaagttgcatgactatgtcactcacattgtacagaagttaagcccatctcccagtccgccctctccacagcataattcaggtgcgccttatcccttaatacattatgtgaattatgacaaattctttgtaaagcatcgcaggttcattgctgctctcactatggaacatgaacctgtccatttttttgaggcagtgaaagatgctaagtggagacttgcaatgcaacaagaactcgaagcactggaaagtaatgggacctggactctgcaacccttgccggatgggaagaaacctcttggttgtaaatgggtgtataagatgaagcataactctgatggcaccatcgaaagatacaaggcaaggttggtcattcttgggaatcatcaggtagaagggattgactatactgagacatttgctcctgttgttaaaatggtcactgttcgtcttgttcttgtcatagcagcagcaaagaagtgggaaattcatcaaatggacgtccataatgctttcctccatggtgatcttcatgaagatgtttacatgaagttgcccccaggctttcgcacatctcaaccaggattagtttgcaagttgcgcaaatcattgtatggcttgaagcaagcccctcgatgttggtttgccaaactatcatttgccttcacgaattttgggtttcaacaatcatcctctgaccactcgctctttactcttcttaatcatggagtgcaactggtagttttggtgtatgtggatgatttgatcgtgtgtgggaatgactccactacaatccaaaaatttaaagtatatctcagcaagtgctttcacatgaaagatttggggaccctgaagtattttcttggtgtagaagttgcaaggaatccaagtgggatattcttatgccaacgtaaatatactttggacataattcaagaaacgggtttacttggtgccaagcttgtgtccacacctcttgagcagaaccatcagcttagtctcgctactagacatcttcttgatcaacctgaacgttatcgacgtctagttggtcgtctcatctatttgtgtttcaccagaccagagctatcttattgtgttcacctcttgtcacaattcatgcaacaacctcgtgagaaacactggaatgcagctcttcgaattgttaaatacctaaaaggaagtcctggtcaaggcatacttcttagcagtacggctaaatttcagttgcatggatggtgcgattctgattgggcaggctgccctttaacccgacgctcaaccaccggctggtttgtgttcttgggtcactctcctatctcttggaaaaccaagaaacaacacactgtttctcgttcctcggctgaagctgaataccgctctatggctaccaccacctgcgaacttaagtggcttaagatttttcatgaatgcacgaagcatatcgaagtggattgtcactttattcgcaatgaggtacttcaaggtaatgttcagccatcttatgtccctacgtccgaacaattagcagacattatgatgcaatcctaccttgcaagggcattggatagaagactccaagtagaatgggccaaagatgcaagagaaggccctagggttcttatgagccttagggtagatttcgggcccatggactaa

SEQ ID NO: 105670 - DNA, 2046 bp, Glycine max
  Peptide Sequence Number=SeqID_222448
atggaatatatatttttggcagctagagatctcatcgataatcaaaaggtgcaagccatcattggaccacaaacatgggcagagacatctttagttgctgaagtttgtacccaaaagagcatacctttcctttctctagcggatgcaactccagaatgggcaatgaagaagtggcccttcctgctgcaatcctctcctaggcaaattatgcagatgaaagctattgctgaaattgtaaagtcttggaaactctataatgtcagcatgatatatgaagatggagactcgtcatccactgaagttttatctcggctctctgaagctcttacatcagttggcacagaattaagcaatgttctaacagttccacctctagtttcttcttcattgtctcaacaacttgagaagctaagagaaggacaatgcagagtccttattgtccatttgtcctttcctttggcactacacctgtttgaaactgcaaaaagaatggatatgatgggggaaggtaatgtatggattactactggtacctttacaagccttgttcattccttgaatgcatccactatctccaatatgcaaggggttattggagtcaagagctatatcccaaaactatggcaccagtatggaaacttctaccatagatttcggaaaaaatttagctcggagaattttgaagagtttaattatgagcctggaatctttgccaccgaagcttatgatgctgcaacgattgtggttgattcaatgaggaaaaccaacaaaaaagggggtcaatttttgctggataagattttacgtagtaattttactggcttaagtggacaaattcagttcaatggacatgaaagagctccaaaacatacttttcaaatcattaatgtgattgggagtagctacagggaaattgggttctggtcagatggacttggtttctcaaaatctttggatcctaatgcttcttacagttcttcagtgaaggaattaggaaaggtagttaatccaacatgtgacatacgactaaggattggtgtcccctccatgtcaatcttcaaacagtatgccaatgttattcaagatcactcagaaaatgttacttccttcaagggatttgccatagatcttttctatgaaacagtaaaaaaattgccataccatctggaatatgattattttgcgtttaatggcacatatgatgagctggtgaagcaagtttatctgaagaactatgatgcagttgttggtgatgtaacaatagtgtccacgcgttatgaatatgcatcattcactcaaccctttactgatacgggactggtgatggttgttcctgtaaaatcaaaaacaggtggtagaacgtggctattcatgaagcctttcacaaagctcatggtggcaatggtagtatggttttttgtggctctaatcattacgcagatttacactgctagccttgccagcatgttgattgttgaacagtttgaaccaactgtagacagcattcagcagctaaagaacaacaatgccattgtaggatgtgatagaggatcctacttgcaaagatatctgcaggatgcattgggcatcaatgctgaaaacatcaagcagtttgactcacaagagagccatgctaatgccctaagaaacaaaaaaatagcagctgtcttccttgatgttcctggggccaaaattttccttgcaaagtactgtaaagggggatctccattgcttcctggtgtaaaccaagccctgctgaacatatctgaaagtggcacacttcgtgatctcgaaaacagtatgcttgcatcagagaaatgtaaagacataattgacccaggtgcagaaactactagtcttagccctgcaagcttcatggtgctcttcatcttaactggaggcacttcaacaactgctctcttaatttacatattttctgagagttatttatggcctggacagagaacaatgtggagtctaatgatggctgaaaggccaatatctgattcagttgatgatctgttaaaagctgttgcgtactattag

SEQ ID NO: 105671 - DNA, 303 bp, Glycine max
  Peptide Sequence Number=SeqID_222449
atgccaccccgccgaagtcagccgcacaatctcaaaggtggttcctgtgccgcgcacgccccggcatgccctgcccttctatcgaagttggagatatgcattattgcccccattaggataggtaggaatgcttccaacctacaaaaatcctgggatgttgaagtagtcagcaagttgcaatggggtatgtggtgcattgtaggagacaccattgacaacatacctctgcttgccattgatataagggccagagtttgcgagcatgatggttcaactcagtttgatcaatccacagtggtatga

SEQ ID NO: 105672 - DNA, 195 bp, Glycine max
  Peptide Sequence Number=SeqID_222450
atgggggagcggtggagacaattcatgtctgatttgacgttgaaatgggcacttgcagccgacaaggaaagtgtcgacgacactgtatgccaaaaatgtgcagaaaaaggcacaggccatctagaagcaaaacattaccctccacgggttatctcctgggggttatgcatatttagaaaagaagttgatggatga

SEQ ID NO: 105673 - DNA, 108 bp, Glycine max
  Peptide Sequence Number=SeqID_222451
atggaaccaaactatggggatgtatggatgtccctgttgcatgctggggatgcattgaccttgttggatgcccctggtgggggaaatagagtggttaaggagttttaa

SEQ ID NO: 105674 - DNA, 315 bp, Glycine max
  Peptide Sequence Number=SeqID_222452
atggcattaaaagttgcaaactataataaactcccctcacctattgtgagccctccttcagttcctattggtgttgctgaaaggcctctctcgttcatgcttgtcagtccaaacgcaagattttccaaaggaagtgtaaaaacaccctattacagtagccaacacacaagagacactatgatggaaacttgcttgtgggacttctatggaggctggatctttgagcttcaatggggtcctttaatggtgattttccaccatggagatgcagcagaagacaaaggaaaagaggtgagaggaggcgccatccattaa

SEQ ID NO: 105675 - DNA, 330 bp, Glycine max
  Peptide Sequence Number=SeqID_222453
atgactaggtggatgactttaaagaaccacgtactagaggactctaggacacaatgctcagataggatgatagagggtgttacaatctccaccccggaaaaagagactaaggcatccaacactaagaccctctgtgaatataagcctaagagaaccctactcttagccaaaactagaaaaccatattctagcatgctggaaagaaggattcatggggatcctccaatagagtattggaatgacttgaaaagtgcccttaggaagaggcatatcccctcttactatgaaagagagcttatggacaccaaaggcttagacatgggagtatga

SEQ ID NO: 105676 - DNA, 1062 bp, Glycine max
  Peptide Sequence Number=SeqID_222454
atggtgcagtggcctactccatcctcttcaaaggatctcaggtccttcctcgggctcaccggattttaccggaagttcattaagaactactccacgatggcggctccactaacttcgatcttaagcaacgacccattcgagtggtcttcagtggcccagagtgcctttaaacaactcaaacaggccatgtcctcagccccagtattagccttacctgatttcaacgagcccttcgtcctcgagaccgacgcttcaggctccggcatgggcgctgtactcacacaaaaaggtcaccctctcgcgtttttcagtaagcaattcgggccacgaatgcttcactcatccacctatgtccgcgagcttcacgccatcgtctccgccgtacgcaaatggcggcagtaccttttagggcactccttcactatactcacagatcacaaaagccttcgtgagcttatgtctcaggtcgtccaaacacccgaacagcattactacttatccaaactcttgggctttgattatacaatacagtataagactggatcatccaacgccgtcgccgatgccttgtctcgaacgaatactgaaccttctgctgcaatgttacttctctcaatgcctcaccatgacttcatggaagatcttaaacgcaccttacactccaatagtgagttccaagccttacttgccaaggttcgtacgcaacccgaggatcaccccgactatcgcgttcataatgacttattattcttcaagaactgcatctggattaaccatgataacccatatattcctactttgatgcttgagttccatgcaactccactaggaggccacttcggggtcactaaaaccattcataagctcgaatccagcttcttctggtcctccttacgcaaggatgtcaaacgttttatcagggaatgtaccgtttgtcaacagacgaagacgacaacccagcgtccagcaggattactccaaccactccccattccctttggagcctgggaagatatttccattgacttcataacccaccttccgcaatcacatggatacacc

SEQ ID NO: 105677 - DNA, 357 bp, Glycine max
  Peptide Sequence Number=SeqID_222455
atgattaacttctacatcgttcttcgtttggtgttcttcgttcgtcatccgggatggggagccccgcttcccgttctactagcaatcagaccttaccagtttcaagggatgatcctctcgttgccttggatggttagacctagtgctatgccaccttttgttgttgttcttctagctggagaaggagttgttgaggtctcccccaacgtgccttcctctgttttggataagagcaagcatgatgatggtgttgggtgtcaagccggtctaccttcagctttgttgactgtccatgccactgctctcgctaccgttgctgctcctgctcctcaacctaatctttctgcccctatttag

SEQ ID NO: 105678 - DNA, 585 bp, Glycine max
  Peptide Sequence Number=SeqID_222456
atggccctaggggacatggcagctcgcccaggcgagttgttgcttcaacctgaacttcttggtgttcaaggaatcctagcctatcttgcatgtcaatttcatcttaaagaaatacaaaaatacctacacactagatcggatgttgaagaaggggcacaagacctcgaaggccttcaccatggcccaactattagggtgaagttgagagggggctacattcaagtgcacaagcagagcacaccgaaagttgttcaaagggagtaccaaacccaaaacatcaaaaagacagtagtacataaaaaagaaggatggactacccaacaccgccctcaaaaagggaaaattttcattcccgcaagcttggacgactatttggtaggatccctcaagcccatcgacgacaggaggggacgatggttgcaccctcctacgaagatgaggggtgcctccaccaacatggcacgagaccatcaacctcttcgaggaagaggactcactatcggaggatccatgacatgtcctcccgatccaccaggggttactgaatcaaacccccgaaatcactaccgcctatacccatggtag

SEQ ID NO: 105679 - DNA, 687 bp, Glycine max
  Peptide Sequence Number=SeqID_222457
atggtgtcggttaacgttcgtccttaccggtaccctcactttcagaagcatgaaatcgaactccaagttgagatgatgcttcaaaagggactgatccaacccagcacaagtcctatctcgtccccagttattctagtcaggaagcacgatgggtcctggagattttacgtagattatcgagctctgaatgtcgtaacggtcaaggacagattcctcatccctatgattgatgaacttctggacgaattaggagctgcttgctgtttctcgaagggcgtcgaacccgtagcttccaaggtcacatctattcagcaatggccagtgcctcagtctacgagggccttgtgcagcttcctcgatcttgtcggattttatcgcacgttcatccgaggctatgcaaccattgctgcccccctggttaaggcaacaacagtggatccctttcagttgatgaccccaactcatatagcatttgatcgtctcaaggaagctctatctacagcgctggtgctggccctaccagacttcaacaaacctttcactcttgagacaaacgcgtccggggtcggaatggatgtcgtcctgtctcaacaaggccaccccattgccttttttagcaagcccttcacttccaatcttctgcgatcgtcgacatatgtgcacgaactctgtgccatcaccatggtg

SEQ ID NO: 105680 - DNA, 219 bp, Glycine max
  Peptide Sequence Number=SeqID_222458
atggaccgattaggagtagttggaaaaaaggaacctgatgctgtttctcttgcccgcacggaagaggagcctgaggcagctgcacgaaagttaacagaagcagcattttctcgtgggagtgcagataacattacatgcattgtggtgcaattccaccatgagaaagcagaactagctaatcctgacaaagcagaagcagctagtgctcagcatgagtag

SEQ ID NO: 105681 - DNA, 147 bp, Glycine max
  Peptide Sequence Number=SeqID_222459
atggccatgattgttgctgcttccgtgacccatgacagtggcggatccaagaccttaagtcagcgggagatcaaagcgctaaagattttacaccagcaaaggaaaaaccatctcgagcctttaactaatgggaatataagctcttga

SEQ ID NO: 105682 - DNA, 321 bp, Glycine max
  Peptide Sequence Number=SeqID_222460
atggggtgcctcctcacaaagggggtcgcagtgaccgggcctgggcgactgtttatcaaaaacacatgtctccacaaagtcatacatgatcttggaaagaagatttggacatcaaagggagaagaaaaagaagctgccaagaaggagttcatagaggcccttaaattgttggaggaacaactgggagataagacttattttggaggagacaatattggcacttattatttatttagcaagcatcaagtttttatttttgcaaaccctccttctgtcaatactcagtacgaatttaacaaattaatcataatcctcttgtag

SEQ ID NO: 105683 - DNA, 819 bp, Glycine max
  Peptide Sequence Number=SeqID_222461
atgtgctgcaaggcgattaagttgggtaacgccagggttttcccagtcacgacgttggcgaattggagctccaccgcggtggcggccgctctagaactagtggatcccccgggctgcaggaattcgatcattttcaagcaatcctcgctgtacgtcggccaccagaagctggtgcccgaggtcggggattggcgcaccttggcccaggaaaatggagggcgcgtgctggttcgcaaccagcagggcgttgaactcatctcaaatgtctgccgccaccgccaggcattgatgctgggcggccaggccggcgacgtcaccggccattgcaattcgcacggcagcctcaaggccaccggcggcaacatcgtctgcccgctgcaccgctggacctacaacaaccagggcgagctgctgggcgcgccgcagttcgagaccacgccgtgcatgaacctgcagaagttccggctgcgtgattgccatggcctgctgttcgaaggcccgcgcgacccggccgccgacatggcgccgctgttcgcgcggcccgagttcgacttcggcgattacgtgctggaccacgtcgaagtgcaccagtgcaactacaactggaagaccttcatcgaggtgtacctggaggactaccacgtcggcccgttccaccccggcctgggccgcttcgtcacgtgcgacgacctgacctgggagttcaacgactggtacagcctgcagaaggtcggcgtgcacaacgcatcaagcttatcgataccgtcgacctcgagggggggcccggtaccagcttttgttccctttagtgagggttaa

SEQ ID NO: 105684 - DNA, 801 bp, Glycine max
  Peptide Sequence Number=SeqID_222462
atgctggcggtgatggtagcgccgaccgtgggcatcaacccgtttgacccggtatggatcgccacgctggtcggtattgtcacgctgagctcagccggtgtggcgggcgtcggtggcggcgcgacttttgccgcgctgatcgtcctgccggcgatgggactgccggtcacgctggtggcattgctgatctccatcgaaccgctgattgatatgggccgtaccgcgctcaacgttaacggctcgatgaccgccggttcactgaccagccgctggctgggtatgaccgacaaaaaagccgcaaagcctgccgttttttttgccgttttctgcacttttttccgcaatcatggcgctaacgtcaggaaaacgttaagcatggcgaatgctgcggggagttaccgcaggagaaccctcatgagaaacgttatcgcctcaatgctggcgttaaccctgatagcgccaaccgtaagttttgctcatccgtatggctggggtccgggccctggcccgcactggggtggtccgggaccccgctggggccatcccggaccgctgcgttttctgccggaggccgcgaccgccgtgctgattggcggactgacctactacctgctgaacggtagctactaccagcggcagggcgacacctacgtggtggtccagccaccggatggcccaccggccagcgccatgcgcgttctggattacaacggcaaacgctattacgtgcaggatggtcactactatcagcgcgagatcagcggcagctacattgaggtgccgcggccgtatgggctgtaa

SEQ ID NO: 105685 - DNA, 396 bp, Glycine max
  Peptide Sequence Number=SeqID_222463
atggaacagcaggatatggctgatacaaccacccttagttattggttaaattggaggttctatctgtgtgcagtttgtgttttgctgtctattgtcctttcatttcttgtaatatggaaggataagggttcaaggaaattcagatctggaaaaggagaaaatcaggaagatgggactttgtctggtgatgaagcatggaaaccattccttaaagaaattcacccagtttgtttgctagcttttcgtgttattgcattctcttccctgttggcatctctagttgccaaaattcatattaatggcagagccatatttttttattacactcagtggaccttcactctggttacaatttattttggggtatggcttgtaatttttcttggaggcctttaa

SEQ ID NO: 105686 - DNA, 894 bp, Glycine max
  Peptide Sequence Number=SeqID_222464
atggcggtcaactctaatgttaaaccagctccaaattttgacaaggacactcatttcaatgcccaaccctatgaagaattgctatcaaggttaggcattaagcacttaataacctttgtcaagcatcctcaaacaaatgattatgcagaagcagcgaacaagaagaagtccaagagatggccagggtcaaggaagaagttacctagctccgcgtctcaagaagatataacaccaaagttcggcctcgcaccttttagcctggtcgtggtgagcttagacaatgaagcatacaaacttcaagaactagatggaaaagaaatcttgagaaggacaaacattttgttggtgaaatctcccaaggctcgtcaaacccaaggtttgtccttggtgaatcttgccaaacccaggacaaacgtgttcctagtcaactctccaaaggatcgtcaaacccaaggtatgtccttgttggttctcaccaaacccaggacaaatgtgttcctggccgaatcttcaaaagctagtcaaacccaaggttcatccttgcttcgcaaagtgaaaagggaagcaccagcaagtgagaagccaaaacccgtgcgcacccatctttgcaacatgattattgtgcctgagattaatgatagcaccattggagtctaccatgacaagaccttcaatcaggttgaaatcaaacccgagatgattggacattatttcactgagttctctatttcatacaaacccgtcaagcatggtatgtcataccaaatgcgaaggatcacactcgttgttcctagacgaggccaaatccaatttcaacataaccccaaacaggcggtatgcgaaatccaaataacaaattcgcaacacaacaggttaatgcaagaaggaaaatag

SEQ ID NO: 105687 - DNA, 105 bp, Glycine max
  Peptide Sequence Number=SeqID_222465
atggagtccaatgaccttcacggtggtgattttgttgagttccttcgcctaatgaatgagggggaaccaacaaaagggactccaacactcaagctattagattaa

SEQ ID NO: 105688 - DNA, 1254 bp, Glycine max
  Peptide Sequence Number=SeqID_222466
atggtgagggatttcgatattttatgctcattctttaacattcgccctagtgttcatgtgctcatgtactttttccaaatgaagttgattgaaaggagagtagcgagcatcattttcccttctactagcaatcgaaccctaaaaggaataatgagtgactttgagtggcatcctttagtgaagcaggttgaacctgtcgatgacgtgctccctcccccaactagtgtcaatgaaccctctaaagggggaggagatccaattaacgctaggatcaactactgccaagaggaaacatggcgaaaaggttggggggatcagactacgcaagaggtcaaaggctccctttattctttggcatctagttcaagttgtccttcttccattcttcctaagactcccaacccacgaagcccaccttcgaccccctcaatcgttcagactactgctactacggtcaatgcctataatcctcttgctcctccacctttatccaccttagtggtttctgtatctcttccatatacactggtcactttcgctcctacccctgttgtgcttgcttctatttcttccttggcaccaccgctgcttagtgtggggctgacaaaggtacaaaattcaaatggtgctacaaaggtcttccttcagaagagcttggctattttagaggagagtgagaacaagcataaggaggctatggacataattgcttccttggagcgagtgaagcgtcccaaggtggccgatgttactgttgcctttgtcgaggctatcaagtcaaatcaccagttgtcgttcagggagtttggacattataaagatgcattaaaagagaatgatgacttggcaggtgaggtgaagcgctctgctagggagagggaaacacttgatgtcacgatggcagaattcgcaagagtgattgctaatcttcaagcccaactgagggattctgagctcacaacgtctaacctccaggccaagctgaaaaagtttgagcttgaagtggcaagggagaaggaggccaacaaggagctaaatgatgagcttatcatgtttaagaaagagccagtgcagcaacatgagaaagggttcttcaaagttgtcaggtatgaagggctcttttccaagggtctcgatctgaacctctttgacctattcaaagatgtgaaggacggtaaacttcttgatgaggacgagattactgctatagaggagtctaatggaggggaggaggatgatagggttgatgtttag

SEQ ID NO: 105689 - DNA, 201 bp, Glycine max
  Peptide Sequence Number=SeqID_222467
atgacgatttggaaacaacgtgcaaaattagtcatggccacaactaggtgggtactcaagcatccagtttatggcattgtgatactaaggcttgggatgtacacaagtccaaattatgttctttcatcggacgacgttcctaaaggaaaactctacaaggttccggaatttcaacaaacactatcgacaataacgaagtaa

SEQ ID NO: 105690 - DNA, 366 bp, Glycine max
  Peptide Sequence Number=SeqID_222468
atggggtggggtgggttcataccaggcttccggaataaccttccagaagaaccatttcggaaggctattccgaaatgtctattccagaaggctattcaagaatatttggaagtgcctaagagaattcctcttagcttgtatgaatttatattcatatttacaatgcttttaacctatttgattgttcagatggcgcatacaaaaagattagttttgatggtgatgatgacaatgacaggtgcaatagaccaacaatgtctgaatagaggcaatcaacctgtgcaagtggagcctctcaagcatattgaccaagtccatgctgttcaggaagtggagcatgctgagcatatgcaacctatggactag

SEQ ID NO: 105691 - DNA, 357 bp, Glycine max
  Peptide Sequence Number=SeqID_222469
atgaaagaaagaggaggaagtagggacttaccgatcaagccaaaggagaaaggcgacgaagcagggggacgtgcgcgcgtggggcggtgggggggggggaggtgcactgcaagaaagggaattggttggattatgagggagggagaagttaggattggggtttcattaaggcaaaacttccttcttttaaggcaccctgatgtagctcaatgtggagcttataggccttggatcttcttcatcaatggagttctttgcttcttgaagatcaatggcagtggaatggagaaggaggaaaggagattggagatgccacttcaaggagaagatgaatcaagaacaagctcaccaccatag

SEQ ID NO: 105692 - DNA, 351 bp, Glycine max
  Peptide Sequence Number=SeqID_222470
atgaataagggtccaatagctaaaactgacggtccgaacagcaatgttaaaactgatggtcgaagtccaaacacgatttgtcttggaactaaaacacctaatacggagcttagggttgtgattgtgtcatctctcttctttgacccactagcagcaagtgcagctttgagagtggaacggtcaacagaagctgtagaactgcggtggcgcaatttgaccactccggctgccgttatctgcaattttggaagtgaaaagtgctgctaccgccgtgatggccaggtacgacgctatgacccttggaggagcggcagggtgcctcgatgccgtgctgctattgcacactattaa

SEQ ID NO: 105693 - DNA, 2286 bp, Glycine max
  Peptide Sequence Number=SeqID_222471
atggagtgcaacaaagatgaggcagctagggtcaaagaaatagcagagaggaaatttactgaaagggaatatgctggtgcaaaaaagtttgctctcaaggctctaaatttgtttcctgcactggagggtctttcccagttgctaacaacacttgatgtttatatctgtgccgagaataaaatacatggagaaatggattggtatggtatacttggagtgtatccatatgcggatgaagagacagttaggaagcagtacagaaagctggctctaactcttcaccctgacaaaaacaagtctccaggtgcagaaggtgcattcaagcttgtttcagaggcgtggagtttactatcagataaggtcaaaagactagcatataaccagaacaggagattggaaggatttcaggataatgctcccaacaagaatggttatataaaacttaacaagaatgcaacttcaagcatgagaacaggaaataatgatgctcgggcacatccacatccgcatacaccctccattcctcctccacatacaaatgctggtaccttttggactatctgtaataagtgcaagacacattatgagtatctcaggacatatttgaatcaaacccttttatgtcccaattgtaaacaagcttttgtggctatagagaagggtccgcctcccaatgttttcaagtcatctaattggtcttctcggcaacatcatcagaagtcttctcggcaacattccaatgttggaaggaatcaccctgtgaatccaggaagaactggtgctgtttctcaaaatttacaatccagcggttttagtaaaccaaacttccagtggggtcctcactcgagaatggctggctttgttaaaaaagatggatcatcttctgtttcagctgcaaatgttaagcagcagtcaagtgagacaaaaagagaatgcgagggagtccagtcaattgctgcatgggagaggaatcatatgcataagaggtctgatgttccttttagtaatgccgaaaaacctatgaagaaaatgaggacagatgatatgtacaatacaaatcatatgaccatgagagatggatcaagcagtttgggccatttttatggatcaggaaaagctaatgtgggagcagaaaggattcatgttttttcaggtacttacaagcattacagcacaaaagagttgtcattgtttgaattacgaaatatgttggttgataaggcacagactgaaattcgcgagaaacttctagaatggagatcaatggctgaagctaggattacaaacaaggacaaaggaaacgagagacagaaaagcacattcaatgacaaaacaactggtccagagaaagattccactattaatggtaacaggcacgtggacagtgattctatcccagtcaaatctgatgatactgaaaaggagaaggcagcctatgttacaatcaatgttccagatcccgattttcacaattttgacttggacagaactgaaaattcttttgcggaggaccaggtctgggcagcttatgatgatgatgatggaatgcctcgctattatgctagaattcacaaggtgatttccacaaagccatttagaatgcgaatcagttggcttaactctcgaagcaacagtgaattgggcccaatagattgggtaggtgctggtttttacaaaacatgtggggatttcaggactggcagacatgaaataactgaatcgttaaattccttttcgcacaaggtaaggtggacaaaaggcaccagaggagttgttcgcatctttcctgggaagggggaggtctgggctctctatagaaactggtctcctgattggaatgaaaatactccagatgaagtgatacacaagtatgatatggtggaagtggttgaagatttcaatgaagaggaaggtttattggtcacaccacttgttaaagttgatggttttaggacagtgtttcacaggcgcagccatgatcaggcaagaaagattcctaaagtggagatatttcaattctctcatcaggttcctaattacttgcttactgggcaagaagctcataatgctccaaagggctgccgagagttggatccagcagctactcctttagaccttcttcagacaacagctgaagaggcattggataatgtcggaaaatcaaaggaagacacttaccccgggtcacctgaaaaccatgctgctggtaagggggagaatgcttcaaaacctactagagaagatatgttagacgaggatggtaaacaggtaaagtatgatagatga

SEQ ID NO: 105694 - DNA, 252 bp, Glycine max
  Peptide Sequence Number=SeqID_222472
atggtgggtcagctcgccatcccaccttttggtgcggtgggcgaggccaggatgttcaaaccactaaattttagcaggctgttttggttgactaaaagtgaggcgggcctaaacggccagggccaacccatttttccatccctaaacccaagcattgttttctaccaagccacttttgactctaaacaaatcgatagatttgttgaagaaggagcccatcggtgcattaaatgcaagtcccttccattatga

SEQ ID NO: 105695 - DNA, 177 bp, Glycine max
  Peptide Sequence Number=SeqID_222473
atggcgaggattcctgacaagattaagtctattgatgggtcaaaagagacgcttaagcttgctgtcagaatcacggatctttggttcgttgggactcctaacaagtctgagcaagtggaaatggtttttgttgattctgagggtgatcaaattcatgttgtttgtaaaccggactag

SEQ ID NO: 105696 - DNA, 560 bp, Glycine max
  Peptide Sequence Number=SeqID_222474
atgaagaaggctcctcatgaaattgtcgttgttattaagaggcaagttgatgccatagttgttagtgccaatatgtatgatgagctatatctagttcacgatgctttgaagaaggttgcggttggaggagtctttaggactgttgtgggagagttttatttgcctttgttgcaaaagtcgagttctgctctgtcatccttgctgagatgcgggttatctatcttggcattagcattgcttggaataaaaggatacattaattttattgtagagtctgattccttgaatgttgtgaatctaatttctaagggttgtgattttcatcatccttgtgctacttgcattattaaaagcatagtcattttccttgaggaacttataccatggccggacaacacttttatctttaaggccggcatccaggcggctgaggagcacccagtatacattgggttatttctgttgtccagatgtgttgacgggaatgaagtattgatctgccagatgtctgttgatccagtggaggttgctcctttgtatctcaactggaccgcttctgg

SEQ ID NO: 105697 - DNA, 162 bp, Glycine max
  Peptide Sequence Number=SeqID_222475
atgcattttggacaagcaatccgcatttatcgaaggcagatccattgtagacaatgctttgatcgcaacagcaatcattcattatctcaaatgcaaaatgagaggtggatcatgatgggtgttaatgacaaggtgggtcctattgtcccgggtagaggataa

SEQ ID NO: 105698 - DNA, 186 bp, Glycine max
  Peptide Sequence Number=SeqID_222476
atggcgacacactcagctggtaccactagcccctctggcaacacacccagctggtacggtcacgtgggactcgcccacggtgctggcgagacaaccattcacgtgaagttcagcttttcaggcttgcaggcttctgctctccattgtttagggatgcagcagcattgtttagggatgcagagttag

SEQ ID NO: 105699 - DNA, 591 bp, Glycine max
  Peptide Sequence Number=SeqID_222477
atggataacagggacaccatagaagtgccttctttttaccacaagcaatgcgtgccagaatatcctgattttgtccagttcagatatgatgaagcaacataccaaatcagactaagacaacatcagcaaaaagtcttctttgctgaaggactaaaacacctcagaaaagatttaggaatttttgaatctatgaccattaacttctttgcatgtgatgacaaatccacatttgaccttcatttcactccctcactagatcaacagacctgcggaagaccacggctgagcttaagagaacatgtttggacgcttgaaatcacccagtcaatccttggtgcacctaaaccactgaaacttccgcctgttgctataagacatgttaatgcctgcggtcaacatatgatcatccttagaagatttggacctccattacagtggcatgttgtcgtccttgatattggaattggggagaactatgttgtgcaaccttggtatcaattccttggtgacagtgatttctcccatggtgatgagatctcattctattataggcgtagggagaaaatatgggaagtagttatcaggcactag

SEQ ID NO: 105700 - DNA, 219 bp, Glycine max
  Peptide Sequence Number=SeqID_222478
atggagaagatgagtctgaactcatggcagcactcatctgagtattggctttttccgaaatgcaggaagagtggatgtttgaagaacaaatgttgtttgcagaagaagtggtggagtggggtagtggaatcgtggagcattgaatgctggttctgcagattggacgtgaagaggcagctgaatcattgtgaatgtatctctggtggtggaagtaggtga

SEQ ID NO: 105701 - DNA, 207 bp, Glycine max
  Peptide Sequence Number=SeqID_222479
ggattcaatatggtacttcgatagtgattgctctaagcacatgatgggtgacaagtccaaactctctgactttgtgtcaaaagatgaagaatacatcattaagatagatgattcttggttgtggcatcgtatggctgcacacataaacatgcctcatcttaatcatctagttgggaaagactttgtaattggtcttccaaagctcaa

SEQ ID NO: 105702 - DNA, 135 bp, Glycine max
  Peptide Sequence Number=SeqID_222480
atgtctgcattccaatattcaatgcagcagagatcagaaacagattccatttccaatgacagatcatattcagtgcaattgcctgttcattcaagcttatcattgcttgctgtcagttcgaccagattatggtaa

SEQ ID NO: 105703 - DNA, 936 bp, Glycine max
  Peptide Sequence Number=SeqID_222481
atgaaagcagccattgtcagtgccgcaggtgagaaaccggtatggggcgatttcccgccaccgcaggccgatgaacagcatgtggtggtgacggtgaaggccgccgccatcagccagctggcgaaagcgcgggccgccggcgcccattacagcgccggtagccactatccgtttatcgccggtattgatggcaccggcacgctgagcaacggcgatccggtctattttctcgcctttagcgcaccgtggggcagtatggcgcagcagacccgggtgccggctgcagcggtggttgcgctgccgccgacgcttgatccgctgctggctgcggcaatcgccaatcccggcatgtcctcgtgggccgcactgacgcgtcgcgcgcagtttcaggcgggtgaaaccgtgctgatcaacggcgcaaccggcacctccggcgggctggcggtgcgcattgcgcgtcacctcggtgccgggaaaatcatcgccaccggccgtaaccgcgcggtgctggagcagctgcgcacgcagggcgcggatatcatcctgacgctggatgaactgcccggcgcgctgccagcgctgatgcggcagggcattgatgtggtgctggattatctgtggggccagagtgcgctcgacatcatgcatgcggccgtggccggcggtgagaaaacggtgcgcttcgtgcagattgggtcgctcagcgggcaggagatcgcactgcacagtaaactgctgcgctcatccgggctgacgctgatgggcagcggactgggcagcgtctctgacagcgaactgatcgcctgtattggtgagatgctgaacgccgccgctgaaagtgacttctccatcgcttttcagcagcgtccgctgagtgaggtagagcaggcgtggcagcaggatgacagccgctgccgcaccgtgtttacgctctag

SEQ ID NO: 105704 - DNA, 1776 bp, Glycine max
  Peptide Sequence Number=SeqID_222482
atggctctgctgggggagggaggtcgcggctacgaactggctcggaagcttgacacgtgcggcgtgtggcgaacctggctcggcgacgccacctacgccaacttcgcacccttcctctcttccccttccgcttgggactccttcataacctccaccactcacatccctctccaactcagagtccgcgccctcctcttcgataaagccaccgtttccctctccctaaaccctaaccctaaccctaaccctatctcctatctccaacgcctcaaccctatttacctccaattacacgccgacgacgtctacttcaccctcgacgccgactccaaggtcctccaaaccctacctcttcaccattctctttcaatttcattctccgtatttacattttgttccttcaatttaatgcagaatcagtcaaagccttcttcctcgactggatccaggtacgttgaatctcaacttcccgaaacgtggtataatcaagtaatcgaaaagtacaaagctaataagaacctagtttccggcgaatcacgttcgccggcggatatggcttcttatattacctacgttactaatcataagaaacggcgcgtggcattcaaggaagatgttacggatcacgcgctgcaaccgaacggtggtggtagttttgttgctgatgatgattgtgcggtttttccggagatagcgtacgcgttgaactgcgtgcctgatagcgcgcttccgttgagtgatagagtggaaagtagtagtaaccagaaagtgaaggtgcttagtgttcttgataccttgcctcctattgcggcaactaggagttctgttatgatggagaggctcggggttaggcctgagcatggtagtgtggaacatggaggagggttgtctcgtgggaaattcggagctgaggggaatgggaaagttattgggcctgagcaagcagcgaaattgtcgcagaaggcagtggcacgtattttgttgggtgttgggtttgaaggtgccatggaaggttctgttgaggacttctctgaagtattgagcggacggatatgtaaaataggaacaaatttgagggtgcttgctgatagttacaagaaacagtgctcggccattgagcttctgaagatgttgcttaaaacagtggggtttagtaattttgcgccattagtggatgtggttaaagatggctccaagaataatgtacatcagagtcagcaacaagttcatggaatgcagccacagctacagcaacaacagcagagttcccttcggttacctcaacaagttcaaatgcagaggcaaatgcatccgcagatgcagcagatgattcattcccaaaatatggcttttcatcagcagcaacatcaacaacagccgcagcaacagcagttagagagaatgcgaaggcgtgcagcagcagcagctactcctcgccctgctatggatatagataaggaaagaccagtggttcaagtcaagattgaaaaccaggatttaccacttgatggtaatgccttcacttctagacatcctcaaatgcagcagtttaggcagcagcagcagatagctgcaatgtcaaatttccatcctcaatcaggcactcagttcagacagatgggttccttacagattccttcaatacagtccccgaacattagcatggttagagccccgcctgtgaaggtggagggcttctcggaattgatgggtggggattctacatcaaagcatgatctggaggaaaatagactgacttctcccaatggtaaatag

SEQ ID NO: 105705 - DNA, 414 bp, Glycine max
  Peptide Sequence Number=SeqID_222483
atggatcgcgccataacaggtatcccaggcatagaaaacgtgcacagttgtcgggatctctcgagtttctgtcagggaactgaatccgacatagcatttcctatgaattctgtggtcttggagacacgtgagtcgcttcgagcacgtgcactcgtactgaacacgttcgaggatctagaagagtgttgcccacccacatcatctttggaattccttggattaggagagttggagttgcgtcatgtggcagtttccttctgtatatttggaacaacgaaagttgtggacgatatggtcaatgatctcatggctgcgttgacctacaagactgttagttcaggtggttcctcttatgtctgcatggatcatttgtttcagtacaacaataatgtatcaactagccaaaaaaactaa

SEQ ID NO: 105706 - DNA, 204 bp, Glycine max
  Peptide Sequence Number=SeqID_222484
atgaaggtgcaaaatgctgcaataaaggctgtaaaaaaggaccaccatgctgcagtgaaggcagcaaaaaacgggaagaataaaggagccgaatgttgtaatgaagggagctcaacagtgagtgaagtagtgaccggacagaacacagaggatggtatccctgataccatgcagaaagaaagacttgaaaggaaagagggataa

SEQ ID NO: 105707 - DNA, 207 bp, Glycine max
  Peptide Sequence Number=SeqID_222485
atgaggaggggagcagcaggtggcgtgtcatgcaagagtgtcaaaaggtgggggagaagggaaagggaaggatcattggagaatggtgctaaagaagctatgaaaataaaccaattaaagctgttaattcctaatgttttgaaggtgttgttccacccaagtattttgaaagatagaatcatgacatggcagacaaccaataattga

SEQ ID NO: 105708 - DNA, 1464 bp, Glycine max
  Peptide Sequence Number=SeqID_222486
gagagatccaaagaggtggaaacccctaaagatgttctgaaaggaaatcaagaggtgaaaagattatgggttgacgtgataagtgagaatcgaaatccagcaaaaggaaggataatgtcttatgtggcaccgaaaatggtagagggacaaattgaaatcgagattgaggatgaggacatcgaatctgaaattagatattgggaaaatgccctaatcctatatgtgctagggggtgacctcagtatgaatacgattaagaatttcatggagagaaactggaattttgtgcagctgccagacttgtattatcacgatgatgggtacttcctgctaagattcaaatcacatgacgatatggaagtggtggtgatgaagggtccctatacaataagaagcatgccggtggtactcaaagagtggagacctgattttagtctgaagcaggacatgctacgaaccatacagatatggataaaacttcccaagctcccgttgtatctttggggcgaacgaagccttaacaaaattggcagtgccattggtacacccatggttactgatgaatgcactacccacaaactcagagtttcctatgccaggatgttagtggaggtcgacattactagaaaattggtggaagaaattactatcaaggataaagatggtcggaaaatgatgcaacccattgagtatgaatggaggcccaagttctgtgataaatgtcagaagatagggcatcaatgtggaaatagggtcaagaagaaaaaatggcagcctaagcctcaacaggagagaaaacacgaaatccctgttgaggtctctacaccaaggaaagaaacaacaacgagtaaagctaatggagatgaaggaaagacatggattagaactactgaagatgatgaagagacgtggactaaagtgagcaaagcttcaaaggatacaggttttgaatggcccccaagccttcgatcggggaccatgattgcttcatggaatgtaaaagggcttaacaaggctggaaagctaagggagataagctcccgtctcctagagcttcagccagaaattgcaattttgatcgaaacaagagttaaagaaaataaagctactaaagttagagagaaacttcgcctaaatgggaattatcttgataactatacttgtcatgaaaatggtaggctttggatccattgggacttaaatagggtggatgtgaaatgtgctagtaggactagccaacttatacactgtggtgtttatgatgtaactggaaatttcaagttttggctaactgctatttatgcaagtaatgcattggatagaaggaaaattttatggaaagatattaagaaaattcatgagactcatcaaggggcttggtgtgtggtgggtgactataacaacgtggccaaggcccaagacagaattggtggaaagatggttaccgcagctgttcacaactag

SEQ ID NO: 105709 - DNA, 738 bp, Glycine max
  Peptide Sequence Number=SeqID_222487
atggctaacaaagagatgttcaacatgtcaggttctgaatgcttggactggaagataagatccaaggtagctgttggggtggcggatggattggtttatctccataaagagtgcccgagacgaatcattcatagggacatcaaggcctccaacatattactaaatgaaaactatgaagctgagggaaggaaaataattggtgccgtaataaacttcagatatcagattttggactggcaaagtggctcccaattaaaacactgcttgcaccaaattattggctgcagatatttggctccggagtactttatgcatggagttgtggatgagaaaactgatgtatttgcctatggagttttgcttttggagctcataactggtcgacgcgctgttgattcggatagtagacaaagtcttgtcatctgggccaagccactactggatacaaacaatgtaaaggatttagcagaccccagattaggagaggaatatgaccctattgaaatgaagcgtgccatggtgacagcttccaggtgtgtccaccatgtatcctccaagcggccatacatgaatcaggttgtgcagctactaaagggtgaagagacaattatggaaccaaagaaaactttagttgcacaaaagtctctcatgttagaggcatgtgacctagaagaagattatacttgctcaagttacttgaaggacctcaatcgccacaggcaactaatcatggagtaa

SEQ ID NO: 105710 - DNA, 1548 bp, Glycine max
  Peptide Sequence Number=SeqID_222488
atggtgatgaagcagagagatgaagagctctctttgttcctcgagctgaggaggagggagaaagagaatgagaaaaacaaccttgttctgcttcaaaactctgaggaacttcatttgtccaatttggaatccaatgatgggggctccatgatttccaagatcgtgtcttcggtgccaccaaggaagaatgaagttgaagagtttttgaattcagagattgacaagtctgactatgaatggcttcttgcaccaccagatgcacctctttttcctactttagagaaagagtcacaaatatcagtaaagagtgaacaggagactcgtaatgctcgccctacagctttaaaacctagggtagcaaatatccaagcagatcctgctttaagaagcaatgtagtttccaagcatcatgcatcaatgccaggactaggttcttccacaaatggtagtaggagaccttcatcatctgggggtctaaccccagccacttcaagatcttcaactccatctggaaggccaacattaccttcaacaaccaaatcctctaggccatccacacctacctccagggccaccttaccatctgcaaagtcaacagctccaccagtgagatcatccactcctacaagatccactgccaggtcctcaacacctactgcaaggccttccttggcacctccaaagacatctcagagatcagcaacaccaacacttagatcatcaaccccatcaagggcatttggagcatctgctcctcctactagaccttcatcagcatcgaaagcacgccctggccctttagttgctaagaatccagtgcaatcacgtggcagctctccctcggtgagatctagaccatgggaaccctcacaaatgcctggtttctcacttgatgctcctccaaatttgaagacatcattgtcagatagacctgcttcagccactaggactaggcctggtgcaccgaattctagatcatcttctgttgatgccagcagcaatgcaaaatctagaaggcaggcaagtaccccttccaaaggaagaacttcaacggggctggtccacaataatcacacctctatgcaagttttgagtagagctcgtttcactgatggagatgatgaaagcccagttatgattgggacaaagatggttgaaagagtagtgaacatgaggaaactggcccccccaaaacatgaagaccaccattcatctcgtgagaattcttatggaaaatcttcttccggtagctctggatttggaactacactttcaaagaagtctttagatatggcaatgaggcatatggacataaggcgaagcttccaaggtaatatgcggcctcttgtgacaagcattccagcttcctctatgtacagtgtgagatcaggtagttcctcaaagagcaggacagtgagtgcttctgattctccacttgccacaagcagcactaccagctctgaaccaagtgttaataacagctccatatcttatgatggaagtgaggctgaagaaaatgattttgcaagtgagaagggaaactcttga

SEQ ID NO: 105711 - DNA, 135 bp, Glycine max
  Peptide Sequence Number=SeqID_222489
atgagtgcattttatagaaaacaaaagtgtgacattaatgctcgtggatggacttcattggcaattcatggtggagttgcttcagtgcatccttatgatgttcattcgcagatttatacaaggactaaagtgtaa

SEQ ID NO: 105712 - DNA, 147 bp, Glycine max
  Peptide Sequence Number=SeqID_222490
atgggcacaaatagaggccttgcagtgttggaagaacatagagcatgttcatcaactgggcattctgaaaatgccaaattgcaagaggttttcttgatctccttgaacgttgccgtcgtcaacttcttccgcagaatgctgacctaa

SEQ ID NO: 105713 - DNA, 2271 bp, Glycine max
  Peptide Sequence Number=SeqID_222491
atggatgcaatccaaaccgagaaaatctacgttgctgttggtaatgatgtgcaagatggacttaagactttgaattgggctctcaagaagtggaattctcatccaatttccattgctgttctccatgtcacacacaatagtaccaaggattatgtctatacaccatttgggaaacttcctgcaagatctgtgagtgaggagaaactacaaattctcaggaaagatgagcaggataaaatcaacaagctgctttccaagtatattgctttttgtggcaaggtgccagcagagattcttgaagttgagaaatttgatgaacctatgcaaaagcgcgtcatagacttgatctttggtctaggaataaccaaattggtcatgggattttcattcatgaagccatccatgaaatctaaaggtgctattagtggattgttctatgttcatcagcacaagccttccttctgtgaattgttcattatttgtggagggaagcaagttttcctcagaggaaaaaatgatgagaaaatcatggaggatgatcgcggggtcatgagtgcaagaatgagagataaggaaattgaaaaatactatcaagaattgttgtcttcgaacttggaggaaggaaactgcgtgctagaaaatgacgactcacagattggaccaattgagccacatgtcactgaacacaacaattatgatatgagtgctgcggataaaattgagatcctgaaaaataagcttaatgaagctcagaagattatccaattaaagaggaaagaagccaaggataatatagagaggcatactaaagctgaatgggcaatttgtttatgcaacagtcgggccgaagaactggaaagtcgaatacgagaagaggcgagtgcaagagaggagctaaagaaggaatcagacgcagagaaagagcaaacagtggagatgaaaacggagctggaagagaggaagaggagcctgagatccctgacggaagttcaatcggagctctcaaacaggcttcaaatatggacgttggcgaagacgcgggcggagacgcagctggagaaggcggtgggggagaggagcgagatggtgagggagatagaggagctgaggcggcagagggacgtgttcaatcggaggatcgagttttgcaaggagaaggacgccatcggaatggccgcgagcctcgccgagatgacgtgctgcgcattcagggagtacaccgaggaggagctccggttggcgacggataacttctccgaccgcctcaggttcaagtccggcggggattggactaatgtgtatagaggacgctttaaccattcctctgttgctatcaagatgcttccttctttgtcacaccaacatttccaatccaaggtgaggcttcttggtgatattaggcaacctcatctggttgccatggtaggcttttgctccgagcccaaatgcatagttttggaatacatgggcaatggaagcttacgtgacatgctgttttctaggagaagaaaccgggtcttacgatggcatgaccgaatacgaatagccacggaagtttgttcgggtctgggctttctcaatgcagctgagttgaggcccgctattcattgtcatttgagctcatcaaaaatcctcttagaccgcaatttggttgcaaagatcacgggctttgggcttcttgaatgccatgatgagcaatgtaacgttgagtcagatttgcaagccataggggttttgttgatacatcttctgacgggaagaaattgggccgggctcgtcgaggaggtgatgacagtggatatggataggaaggctttgggtagtgttcttgatgagatggctggacaatggccattggatcttgcaagggaacttgctgccctggctatgaggtgcatgtccatcaaagccaaacccaactcagaactcagcattgctagggttttagaggaactcaatgagataagaagaaacggggatgaaatagttgaaagggaagggccaaagacaattattggtggatgtatagatagggcaggttccagtgatatgcctagtgttttcctttgccccatacttcaggaggcaatgacaaacccacacgtggcagcagatggattttcttatgagctagaagcaatagaacactggctgcagtcggggcgtgacacatcaccaatgacaaatttgaggctgaagcacacattcctcacccctaatcacacccttcgttccctaattcaggactggcagaccaacaaatcaacctag

SEQ ID NO: 105714 - DNA, 282 bp, Glycine max
  Peptide Sequence Number=SeqID_222492
atgacttttcaattatatttgaatggcccagctccctgtcccagtgtgaatgtcactgttggtgagaaagaagaacggatgatgatcaccggattgcacactgtcgttgacatattctgtgttgtatgtgggtccattgttgggtggagatatgaggctgctcatgagaagactcagaagtacaaagaaggaaagtttatccttgaaaggtttaaggtgttgggacctgatggcagcctctacttggcagctcaagcagctggaagtgatgctgatgattaa

SEQ ID NO: 105715 - DNA, 756 bp, Glycine max
  Peptide Sequence Number=SeqID_222493
atggaaagggtttggtggtatacgggaaaagagagggttttgggaggaggagaagggaaaacaaaattgagaggaagaggaggtgtagagaatatcaacatcgaggtgttaggacttgtgaatttgaaacaaaagcaaattgaagaagagatcaatgatcaggatgttcttgaagagagggggagtctttgtgaagtagactttaatagacgactggaacaacaaaaagacttttggagagtgtggttaaaagagagggattgcaattcaaaaatcttccattccataatgaattggaaaaggaggaaaatgttttttaagggactacaagtggaggggagttgggtggaagagcctagcatggtgaagatggaggtgaaaaagtactttgagaggaggttcttggaagattttgaagatagattgaagcttgatgggatagaaatcaatcatctctctagtaaagataatcttatgcttacctccttcttcaaagagggggagattaaggaagcaatttgtgattgtggtagccaaaagagtcattgcctgaatggttacactttcttattcatcaaagagttttgggaattgttgaagggtgatattatgaggttcttgaggaatttcattctcatggtggtcttgctagagtgtgatattacttgtgtagtgagttatgaattatacaataacccgactagtgtttaccttaggaaaaaggtttatgggcgggctgttaaatggaaagtgtag

SEQ ID NO: 105716 - DNA, 777 bp, Glycine max
  Peptide Sequence Number=SeqID_222494
atggggtttggtctgaataggaggacaaagagaagagaagaacaaggagaaggaaagatgcgcaagtctttcaaggattcactcaaagctcttgaagctgatatccagtttgccaacacactagcttctgagtatccaagtggtggtgcctgcttccaattgagattgtcctacagcccagctgctcaattcttccttttcctggttcagtggactgattgtcaccttgctggagctttaggattcatcagaattcttatatacaaggcatatgaagatgggaagacaaccatgtccatttatgaaagaaaagccagtctaagggagttctatggcgtggtgtttccctctttattgcaacttcacagaggaatcaccgatgttgatgacaggaaacaaaaacatctatgtgctactaagtataagcttaaagatttgacaagcaaaggaaacctttctgaaattgacatggagagggaattagagtgtggtatttgcttggagataaatagcaaggttgtattgcccaactgcaatcattcaatgtgtatgaaatgctatgaagactggcatgcaagatctcagtcttgtcctttctgtcgagacagtctcaaaagagtgaacactgatgatctttggatctacattagcagcagtgagattaatgacttggcttcaatcaacaaggagaatttcaaaagattatttatgtacatagaaagtttgcctctcacagccagaccctatatgcaccatgccatatatcatcaccactag

SEQ ID NO: 105717 - DNA, 609 bp, Glycine max
  Peptide Sequence Number=SeqID_222495
atggaaactgggtcgaactcagaatcattgaacagaaacgtggcgatgagtgtgaggggtagcactgggaagaagaaacagcagggaggtgttactctagcaggcaaaaaagtggacccttttgtgccgagaagcgagcacaacccgagagagttacggtcgtgggcgaaaagaacaggttttgtgtcagattactctggggaagcagggtcaagtggaagtgcaaagtttgaagctttagagaggagaggaggagggtcatctccgaagatagagatagatccggtggtggggagaacgaggcaaaacgagatcgaacaagagactcatggaggagcaatgaggggtgagaatggtgctgttttggatgggagagggaggaaagagaaggagaatgagggttgtgagaggaaagttggtttcaatgggaatgggaatgggcatggagtttctgcagtggctcctgtgaatgaggaaaaggagggggaggagggaaatggggatgttaaggtcagtgtgcttcatgaaggggaggaggttgctgatggagggtggcagggaccgttgggattgaagtgcgggctcaaagagaatcccgggattggttag

SEQ ID NO: 105718 - DNA, 2886 bp, Glycine max
  Peptide Sequence Number=SeqID_222496
atggaggaaaaagtgcaaaccgttttgaagctcttagaggaagagggggactcttttgccaagagagcagaaatgtattacaaaaggagaccggaactgataagctttgtggaggaatcattcaaggcttaccgagctttagccgaacgatatgatcacatatcaacggagttgcaaaatgccaacaacaccattgcttctgtctttccagatcgtgtcccatttatggatgaagacgaagatgatggatcaccaaggccttcaagaaaaaaagcagaagggttcaaaacaaatattccaaagcctcccgttaaagatttaaaaagtgtcataacaacagcagcagccacaaggagattgcattccaagaagccagctgccacagcaacttctgctgctccgaaagttcctaaatctggtttgagcagaaaagcggcacttgaagaggttgacaagctgcagaaacagattctggctctacaaactgtgaaggagtttgtaaagaactcttatgataattccgtagctaagtactgggaaactgatgagcaaatcaaggaattgcaagagagagtttccattctgcaagatgagcttggagaaggtgttgatattgaagatgatgaagctcgccgtttgatggcagaagctgctcttaaatcatgccaagaggcattgacacagttgcaagagaagcaggaaaaatcacttgatgaaaccagaattgaatccaaaagggtaaaggatgtcaattccatgttgggctctctcatggaggaattccattatgatcagaataattctgaaaagccaagggtccaaagagatttaaaagaaatagcagaaacaaaggacttggaagagaatgccagattgactcagaagaaacaggagttgcaattattaaaggagaacattaaagagcactttgagactagctccaattcatcactcagtgtggcagaaatggcagagcagattgatgagctagtgaacaaagtaatcagattggaaactgcagtatcgtcccagagtgttatggtaaagagattgacaacagatactgatgaacttcatgagcagattcgaactctggaaaatgataaggaaagtcttatcaaggacaaaaacaaattgaatgaccaactgagaaagttggaagaaaagatgcatggagtacaggatctaaaccaaactattgaggatcagaatagcaatctccaaacccaattcaatgaagcacttagtaatcttgatcatctctcagagaaagtccaaaatgtgcagccaggcgaggaggccaagaccacagatttatcacacacacaaaaggattcatcaacccaggctgaattaaaaatcaaatctgaaggacaagttcctttgaatcaagacaatatgttgttgaatgataaggagattacaaatggtttggtagaagatgatgcaacagataaggagcttaaggttgctggtactgttgaagatgatgcaacatcagacaacaagcctgaggtcactggctcaccatctgctagtgaacccaatgtcaccggttctttggaaaatgatgctaagtcagcaaatgaggttaaggtcaccagttccttagaaatggatgaggcaactcctgtggaaaacaaatctccaaaagaattggaaaaacaagagaagactgtacatcctggcaatgatgatgaaaaggcaacagtttctatgagcactaccacagaaaagcaggatgtcagtcagcacctggcgagcaacaaggcagatagttcttcagagagttctgagaaacagcaagaaaatgatgataagcaaagttcacgtgagatagagaatgtgctcaaagttgatcccaaggggcaggcaacagcacaagaagatgaacctgattggcggcaattgtttacaagtgggatgcaggacagagaacaagttttgctgactgagtatactaatactcttcggaattataaagaagtgaagaagaggctgactgaaatagagaagaaaaatcaagacaataactctgattcatctttgcagctaaatgaactgaagacatctaatgccatgaaagatgaagagataagacttctgcgtcaaaaattaggtctccagcagagaagcatggaaggaaatgaagatttcacagaggaacttttacaaattgaactacctgaatctacttcactcattgaagaaaaattccggtcaaacatggatgaaatcctagaggagaacttaactttctggttaaaattcagtgcttattactctgagatacagaagtttgaaaccaccatcaaagatttgctgaccgagttatcaaaattagaggaaagagagaagtcgtcagagggtagtagcagcataaagtattcaataaaatcagattcaagaccaatttacaaacacctaacagagatccaaagtgaaataacagtctggatggaaaaaggtgccttgctgaaagaagaactgcaaagtcgattctcatctttgtgtgacatccaagaagagataacaacagaattgaaaagcagtgctgaagatgatgacttcaggttcacaagctaccaagctgccaagttccaaggtgaaattttgaatatgaaacaggaaaacaacaaggttgctgatgaacttcaaacgggtttagatggtgtaacatctctccaacttgaaatagaaaaggctctggtgaagttgaatgataaatttgggttctcggcttcaaagagacaacaaaatggccagctaagacaatcagagactcgggccaaggttcctctgaggtcattcatctttggcgccaaaccaaagaaacaatcaatcttctcctgtatgacccctggaatgcataggaaataccggtag

SEQ ID NO: 105719 - DNA, 1974 bp, Glycine max
  Peptide Sequence Number=SeqID_222497
atggagttcccttcttcctcctccatcttctccccgcgcccatcagacgacaccgttttctacgccatataccccgactcccccaccacaacctccaccgccacgctccgctccctccacctcaaaattctcgaaaccctatctcccttcaccgaagactacatatggcagcaccaacccttcaccctctccgtttcaactcctccgaacccttcctgcccctgcccctcctcctcctcccacctcctccacctccacggccgcctccgcttcggcgacaacctcgacgacgagtggttcgccgtcttcctcctcttccgaatctcacaacgcttcccttcactctccattcgaatctgggactccgacggcgacttccttctcatcgaggctgccttccacctcccccgctggctcaaccccgacactgcgcaccaccgcctcttcctccgcaacggaagcctccacatcgtgccgcgtaaccgcctcaccaacccctccctcattgattccctcaattttgtcgctagttcccctcacgaatccctcgcctcggacgcaatccagcgcgccatcaaaaaacgcatcagtaattaccctgaacaagctaggaataacatgcatagggttagggttagggttccggtgtcggcggcgtctattttaaagcacgagccaaggttaatttcgctggcagtggaggggttctatgatagagatatagacacgatgaagttcgcggcgaggatggagaggtttgtggagagagggaaaacagaggagttggtgtgtgtttcggtgaagatgtcgagggcgatgtacgcgcagttggcgcagcagaggtttcaggctccgaagtgctaccctgagatgccggctcggagcgagagggaagggtttgcggaggcggagctggggatgaagatagcgtgtgggttggagatgatgtatcagcagcggaagcgagacggggaggaagggaaagggagctcttgggaggcgtttaggaagagtttggagaacagtgggtacttccaaggacagcttccgggttcctctgagtaccagagattgatgcagagtgctcaggagtattataggagcacttctctgcactccaaggccagtgacttgctgaatgctcctgttagacgcatagatgaaattcttgctttgcctcattcggtggatgattttaaggatcaggaggttcctccatctgatgatgattcctggctttacggtggagaggaagagttgaactctgttcttatggaaagacaaaaggagatggaactatatgacttaaaacacaaaaagaaagggaaagcaaaagagggtcaagatgctggtccatcatctgcttcaaatgctgacgagtttgatcccagtgatatagcaaaaaccatgcaggcatttgtccataagttgtcaagttacaagggtgctgaagctcctgaagataggaataaggaagtgaaccttgatgtggaccaatttattaaagacatggaatcaataatgatgcattcagacggtgaagttgccaacagtaatattgaagaaggatcgtcgtctgatctggactttggctcaaaactcttcatgtcttcaaggttggggctacctgatggaaaattgatcaattccctagttgtttgggatagtgataattctgatgacagtgatattgttgaattggatgaggataatgaggacagagaggatattttcatgcggtcctattctgatgctatgaatgaagagctaaaggcaacaacccttcagaaaagttttgttcgtgctaatgaacaaattccaaagaaggatcagggaacgtcaaatgcatctgaacatattatggacgaggatttttctcctgtagacgtggatcaagggcttcctggtccggcttccaatttgcttggcctcatgggggtgcagttgccacaagatggcaagaagggcaaatga

SEQ ID NO: 105720 - DNA, 537 bp, Glycine max
  Peptide Sequence Number=SeqID_222498
tggttgtggggtagtagcaaggagaaagagcctgtttctagtggctctacactgaattcatcttctgaatggagttttaaggaaagagagactgtgaagtttccttcagtgaagggaacaaagatagctccttctcacaggaaggttaaaaggaaatggcagagcagggaagagaggagacatgatagagagtatgatgttgtgttggttccatctgatggtgatggttgtttgtcaagctctgaatctgatgactcagatttttccattgggtggttggagcctcatggctctgatttccttcagagtgatgatgatttggataatagttttgctgtgctggttccttgctataggaaggaggtgtcgagttcaaacaaggagcttttgagtgtcatcaagaaccttccaaatgaattttcttctgttggtttggccttcttgatgattctgatgctaatgaggaaatgtttgtcattatcagatgctaatgcactgcttagcaattataaatgcaatggtaattggggccaataa

SEQ ID NO: 105721 - DNA, 441 bp, Glycine max
  Peptide Sequence Number=SeqID_222499
atggcaatagcgttagccaaacgggtgacattattgacacgtgtcgacaagttggccgcacatgcatcccatgattggggtaatggccatccacgtcagcaactttggacggttatcatatctctcaccaccgaatcaacgtccaaagaagacgaggttttgagcgattgggtttggttctcagtgtacccagaaaaagaggcagaagaaggaagaagaagaagaagattagagagtgagagagggataattggcgagttagggtgtcgaattgactcactgagtatttgcattgtatcgccggttttttttctttcgccggagaaaaccattgctccgatctcctctgctttttgtttccgataccatagccgtttgaaaggttcggtttttccggcgaggagtgtgggattttctggtgattccttggttgtgaattga

SEQ ID NO: 105722 - DNA, 265 bp, Glycine max
  Peptide Sequence Number=SeqID_222500
atggtgtcaattttgattgtcgttttggtggggagggttgggttgcagccgagtggatgggggtttcgtgttaggggttgtggttttgatctgcgcgagtggaatttgcttcaattacgatgcattccgtgctcggaatttggggatttggttgggcagcagcaggaggacgaggagatgcttgtcccgcacacggatttggctgagaataatcaccaacccatggaagttgtggctcaacctgatgctgccaacactgtggaga

SEQ ID NO: 105723 - DNA, 471 bp, Glycine max
  Peptide Sequence Number=SeqID_222501
atggtggggaatgtgtgtttgtttttgttgaaaacctcggcggcgagtctgacgtggccatacttgcagagcgtgtcgagcaagacgcagatgtcttcgggcgtcgttttggtttatgagaaggcgtcgtgtcgtggaaggcgcgtacggcttggcgcgggttggggtgaggtggctttggtccatttcgacgatgagttaccatgcacgtcgaattggcgaatcttggccatgggttttggcgcagtggaagagggagagggcgatcttggagtggtttttgaggcggaggagggtgggggaggagcttcgagaccagttcgacgtcgctttcgtcgcgaggtgacggcggtgggagggagcagaagcggcggaggagtggctctgacggggtttgggaaacgtcatgatggtgttgcttcaaacttggaagtacagtacatacgatgcagaaatgcggaagagagttag

SEQ ID NO: 105724 - DNA, 417 bp, Glycine max
  Peptide Sequence Number=SeqID_222502
atggaccaaagccacctcaccccaaccccttctactttcctaaccctaattcgccgcctcatctgcgcccgcctcacgcgccaagccgtacgcgccttccacgacacgacgccttctcataaaccaaaacgacgcccgaagacatctgcgtcttgctcgacacgctctgcaagtatggccacgtcagactcgccgccgaggaaggtgagtctgcacccagagatgtttgagagaactatacggaatgcagaggaggtgtttgatcaaatgcgtgagagcgggattgagcctgaaccgcgcgcatatgccgcagctcgtgctggatcagctgaggttgatgaaggagaaagggatatgtcccaatgtggtgatgtacacttcggtaatcaagtgtctggcctcgtgcgggtggcttga

SEQ ID NO: 105725 - DNA, 2277 bp, Glycine max
  Peptide Sequence Number=SeqID_222503
atgtcagatgacatgctcattcatttctcatccaactcatccaaccaatcagatcagtctctgcctacaaagattgcaaagttggaagctcgcatggttggtaagggttcctccacgactgctcagcaatcaggttggtcctctgtgtccgttccttctgctgggaaattaggtggagctgctgaaaatttggctgaaccatccacttccagtgattctgatgatgataatggtggggaattcttaatacaagccaacactcagaaacgccaaaaatttcaagaagatggcagcgcaagtgtttttgaacgtgttgaggttgttactgatgcaaggcaaacgagtttggagaccatggagacaaaaattaatgttgatgcgaatagaaagaaacatggccgtggaagagggagttctggttcaggtagaggccgtggttccagagttactgatcagaccaaaacacaaatttctcctccaacagttttggcttcaaatggtcagattgagagtgtataccataaggaggacgttgcatctttagaagcaaaagttgttgcattggaggaggaattgcgtaaatcaaagcaagagaccgctgattatcaaaatctttatcgacagctagaaaaggaactgaaggagctgaatgatcatgaacagcaaatgaagcctaagagaatgaaaataatatctgacttactgatatctgtttcaaaggctgagagacaagaagcaaggttgaaagtacggcaagactcattgagacttgggaatgttggtgtaatcagttcaattatgaattgtagagctggaactgtcatatccgagacctgggaagatggtcaagctttaaaggatctgaatgcccagcttaaacaactaatagaaacaaaggaggcaatcgagcggcagcgcaaattgtttaagaaaaaacaatctgataagagtgatggaatagatgcagaggctggattaccagaagatattctaattcatgatgagatctacaagtctcgattagctagccttaaaagagaaaatgttcaggaagaagaaattattttccgggagagggaacgatatgaaatagagaaggggaggttaattcgtgaaatgaaacgtatacgggatgaagatggttcacggtttaacaactttcagattctaaatcatcgctatgcccttcttaaccttcttggaaagggaggattcagtgaggtgtacaaggtcagatcagaactatcaaaaataagaaatttccagcaggctttcgacttggtagagcatagatatgttgcatgcaagcttcatggtttaaatgctcaatggagtgaagagaagaagcaaagctacatacgccatgcaattcgggagtataatattcacaagactcttgtacatcgtcacattgttcgtttatgggacatttttgagattgatcaaaacacattctgcactgttctagagcattgtagtgggaaagatcttgatgctgtcctcaaagcaacacctgtattacctgagagggaggctaaggtcatcatagttcaaatttttcaaggccttatttacatgaataaaagaacacagaagattatccattatgatttgaagcctggaaatgttctgtttgatgagcttggtgttgccaaagtgactgattttggtcttagtaagatagtggaggatgatgtgggatcccaaggtatggaacttacatcccaaggagctggaacatattggtatttacctcctgaatgctttgagctcagcaagacacctcttatatcatcaaaggttgatgtctggtctgctggaattttgtattatcaaatgctctttggccgacgtccttttgggcacgatcaaacacaagagagaatacttcgcgaagacacaattatcaaggcacgcaaagttgaatttccttctagacctaccatttctaatgaggcaaaggattttattcgacggtgtctaacatataaccaggccgagagaccagatgtattgaccattgctcaagacccatatctcactttctcaaaaaattattggagatgggagcacgcgtgcgaagccatcgcttcgttctgggagtggcggctcgtgaaggtgttgatggaaggaaaggaggtgaagtggtggatggagagtgaacggttgaaaggacttgatgagaagaatctggtagaaaggaggttcaaggactttgagtctgcaatggagtatttatctaagtatttaaagagtatgatgatggatggtgtctga

SEQ ID NO: 105726 - DNA, 435 bp, Glycine max
  Peptide Sequence Number=SeqID_222504
atgaaggtgaaaaagcagaagaggcacaggaagattttgacgttttacactgcttgcttcggttttcggaagccttacaaggttctatgtgatggcacatttgttcatcaccttcttgtgaatcgaataacccctgctgacacggccattggcaatgtcctcagtgctacgatcaagctctacacaacaagatgtgttctagctgagttgaaacgacttggtagctcgtattctgaggctctcgaggcagctcataaacttatagttgcaagatgtgagcatgaaaaatgtaagagcgcagatgcttgcatcatggaggttgttggagaaaaaaattctgagcatttctttgttgctagtcaggacactgacctgcggaaacagttgcaagagttaaataacaatcttggagaatttgtgtcatgtccagtctag

SEQ ID NO: 105727 - DNA, 183 bp, Glycine max
  Peptide Sequence Number=SeqID_222505
atgaaaattccaggtcaaaatcgggatatgaagagtgtccacgttttcagcagagaaatcaagtatgagaacaggaaatccagggcgaagatgaaagagaagcagaaacatgtgaagaatttacaggagttgatgggagtagctagagagtacctcagagaaagttcagtgacaatggagtag

SEQ ID NO: 105728 - DNA, 333 bp, Glycine max
  Peptide Sequence Number=SeqID_222506
atgtacatcaagcaggttgtgattgaaggttttaagagttatcgagagcaaattgccactgagcctttcagttctaaagttaattgtgttgactacatacatatattcttgaaaatcctgccattgatctcctaccataagtccataaacgatcgcacgaagaacacaaaacaagaaaatgacgtagggaatgatcgcggtcgcgattcggcaaatggtcactttggggaagttgcagctcgcccaggcgagctgaaacttagtgctaaagcaatgagctcgcccagacgagttggttgcttcaccatgaagtcatttggtggcccaggctag

SEQ ID NO: 105729 - DNA, 294 bp, Glycine max
  Peptide Sequence Number=SeqID_222507
atgtccataaaaagaagagttaaggagacacaagaattttactgtgaagctgaaaaccatggtatgatctcatcctacttgattgctatgctgatagttggtgctaacggatctggaaagacaaactttttccatgccatccgttttgtgttaagtgatctctttcaaaacctacgcggtgaagataggcaggcactactccatgaaggagctggacatcaggttttatctgcgtttgtggagattgtgtttgacaattcagacaatcgtatcccggtaatatgtcgaggataa

SEQ ID NO: 105730 - DNA, 312 bp, Glycine max
  Peptide Sequence Number=SeqID_222508
atggcctcctatggtggtgagcttcttctagactcatcttctcctggaaatggcgtctcctctctctcttcattctccattttgctgccattcatcttccaagaagcaaaggaatccattgatgaagaagttcctaggcctacaagctccaatggagcttacatcaagtacaaccaaagcaacaatgaagatccaacccatgagtgttgttttggtgtaaaataccctcagactcattctctatggcattggatagaagactccaagaagattgagccagagatgcaagagaaggccctagggttctcatga

SEQ ID NO: 105731 - DNA, 531 bp, Glycine max
  Peptide Sequence Number=SeqID_222509
atggagcgtgagaagaaactcagtatactttatcaaaaacaaggacgtgcaacccagttttcaagtaaagcttctcgtgataagtggcttcaaaaggagattgatgatcttgaacgagtgctttcttcaaacaagggccaggcaatgacccttgccataggttccaatatttgcaaattgttaatctctatcatggagcaaaagcttttggatgaaattgatcggcttaaagaagaactgcaggattgtgatgagaacataaacagacgtaaatcagaaattactactttggaatctctcattgctcagtcacgtgaagggcttaatcgttacaaagaagagagagacaagttacatggggagagaaagtccctatggggcaaagagaatgaacttactgctgaaattgataagctgagagctgaagttgagaaggctgaaaagagtcttgatcatgcaattcctggtcatatagatgaaggagattgcagaaacactttgcttccagaaattgtattacacttagaatga

SEQ ID NO: 105732 - DNA, 534 bp, Glycine max
  Peptide Sequence Number=SeqID_222510
atgcattcttctgttagacagtatctagatgaaaggttgaaggaactagatgaagagaaggaggaacttagaaaatatcagcagcttgacaagcaaagaaaatccttggaatatgctatttatagcaaagaagttcaagatgctcagcaaaaacttacagagatagaagatgctcggaccaaggtttctgacacatcagcaaggaagtataatgatgttcttgatgcacatgagaaatccaaagatttagagaatacattaaaagatgtatcgaaagaacttcaaaactttaacaaagagaaagaggttattgaaaagcgacgaacagtggcattaaagaagcacacagagcttgagcttgatgtaaaagacttgcaagagaagatctctggaaatacccgagccaaagaagatgctgcaagacaactggagatacttgagaaagaaattcaagattcaactgctgaactgggcaaaattattcctttacatgaagatcaagttcagaaagaaaaagacattggcaagcagtag

SEQ ID NO: 105733 - DNA, 618 bp, Glycine max
  Peptide Sequence Number=SeqID_222511
gatgtgagaagagggttgaattcagttaggaagatctgcagggagtataacatttctggagttcatggtccaattattgagttactgaattgtgatgaaaagtttttcactgctgttgaagttactgcaggaaacagcttatttcatgtggttgttgaaaatgatgacaagtcaacccagataattagacatcttaattcacagaaaggtggtcgagttacatttattccacttaacagagtaaaggctccacgtatcacttatccacagagttcggatgtcatacctcttttaaagaaattgaattttaaacatgactatactcctgcattcagtcagtttctaaactactgtaacacagcacaaggatctagtggcggccttattacctatggacctacttcagggggtggggggagtctgtgtaatgttcaaattcaaattttgcacaggagttcactcgaaattttcaatgtaaacacagtaattaacgtagttctcaatagcggccggagtgcccgctattgcagcagagcgacagtgacgtgtgatgcagacttctttcgcgttgcgattggagtggctgggatcgtgcttctgactatgaagcccaagtga

SEQ ID NO: 105734 - DNA, 743 bp, Glycine max
  Peptide Sequence Number=SeqID_222512
ggagcactacatcagagtcaagctgcgaagcagttaggctttgctgtaatatcttggtagagaggctaaagcctcttaaggaaaagctgcaggaggaaatggactctatcaaatgggagacccttattctccaggcatacatgcaagctgtgaacttatcagcatcttcattttatgtacctagtaatgattccatgggttaccttagttatggtgctgcagtggaaatagatcttctgaatggagaaaccagatttttgcaaacagatattatttacgattgtggacagagtctaaaccctgctgtggatttaggacagattgaaggagcttttgtccaggggttgggatttttcatgcttgaagaatacgaaacaaatcttgatggtttggtgttgcaagatggcacttggaactacaaaatcccaacgatagacactatacctaaacagtttaatgttcaaatcctcaacagtgggcatcaccagaaacgtgttctctcttcaaaagcttctggtgagccaccattacttctagcagcctccattcactgtgccacaagagcagctgtaaaagaggcaaggaaacagcttctttcatggagcaaccaagatgaagaagattcaacatttcagttgggggtccctgcaaccatgcctgtggtcaaggaactctgtggactggacattgtagaaagatacttgaaatggaaaatggggaaggacataatggtgctcacttaa

SEQ ID NO: 105735 - DNA, 459 bp, Glycine max
  Peptide Sequence Number=SeqID_222513
atgtcgcgggggtcaggagaccttggggacgtcaggtggggtgctattgcccaaaaccaagcttggccaatcccaacccaacccgggcatagtcagccaatcgcgatggtagcgcagttgatccatgatcgcgttgtgatggagtgcctagagggtgtttgggagaccctcgaaggcaatgagaggtgccgattccgtggcacaattagactcactgctacttcgctagtacatccggagcaacccgcacgtacacttcagcagcctgtggagtggatactacctacacctactccatatcgactagttgagtcggttcaagtgatagaggtgtcatcctctgaagaggatcttgaagaggacacagaggagttacctcctgaacctgctgtggatgcccctgactatgtgttatgtgcttatcatattctattgtgcactctgtgtggttacttatga

SEQ ID NO: 105736 - DNA, 237 bp, Glycine max
  Peptide Sequence Number=SeqID_222514
atgtcacgaaaccttacagattacacaatcatcccttctttggcttttggaatgttacggaactttatggattgcgccttaacacgtcctttcaactcccgacatgtcgcggaacttcacagattgcctaacgatgggtgtcaagtacctcaaagtggtcaagcaagggtcgcaccccaacaaatagatgatccccggacgaaattagggtatgacacatggaaagaaatactttaa

SEQ ID NO: 105737 - DNA, 951 bp, Glycine max
  Peptide Sequence Number=SeqID_222515
atgctgccgcacgctcacgctggaacatcctccagagagctttttctgtctgcgttggcgtccaaggccaagggatcggaatcggaatcggtttcatcgctcggaattccgaggttcgctgttgcggccgcgagggctccgttcttcgcgcagcgtgcgataggggaggagacgttggaggctgtagcaagagggctaaaagatccttcttttcgtgtgattcaaaaccactttgcaatttcaggaaatctaggagaggtagcagcaaaggaagaagtttgggaagtggttgctcaactggttggcctttctttaggcatattgattctggatacacctggccttgtaaaatcatatggtgtaatttcgttaacttggttgagtatgcgactactgcatctttggctatgttatgaatcactttcagttctccagtttaacacaataaatataaagcgtgctcgcatactggtaaaatcacatgtgttacactccactgttccaggatgcaccgatagcaacagagaagtaaatatattagcctggtctcaattcatgaagccaaaaataatttttggcttgcccttggagaaaatggatggtgtggagagatcttattttatggtggaggcacttataaaattatatgcaagtgagaaatatattcttatggtgaatcaacagacagaagatttgagattttatgtttctttcaaggttggagctacaaatgtatcggtattgcgaagtgtgtggcagagtttctggctaagtgagaactgggatagtgatgataatgttcgtgatcaaattgctactagcctaatggaattggaagaaaagtttgaggatttcattcaaaagttgaaagatgcagaatgggatacccagcaattcaatttgaaggttcccaaagaaatcttcattgatgacaataccaattctctctaa

SEQ ID NO: 105738 - DNA, 2289 bp, Glycine max
  Peptide Sequence Number=SeqID_222516
atggctgagcacaacgaccgcacacgattacagcatctccagtctcaatctcataccattggtggttcgaactcaaatcgtggtactccaggttcgtctaacggcattccggttactttgattatgacagtttctgcaattcgagacatttctttgggttttccgcattttgatggcaatacaccggtcttggagtggatcttcaaagcagagaagttcttcaattatcataacactccagatctggatcgaatgttgcaacggatgcaagttgtgagcatttgggctgagttaacacgtgctttggaaacacaatttggtccttcactgttcgattgtccgatggcagaattattcaaacttcaacaatcttgtatagttgctaattattatttgaagtttatggcatcagctaatagatctgaaggtttgactcctgaggctttgcgtaattgttttattagtggattgaacaaagacattcgtagagatgttgttgctcaagctcctaatgaaacacttctattaagaaaattagtcctgctgaaatgcaattgcgaagagagaaaggcctttagtgatgatgttgagcttgaaggtcatgatagtaaagacataattgataatgtgaatggtaatgcagaggtgattcttgaaaatcatcacttatcactgaatgcattaaagggtggtaggggtgtaggcataattaggtttacggcctatgttgataagcttccagttaagccgagagttgctaaagtcctcaagctacctgtggaaccaacaccttcttttaaggtcatggtggagaatggaaattacatggttactgaaggcaaggctcaattacatcacattaggagaatgttgaatacagatgttattgctgagatattcaccatgcaattaattgagcctaattcagtgcaatttcccttggtggaattgcccaatgatatggaacctgaattggcattgcttctccattcttatagtgttgtgtttggaactcctacttcattaccccctccaaggtctcatgatcattatattccattggttgaaggctctcaacctgttaagccaagtaaaagcccattctcatctccaataatcttggtcaagaagaaatatggatcatggagagtatgcacggattatagagcactaaatgccatcactatcaaagacacatttccaattccaattgttgatgaattaattgatgaattatatggagcagtttttttttctaagttggatttgagatctggctatcaccaaattcttattaatcctgaagatagatacaagactgcttttagaacacaccatggagttggtgtagctatggaaacaacgaaactacaagctgtgttgaattggtcattacctacatctctcaagcagctgagaagatttttaggcatgacaggttattacaggaggtttgtgaaaagttatgctacaatagcagtacctttaactgatcttttaaagaaggattcatttaagtggtctgcaagcaccactaatgcaattaatcaattgaaggaggctatgactttagctccagtcttagctattccgaatttcaaagaaccctttatgttagatactaatgtcttaggaattggaattggggcagttttgagtcaaggatatgactttgttattcagtataagccgggtagagagaatatacctgctgatgccttatcaaaaagtttattgatggcttggtctgaggcaataggggtatggatgaatcaggagtttcatgcttcaaagattggtggtcatgagggagttaccaagtcagtatcctggatatgtaagcagttttattggccaaaaatgcagcaagacataagggattttgtgaaagagtgcattatttgccaacgagctaaagtagaacaagcattgtcagtaggattattacagtcattgcctattccccaaagaatttgggaggatattgatatggatttcatcactaattttccattttcacatggttactctactatcttagttgtgaggaccacatgggaagatgttacttgggtggggacaacttatcctcagttcaaccttgaggacaaggttgttcttaaagggaagggtaatgtaacatatgagaaagagagagagagattggcgccaaagttggttaggaagaatggacacgtgtcagctaatgcagaaattaagggagacaggcaaaacatgcgaattaagaggccgaatgtgttatataagaaatttgttacgaaaaagtga

SEQ ID NO: 105739 - DNA, 1605 bp, Glycine max
  Peptide Sequence Number=SeqID_222517
atggatgtttatgaagaaatcgaagaaactaaagctgaaattgagaaacttacggtaaaactaagagacaagacaaattcacttcagaacttaaagaaatactatgatgcacaggccaataagatacaggaatctattttcaaagttgagaagctgaatcaagaaatgcttcaaaaggcagatgatatcaacgattatgtcagcgagagtttaaataataaagagtccatcaccaaacatctcagtgctgcagatgatgaacttggagcaatttgtgatgataaatttagaaagtggaaagatgaaaaaagagggtatgtattggcgttagaggaggaagaacaaataaaatggaaggaggaacattttaaacatctagaagatgtgcatgaaaaacttatagatcagtttaaggcaagtaagaaggagtgggagttggaaaaatctacattgcttgatgagatttcctcattgaagtctttaaagcgtctggaagatgaagtctccaatttgaacaagaagtgttttcaattgatgaagcagttggagttgaaagatgctgttttgatcagttccaagaaatatatcaatgaagagcgagagaaagcagcatgtttgatgaggcaggttgagtcctatggatttgccaatgaactgctacatttgccacacaacgaacttgataggcacaaggatttgcatatggaagatggtttcaaagaacaacttaaggaagtttatgatgctttagacagggcaaacattgaattggatgagagaatatgtgaaaaaagtgaaatggagtttgaattgagaatatggaagtcatttgttgaacgtttgaggagcggtcttgaagaaaatcttgtcatgtgcaaagaactggaaaattcactccttgcacaagtagattttactgaaagcctcaagcaagagaaagatagcttggaaacagaagcttctgttccagcaaattgggaaacatctgagtcttctgaaactgttgaagggacatatctccagatcatagaggagaaggacaatattttagaggagctccagaaaggggttataaggcttgaacaagagtcacatagaagagaatttgaaagtagtatgattgcaaaaggcaacatgatcacagcagctgaggttctagctacacttgaaattgaagagaagttgatgatggtggaacttgagtatgatatccatgatatggagcagaaactgaaattgcaagaggaaaattggaggcaatcagaacagcttgcattggatattgaagaggaaatggaagcaaaacaattacaaataaagaagttgattgatcaaatggagaacaagctaagaggctcagatgtttttcttcaaaaactcaagatagagaatagaagtttgcttgaaaattctacagacactcaactaatggacacattgagaagcatagtgcagtgttttgagaatgatagtgtaggaataaattttaagaaggatgatggattgcttgtaaaagagaatatgataatgcattctccaacggggataaagaaacttgaaacattttctgatataaggtcactatttaaggagctcaacacttag

SEQ ID NO: 105740 - DNA, 2199 bp, Glycine max
  Peptide Sequence Number=SeqID_222518
atggctcttcccggttccctgcagttgtcccatggattgggactttgcaggaacctggactgcaataaacattcggtacagaagttctctataattctgtattctttgtgcaagagggcagcggatcatggcaaattacatttatatagtgcaggtccttcatatcctatttcgttcatgagacaggaatgcaggggttttcaacaccttcgtcatataaacaggccagcacatacattatcttgcaaatcccgctcttttaagtgtcattgttttttaggccaaccaaatgagcttcctgctgttaaggtggctgctacagtgttggctaggtcttgtaatgtgttacaaaatagtcctaccatagtaaagttgattcctgcagttggtgttatcatttttgcagtatggggtgttggtccattattgtttcagacaaggaaattacttttccagaggagtgatagtagttggaagagaagtaccacttactatataataacttcttaccttcagccattactgttatggactggagcaatacttatttgcagagcattggagccattaatcctaccttcagaaactagccaggttgttaaggaacgacttttgaattttgtaagatcattatcaacagtactggccttcgcctattgtttgtcaagtgtaattcagcaagcgcagaaattcttagcagagagtactgatgcaagtgagacgagaaatatgggattccaatttgctggcaaagctgtttactctgcggtatggatagctgccttttcactgttcatggaattgctgggcttctctacccagaaatgggttactgcaggaggtcttgggacagttttgttgacccttgctggtcgtgagatatttacaaacttcctttcgagtgtgatgattcatgcaacccggccttttgtggttaatgaatggattcaaacaaagattgaaggatatgaggtttctggtaccgtcgagcatgttggctggtggtcaccaacaattattagaggtgaagatcgtgaagctgttcacattccaaaccacaaatttacagtgaatgttgtgcggaaccttagtcaaaaaacacattggcgtatcaaaacccatctagccattagtcatttggatgtaaataagattaataacattgttgctgacatgaggaaagtcttagccaaaaatcctcaagttgagcagcagaggttgcacaggagagtgtttttggacaacataaatcctgaaaatcaggcacttttgattctggtgtcgtgttttgttaagacctcacattttgaagaatatctgtgtgttaaggaagctgtactgttggatcttcttagagttattggccatcaccgagcccgacttgccacaccagtccgtaccctgcagaaaatatacagtgatgctgacttggagaacataccatttgcagattcgacatttggtcgtggtgctgggacagtacctaaccgtccattattagtgatcgaaccatcttataagatcaatggagatgataagaaaagtcgatcggcacggccagctgttgatcaagataacaagacagctacgcgaaccaaagttgacactgagggggataacaaagttgtgacacctaactctgatgcaaatggaaactctaagacagttgtgactcctaactctgatgcaaatggaaactctaagacagttgtgacacccaaacctgatcctgaagtgggtgaaaacaagccactgaaatcagattcaagcagggagaacgtggaggtgccagaatctccttctaaatccaaagttactggtttggtagtggataattcagcccagaaggacgtagatgtcaaacaagccaaggttcataccactaaaaacacaaagccaaatattgactctgacaatgtagtgtcctcctcctcaactaacaatgctgacaaaactggtggatttaatacgaatatgccaatgaaacagcaaggggaaaagaaacctgctgcacagcctcatgcatccaggactgttcttgaagagaatatagtactaggtgttgcattggagggatcaaagaggacacttcccattgatgaagagattgacaatgtgacatctcgagaggcaaaggaaatggctgcattgcagagtggaaatggatctccaaaggctccagatggaaatgacaactag

SEQ ID NO: 105741 - DNA, 720 bp, Glycine max
  Peptide Sequence Number=SeqID_222519
atgcccttatcagccgccttcgctatcctgaaggctcagctggagaaatgggctccaactaccttcaagaggtcactggtgcaggatatggcagcccattcggcctgcgattttggtggaggaaaagctgaaaaattggcccttgcaaagtatagacaggttatttggcaagggagggttcttaattcccaattcactgatgaagagttgaggagtcaaggccgttgccctatgacaccggaagaggttggattgttgctagcagctatgggatttgacaatagcactcgtttatatcttgcctctcacaaggtctatggtggagaggcaaggatttcaactttgagggaattatttcctctgatggaagacaagaagagccttgcttcatctgaagagcgttctcagataaagggaaaagcttctctattagctgcacttgactactatgttggcttgcatagtgacatcttcatctctgcttccccaggaaatatgcacaatgcattggttggacaccggacatacttgaacttaaagactataaggccaaatatggcattgatgggtcagcttttcctgaataaaaccatagagtggtcagagtttcaggatgcagtggttgaaggtcaccaaaatagacaaggggaactaaggctgaggaagccaaaacaatcaatatatacgtatccagctcctgattgcatgtgccaagcttag

SEQ ID NO: 105742 - DNA, 885 bp, Glycine max
  Peptide Sequence Number=SeqID_222520
atggagctcctcgggtacctgaatcagggtcacccttctagaggaacaacacttgttattactctttcattggtgctttcgacacttgtgtccttctccactttcacacatgccttctcttcttctgcgtttccgtcttgtaacttgtcagagtcccttaattcctatgagctatggtgtgccactagaatggtcatcgaattagagatgaaccggactccggaacatgcttatgttgatgccacctatttattggcttctagtgccttacaccttgcaattaactatgtgcaggaactgaatcctataaaacctaggcactcacgtcttctcaggagtgccgtgcaacatgaaactcctacatcacagctttctgaaatatggtcacctctggaaagccaaggatggaaaccttatgttgaatcaaataagccaacattaccagagaagtccgagggatatatccaggtctttcttgatggaggtttgaaccaacaaaggatggggatatgtgatgcagttgctgtggcaaagatactgaatgctactctggtgattccataccttgaattaaatcctgtatggcgagattcaagctccttcatggatatatttgatgtggatcatttcattgatgtattgaaggatgatatttctatagttaaagagctgcctaaagagttcagctggagcacaagagagtactatggcttggctattcgagaaacccgaatcaaggctgcgcctgtgcatgcatcagcccattggtatctggagaatgttttgcctgttctacagagttatggtattgctgcaatctctccattttctcacagactgagttttgacaacttgcctatggatattcaacacctacgctgtaaa

SEQ ID NO: 105743 - DNA, 183 bp, Glycine max
  Peptide Sequence Number=SeqID_222521
atgacgttacgcgccaagatggggatggtgatattgttatataattatcatgcatcatgcatgcctatagtcaaagtagggatggtggtggtttttgcttctggtgcaggagtgcggggtgtttcagagcgtgatgcctacttcatggacttttcgaacaaaggaatgattctcagacgttag

SEQ ID NO: 105744 - DNA, 1932 bp, Glycine max
  Peptide Sequence Number=SeqID_222522
atggcatctgctgcgtttattgagcctctgccagtagtggaatttgttggtcagctattaggaaaagatgtgctgtcaaggccattgtcagatgctgatcgcattaagattaagaaagcccttagaggagttaaagttgaagtaacacacagaggaagtgtgagaagaaagtatcgtgtttctgggttgacttctcaacctaccagagaacttgtgtttcctgttgatgagaactcaactatgaaatcagtagttgaatacttccaagagatgtatggtttcactattcaatatactcaccttccttgccttcaagtaggaaaccaaaagaaggcgaactatttacctatggaggcctgcaaaattgttgaggggcaacgttatacaaaaagattgaatgagaagcaaattacggctctattgaaagttacttgccagaggcctcgcgatcgggaaaatgacattttacggaccgttcaacataatgcttatgatcaagatccttatgcaaaggaatttggaattaaaatcagtgaaaagctagcttctgttgaagcacgaattcttcctgctccttggaaaatgattaatggaatgactgttagccggtgggcatgcataaatttttcacggagcgtgcaagatagtgttgctcgtactttttgtaatgagcttgctcaaatgtgtcaagtatctggcatggaatttaatccagagcccgttatccccatctacaatgccaagcctgaacaggtggagaaagctttgaaacatgtttaccatgtggcagggagcaaaactaaagcaaaggaattggagcttttgttagcaatattgccagacaataatgggtctctctatggtgatctcaagcgaatttgtgaaactgaccttggcttaatttcacaatgctgtctgacaaagcatgtcttcaaaatcactaaacagtacctggctaatgtgtctctgaagatcaatgtgaagatgggaggtagaaacactgtacttcttgatgctgtaagctgcagaataccattggtagtagcatcccaggactggcccgaagtgacaaaatatgccggtttggtatgcgcccaagctcataggcaggaacttatacaagatttgtacaaaacttggcaagaccctgttcgtggcacagttagtggtggcatgatccgagatttactggtttcctttagaaaggcaacaggacaaaagccactacgaattatattttacagggacggtgtaagtgaagggcaattttaccaagttttactttatgagttggatgcgattcggaaggcatgtgcttccttagaaccaaactaccagcctccagtaacattcatagttgtgcaaaaaagacatcatacccggttatttgcaaacaactacagggacagaagtagtacagataggagtgggaatatattgcctgggactgtcgttgattccaaaatctgccatccaacagaatttgatttttatctctgcagccatgctggcatccagggtactagtcggccagctcattatcatgtcctgtgggatgaaaacaacttcacagcagatggaattcagtctctgacaaacaatctttgttatacatatgccaggtgtacgcgctcagtatcagttgttcctccagcatattatgcacatttagcagcgttccgagcacgtttctatatggagccagatatgcaagacaatggctctgcaggtgatggcaatggttatggtgccaaagcaacacgagcagctggtgattatagtgtcaagccattgccagacttgaaagaaaatgtgaagagggttgtgggagtgaggagtggcatacccgttctcacttcttcaaatgagagaaaactcgaaactgattccgatggggatttttcctatcaaactcaggacgggactgaatga

SEQ ID NO: 105745 - DNA, 204 bp, Glycine max
  Peptide Sequence Number=SeqID_222523
atgtatcaagcaaacataaaagcaaagacagtgaaagacttttacagagttggtcatataagaagcagatgccattccagcatctgcatgccttctaactttgagccaaatacagcttatgtccgtatcagaaggcaccaaaaactttcatcattcattcaaaagcaaaaatggtcagaaaaaccccaaaacaaggccaagtag

SEQ ID NO: 105746 - DNA, 228 bp, Glycine max
  Peptide Sequence Number=SeqID_222524
atggcagccatggccatgagagaaaaaaaagaatcaaccaggcatccgaaagaactgaatcatcctcgtgaaccacccgatgtgagactcacaacacgccccctcgagtcaagactcagcgccacaaagcgagggcttgcagcactatccacaccaccaagcagaaccataaatagcttcaataggaagcaagtgacacggaagcaaaaacttctgataccatattag

SEQ ID NO: 105747 - DNA, 1721 bp, Glycine max
  Peptide Sequence Number=SeqID_222525
tggcaaccacgccaaagagaagagcttcctcacatgggtctctgcttctcttcctcttcccccaaccctcctcagcagtactcaggcaaggtctgcgagcactgacagcaagaacgtgggattctccgcgaccacgagcagcgccgggaagagccaattctcggagatcgcgagcgggagcatcgacagcagccaaggctctcttcctcttccttctcctcatggccagattctggaaaggccgaacctcaaggtgttcagcttcggagacctgaaatccgccaccaagagtttcaagtccgacacattactcggcgaaggtggctttggaagagtttacaagggatggttggacgagaagaccctctcccctgctaaagctggctccggaatggtcgttgccatcaaaaagttgaacccccaaagcacccaaggcttccaagagtggcagtcagaagtgaactttttaggaagactttctcacccaaatctggtcaagttgttgggttattgttgggacgatgatgagcttcttctagtgtatgaattcttgccaaagggaagcttggagaatcatctattcagaagaaatcctaacatagaaccactttcttggaacacccggtttaaaatagctatcggtgcagctcggggactagctttcttgcacgcctccgaaaaacaaatcatatacagagatttcaaggcctcaaatatacttctcgatgtgaatttcaatgcaaaaatatcagattttggcttggcaaaattggggccttctggaggacaatcacatgtaactaccagggtcatgggcacgtatggttatgctgctccagaatacatagcaacaggtcacttgtatgtgaagagtgatgtctacggatttggtgtagtgcttcttgaaatactgacaggcatgcgggcacttgacacaaaacggccaacagggcagcagaacctagttgaatggaccaaacctcttctctcttccaaaaaaaagttgaaaacaataatggatgctaagatagtgggtcaatattcacccaaggcagcgtttcaagcagcacaacttactctaaaatgcctagaacatgaccccaaacaacgtccttctatgaaagaagtgcttgagggattggaagccatcgaagctatccatgaaaaatccaaggaatccaaaacctgcaattcttatcaacctcctcggcagagagttcatttgattggtagccctagttggcgctttaatggttattacggttatcttgacataactcatcggagggactcttggaaccttttaagaaccctctcgtgtgacaacactctcccatggtgtatcatgggtgacttcaacgacctactctttcatgttgaaaagaaaggtctcaaccctcacccaaattctatgaagcacgaacatttcagtcccttgccgtgttcgatgttcgacacgcaagcagtgcacgactctaatatggttgatatccctacacttggacaaaaagcaagggctcccccaacgaaggagacattgataccccatgccaccatctcacacattgagaggaatatcagtgacgaagacaactcttctctattggctcctttcgttattgatgagttcagaacaaccctctcccagttgcacaatgacaaatctgcaggtccagatggactcaacccagcattttacaaaaaaatctgggatgttcttg

SEQ ID NO: 105748 - DNA, 3042 bp, Glycine max
  Peptide Sequence Number=SeqID_222526
atggttgttttaatctccaaatacgatcctgtgcttgaccaagttgaggattttacagcaagctcttgtctcacactactttgcagcatacatggctgttcaataacaactagtgaaggcattggaaattctaaagaaggattccacccaatacataaaagatttgcaggattccatgccactcaatgtggcttttgtactcctggaatgtgtgtttccctctttggaactcttgtcaatgctgaaaagactacttgtccagagccacctgctgggttctcaaaagtaactgttgctgtggccgaaaaggcaattgcagggaatctttgtcgctgtactgggtatcgaccgattgctgatgtctgcaaaagctttgcagctgacgttgatatggaggatttggggttcaactctttctggagaaaaggtgataacaaggactcaaagcttagtaggttgcctcaatatgaccataatcaaacgaatagtagatttcccttgtttttgaaggaagtcaagcatgatgtgttcttagcttccgagaagcacagttggcacagacctattagtctaatggagcttcagagcttattgaaattaaaccattgtaatggaacccggataaaaattgttgttagtaatacaggtatgggatattacaaagaaaaggaagcctatgataagtacattgatctaaggggaatttctgagctttcaaagatcagaaaggatcaaacagggattgaaattggagcagcagtgacaatatctaaagctattgaagcactgaaggaagagagcagaagtgactttctctcagattatgtgatgatacttgaaaagattgctgaccatatgagcaaagttgcctcaggatatattcggaacacagccagtgtaggtggaaatttagttatggcacaaaagaataattttccctcggatattgctacaatacttcttgctgtagatgcaatggttcacataatgactggtacacaatttgagtgcctaacattggaggaatttctcgaaagaccgccattaggtttggaaagtgtgcttttgagcattaaaattcctagtttggaactcaataaaactgaatcatcagaaccaagaagtagattcctttttgaaacttaccgagcttctcctcgaccccttggaaatgcccttccctacttaaatgctgctttcctggttaaggtgtctcaatgcaaggattctggtggaactgtgattgacacttgtaggttctcttttggtgcttatgggagtaagcatgcaatcagagcaaaaaatgttgaggagtttttagctggaaagcttttaagtgctagcattctatacgatgctgtcatcttggttacagccactattgtacctaaagatgatacctcaaaaaccacttaccgttcaagtttggcagctggttttatttttcagttctttaacccacttcttgatgcttccgcaataaacaatggttattttaatggacatattaatcttccttatgctaaggattttgagttaaaagagaatcagaagcaggttcgtcatgacaaagttccaactttactgtcatctggtaagcaaatccttgaagcaggctgtgactatcatcctgttggtgagccaattatgaaatctggagctgcactacaagcttcaggtgaggttgtgtttgtggatgacattccatcaccagcaaattgcttacatggagcatatatttatagtgcaaaacctttagcaagggttaggagtataaaactcacaccggaattgcaattggatggattgagggatatcatttcaattaaagacattcccaatggtggggaaaacattggatctaagactatatttggggttgaacctctctttgctgaagagatagccagatgtgttggtgaacgactagcctttgtggtcgcagatactcagaaacttgcagatatggctgcaaactcagctgttgttgattatgataccaaaaatcttgaaccacctattctatccgttgaagatgctgttgaaagatctagcttttttgaagttcctccttttctttatccaaaacatgttggtgatatatcaaaaggaatggctgaagcagatcacaagattctttctgctgagttgaaacttgggtctcaatactatttctatatggagacacaaactgcacttgctgttccagatgaagacaattgcattacagtttactcctcaaaccaatgccctgagtttgcgcattctactatagcaagatgcctaggaattcctgaaaataatgttcgtgtaataacaagaagggttgggggtggttttggtggaaaggccttgaaagcaatatctgttgccacatcatgtgcactggcagcacagaaattacagcgcccagttagaatgtatctaaatcgaaagacagatatgataatagccggaggaaggcatcccatgaagataacttacagtgttgggtttaggaatgatggtaagattactgcactagaacttcagatattgatcaatgcagggatatatgtggatataagtgcagttatgccacatcatatagtttgtgcacttaaaaagtacgactggggtgcactatcttttgatataaaggtatgcagaacaaatcatcctaatagatctgcaatgagaggccctggggaggttcagggatcatttattgctgaagctattatagaaaatgttgcagctacactttcaatggatgtagattctgtcagaagcgttaatcttcacacatacaaaagtcttcagtcattctatgagtactatcatggtgaaccttatgagtataccttgccttcaatatggagtaagttggctgtttctgcaaactatgaccagagaactaaattggtgcaaaagttcaacaggattaacacctggaagaaaaggggaatttctcgagtaccagctgtgattgaactgactctaagaccaactcctggaaaattggaggaattgaagtgggtcaaggtctttggacaaaggtga

SEQ ID NO: 105749 - DNA, 171 bp, Glycine max
  Peptide Sequence Number=SeqID_222527
atggaactggagaagacaccaacaagtttggtttttggtgttaatggtgagaggtttgagctctcccacgttgacccatcaaccactttgctccaattcttacgcactcgcactcgtttcaagagtgtcaagctcggttgtggtgaagttccaggtcaaacgggttattag

SEQ ID NO: 105750 - DNA, 300 bp, Glycine max
  Peptide Sequence Number=SeqID_222528
atgtcggatgaaaagacaaatgtacaaccagcagcagcagcagcagaacctgtcaatgaagattttctaccaccatctgattgggatcgtcagaacgacagtgacaccctaattctaatgcttccagggtttaggaaggagcaaatgaaggttcaagtgacctcgaaccgtatgctaagggtgagtggtggaagaaagatcagtgacaacaaattacgtcaatttcgcaaggaagaacccctttctgattatcatgacaccaaggggatcactgccaagtttgaagctgggatgctatat

SEQ ID NO: 105751 - DNA, 207 bp, Glycine max
  Peptide Sequence Number=SeqID_222529
atgggggatatgttcgtgcacctcagcggagcattggaaccgaagaagaagccagagatggaatgcgctgcatccctctacgagaaccaggagcgtcttgatctcctccaccattgctactatgggccaccacttgcgacggagcgcaaagctgttcacttgccacttggatgggttacacttggggtttttttagtctttaattga

SEQ ID NO: 105752 - DNA, 1100 bp, Glycine max
  Peptide Sequence Number=SeqID_222530
ggtttaggaaggagcaaatgaaggttcaagtgacctcgaaccgtatgctaagggtgagtggtggaagaaagatcagtgacaacaaattacgtcaatttcgcaaggaagaacccctttctgattatcatgacaccaaggggatcactgccaagtttgaagctgggatgctatatgtaaggattcccaaagtgttcaaaccacaaccaccaccaacaactacaacaaaaccaacacaacaagaaccttcaaagcctcaaacaacaacaacaccaacacaacaagagcctccaaagccaccaacacaacaagaaccttcaaagcctcaaccagcaacaacaccaccaccaacacaacaagaacctccaaagccaccaacacaacaagaaccttcaaagcctcaaccaacaacaacaacaccaccaacgcaacaagaacctccaaagcctcaactaccaccaccaacaacacagcaaaaacctccaaagcctcaaccaccaccaacaacaacaccaacaaaactagaacctccaaagcctcagcaaacaacaaaaaccgatcacaaaacacatgctcctcaagttaatgaaaaagagacaaaggaggacaaaattagtgaagaatatttcaaaaccaagacacaaacaccagtaccccaggaaccaaaggcagctcatgaagattctcaaaagaagccacagaaggagatgatgagcaaagcaaaaactgaagaagaaagaaaaactacttctgaaactcaagaaatgcatggaactgcacaaactacattcaaggagcaaaaggcagatcatgatgaagattctcaaaagaaggagaagggcaaagcagaaacagatagcaacggcattagggaagctataacctctaaagctcaggaaactagtcctgatgggttgagtaagagtattatagccatggtgcacaaaatcctggccatgatttctggttgtgtttccgaggttaagaagcaaaataaagtgccccacattttggtcttcatcattcttgtgttgctgatggggcactacactaagactgcaatcaagacatcttttggaggaccccaaaaccaagagctttaa

SEQ ID NO: 105753 - DNA, 873 bp, Glycine max
  Peptide Sequence Number=SeqID_222531
atggcacaggcacaatcagcggctaattttgattaccaagattttgatccctttttcgaatggtctgaagacgaaggaagtgccacgctcattgtaatgctgccaggattcacaaaggaacaattaagggttcaagtgacttcaactcctgtgctaaggatcaatggtgaacgacagatcgttgagaacaagcggcgtcgtttttctagagaattctccattcccccatattgtgacaccaatgatgtgagtgctaagtttgagggtggcgtcctaagcatcaagtttccaaagctcatcacccctgctgctaggtctcagccacagccacaggaagctccaacaatgcctcagaaagagaaagaaccatcacaacaacaagatcaggttcataagcaagagtcactacagaaagagaaagaaccaataactagtgatgagaaagaagagaacaaaacagaagagtcgtcaccacagaaagagaatgagccaattagtgatgatgacaaagaaaaggataacaaaacagaagaagtagttgctgaaaagaaggtgaggactaatggggtgccagagacagcaaaagaattaggaacaacaacaacaacctcatcaaaaccaaagataacccagagactgaaaacaagggttttagatttcactgtgagtttgagatcagtagaagaccgggatattgttaagcaagggtttggaggtaacaagtgtgcaaagctaattaagaggccaaagatatggatgaacatttttgtggtcatcttattggttatggtgctggggttgtatgtcaaaaatgctgcattcatgttatctcataagggaggatcagaacttcaggaattcaaggaattttaa

SEQ ID NO: 105754 - DNA, 129 bp, Glycine max
  Peptide Sequence Number=SeqID_222532
atgggttcaaggacacagccagcagcatctgatcgtgtctacgaagactttgtaccattgtatgaatgggatagaaatgaaaggcttgtcaatgttatgctaccaggtaacgttcatcgtcaaatttga

SEQ ID NO: 105755 - DNA, 435 bp, Glycine max
  Peptide Sequence Number=SeqID_222533
atgcagtttagttgtatttttaaatccttggtgttcgtgtcaaaatgtgctgactcctttactataaacaatggtcccagggcagtttctgttattaattcttcttcagaaagactaggaggagcaagagttgtagccactgctgtggttccagataatgtggcaaaaattcaggacattctaagaagatggagtgatattgagcaaatggatctcataattactcttggtatatcattaacatgcctggaaactgttgctgagtgttggaagctttattgccagcacttaagcatggtgctcaggggagacaagagagaaaaacatcatcgtcacgttcctcatgccgaagcagttcctgcagatgtgtgggaacagagtaatatgctagccactggtgctggctctgatatctcttgttcctgttgcaagtga

SEQ ID NO: 105756 - DNA, 582 bp, Glycine max
  Peptide Sequence Number=SeqID_222534
atgtttgtatcagcaccagtcgacaacttgttggttacatcaccctcttacagtgttgaatatgaacactttccgtcagttgcgcagtgcatcgctgatctagactacgacgaggtgtcaccatgtctccgctgggggcccattgctgttagacaccgaccagagaggttcgtgtgccagttcggatacgtccagagtattcctccacaacctatcgattcatgggagtcatttgatgaaatagacgacaggtggatgcactactcagaccattttgcgtcagcaggtgagatgtgtgttgtgccaggtcagtgtgcggccgactacatgaactggttcttcgtcatttctcatccattcaagaccacggcacagccatcagatccgccgcgagatccacctgcgatgcatgatgcctcatttgtggagccacatatccctcaggtcctggagccagtagcaacatcgacacatgcccgttctgaggtggatgagcctatacatgcagtggaggcttatcatgtgatcgctgaaaggttggagcgtcatctcaacctaaggatagtcatgccaggcacatag

SEQ ID NO: 105757 - DNA, 753 bp, Glycine max
  Peptide Sequence Number=SeqID_222535
atggtcgaaaaaaggagactgcaattcaagattctatcacatgtttgtcaattggaaacagcgcaaaacatgttgagaggaattttcataagcaggctggatggtgtagagttcaagacaatcaggaggaaaacgtcaaattggtggccagatttgaggaggaaggatgattctggtcgtttctttggggtgatggaggggcagaggaaggtggtgtgggtgaagtgggacacagtatgcctccctaaggagaaaggtggtttagtggtgcaggatctctcaaagtatgggagttggagaaatttagatgatggggaggaggaaccacaaggagtcgatttggtggcaggacttgcattctgtgtgcggatcggaagaggaagggaggatgggtggttgtctttgatggaaaagtaccagagactttactgtatatctcaacagcaacatcacagtattcagctgatgggcgttcaggtgggagaatcgtgggaatggaattttgagttgcagaggatgacgttggaaggggagatggaactagtagctatatttatggaggacattaaggggttgaagattcagcttaatcaagaagatagatggatttggaagggggatgcaaatgggatgtactccgtgggaagtggatatcatttgcttaatgaagtggtggcagatgagatcgatgatggagcattcacactcatttggaatatgaaaattccaagcaaggctgtgcactttgcttga

SEQ ID NO: 105758 - DNA, 1293 bp, Glycine max
  Peptide Sequence Number=SeqID_222536
atgtccggagcggccttgtcgccgccgacgaattcgaagtcgctgacgcagacggtgagcgggtcgcacaagttcgtgatcgagggctattcgctggcgaaggggatgggagtggggaagcacattgcgagcgacgtgttcaccgtcggaggttaccactgggcgatctacttctaccccgacggcaagaatcccgaggacaattccgcctacgtctccgtcttcatcgccttggccagcgaaggcaccgacgtcagggcgcttttcgagctcacgctcctcgaccagagcggccaggggaagcacaaagttcatagccatttcgatcgctccctcgagaccggtccctacacgctcaagtacaagggaagcatgtggggctacaagcggtttttcagacggtctttgcttgaaacctctgatttcctcaagaatgattgtttgaaaatcaactgtacagttggagttgtggtttcagcatctgattgcccacaacattactctattaacatcccggaatctgacattggatcacactttggtgcactattggataatatggaaggttcagatattatttttgatgtagctggggaaaagttccatgctcataagttgatgctggctgccagatccccagaatttcgatctaaatttcttgatggtttagatgaggaaaagaatgagattattgtaacagatttagaaccaaaggtttttaaggccatgctgcactttatctacaaagatactcttacggaagaggtggccacggtttcatcaaccactactagccattttccggtttctgaaacattgacagcaaaattgttagctgcagcagacaagtatggcttggccgatattttaaccttggctgatcattgccatgccacggagttgaaagctgtttgcctaaaatttgctgctcaaaatctagcagctgtcatgagatcagatggatttgagcatatgaaagaaaaaggcccatggctacaatcagagatcctgaagacaattgctgggggtgagggtgaaggttccagtgcagtggaaaaatctcagagtgtatggggccaactttcagatggtggtgacacgaatggtgataatgctgacaaattggggggtaaaaaagaacacggcaaagagggaaaaccctcttctgtccaacttttccatgtttcaatggaaagtttagaaaaagcaggtagactagatgttatgcagtgggtgtatgttgttagtgcagagtggtcattgaaaatgagcttatctgcagtagactattga

SEQ ID NO: 105759 - DNA, 984 bp, Glycine max
  Peptide Sequence Number=SeqID_222537
atggaaaagcactcagatggggagaatggcgtagaagaagaacctcgatcacttgagcagaaggagaagcgaaaggggaagcacgacaagccaaagccatgggacgacgacccaaacatcgaccactggaagatcgacaagttcgacccttcgtggaacgacggcggcatgctcgaagttagctccttctccactctcttccctcagtaccgcgaaaagtacctccaagaagcttggcccatggtcaaatcctcactcaaggagttcggtgttgcttgcgaactcaacctcgttgagggttccatgactgtttcaaccaccaggaagactagggacccctatattatcatcaaagccagggatcttatcaagcttctatcacgaagtattcctgctcctcaggcgataaaaatacttgacgatgagatgcaatgtgacatcattaaaatcagcggcatggttcgcaataagagggcgagccctggtgcagcggctgcgtacaacatccctcccccataccttcgcatagcgaagagcctctgggcaatggggtacgaagctcttgaaatactcactggctgctacattctcgtccagggaaacacagttgctgctatgggttcattcaaaggcttgaagcaagtcagaagaattgttgaagaatgcatgctgaataaaatgcatcctgtatacaacattaaggttcttatgatgaagaaagaacttgaaaaggatccagcacttgcccaggagaactgggataggttccttccaaaattcaagaagaaaaatgttaagcaaaagaaggttaacactaaacagaagaaaccatacactcctttccctccacctcaacagcccagtaagcaacccaccaaatctgccgtctgttatggacaatttctggtgccttgcagtaagaatgctgtaaaaagtgttcctttggtgatgccgggaacgttgttacaacttctatccatgtaa

SEQ ID NO: 105760 - DNA, 214 bp, Glycine max
  Peptide Sequence Number=SeqID_222538
ctcttgcactatgtgtggaaagattttattagacttgggtagaaatcctagaagaataaagaaaaggagaaagagcaatgtaaaaattgtgaaaaaagaacttgatgcagcttctaagggtcctctgatcaaggaagcaaagcaaccaattaattctgacacaactcaagtttctctgaaaattgttgaagaatcgttgttcagtgtgctgtag

SEQ ID NO: 105761 - DNA, 153 bp, Glycine max
  Peptide Sequence Number=SeqID_222539
atgggtggactgggagatatgaagctcatctttgggacaacagttgtaagaaagaggggcaaagcaggaaaggaagataagcagacatcaccaacatggaaggtggcaattatgagaagactatctatttatttgtctttgacattcaattag

SEQ ID NO: 105762 - DNA, 573 bp, Glycine max
  Peptide Sequence Number=SeqID_222540
atggcgaaagaaaataaaagagattcattttctaaaaagaaactagagggagtcgtcaccaacacttatttgaagaaaatattaaaaaaaatcaaaaagaagggtgttgtcgttgctcctatgtatccccaggaagaatatcctaaagcgcatgaggcgagtctaggacccagccttgtgcactacggaaacaaagtgcccgaggagaattacttggcaagtccgagatatagcgcggctatccccgacaatgatgcaagaaacttgagaaggaaatacgaaaattgtgatagtaaagaaaagccatttagtgtagaggaaactcgcccaggcaagctggagttcacccaagcgagctacttgcttagggttgaaggcactaactcatccaagcgagtggcttgcttagggctgaagtttcctcttagcccaggcaagctaaatgctagcctaggcgaatctagggtcagaaaagtttatgaaaagatcattttgccccttcctgtggctttgtttctggatctaacaaacaaccctcaaaaccctgagcggccccttggccttgcactgtaa

SEQ ID NO: 105763 - DNA, 276 bp, Glycine max
  Peptide Sequence Number=SeqID_222541
atggcagaaccatcaaagaagcaaaaatggtgtttcgacttcatctgcaatcataggaactcgaagccacggagcatccaaagcacagacaacacaaattactccctccatataatctcttacgttgttttcctcggaagaacaacgtatccgttatccagtgatggtgtagcgtttgaaggaacacttgatgatgattggaagtttgacttttcggtttttgatgcccgccgattggtttgcaccaatcaagcagatatgaccggaagctcatag

SEQ ID NO: 105764 - DNA, 171 bp, Glycine max
  Peptide Sequence Number=SeqID_222542
atgattggttgcaagcttaaaaagctttgggatggggttcagaatcttgtgaatttaaaagaaattggccttcaaggctctcaacacctaattgagatccaagacttatcaaaggtagaaaaacttgaaaaaaggaaacaacacaacaaatcttgtcttcaggagagttag

SEQ ID NO: 105765 - DNA, 498 bp, Glycine max
  Peptide Sequence Number=SeqID_222543
atgaggacgattctaacgaccctgtgtcgactgacctcactatggccacccttgaggacacttgaactgcagattctgcctcaatatctcaccgctgccaatcgtgatgctggtgttgtttcgtctgaatttttgctttgggagcaacaagatcagctccttctatcgtggcttcagtccattattttgccaagggagcatgtgtctagatatcatcatgttgacatcattcttgatggtttaccagatgaatttgagtcgctcgtcccctttgtgagtggcaagtttgagtcattgtctattgatgaagtcatgactcttctattggctcatgagactcaaattgctcacaagaaatcacatgcctcgtccgttacttcgattaatctcactgaagaagcaaaacccaatttggtgcaccaggattctcatactcaggcttatgttgctcaaggttttggctcatcctcgcactttggctcatccacctatttatag

SEQ ID NO: 105766 - DNA, 234 bp, Glycine max
  Peptide Sequence Number=SeqID_222544
atgcatgggggagccgccagtcaaactggtgagttcgtggcaggagaggcacagcctacatgcaggctacgtgtgcaagctacgtgctgcagcagggcacaggcttggcacagaggggaagaactcgccatcggtgcaggcgagatgcagctttggtgcagggaagtactcgccagtttgactggcgagttgagcttcaaatttttttttatatacgcgagatatgagactccc

SEQ ID NO: 105767 - DNA, 540 bp, Glycine max
  Peptide Sequence Number=SeqID_222545
atgtccagtattttcgggccagatgtcctggacatcgtatccgacatcgtggatcctgcagcttcaatgcttttagcaactccagtattttcgggcaggatgtcctggaattgtattcgacatcgtggatcctgcagcttcaatgcttttagcaattccagtattttcgggcaggatgtcctggacattgtatccgacatcgtgaatcctgcagcttcaattcttcatttgacatttcatcttgccttgtacacgatgaattcggttataacagtgttgtatttcaatggaagggtatatgaagataatgatggtgtaatatttgaaggcagtaaaaaagcgattcagattaaacgtggaattagtttcaatgctttgaagaaaaaaattggagacaaggaaaatatattgctttgcaaatttgcgatgacgaagacgttgaaacgatgcttgaaagttttaaacaacaacaacaaattccccgatatgattccaccagtaagaattgttcacccagcagaaggtatgatttcctcttaa

SEQ ID NO: 105768 - DNA, 399 bp, Glycine max
  Peptide Sequence Number=SeqID_222546
atggaggaggagaaaaaggtgtgcgcgtcggagtcggcggttgatggaagccgcgacgtttggagttccgagccctcgctcgcttcctccgcggatcacctcgtcgtaatggtgaatggaattctaggacgggagacggattggaaatatgctgcggagaaatttgtcagggagttgccggataaagtgtttgttcactgtagcgaacgaaatgtgtctatgcttacactagatggtgtggatgtaatgggagggagattggcagaagagtgttactgcaaaaagaagactgactcaaatagaggaatcaggcacacacgttcaaaaaacatagagaattcaagggtccgtagaagcaaccagaggaagtacctgaaagaagtggttcgagcagtgtga

SEQ ID NO: 105769 - DNA, 318 bp, Glycine max
  Peptide Sequence Number=SeqID_222547
atgggggcagaggaggaatgtggagttaggggtgatggtggcatcagggagaaggtggagagagggaaaaggacagaggaaagaagaagaaagagaactgagccagaagaagaggaattgatgcgaagaacaatttgggcaacactcgtgactgcatgcgccattaacccgattaaagtgcaaatcaattatgtttgcaacgaccaacatgagaattcaactataaagaaagtcaaagtgattggatttcacttctcatctgttcaactggcaggctacagaggattatggaacatcaattttgaaaatggcaactaa

SEQ ID NO: 105770 - DNA, 294 bp, Glycine max
  Peptide Sequence Number=SeqID_222548
atgaagatgaatcttagtctaatgtcaggtcatcctactccactgatacggcccatgagcaaatgctggaccagaatcactgtggtccaagagattggagggcatatcaagaagagggaagggggcatgtggcagccagtcagcggagcagatggggtgcataggagagatgcggataacagagggaatcatgggtatttcgggggtgaagttttttctggtttggtgacctattatccattttcactaaataaggaaacaactgcacaaaacatggaattagacaagttttga

SEQ ID NO: 105771 - DNA, 3135 bp, Glycine max
  Peptide Sequence Number=SeqID_222549
atgtcgctgatttcggaggaatcgtacaagttgagatcactcacgactagtggaaactcatcagatggattaaaagctagtgatgtagatccacggttggtgtttcatcatggagtgccatctggtggtgccaagttcgcctatgacaccactctgaggatactggctcttgctaccaaggatggccagattaaactctatggaaaagataatgctcaagccatgcttgaatctagtgagccactgcctagcaagtttctacaggtttgggacatagagaagaaactgttgtctgatgtgtacatagctaaagatgaaatcacttcctttacagtcattcagcatagcctctatatgtacattggacattcaaatggtaatatttcagtttttaagcttgatcaagaaccatcatggcatttggctcagatgaaatacaccatacctctctcagcttcccatgggaactctgaagcatctgatgatactgctgtgacgcatatactgcctcaaccagcagctgatagcaagagggttctcatagtctttagaaatggccaaatgatattatgggatattcgagaaagtagatctattttcagaactggtggaaatatgttgcagccactgcatactgaaacaaaaaaagtgacttctgcatgttgggtgtgtcctttcggaagtaaagtggttgtagggtacaacaatggagagctctttatttggagcatcccttctctaaatataggaaatggttcagcatctaaatctagtaatcaaaacactcctttgctcaaacttaacttaggatacaagtcagacaaaatttccataggatcaataaaatgggtttatgctggaggaaaagctagtcgattatatgttatgggagcttctgactttgcaacttcaaacttgctgcaggtagtgttgttgaatgaacaaacagaagctcgcacaattaagcttggacttcatttgtctgaatgttgtattgacatggagataatatcaacttcaactgagcaaagcaagaataaacaagattctttcattttgcttgggaagtcaggccatctatatctgtatgacgatagtttgattgaaaggtatctgatacaatgccaatctaagtccacaccttcacttccaaaagaagtaattgtgaagttaccactggcagaatcaagcatcacaacagcaaaattcatctccaacaatcccaacatgttaacttctgaagatgagtattacagacagctgataaaaaactgtccactgtttgttccagttgaaacaaaccaaaaagatgggattagcctcagttctgcaaaatttactggattttctaatgttcaaaacttgtacataactggtcacagcaatggaaccataaccttctgggatgcttcatgccccattttcactccaattttgcaattgaaacagcagagcgaaaatgactgttcattaagtggtatacccttgacggcattatacttcaatagcaactctctgcttcttgtttctggtgaccagtgtggaatggtttgcatctttagattcaaacctgaaccatatgccaccaacagcttcttgtctcttactggaggtacaaagaaagggactgatcatataatccaaagtgtgaaacgtgtaaagagtaatggtgccattctttctttgaacatagatcccagctcaatgcatcttgctgttggttctgatcagggacatgtttcagtttttaacatagatggcccaactttgttataccagaaacatattgcaagtgaaatttctgctggtatcatttctctgcagttcctaaccagcagtttacatggttttggaacaaacattttagcagttggaacaaaagattcatctgttcttgcactagataaagaaactggaaacacactgggcacgggaactattcatcctaagaagccctctaaagctctatttatgcaggttttggcggttttgtggtacacagatggacaaggtgaaccgatcaatggatcaattacagaagatggattagagttgagtgaaaggaatcatattgaggatgcaacaacaaagcaactgtacattttgctttgttctgagaaagctttatatgtctattcattggtgcatgcgattcagggggttaaaaaggtgctatacaagaaaaagtttcattcctctacgtgttgctgggcatcaacattttgcagtccttctgatgttggccttatactcattttcactagtggaaaagtagaattaaggtctttgccagagttatacctgattgtggagacttcaattagaggttttaattattctcctccaaaattgaagtcattttcttacagccagatatgctgttcatccaaaggagatcttgttttggtgaatggtggccaagaaatttttgtcgtctccctgttggtccaaagaaatattttcaggcttttggactctattagctgcatctacaggaaagaaatgaagctgtcacaagaagagcttgtccctagcccagtcatccataaggaaaagaaaaagggtatattcagctctgttatcaaagattttactggcagtaaagaaaagcatgctcccattttggaaacagaagatactaaagaaagcatcctggaactctcagctatcttctcaaatgaaaattttccatgtgatgctgataataatgataatctgactgttgatgaagatgagattgaattaaacatagatgacattgacctggatgatcatgaagaaaaacgcaaagatcaaagtatattgggagctcttaataagaagaaattgactgggaagtttcaggttctaaaaggtagattgaaagagatgaagggcaacatccagaaaacatcaagcaaggaaaagcaacaagatgagcaagctggttcagtcgatcaaattaagaagaaatatggattttcttcttccaatgaaacaagcgtcgctaaattggcagaaagcaagctacaggagaacatgaaaaaactgcagggtatcaaccttcgaaccacagaaatgcaagataaagcaaaatcattttcaacattggcaaaccaagtgctgtggactgcagaacaggaaaggcgaaattaa

SEQ ID NO: 105772 - DNA, 468 bp, Glycine max
  Peptide Sequence Number=SeqID_222550
atggatggccttgcaaatggggttgcactagaggaagtaatcacaagggttcaagggaaagggcgacgaagggatttctttggccgcaagggagcggctcgtgggggaagttatcttggtggtacggtggcaaagaaagtaagaaacaggaatttacgaacatacccctacgaggtccaaaatatatccacaccaacttcgcgtggcgcgtcgctcatagtctcgtggcatcttggtaaaatcccaaaccctcacaaggccaaaacagtcatcctactcacccacagccacgtggcaagaatttcccgaaacacattgcacaggtcctggcgctccaaaggaacccgcctcatctacgaaacacacacacagaggaaacacaagcgaatcgaggggtcacacgagagccaatgctttctcagcacacggatcgctgacgtggcgcgagatcgtcgaaatcccgcgtaa

SEQ ID NO: 105773 - DNA, 162 bp, Glycine max
  Peptide Sequence Number=SeqID_222551
atgatgctaggttgcaaacctgggaggtcacattgtcgaacctcgactgcatttacccatgctgagcttcctcatctgctttgttcctccatttcaggttggatgctcgacaacctaaacaggatcttggattttgattatccgttgtacaaaggttgttga

SEQ ID NO: 105774 - DNA, 2664 bp, Glycine max
  Peptide Sequence Number=SeqID_222552
atggccaagaaagttcatgcacataaaaacaataatggtgttaagtgttattttatatatttgaacagagacttctctcttgctacgatagacagcttcaaggaagctaaattgagcatttgttcactaatttctgagcattcctttcctaaaatgatagcttcaaacctggaaacttctggaaacggcatggagctgcaagtagaaacatctcaggtccactgttcagaaggagaattaccatactcttgtcaagtagaagatggctggtcaaagacaaatagttactcaaatgtgtattcagtgaaaaaattgaacaaagaggatttttccaaacaatcaggcaccagaaataatgcaccaaaccttgtggcaaggttgatggggatagacaccatgccattaccattagacactaaatctgttgttccattggatgaaagcaaacatggaaatatggagaggaagttttcaaaaaacggaatgaatccaaggggttctgttggcaggggttcctccaactttaattcttctagccatatggtatttgattcattttatcgagacattgatgttggtgatgatcaatgcggacagaattttggaaaaccaaggcctagggaacatcctcaggaagaggaactaaaaaaattcaagaaagaatttgaagcatatcaagcgtcaaggtttaaggaggggtcaaagaatgttgaaattggaagtggttctgggagaatgctttctcaagagaacctgagcaaggaaaagatgctacagattgcaagttcaaagacagatagccacacatttaagacaaagctacttaatggtaatatgatggagccaatctcaactaagaaaaacgaaccctttccttcaagaagtaaaacaccaagtagagactttgaggagtctttaatgatgaaatctagaagcagattagatatatgtgcttcttccactcagatagttatcttgaagcctggttctgataggatttgcaattgcaaccatgaacagaattgcatcagtttatcaggcactttacacgggagaaaaggtatagaagattttcttgaggaagtgagagagcagttgaaatgtgaactgcaagggattagagctagtggaactgagacacctcacaatgaaaaactatctgatgctaaagaggtcagagaaagtgtgactagagatgctgaaccaaatttactccgctcggaatcaacaagatcatacaaaagtaaattgcagttcaacggaccaagttccccagaatttttcaacatagataccaggagattcttgtcagagaggctaggaaatattgtaaaaagtgaactgcatttggaaattcctgaagtggcttgttatttagacaatggcaggattagattaaagcaggatactgtaaagtttgcaaatgacaagagtcagtggggagttttgaaagagaaaaaagaattacaaacaggttcctacagacacaaattagatgacaatgtattgttccacaaggagttgtctcctagaaaccttgaaagatccttgtctgctcctgcatcaggaacatcatttggaaggcttcttctagaggaccgccacatattaacgggcgcccttattcagaggaagcttgaagctgttgaagcaatgcctgtggatgttaaaaaaaagaagagagatggatttaatattaaagaaaaactttccaattttaaatatactcttggtctcagagggaagctgtttggcaaaagggttcagtcaatagtagaatcacatggcagtgagcatggtccaattttgagagatatcagaagtggaccaactgttctcatgaaatatggtgagagacatgagaactccactgaggtacctcctagtcctgcatctatgtgcagctgtgttcatgaagaagattggagaaagactggatattcaagtctaacatcaactccagatgcatcttcattagatgatatttttattcccaaggttttcagagatatcagctctggtttgaatgagctaaaaaggcaactcagtcaacttgattccgatggctctgacgacttcaccacaaagccggagcctttcgagtctgaattagttcacttggatgatccagcagaatcttatgtaagagatctgcttgttgcctctggtttgtactttggttcatggaataaatctctattaagaggggacacatttgcaaagcccattggcaactcagtttttgaagaagtggaagagtctcataacaatttgatcaaggaggatgaaagatccacaaaggatcagaacaagaacaagttagagcacaaagttttgcttgatttgttaaatgaggcactttccattgttcttaggtcacatttgacgttgtctagattcagaaggaaactaagcaattcctccatgcagcctccaccatgtggaaaggaactactgaagttagtgtgggacattgtcaatgtttctttaaatcctacatctaacacatgtccttattcacttgatagcttgctgtcacaagatctaggatctatttcctggtctggactaacaaatgatcagattgatacattggaaagagagatggcatgtctaatcactgatgatttggttgaagaattcacaaaggatatgctcttttag

SEQ ID NO: 105775 - DNA, 813 bp, Glycine max
  Peptide Sequence Number=SeqID_222553
atggtcttactcttatgtcaagaaccaactctcctgaaaggcttatgctgttgggttatgactgatgccgggaaccaacttttccaaaagcttaagccattaggcaaaggctcagaaccaattttatatagcacttatagaaaagaagtgtttactgtgattgtgtctaatcatatctttaacaacactcgcccacatacaagaccctttgggtttgaagggttgaaacctataatggacagacttggagaagcttatgacagcccagagaagacagaattggccttgcaactatgttgggccattggagagcatggtggaggtggtggatctcacaaagatgaagcccgtgagctttttgagagtttagaactgcttctgtatgaaaacctttcctcaagtcgtgtgggcatgactcaggaggtatccgatgaggatacttacagaaggtcatcacagtccaggcttttatgttttgttgtgacagccattgcaaagcttgctacgtatcatcgagagttactgccaagagcacgtgtgtccttgggcaaggtggctcggtctcgaatttcagatcctagagtatggagacgtgcatgtgatttcctgggtttgatgaaagaccctgctatatgtgcatccatattggggccttcacgtcctgcacaaggcaccacacagaaagtaggcagcataaactggagtgaaggttcaacgaagatgattgcacatattccgttttacattctaggggaacaagaagggccaccttttcatgatttctcattctcagatatcattccaagcatatga

SEQ ID NO: 105776 - DNA, 294 bp, Glycine max
  Peptide Sequence Number=SeqID_222554
atgccttggatttttcttcttcaccattacaacctcttcttcctttctctctctgaaaaccctaatcctggatcttcttttgcccctctttctctctctgccacaacaggatcaggaatcaaagtgttggaatggaaggattcgatgttgggtatgagtcaaatttcttcttctcgtggagggttgttagcaataaaaagtggttttgttaaggatcttgtaggattgttaaaatcttggtatcacgagggatgtggaattgggaaggaattgatcgatgttgcaatggtgtga

SEQ ID NO: 105777 - DNA, 767 bp, Glycine max
  Peptide Sequence Number=SeqID_222555
aggctgcaagagcagcagctgaagaaaaggctgcaagagcagcgaaggcagtagctgcagccaaaagggctttagatttggttgcatctttctctgaggaggtggctggaaaggaaagaaatctgaaaaagaacaagtcaaagaagcatctcccagttcagctgttgtacaaaaacaaccaacaaattgaaaattgtaggacagatgaagaattggctcgtaagttacatcgagccatgaacagttctccaagaatctctaagagttctccaaactcagacccaaaacgtagtaaacataagaagcctagaagctcttcaagttttgaaatgaccgagggatctgaatctggtgtggcactcagacaagattgcttatctttgaacaacgaacatgcaatagcaggcaagattgattcagaaggatccatccaagaggtatgctcaagtaagaaagataagaaggtggttaaatatcatagacctagccaattagagatagataacggggaagcagagttgagtcagtcaaaaggcaaaaactgtgaagatttatctcctataggtaagaaaagaggaagggtgaagctaaaaaagttgcccttaagcatttgcacctcgaaagatagagcgcagccaaaggaagaaataagagccagaagttctcccttgactagaacgaacacaggcaataatcctgttaatagtatgccttcgtttacagtggagtcatccactgacagagtgatgcctattgaggctacataa

SEQ ID NO: 105778 - DNA, 1287 bp, Glycine max
  Peptide Sequence Number=SeqID_222556
atgggttttcacaataataataataataataataataatgttgaaaccccttttctctcgaacgcaccccctctctcctcaaaattcaagaccctggccaacatcttcatatccattgtgggttctggcgtgctagggctcccttacagcttcaagaaaacgggttgggtcacgggtatgctcatgctcttcctcgtggcgttcctcacttaccactgcatgatcctcctcgtccacactcgccgcaagcttgaacattccaacgacgacgttaacgtgggcttccccaaaatcaactcttttggcgatttagggcacgccattgttggccctcttggcaagctattcgttgatgtcatgatcgtgttttctcattgcggtttctgcgtcagctaccttattttcatttccaccacgttggcctatctcgccggtgatgatgacacctcatcagcatcatggtcctccttgttttggggtttcgccacgccaaaggtgttgtttctgtggggatgttttccctttcaattagggctgaatgctatcccaacattgacccatttggctcctttgagcatttttgctgattttgttgacattgtagccaagagtgtggtgatggtggatgatgtctttgtgttcatgaagaataggcctcctttgaaagcctttgggggctggtccgtgtttctctatggtttaggtgtggctgtgtatgcatttgaggggattggattggttttgcccttggaagcagaggccaaggataaggagaagtttggtggggttttgggtgtagggatgttccttatttctttgttgtatgcatcatttgctgctttgggttaccttgcttttggtgaagggactcaagagattatcactaccaatcttggacaaggagtggtaagtgctttggtgcagttgggtctttgcatcaacttgttctttactttcccactaatgatgaatcctgtgtatgaggtggttgagagaaggttgtgtgactataagttctgcttgtggatgaggtggttgttggtttttggggtgagtttggtggcacttatggtgcctaattttgcagattttttgtcattggtgggtagtagtgtatgtgttattcttagctttgtgttgccagctatgtttcactatttggtgttcagagaagagattggttggagcaaaatggtgtgtgatgggctacttgtggtttttgggttggttattgcagtgacaggaacctggtcttcgttaatgaacatatttggccctaatgcttga

SEQ ID NO: 105779 - DNA, 1633 bp, Glycine max
  Peptide Sequence Number=SeqID_222557
atgtcgtgttcttcttcatctggttctgaagaggacgatgaggggttcgactcttaccggaaaggagggtaccacgccgtaagagtcgccgaccagttcgccggcggcaggtacatagcgcagaggaagctcggttggggccagttttcaacagtttggcttgcctatgatactactacatctgggtgtttccacagtggcacaatccctctggcatatgtcgctctcaagatccagaaaagtgcggcccagtttgttcaggctgcccttcatgaaattgatgttcttacatccctttctgatggtgccgacatggattcaaaatgtgttgtccatttgattgatcactttaagcacacaggtcctaatggccagcacctttgcatggtgcttgagtttcttggggatagtttgcttcgtctaatcaaatataatcggtacaaaggccttccattgaataaagttagggagatttgcaagtgcattttgattggtttggattatttgcatagagaacatggtattatccactcagacctaaaaccagaaaatgttcttctggtttctaccattgatcctggcaaagaccccgttagatctggactcaccccaatattagagaggcccgagggtagcataaatggtggtggagttactagtcttattgagaaaaagttgaaaagaagagctaggagggcagttgcaaaaatatctggaagaagttctccaataggaggaattgaagctccaaagtctgagagaaatcttgatgggattgatgtgagatgcaaggtggtagattttggaaatgcttgttgggccgataagcagtttgcagaagaaattcagacaagacagtacagagctcctgaagtaatactgcacgccggttattcattctctgttgacatgtggtctttcgcttgcattgcttttgagcttgccactggtgatatgctatttactcccaaggatggacaaggttttagtgaggatgaggatcaccttgccctgatgatggaactccttggaaagatgccccggaaggttgctacttctggagcaaaatccaaggatttctttgacagacatggagatctcaggaggattcgcagactaaagttttggccgctaagcaaactgttggttgttagatataaattttcagagcgtgatgctcatgagttttcagagtttctttcaccacttcttgattttgcacccgagaagcggccaacagcacagcagtgcctgcaacacccatggctccagggcatagagtctacaccaaatgaaatgagaaatgaatctagtgtggaaaaggtggatgttgggatgagcaaccttcaaatcaagaaaagagatttgagatcctcattgatgatgttgcggcgagaattcgtcgtcaccgacgtcgatgatgacacggtaaatctaagagacacgatgatgctgcgacgcaacgagacgacgacgaaagggagagcgagctcagaaagtgacgtcgccgccgaggaggagatgacatgccgtaatgctgtctttgaaattcgtctctggccacgacgcacagtggtggcagcgatcgctggtggtggcttaaatctggggagggagaaatatgatgtggaag

SEQ ID NO: 105780 - DNA, 246 bp, Glycine max
  Peptide Sequence Number=SeqID_222558
atggatttgtcttttcttcaaagcccacatgcacagtcttttcttcgtagctcaaaggcacaatatcagatgataaataacacaatgggtgaaggtaatactagtactagagatatgagcaccataaataacacaatgggggaaggtagtactagtactagagatatgagcaccgataaaataaatgttgatttaaatgaatatccaattgaagatatttctttagagaatggttattcaggaaca

SEQ ID NO: 105781 - DNA, 889 bp, Glycine max
  Peptide Sequence Number=SeqID_222559
atgaatatcaataacattcttttctggcttctactcccatacttcatcttagcttcttcttcctcttcctctttctgcaaccaccatgacacctctgccttactacttttcaaaaactcatttgccctcaacacttcacttcagtattattatgggttggcttcttgttcttcaaagacagaatcatggaaaaacggaacagattgttgtgagtgggatggggtcacgtgcgacaccatctcaggccacgtgattggtcttgaccttagctgcagtaatcttcaaggtcaactccatcccaacagcaccatcttcagcctaagacaccttcaacaactcgacctatcctataatgatttttctggctcttcattatattctgcaattggtgatctcgtcaatctcatgcatcttaatttgtcacacactctactcagtggtgacattccctccacaatctctcacttgtccaaattacggtcacttcatctcggtggtgactaccagagcatgatgagagttgatccatacacatggaacaaactcattcaaaatgcaactaatttaagagagctttctttagattttgtggacatgtcttatatcagagagagctctttgtcattgttaaccaatctgtcttcctctctcatctctctgagtctctcattcaccgaattgcaagggaatctatcgagtgacatcctctctttacccaatcttcaacaactagatttgagttttaataaagacctgggaggtgaacttccaaagtccaactggagtactccactaagctacttggatctctctaaaactgctttctcgggaaacatttccgattccattgcccatttggagtctcttaacgaaatatatctggggagtt

SEQ ID NO: 105782 - DNA, 219 bp, Glycine max
  Peptide Sequence Number=SeqID_222560
atggaagagacattgaatttacaagataccctcacgtgtcactgcgttgaaggacatggaagatcacaagcatcgagctctaattcatttcctctagagatttttcgatccgattatggtgtgcctgatgactatgctgacaatgatactgtctttggagaacacgggaaactcaatgtcgtgccatatctcaaatatgacatgcatgcttatgcttga

SEQ ID NO: 105783 - DNA, 1808 bp, Glycine max
  Peptide Sequence Number=SeqID_222561
tcctagaaatccacttttctgatttgagtttctttatgtctctcttgtgtgctctccgtgacccaatggaactcaaaaaatggttactgttctttttgttgctggagtatgtttgttgcaatgcggagtctaagtgtgtgaagggatgtgatgtagctttagcttcatactatgttagtccagggtatttactcttggaaaatataacgcgcttgatggaatcaattgttctgtccaattctgatgttataatctacaacaaagacaaaatattcaatgaaaatgtgctagcattttccagactcaatattccattcccctgtggctgtatcgatggtgagtttctggggcatgtgtttgagtactcagcttctgcaggtgacacctatgattcgattgcgaaagtgacatatgccaatctcaccactgttgagcttttgcggaggttcaacagttatgatcaaaatggtatacctgcaaatgccacggttaatgtcacggtcaattgttcttgtgggaacagccaggtttcaaaagattatgggctgtttattacctatctactcaggcctgggaataatttgcatgatattgccaacgaggctcgccttgatgcacagttgctacagagttacaatcctggtgtcaatttcagcaaagagagtggggatattgttttcattccaggaaaaggtcttgctacgagtgcttcagttggaataccaatagcaggaatatgcgttcttctattagtaatttgcatatatgtcaagtacttccagaagaaggaaggagagaaagctaaattggcaacagaaaattctatggcgttttcaactcaagatgtctctggaagtgcagaatatgaaacttcaggatccagtgggactgctagtactagtgcaactggccttacaggcattatggtggcaaaatcaatggagttctcatatcaagaactagccaaggctacaaataacttcagcttggagaataaaattggtcaaggtggatttggaattgtctattatgcagaactgagaggcgagaaaactgcaatcaagaagatggacgtgcaagcatcaacagaatttctttgcgagttgaaggtcttaactcatgttcatcacttgaatctggggtctcttttccttgtatatgaatatattgacaatggaaacttaggccaatatttgcatggtacagggaaagatcctttcctatggtctagccgagtgcaaattgcactagattcagcaagaggccttgaatatattcacgagcacactgtgccagtgtatatccatcgtgatgttgcagattttggtttgaccaaacttattgaagttggaggttccacacttcaaactcgtcttgtgggaacatttggatacatgccaccagaatatgctcaatatggtgacatttctccaaaagtagatgtatatgcttttggagttgttctttatgaacttatttctgcaaagaatgctgtcctaaagacagtagaatctgttgctgaatcaaagggccttgtagctttgtttgaagaagcacttaatcagagtaatccttcagaaagtattcgcaaactggtggatcctaggcttggagaaaactatccaatcgattcagttctcaagattgctcaacttgggagagcttgtacaagagataacccactactacgcccgagtatgaggtctatagttgttgctctcttgacactttcatcacctactgaggattgctatgatgacacttcctacgaaaatcagactctcataaatctactgtctgtgagatga

SEQ ID NO: 105784 - DNA, 501 bp, Glycine max
  Peptide Sequence Number=SeqID_222562
atggatgaaaacatggttgcagactttggattaaacaaattgattgatgttggaagttcatcacttcccactgctaatttgaagggcatatttggttacatgccaccagaatatgcatatggcaatgtttctcccaaaatagatgtctatgcttttggagttgttctttatgaactaatttctgctaaagaagcattgatcagaggtggtgtaactggtgcagaattaaagggtctttttgatgaagtatttgatcagcaagatcccacagaaggtcttaaaaaactggtggatcctaggcttggagataactacccaattgattcagtttgcaagatggcacaacttgctagagcatgcacagaaagtgatccacaacaacgtccaaatatgatttctgttgtggttaccctcacagcacttacttcaactactgaggattgggatattgcttccatcattgaaaatccaaatcatgctaatctaatgtctgggaaatag

SEQ ID NO: 105785 - DNA, 201 bp, Glycine max
  Peptide Sequence Number=SeqID_222563
atggatgtatcttcttgcacgggtgagaatagggaaaggccaaaaaggcttcacctgaagcgtcttggtgaaaactcgtttttatgtggctttttagcttttggtatagcaaaagatgaaaccataaataatgagaagaactgttttgcactaaaagctgtaagcattcctcaaaagaatatgtatatgccttatagttaa

SEQ ID NO: 105786 - DNA, 1689 bp, Glycine max
  Peptide Sequence Number=SeqID_222564
atgtcagcgatgctgcaacctcagatcattctgctcaaggaaggcacggacacttcgcaagggaagccacagctggtgagcaacatcaatgcctgcaccgccgtcgccgacgtcgtccgcaccaccctcggccctcgcggcatggacaagctcatccacgacgacaagggaaccgtcaccatctccaacgacggcgccaccatcatgaagctcctcgacatcgtccaccccgctgcaaaaatcctcgccgacatcgccaagtctcaggactccgaggttggcgatggaaccaccactgtggtgttgcttgcagctgagtttttaagggaggccaagccattcattgaagacggtgttcactctcaaaacttgatacggagctataggacggcctgctccttggctattgagaagattaaagatctagctgttagcatagaggggaaaagtctggaagaaaagaaaagcttgcttgcaaagtgtgcttctaccactctttcttcgaagcttattggtggagagaaagaattttttgcacccatggttgtggatgctgtaatttcaattggaaatgaagacaggttgaacatgattggaataaagaaggttcctggtggtaccatgcgggactcatttctagtaaatggtgttgccttcaaaaagacattttcatatgctgggtttgagcaacaacccaagaagtttctcaatccaaaaatactattactaaatgttgagttggagctaaaatctgagaaagaaaatgctgaaataaggttatcagatcctgcgcaatatcagtcaatagttgatgcagaatggaatattatttatgacaagttggataaatgtgtcagcagtggtgccaaagttgttctttcacgactggctattggtgatctagctacacagtattttgcagatcgagatattttctgtgctggtcgtgtagctgaagaagatctgaaaagggttgctgctgcgactggtggaaccgtacaaacatctgtgaataacattattgatgaggtccttggaacttgtgaaatttttgaggaaaggcaggttggaaatgagaggttcaatattttcaatggatgtccatctggccaaacagccaccatagttcttcgtggtggagctgatcagttcatagaggaagcagagcgaagtttgcatgatgcaatcatgattgttaggagggctttgaagaattcaacagtggttgctgggggaggtgcaatagatatggagataagccggtacctgaggcagcatgcacgtacaatagctggaaagtctcagcttttcattaactcctatgcaaaagctcttgaggttatacctagacaattatgtgacaatgccggatttgatgcaactgatgtgctgaataagctaaggcagaaacatgcgcttccttctggtgagggggcaccatatggggtggacatagcaactggtggaattgctgactcatttgctaactttgtctgggagcctgcagttgtgaagatcaatgctataaatgctgcaacagaggctgcctgccttatcttaagtgtggatgaaacaattaaaaatcccaagcatattgtgtgggaatggtatcctccttgtactgcatgtgaatggggtttccatggtttgctaagggaagagacagtaagggcttcattcctcacctga

SEQ ID NO: 105787 - DNA, 261 bp, Glycine max
  Peptide Sequence Number=SeqID_222565
atggaatgggggatgtatcgtcataaagcactcaaagagagactcaaggtgcaagcaaggagtcagcaggatcaaactcaagactcttgggcaccattgttgctggatgtctctgatgtctgccattgcagcagggcagctagtgaacagccacatgaaatacaacagatcaagcaaagatctaaccaaaatatcatcatcttgaggtcagggacgtggttgcagtcattagggaaggaaaatggagaaacattagattag

SEQ ID NO: 105788 - DNA, 393 bp, Glycine max
  Peptide Sequence Number=SeqID_222566
atgacgaaaaagtctacgagaaatatggaaatagcaaagagaagtggaaccaattttgttaaagtcgtagagacccttcatgggaggatgtacaaactgttgccacttgatgaccaaagcaccctggccatgtctgtgcagctagagttgagaattgtacctcctgttgagcctgaggtagctccttctagtgtccatgtcaggataaagggaagttgtgttgatccctcagagcatgacccagacacggatgcattagacaagtgtgggttgtatcctgatgacaattctccctgcctagttgcccttggaagagtttataaggggtcaataatcgtgcaccacatccttttgcgcaaaaatttggtgaacataggtattgatgaagtttga

SEQ ID NO: 105789 - DNA, 697 bp, Glycine max
  Peptide Sequence Number=SeqID_222567
atgaaggtcacagtggtttctcggagtggaagagaagtggttaaaggtggcgttgagctcagtgattctgagattgttcgtgagaaggaagatgcatttttttgtggaatgctgtttgcaagccctattgccaagaagtacccatcaaggcagcgcttgacacttccagtccaacctggatcaaaggaaaggcctgttgtccttaattacaaaaagagtctgaaagactatacaagtggaaattcagaaaccttaactgttgtattcaaggatttgggcccacaagtttcttaccggacacttttcttctgcgagtatttgggacctttgcttctctatccagtcttctattatctccctgtctaccaatattttggttacaaaggtgaacgtgtgatccaccctgtgcagacatatgccttgtactactggtgtttccattatgccaaacgaattctggaaacattttttgtgcatcgcttcagccatgcaacctcacccctttccaatgtgtttcgtaactgtgcttattactggacctttggctcctatattgcttattatgtgaaccaccctttatatacccctgtaaatgacctccaaatgaagattgggtttgcaattggaatactttgtcaaatttcaaatttctattgccatattattctgaagaatcttcgtagtcctggtggtgaag

SEQ ID NO: 105790 - DNA, 144 bp, Glycine max
  Peptide Sequence Number=SeqID_222568
atggctgacaatggctgcacacgacgccgatgcgacacattggagacaggtttgatggacgctgagtgtgtggatgaacgatggatcgaggacacaaaccgagcgaagaagctaacaagtggtctctctggggtgaaaaaatga

SEQ ID NO: 105791 - DNA, 612 bp, Glycine max
  Peptide Sequence Number=SeqID_222569
atggagaaaatggtaagatatcatgtcaaggagatgcatagaattggtaaggtaacgagcaaggtacttctaagaagtcctaatatcaaaaaaggaagacaccctcgtctactagcgttgataataagttccatgcaagtgatggataaaaacactaaggaaacatatgggtctaatgaaggcatgtcaattagttattctttcatattaactccttcagtgaagccaaagaagaaggatgtacatgtagtggacctctctccctatcaaggcccctttaacctagaagttgacaaggacaaaaaaaatcatgatactcttgttgttagttctaaaattaaaagtcttaacaaagaacaaaatgatgtaagaaaatttgttaaaaggaatgatgatgtggacaaggatgaagttcagagtcagagtgaatcgtctccattgaaacaaccatctcatcaagaacccaccattgaagagaatttcatggagtttgattctagcataaataatccttccaatcctatcataaaaaacaaagcacaacctgaaatggctcaatatggagaagaggaattgttaaatatggatgttcttgcagtgatcattccttaa

SEQ ID NO: 105792 - DNA, 219 bp, Glycine max
  Peptide Sequence Number=SeqID_222570
atgactgtgagtcaagtgcacaaaccctacaatgtttctcaaagaaggtccacatatgtgccacatgctggagtccctttgaatagatggattcaactgggacatcaaggttcaagttctcaatggcaaccatttgaggaacatgttgaaaaccaagtgaagaagacatcaaaggttgagaaagagtgcaatcttggagcaatagatgaacaatggtaa

SEQ ID NO: 105793 - DNA, 330 bp, Glycine max
  Peptide Sequence Number=SeqID_222571
atggacacattgtcgttgttctactatgagaagatggtaggttacatgccttcaagttttgcagatttagtgtttgttggcgagaggatcgaagtgggtctgaaaagagggaaatttgattatgcttatactatgagttttggtaataggaggcctggggtgaatggagcgaagaaaaaagagggagaaacccatgctatgactgtagtgcccacatggtcgagctcttcgcaaacccctcacaaccccatgtatcagtatccctcacaccagtaccactattcgacaaatatcagtcctcccccctgcccaacgcccatccgaccatga

SEQ ID NO: 105794 - DNA, 330 bp, Glycine max
  Peptide Sequence Number=SeqID_222572
atggatgcaatgatgagcataaggaagatgatggaggttaacactgctacagttgctattgtgagtattgttattgagatggacctgattcacccgtccgatttcaatcgagtgagtcgtccaatctcagatgtagtaggtttaggaggcgaggcagcggaaaatgcaggtgggccctattatgttcaggagagtcttgttggggaagctattacttggtataccaatcagaaaccttcccgggtccgttcttggatggacctaatggctgccttcattaggcagtatcagtataactctgatatggctccagatagaatgcaactatag

SEQ ID NO: 105795 - DNA, 462 bp, Glycine max
  Peptide Sequence Number=SeqID_222573
atggcggcacagctaattcgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttctcgaggtggattctcccgaggaagtcatgtcggcatctgaggcagactctacggaggatagcggcccgagggagatggcgatcagcgggggctcttcatcctaccaccactatggacacctttgctctggatga

SEQ ID NO: 105796 - DNA, 309 bp, Glycine max
  Peptide Sequence Number=SeqID_222574
atggaccgactcaatggttctactaacctaatgatagtatcagatcttgatttcacaatggtggaccatgataatccagaaaatcttgctcttctcaggttcaatgcgctatgggaagcttcttattgtcataattctctgctagttttctccagtgggagatcgcctactggagatggttggaaacaacatctagataaaaagtggaatagagatatagttgtcaaactcagagaaattgggttatacaatcatgcaagatatgctggtttaaagggccaacaaatctgcacaaataatgccaaataa

SEQ ID NO: 105797 - DNA, 198 bp, Glycine max
  Peptide Sequence Number=SeqID_222575
atgattttgtacaaggtcattcaacatacatctgaagatgcttctgggttgcaagatgtaaaagttgatcctgaagaagtggacatgcctaatccatcaacaatccaaaagcaagtggatgaagatgcatatgatttggtagaagctgacaatgtagtgggagaacttgaagatgactttgaatttgaatttgtttag

SEQ ID NO: 105798 - DNA, 168 bp, Glycine max
  Peptide Sequence Number=SeqID_222576
atggttaaaatgattcttgctaataggcaatcttctgcccaattaatgaagatgaggattcgttacataattgagtggaggaagctaaagaagctcaagattaaagtcgctaagctcatagcaaagcttgccatgcttaagccctacaacactctaacaatgctatga

SEQ ID NO: 105799 - DNA, 969 bp, Glycine max
  Peptide Sequence Number=SeqID_222577
atggcgcgtattatactgcatgctcgtagcctagttttcaacttctatgcagcttcatgccccactgcagagttcattgtgagaaacacagtcagttcatcttcttcttctgattcttcaattcctgggaagctccttcgcttggtttttcatgattgctttgtggagggatgtgatgcatctttgatgctactagggaataatactgaaaaaagtgatccagccaataggtctgttggaggattttcagtaatagaatcagcaaaaagagtccttgagttcctttgtcctggaacagtttcttgtgctgacataattgctttggctgctcgagatgctgttgaaattgttggtggtcctatgattcaaattcccacagggagaagagatggaatggtttcagttgcttcaaatgtcagacccaacattttggacaccagttttacaatggatgagatgattaaccgcttctctgataaagagttgtccttgtttgaccttgtcatcctttcaggtgcatattcgttcaaatttctagctggaggtttcaaaagggctcacaccataggaacagctcattgcagctcattcagagataggttccaagaagactccaaaggaaagctcacactcattgacaaaacccttgacagtacctatgcagataagctaatgcaagagtgtcccttaagtgcaagcccttctgttcaagtgaacaatgatcctgaaacatcaatggtctttgacaaccagtactaccgaaatcttctaaccaacaaagggttgttccaatctgattctgccttgctaagggacaatagaacaaggaaatttgtggaggacttggcaaatgatcaagagtttttctttgaaagttggggccagtctttcttgaagctcactagtattggagtcaaaacaggtgatgagggtgaaattagacgttcttgcgcatcaactaatgcataa

SEQ ID NO: 105800 - DNA, 135 bp, Glycine max
  Peptide Sequence Number=SeqID_222578
atggctgtgaacatttcaattgctaggggagagtcccttgggaaggcctgtctactgattgttgtagtgtgtgggactaaaatgtgtcacacgatcatatgggatgtgtcacctccaaggaatacccctgattga

SEQ ID NO: 105801 - DNA, 351 bp, Glycine max
  Peptide Sequence Number=SeqID_222579
atgagttccacaaccaaagcccctccttcctctaatgatgctatgtcaactgaggagagtggttggacgacatactttgatgacttcttcaacaaccatgttgtggataacaacaagtgttccatgcctttatccggtggtgttgctagctcctcccttgtctccgatgcagcttcttcggcagagaagaaaaaagtggcaaatagtaaacaagttgaggagtttaattatgtgaatagatatgtcaagagatcaagtttcaagaagaggaaggatgtcataacggctttgattgatgactctttggaagatacggcaacttctcctcttaatagtcccaaggttcattaa

SEQ ID NO: 105802 - DNA, 222 bp, Glycine max
  Peptide Sequence Number=SeqID_222580
atgcataataagagagactgtatagaattggctgaagagaataaggagagcatgatgcgtctagaggctctgacgcaagaagcacaacttcaagatgaagtctaccaggcacaactggaagaaatacagagcctaaaggaaaaacttaattggacaaaactgcccccaaatttatggacatctatcagcggagaggaagctcgtaataacagcagtaattaa

SEQ ID NO: 105803 - DNA, 2793 bp, Glycine max
  Peptide Sequence Number=SeqID_222581
atgagaaaagtttggcttcttgtcatagtgatgttctaccatgtctttccttcaaaaggaatcagcaatgtttctacaagaccgagtactgttaacataggggcacttatgtccttcaattcaaccgttggcagagtggctaaagttgctatagaagctgcagtggatgatataaattccaatgcaacgattctcaatggaaccaagcttaatatttcaatgcttgacaccaaactatccactgggttcctaggaatcattgactcattaagattgatggagaaagacactgtggccataattggtccccagttctcagtcatggctcatgtgatttcccatattgcaaatgagatgcaagtgcctctactttcatttgcagcaacggatcctacactgacttcactgcagttcccatattttgttaggacaactcagagtgatctgtatcagatggctgctgtggcagaaattgttgatcactttcaatggagagatgtaatagcaatttacattgatgatgatcatggaagaaatggggtagctgcattaggggacaagctagctgagaaacgcggtaaaatatcgtataaagcaccatttaggcctaataacattaccagggaagaaataaacaatgcattagtaaagatagctttaattgaatcaagggtaatagttcttcacatatacccttcttttggtctacaagtgcttcatgtggctcggtcactaggcatgatgggaagtggttatgtgtggatagccacagattggctttctacattactagattcaaacccgtcattgttcacaactcaagccatgaatgacatccaaggtgttatcaccttgcgcatgtacacccccgagtcagaaatcaaaagaaattttagttctaggtggaacaaactgagccaaaagaaggatcctgaagagggtccttttgcattgaacacctttggcctttacgcctatgacacggtttggttgcttgcttctgcactagatgcattttttaagagtggtggaactttgtcattttcaaatgattcaagcttaaacatgttaaaaggggacacccttaaacttgatactatgggggtatttgttgatggagtcatgttgcttgaaaagattttagaagtgaacagaactggtttaacaggccaaatgatgtttagtcctgatggaaacttggtgcatccatcatatgaagtcattaatgtgataggcactggaattcggaggatcggttattggtccgaaacctctggcctccacactggggaaactcccaatcattccaattccagtgaaggactatttggtgtcatctggcctggccaaacaacccaaaccccgcgaggttgggttttcgccagcaatggaagacacttgaggattggggtgccactcagaattagttaccgcgagttcgtgtcaagaactgaggggactgagatgtttggtggttattgcatagatgtgttcactgcagccctcaacttgttgccttatcctgttccctacaagtttgttccatttggagatggtaaaaccaatccattaaatacaaaacttctcaacaagatcacagctggggagttcgatgctgttgtaggggacattacaattaccacaaaccgaactaagatagtggattttacacagccatacattgagtctgggctagttgttgtggcacctattaggaagatgaaatccagtgcttgggctttcttgaggccattcactccgatgatgtggtttgtcacgggaatgtttttcttggctgttggagttgttgtgtggatattagaacgtcgcttaaacgaagactttagaggcccatcaagaagacagtttgtgaccattatatggtttagcttttcaaccctgttttttgcacatagagaaaaaactgtgagcactctgggtcgcttagtgctaataatatggctttttgtggttttaatactcaactcaagctacattgcaagcctcacctccatcctaaccgtggaacagctctcttcctcggttaagggaatcgaaagcttggcaacaagcaatgaacgcatcggtttcctgagtggctcctttgcagagaattatctgacagaggagctcaacattcacagatccaggcttgttcctctcaactcaccatcagaatatgaaaaggccttgaaggatggtcctgctaatgggggtgtcactgcaataatagatgaacgtgcatacatggagctgttccttgcaaccagatgtgaatacggtattgttgggcaagagttcaccaagatgggttggggctttgcattcccgagagactctcccctagcaattgacatgtccactgccatcctaaaactatcagagaatggtgatctccagagaattcatgacaaatggctcacaagaagtgcatgcagctcagagggtgccaaacaaggcatagaccgacttgagctagaaagcttttggggtctgttcctactgagtggcattgcatgcttcattgctctcctttgctatgttatcagaatggcctatcgttttagcagacaccccaatagtaaccctgagggatgctcatcatactatactcgtcttagatcattctttacctttgtcaatgaaagagaagaagaggaagaaaaaaacatcatgtcaaagagaaaacgaaccgaaaagggatctagcagaagggtggcgcatgaagatggattaataatggatggctcaagtgttagtgtccatattgaaaacgatgccgcccaaggctaa

SEQ ID NO: 105804 - DNA, 702 bp, Glycine max
  Peptide Sequence Number=SeqID_222582
atggctaagttcgatcctgagatagtcatgaagttctatgctaacgtctggcctacagaagggggagtcagagacaagcactcctggccaaaggcggagtcaacgcctctggcttcacgaggaggctatcagccagttgctgtgcattccggggcaagactttgcctagagcgtagtggggagacaggtgcggatcatgcgcaccagcatgaccacccttatgcaaatctggatgacgtgagtgtccatgtcgcccagctgatttcagatgctatctatcagtttgtagggattatgcctccgagacacccagtggatccagagaggtccaatagggccttggggtttccttctttgattacagcttgtgccaattctatggagtggtcaggtgccacaatagccaaaggaggaccagtagcagccagctacagatgcgccaccatcgcctctacaagagacaccttccctgggatgcacacatacatgcagcatgtgactagccagcaggcgactaatcacaggggccaggaccccaatcttttcccttggcctacccccgagcagttcggggccacagttgcctggcctagagatgagaccgattttcagacacaggcaagacccgtagggacccctggggacgatagaagagctcaggaggatgacgacaaggccaacgtgctagatttcttcacttga

SEQ ID NO: 105805 - DNA, 228 bp, Glycine max
  Peptide Sequence Number=SeqID_222583
atgtcgttaaacgttatccgagtgcatttactcgaggaagcattcaatgcgaaaatcctatccttactagctctaacaagggacaagatagaggagttaatacaggagggtgcccttgccaactacatctacacccctaacaacaacacagacagttaccgaggtcatggtcggggccatggaagtcatcatggaggccaaagacaacaatcccacggcgacaaatga

SEQ ID NO: 105806 - DNA, 2796 bp, Glycine max
  Peptide Sequence Number=SeqID_222584
atggctttccaaagggcatctgcaaccatgattggagtttggattgttgtgttgatggttctctccaaaggattatcttcaagtggggtagtatcagataattccacaatacctgcttttgtaaatattggggttctctattctttcaataccagtgttggtagaatggtgaaaactgctgtacaagctgcggttgacgatgtaaattttgatcaatctattcttgctaacactaagttgaaggcctcactgcaagaagataccaaatacagaggttttctgagcattgccgaggccttgcagctcatggcaacacaaactgtggctataatcggtccccagacgtctacaacagctcatgtcatatctcatatagcgaacgagctccaagttcctctactatcatttacagccactgaccctactctttcttcacttcaattcccattctttattagaactgcttttagtgacatttatgaaatgactgcaatagcagactttgttaactactttggctggagagaggttattgctgtttatggtgatgatgaccatgggaggaatggaataggtgcattaggggataagcttgccgagagacgttgcaagatctcatttaaagcacctatgactcctgagacaaccagggaggagattactgatgtgcttgttcaggtggccttggcagaatcccgggttatagttcttcacacaagtactgcttggggcccaaaagtgttaagtgtggcaaagtctctgggaatgatggaaaacgggtatgtctggataacaactacttttctgtctacttggctggatataggtagtcccctatcttcggatgcaacagatgacatgcaaggagtcattacactacgtatgtatataccagattcagagcgcaaaagatggtttttttcaaggtggaaaaacttgactacgggaaagactgctaatggttcccagggtttgagtacttatggtatctttgcatatgatactgtttacgctcttgctcatgcacttgatgcatttttcaaacaagggaaccaaattacattttcacgtgatccaaagttatctcaactacgtggagacaacatgcatcttgatgctgtgaaaatattcaatgaaggaaagctgttgcgtaaatatatttatgaggttaacatgactggtgtatcaggtctattcaagtatacatctgatggaaaccttgttaatcctgcttatgaaatcatcaatgttattggaacagggactcggagggttggttattggtctaattacactggattatcaattgttcctcctgaagcactttattcaaaaccacctaatcgatccagtgcaagccaaaagctactccctgtgctttggccaggagaaacaacccataggccccgtggttgggtttttccaaacaatggaaggatgttaaaaattggagtgccaaaaagggttagttatcgagaatttgtctctcaagtacaaggcactgacatgttcaagggattttgcattgatgtatttctttctgctgtgaacttgttgccctatgctgtcccttataaatttgtttcatatggggatggtgacagcaatcctagtaacactgagcttgtccgtcttatcacagctggtgtcttcgatgctgcagtaggtgacattacaattactacagaaagaacaaagatggtggattttactcagccatatatcgagtctggtttagtggtagttgcatcagttaagaagacagattccaatgcttgggcttttttgacgccatttacaccaatgatgtggactgtcacagctgtcttttttctactagtgggagctgttgtttggattttagagcataggctgaatgatgattttaggggacctcccaaacaacaaatggtcaccattttgtggtttagtttttcaaccatgttctttgctcacagggaaaacacagtgagcactctcggtcgctttgtgctgcttatatggttatttgtagttctaataattaactcaagttacacagcaagcttgacatcaatcctcacagtgcaacaactttcttcacctgttaaaggcattgaaagtttaataagtagcaaagagcctattggctacttgcagggttcatttacgcgaacttatttaattgacgaaattggtattgatgaatccagactagttcctctgaaaacaccagaagaaactacagaagcacttaagaaaggtccccagaagggtggtgttgctgcatatgttgatgagcgtgcttacatagagctcttcctttcaagccggtgtgattatagcattgtaggtcaagagtttaccagaaatggttggggatttgcctttcctcgagactcaccgttagcggttgacctttcaactgcaatattagagttggcagagaatggagacttgcaaaggatccatgacaaatggcttttgagcagtgcttgcctatcacaaggtgcaaagcttgaagtggacagactcaacctgagaagcttttggggcctctatctgaccatgaggcagtactccaagcatggcccagaggagctcgaatcttctggccatggctcaggatcttcgcgtttgcgcacattccttacattcgtagatgaaaaggaagagatagttaagagccgctccaagagaaaaaaaatggaggggatatcttacagaagcacaagtgaggttggatcatccatcaccttcaacaaagcatattctcaggcatcattaaacagaattgattcagttaatgaaatctaa

SEQ ID NO: 105807 - DNA, 3105 bp, Glycine max
  Peptide Sequence Number=SeqID_222585
atgaggctgaattcgaacctcagctatttcacgccaactagaggtcgaattcaaacctcgacttcttcaagcaaacaacaggtcgaacttggagcagagttgccacccacgaactcgattcatagaggaccaacgtggcttcgaacatggcataactctctcaacaccggacatgtatatatagacccagaggagagatccccagtaaaatacaacatgagcaaagtttggcttcttgtccttgtcatcctctacagtggttttccctcaataggaaccaccactaccgattctacatcaccaagtgccgttaacataggggcaattttatccttcaactcaacaattggcaaagtggctaaagttgctatacatgcagcagtggatgacataaattccaatgcaacaattctcaatggaactaagcttaatataacattgctagacaccaaactatccactggattcctaggaatcattgattcatttttgttgatggagaaagacactgtggccataattggtccacagtactcagtcatggcacatgtgatttcacacatagcaaatgagatgcaagtgcctctactttcatttgcagcaacggatcctacactgacttcactgcagttcccatattttgttaggacaacacagagtgatctgtatcagatggctgctgtggcagaaattgttgatcactttcaatggagagatgtcatagccattttcgtcgacgacgatcatggaagaaatgggatagctgccttgggggacaagctagcagagaaacgttgtaaaatatcatataaagtaccatttaaaccagataacataagccacgaagaaataaacagcgcattagttaaggtagctttaatggaatcaagggtaatagtccttcacatatacccttcttcaggactagaagtgctccatcatgcagctcagtcacttggcatgatgggaagtggttatgtgtggatagccacagattggctttccacagtactagattcagaaccatccttgttctcatcttcagccatgaatgacatccaaggagttatcaccttgcgcatgcatgcaccagattcagacatgaaaaaacaatttgtttctaggtggaaaaaactgagccaaaaagaagattctaatcaggacccttttggggtaaatatctttggtctttacgcctatgacactgtgtggttgcttgcttcagcactcgattcgttttttaagagtggtggaactttgtcattttcaaatgattcaagcctaaacatgttaagaggggacagccttaaccttgatactataggggtctttgttaatggtagcatgttgcttcaaaagattttagaagtgaacagaactggtttaacaggccaaatgatgtttagtcctgatggaaacttggtgcatccatcatatgaaatcattaatgtgataggcactggaattaggaggattggttattggtctgaaacctcgggtcttcacactggggaaggtcctaatcactccaatttcagtgagggactatttggtgtcatctggcctggccaaacaactcaaaccccgcgtggttgggttttcgccagcaatggaagacacttgagaattggggtgccactcagaattagttaccgcgagtttgtgtcaaaaatcgagggaactgagatgtttggtggttattgcatagatgtgtttactgctgcactgaacttgttgccttatccggtaccattcaagtttattccatttggtgatggtaaaaccaacccgttaaatttagaccttcttcacatgatcacaactggtgcctttgatgctgtggtgggggacattaccattactacaaaccgaactaagatagcggattttacacagccatatattgagtctggtctagttgttgtggctcctatcaagaagctgaaatcaagtgcttgggctttcctcacaccattcactccaatgatgtggtttgtgacaggaatgtttttcttggtggttggagctgttgtgtggattttagagcgtcgcataaatgatgactttagaggccctcctagaagacaatttgtcaccattgtctggtttagcttttcaaccctattttttgcacatattatccttgatgctttcctcgtgtacagaacagaaactcaatttttaccagactgtaaagatcaatcaaccaaaaagaaaaacaccttctatgcaggagagaaaactgtgagcacccttggtcgattagtgctaataatatggctttttgtggttttgatactcaactcaagctacattgctagcctcacctccatcctaaccgtggaacaactctcttccccggttaaaggaattgaaagcctagtaataagcagcgaccgcatcggtttcctgaggggttcatttgctgagaattatctgacagaggagctcaacatacacaggtccaggcttgttcctctcaactcgccatcagaatatgaaaaagccttgaaggatggtcctgctaatggcggtgttgctgcaataatagatgaacgtgcgtatatggagctcttcctagcgaccagatgtgaatttggtatcgttggtcaagagttcaccaagatgggatggggttttggcttcccaagggaatctcccttagcaattgatatgtcaactgccatcctaaaactatcagaaaatggtgatctgcaaagaattcatgacaaatggctaacaagaagtgcatgcagctcagagggtgcaaaacaaggcatagacagacttgagctaaaaagcttttggggtctgttcctactgagtggcatagcatgcttcattgctctcctttgctatgttattagaatggcctaccgttttagcagggattccaatagtaataacattgaatgctcatcactctctgctcgtcttcgatcgttcctttcctttgtcaatgaaagagaaggggaagacaaatgctggccaaagacaaggagaaaggagaagtgctcttgtagaaaggtagtgcatgaagatggatctttggatgactcaactgttcgtgtccacattgaaaataatgtcactgcccaagattaa

SEQ ID NO: 105808 - DNA, 459 bp, Glycine max
  Peptide Sequence Number=SeqID_222586
atggaccgtgggggtaggcttgtaccatgtcaatgccgaccctttgagggaggtgggaaagaccttgcacatcatggcgtcattaatggagtacaaaatgacttgtgtgaaggagagttgagtgtggctttcctgggtatgtgtctcggcataggtggttggtggggacagaaagcaaggtggggatggtggaggtggcaaaggtggtggatgttgggttgtaagtcaagttttgagggagaggtacctgcaaaaggaactccgaagagcaagtcaatggtacttagaggtgtttgtgtgtctagcactgagatgagtcaaacgttcctaaggatctcccttctgggtctttatatagatgttggtgttaagggagttgcgcgatgtttagaaccacgtttgtcctctatgcctcgtggcctaattcatgggtggcagttggggatcaccatgagctga

SEQ ID NO: 105809 - DNA, 342 bp, Glycine max
  Peptide Sequence Number=SeqID_222587
atgttcaaaatatttaaagctgaagtaaaatataagcttaacaaaagaattaagaatgttcaatctgatcatggtggtgaatactatgacaaatatggtggttcaggtgaacaacgtctaggtccatttgctaaattccaagagatattaggaatcgtccctcaatacacaatgctagggtcacatagcatgaatgatgtagccgagagacaaaattgtggaagcaatgccttccaagattattttgatgatgccaaagaatcaagagtcaagcaagttccaaagaatcaagagtcaagcaagtttcaagaatcaagatcaagattcaagattcaagaataa

SEQ ID NO: 105810 - DNA, 1866 bp, Glycine max
  Peptide Sequence Number=SeqID_222588
atgttgcacacggtgggaatcgaaatcgaacacgagttcttccgccaaatagttcctattcatgtgaacgcatcgggtcttacaccccttcgtcaatcgtttggtaaggctgcaaccacagcactgattgtgaccctagatgggactatgtacttggtggatcaattggagagtggttccacgagagtcatatggtcgttctcgacaggattgccaatctaccaatcatatcaagcaccaactaaaaaggataatggtaaagaaaatgcatctgcagcactgatgagtgggttcatggaatgcggggaagggaatgactggtcattgtatatgcacgacaagcactttggtaaaatgagaatatcagaatctattgcagaatatgtagctcgtacacctacattttcagatgatggagcagtaacacttggatccaaaagaagcactttgtttgaagttgatgctaaaagtggatcaatcattaaaatccatgcgatgtctgattttgataatgcttctgcaccttgtagtgatggaaagcagggtgtcacaaatatcctcaatgtaaagaataaggaccttgctgatcccatgaagctgaattcacctcagccgctgcttaagatttttaggacagattattctcttaaatctgttggtcctagctcaggaatggttttgtggactatggcagtagctgaatttgaggctgtattattatgccaacatacatcttttgatctagaggatgagtatgcttctgacagtagcctcaattttaggatgccatacccatgtcaagagataaaccaagtctttcgcctgaaaaagaatttccggtttgaaccttcactaactgaaagactacttgtggattatcatgaaaatgatatgctctcgatgcctaactcaaagctaatgcttccttcacagccaaatattgatagattattcaatggtcatgatgataatatgatgctccctcaacctcctgtggagattacaacaccaggggaagtttatctgaacaggacaagtgaatggccaactccattacctcttatattgtttacggtctttcttctggccttttcactcatctatcctctagtgattgagaaccaagatatactcaaggaccaagacagtgagtctgaattaaaaggttcacctgctaagaaaaagaaaacacggaaatcagggaagaaaaatggcactatcgatacaagggaaaaacacctgtctccagagaatgaggatgttctgacacaaaaggataatgagagagaagtatggaagcatttcaatcaaggtgatgaaagtgttgatggacgaagaattggtaaattatttgtttcaaataaagagattgctaagggaagcaacggtaccattgtccttgagggaatatatgaatgccgggtagttgctgttaaacgtcttgtcaagtctcatcatgatgtagcttataaagaaatccaaaatctgattgtgtctgatcatcatccaaatattgttcgatggcatggagtagagtatgatagtgattttgtttaccttgctttggaacgttgtacatgcaatttagatgacttgattcaaatttattcagatatgtcagaaaactttgcgtttaggaaggaccaaggtttcagatgtttgataaagtcccaaatggagatggagaagtataatacacaatgtctttggaaggaaaacggctatccatctcctctattactaaaactaatgagttgttgtggaatctcaacgcatcccctcactcctagattggacaaatggaatgtggagattggagaactgaatttttttattgcactaggagaactgctaggtcagttctga

SEQ ID NO: 105811 - DNA, 318 bp, Glycine max
  Peptide Sequence Number=SeqID_222589
atggcggaacatggcagcagacagaaattccgccatataaacatgccattgcgccttatgacgctgccatggtgggccacccttcacaaattggctatggcagttgccaaaaaatccaccatggtggagccatggctgctatttaataacactgtaagagtgttatcagaaccagaccggtcattgactcggtgcagctacctagggacatgtcagagcatcatagtgaccatagtgcagctgcacgtttcagaccggtccgttccaagtttaatcacaatgcttagaaagtcaacttccaggcatgagctttcataa

SEQ ID NO: 105812 - DNA, 459 bp, Glycine max
  Peptide Sequence Number=SeqID_222590
atggatcttttcttattggagttcattcctgaagccaaagatcttattagttgtttattaaaccctaaccctgatctaaggccaaaggcgactgaagtattgtaccatccttttttctggagttccgagatgagactttcctttttacgtgacaccagtgacagggtggaactggagaatagagagacaaattctgatcttttggtgacattagaaagcgttgctacagtggccttgggtggaaaatgggatgaaaggatggaaccaactttcattgctaacatcggtcattaccggcggtacaattttaacagtgttcgagacttgttgcgagttatgagaaacaaactaaatcattatagagaattgcctcgagaaatccagttggataggctttgcaacatgatgtgttggggtgggattttgctaactgaccccataccgcatcctttggcctga

SEQ ID NO: 105813 - DNA, 210 bp, Glycine max
  Peptide Sequence Number=SeqID_222591
atggcatatcttgaggctgccaataaagactcatttagaagattttggacgattagagacacttacttaactagtcttcaagcgcaagggatatccttgaaaaaggttacacaccaactaggaagtagcataagagaggttcaaacttacaatattcatggaaaagtttggggtttgaacaaaattcttaagtatacattgacagaataa

SEQ ID NO: 105814 - DNA, 624 bp, Glycine max
  Peptide Sequence Number=SeqID_222592
atgggtaatcttcctgttgtaattatcccagcaatctgtgatcagaaaggaggtccatttggtgcacctgatgattgccgcaatagggctctctcttattccttttgctctttggcgcttggtggtgtcttcatctggacttatacttaccaactaatgcaaaacacatccttgagatacaaggcatttgaggctgctgagatcttaaagattcccagcaaagacattgatgctaatgcagaagctcgccttctcaagcaaaatgatggttacgccgtagacactgaaaatcagattcttgtagaccaaggtccttctattgcaacgaagaatatggaaaaatgcttttgtcacagaatgatggaaactcttgtccaaatcctggcagaactaatgtcacccccaacaattgctacaagaaattttacctgcttccatgatcagtttttaggtttcctctttggtggagttaaatggctaagaaacctaataatagggcacgatgctccactgaaagtgatccaagactcaattcaattgttaggctacacaccgaaggacaggattcagaataattgtataggaaaaaatattgatgtgaaaataattaaggaaaagagataa

SEQ ID NO: 105815 - DNA, 3360 bp, Glycine max
  Peptide Sequence Number=SeqID_222593
atgaagcaatcgatgacgaccttccccggaaacctaccaatcctggacggaaagaattgggattgttggcaaattcagatgaaggcgatcttggggagtcaagatgtaagtgatatcgttgaacaagggttgtcggcgcttcccgatggagctacggaggagcagaaggtggcgcacaagaaaaacaagatgaaagattgcaagtcgatggtgttgttccaccagagcggaacagctgaaaaggtgaaattacaaacccttcgtcgtcaatatgagttgatgcagatggaggaaaacgagagaattgctgtctacctcaataggatcataagtcacacaaatgcgatgaagtccaagaaggtagaaatcttgaaggttgaaaagttgcaaggctcactcgaggctcatgagcaaagactcatggagagatcaatggcaaggtctggtgaccaggttctacaagctacggtctccaagaaaggtggttatggaggaagatccagtttcaggaatcgaggaagtactgagacaaatttagaggaaaaacctcttatgctcatgatggtcacaaaccataatcccaaagatgatgaaagatggtacattgactcaggaagctcgagtcacataacaggacacaataattggtttgtgaatcttgatgaaaccaagaagagcactgtgaggtttgctgacaacagggtaatccaagcagagggaattggtgaagttctgattaaaagagatgatgggagtagtgctatactatcagaatgtctctatgtgcccaacatgaagagcaacctcatcagcttaggtcaactggtggaaaagaaattccacattgacatacacaatggataccttgcaatttttgagccagtaactgagaaaatggtgataagaacaaaaatggcatctaacagaacattccaggtaagtcttagaaatctagaatctcagtgtatgactgcagaaatcctagctgaagatacttggctaaggcatttgaggctagggcatttaaatttcagggatttgagcatgcttagaaataaggagatggttctagggttacctgcaatccagattcctagtaaagtctgtgatagttgcttaatcagtaagcaacctagaaactctttcagtaatttcacaccatctagagccaatgacttactccacattgtatactctgatgtatgtggcccctttgatgccccatcactgggagggagcaaatactttgtgacattcattgatgatctaactagaaagatatggatctatccaatacaacccaaaagtgaggtattttcagtgttcaaaaacttcaaagcactggtagaaaaacagtctggtaaatgcatcaagatattcagaactgatggggtggagaatttacctcaaaagagattgaggatttttgcaaggaccagggcattgtgcatgagaagtaagaagttaccacacagtttctgggctgaagcagccacaactacagtatatgttttaaataggtgtcctacaaaaaagcttgatggcaaggtacctgaggaagcatggtctggagtaaaaccctctgtgaggcactttaggatctttggatccttgtgttataggcacataccagatcagaagagaaagaaactggatgacaaaagtgaagctatgatatttgtagggtataattctactggatcctacaaattatataatcctaagaagaatgaagtagtgttcagcagagatgttcactttgatgagacacaagcatggaactgggaaaaatctcaagaaaggctcacctttgtcagtagtttacagtttgaatgggaagatgaaaacacaactgagaatgtttgggatataatcaatggtactgaggaattccagattgatgaagccagacctcaaagacaaaggaatctaccagctagactcagagattttgaagtatatccagataatgcaatctcaaaggatggagatttggttcaacacatggcattactggctgatacagaaccagtgagctttgaagaagctatcacaagcagtgtttggagggatgctatattagaagaaatcaagtcaatagaaaaaaataatacctgggagttggtgtcactcccaacagagaaaactccaatagctgtcaaatggattttcaaaataaaattgaagcctgatggtactatagaggtctttgccccagtggctagacttgaaacaataagattactagttgccctagcaagttggaaacgatggatattgtggcaacttgatgtaaaatcagcattccttaatggccccttagaagaagaagtttttgttacacaaccccctagtttcataaataaagggagtgaggataaggtactgagattgaagaaagccttgtatggcctaaaacaggctcctagggcttggaataggaggattgattccttcttggccaagacaggatttcataaatgcagtgttgagcatggtatgtatgtaaagcaattgagtcagaaagctgggaatctctacatttgtctatatgttgatgacctactcatcacagggagtagtgcatcagaaattgaagcattgaaggaaagccttaagggagagtttgagatgactgaccttggtgtcttgtcatatttcctaggcttagaatttcagaagcatgattgtggtctgtttatgcatcaaagtaagtacttgttggaagtactaaagaaattcaagatgctagattgtaacccctctaaaacaccagctgaaatgagttgcaaattgggaatcactttcagtgtgggagttatcagtagatttatgagtgatccaagacattcacatatgatggcagctaaaaggatactgagatacttgagaggcacactagactttgactcaaactggggtggagatgttcttgacagaaaaaacacagtggggcatcttttcttgtttggaggtgctcccatctcctggtgctctaagaaacaagatgttgttgcactctctatttgtgaagcagagtatatagctgcttgttcagcagcatgtcaagcttgttggctgtcctcattactagaagaattgggagtagttactactgatgctgtaaagttactggttgacagcaagtcaacaattgaccttgctaaaaattcagtctctcatggtcgctctaagcacattgaaactaagtttcatttcctaagagatcaggtaactaaaggaaaaatcaagttagttcactgcaagacaaaaattcagttggcagatatcttcacaaaagccttgaagatagacagattcaaggagctgagaatgatgatgaatattctagagctttag

SEQ ID NO: 105816 - DNA, 867 bp, Glycine max
  Peptide Sequence Number=SeqID_222594
atgcttaagctagcccggcttcatcgatcagcttctaaatcctctcgctcaagcgcccaaagaggctcgcatgagcgaggcttgtcggtgatagtgaagactgaagagttgattcgtggatggaaggcatgggaggcggagacttcatctcatgggtacgagttcgccaatgatccttcaagattccggttgacacatgaaacatcatttgtgaaagctcacgcttctttttggacaagatattcaatcttcttctatataggatgcttctttagacaattttataggtctgtaggcaaggctgactacttggctttgcgcaatggatttatcacggttcacctggctcctggaagtaaatttaacttccaaaagtatatcaaaagatccttggaggatgacttcaaggtagttgttggagtcagtcctgtcctctgggcatcgtttgttgtttttctgctcctaaatgttaacggatggcatgctatgttttgggcatccttaattcctgttgtgataattttggctgttggaacaaaacttcaagctgcactggcaaacatggctattgaaattacagaaagacatgctgttgtccaagggattcctcttgttcaaggctcagacagatatttttggtttggtcggcctcaattagttcttcatcttatccattttgctttgttccagtattcttttgggctgagaaattgtttccatgctgactacaagcttgcagtagtgaaagtagctttagggcttggggtgctatgtctctgcagctacatcacccttccattatatgctcttgttactcagagccattctaatgctttgattgatgttttttcagtgagcatgaactaa

SEQ ID NO: 105817 - DNA, 2019 bp, Glycine max
  Peptide Sequence Number=SeqID_222595
atgtctgtcttaaagtacagaaatctttttctttgtctggtttcatggttgtgctgttgttgtgtggctgtggcttcgagtgagagtagtattggttccaaagaccttgatcagacaccaacatgggctgtggctggtgtctgcactgttttcatcttgatatccataactctggagaaaagccttcacaaagtgggaacgtggctaagggaaaaacacaagaaagctttgcttgaggctttggaaaaggtcaaagctgagttgatggttcttggtttcctttcactgcttctgactttcgggcagagttacattgttagaatatgcattcctatggatgtggcagacaaattgttgccatgtccttatgttggtaacgacaagggatcaagtagtgaagaggaacaccgtaggaaacttctttcttatgaacgcagatatttgtcagatgatgctaccccttaccaatgtaaggagtgggttcttggactttgcacgccgactttgagaggtgcctttgtcaagaggataagagggagaacctgcgaaacaaaagattctgacgttcaagtcgagtgtttatgctcctgttgtagggtcgaatgttgtctgacgtcaggtgtggtaacctcgagaagtgtgaaagaattgcaagtcgatgtggcttgtcaagcccccgagcctgaacaagtgttgtccgggtgcattgaagacaaatgttacgttctgtttgttgctgcagacgcgcagtactcttgcatacgtgtcacttgcaaagtgggcatgcattggagtcggggtgtgtgcctaagtgggggtgcgtcgtggtcactgttttttctcaaaatttccttgcttccttgctttcttgcttatggtttcccttttcttcttcgtttgtctcttcagtcttcaaggggttcaattgagcaacccattatggacttagatgtcatttctattagcggttcctcgtcagaggatactcgtcgtggtgcctccaacagcgagtcttccttttcgaagagggtgaaggccttgtgtcggactggagggggaacttctgtccctcgcgggaggacgcggtcttccgctgttgcctgggagcctatcccggttattatgattcttctcctttctgcttctgggggtgtgacgagaggtggtgggggagatgtcagggcgtctccccgtgtgggacgtaaccatagcgctggtcgtcatcgtctgcccctgccatcgttggctataattggacctaagaacttctgcaagttatccattcaggcttgtggaagtgatgacttctcgttcttgagagtggcgtcgggcagttcacccttctattttatctatagggacgggaagtcctgcttctcattctactggcagtttgaccctaccagtccacaaggctattttggagcaactgctggcctcgctagatgcatgagtcattctgtctcttccttcggtgagcaatctcctcaccgccttggatgtattattggtgacttcgcctgggggtcactcgtgaagcaggtcaaacttgcaagtgagattgtgtcaccgtctgccactattggaaaagggggtcaacttgctggtgaggtctaccctagtgctattgttgctaaggtcactcccagcactccttcctttgttttggcaaagaggaagcgagatgatggtgttgggctgttcgaccgtaagaaatccaaggcccctatgagccttcgtgccctgaggcaggctccttctactgtttctcctgctccttcatctcctgttgttattgttgttcaggagcgcacttttgttgctgttgaagttagtgagtcagctactttggctggttttgttgtggcgccatcgtccaccgctacggcacctttgttgagtgtcggtgtggtagccactagtgctcttacggaacctgaggatgactctgttagcttcccttgtctgaccgttggtctgagtatgttcgaaagagatgacttggtgcttgatgcgtag

SEQ ID NO: 105818 - DNA, 1131 bp, Glycine max
  Peptide Sequence Number=SeqID_222596
atggaagaacatctcactccattggctgttacccatctccttcaacacactctcagaagtttgtgcatccatgaaaattctcaatgggtctacgcagtcttctggaggatcttgcctagaaactaccctccacccaagtgggaaggacaaggggcttatgatagatcaagaggaaacagaaggaattggatattggtgtgggaagatggtttctgcaattttgctgcatcagcagcacctgaagttaactctggtgattgttctaccccacctgtttatgggaactgtgaatttcagccctaccaagggctgcaaccggagctcttcttcaagatgtcacatgagatctataactatggagaagggttgataggaaaagtggctgcagatcacagccacaagtggataaacaaagagcctaatgatcaagaaatcaacttcttgtcagcatggcacaattcagcagattcgcaccctaggacttgggaagcccagttcctgtctggtataaagaccatagctcttattgctgtaagagaaggtgttgttcaattaggagctgttcacaaggttattgaagacctgagctatgtggttcttttgagaaaaaagttcagctacattgagagcatccctggtgtgctgttgccacacccttcatcttcagcatacccttataaaatagaaggaggagggtatggagcaccagaacaatggcattatcaaggcggcaacaaccatcaccaccttgcatcaccccaacaaactgaactatatgatcaccatggccacttcaacttgccactcaagataactccttcaatgagtagccttgaggcacttctctccaagctcccctcagtggtgccaccaacaacaacacaacaacaaccactcttgccatctaattcccagcaacaacaacgaaggccattggagttcatcatgggaatgcagaaagtggcaaaggaagagttggaacaagaagaggtgtacaggccagaacttgacataggtgagagtagcagctccttgccaggaggagggtaccaccaacaccaacatcaacatcacttccatcaagatcagaataataatgtaactaggagtggagccaacaatggattttga

SEQ ID NO: 105819 - DNA, 291 bp, Glycine max
  Peptide Sequence Number=SeqID_222597
atggggtttttgcaactattggaggtggcgtctgctccagttattcaagtcctacttatcagtgcagtgggagcttttatggcaactgattattgtgataatcttctttcggcagagtttagaaaatccttgaacaagattgtcttcttcgcgttcactccttcgcttatatttgcgagtttttccaagaatgtttctcttgaagatatgatatcatggaataagccatgcgtagttgaaactctcaggcaaaacaggaatgctttaccagaacaggataaagttttctga

SEQ ID NO: 105820 - DNA, 690 bp, Glycine max
  Peptide Sequence Number=SeqID_222598
atgacgatgttggaacctttacgttgtgatgttgcactccctgttcagagccagcacgtcgatgatgcgccagtgttcatgggtagtgaggtccctactgatttgcgtgcactacctaggtttgcacacactgtccacgaacttactgaccaaggcggccgaggtcatacggtgagacttgttatttgtgtactgtgcgcagaagtgttcgataagggtgtcgaagctgtgtatagacctaggtgggtggtcaccgtaccagacatccaggtgcttatctggatttgtggtcccatcataccactcgaggttgagtggtttttaccccatgggtatgtcagcctccataatgtggtcaacgaaaggatgctgaggagtagtccgccttactggacatcacgcgctcatgcaatgcatgagcagagtgctcatcgccctggggactcttcaagaggggtctcgtatctaaggccaaaccgagtgctaaccatggatgaacaagagatagttgacgacagaccacgggatatgttttatcgcatccccacgatggatgccaaatgtacttaccaaaatccagaggtagcacacgtcggggtggacgtggccgaagtggacttttggacttcgcacatcggctttagaagtgccttgtcaagaggacaggagggggaagtacaaaactgttag

SEQ ID NO: 105821 - DNA, 105 bp, Glycine max
  Peptide Sequence Number=SeqID_222599
atgagggaggggaagattagacaactcttgagggaccagagcagagcttatggtttagaaagggtgacgggatttggcggtggcacgatatataaatcgcaatga

SEQ ID NO: 105822 - DNA, 642 bp, Glycine max
  Peptide Sequence Number=SeqID_222600
atggcagcagagaagaaggggcacatcgtgatggaacctaagcttcaccacttgtggtgctcacggaaccttggcctatgtttctatctgggaggttccaacctccctcacagaaaaacagattctgatgagttccatgttccggggttccctcaaaactacaaattccaccgtacccaattgcataaatttctaagagcagctgatggcactgatgagtggtcacagttcttcattccccagactgcactttctatgaagtctgatgggtggatttgcaacacggttgaggagattgagcctctcgggttgcaccttctcaggaactatcttcaacttcccgtttggcctgtggggcctctcttgccacctgcttcactcagtggttcaaaacatcgtgcaggaaaggaacctggcatagcccttgaagcatgtatggagtggctggatttgaaagatgagaattatgttctctatatttcatttgggtctcagaacactatccgtgcatctcaaatgatggctttggctgaagggttggaagagagtggtagatcgtttatttgggtcatatggccaccttttggttttgacatcaatggagagtttattgcagaatggttgccaaaagggtttgaatag

SEQ ID NO: 105823 - DNA, 2674 bp, Glycine max
  Peptide Sequence Number=SeqID_222601
gattaaagcatgcaactctggctacatacaagtgataagcatgggagaaggaagtgaccatcaagctatggcagacaatggaaatgctgaatctggtgaaggtggagtgcgtagtgctgaaaacaactctggctctcatgttcgggttggggtgtctgagccatatgtgggtagggaatttgattctcaagatgctgcaaagactttctacaatgagtatggcaaacgagtgggtttcagctgcaaagctggcccacatggtcgttccacagctgatggggcaaatatgttccgggagtttctgtgtggcagggaagattcgaaaagaaagcctcctgaaagctgcaatgcaatgattagaatcgagcagaatggtcaaaataagtgggttgttacaaaatttataaaggagcatagccattccatggctagcgttagtaaggtgcataatattcggccacgtaaacccttttctagtgttggaagaaccatgcctgaaacttaccaaggagtggggcttgttccaagtggtatgatgtatgtatctatggataagaattgcattcccactaagaatattcagggaattaagaatactcccgcagctgttgctgttgctgaaacatatcagccggttaaaagtcctacaatgatgaattatgctgttaggccagctacacgaaagaggacattagggaaggatgctcacaacctgctggagtactttaagaaaatgcaagctgagaaccctggtttcttctatgcaatacaacttgatgaagataatcatatgtctaatgtgttttgggcagatgcaagatcaaggactgcttacagtcattttggtgatgcagttactctggacacaacatacagaataactcaatatggagtgccatttgctccattcactggtgtaaaccatcatggtcagatgattttgtttggttgtgcacttcttttggatgattctgaagcttcttttgtgtggctttttaagacatttctgacagccatgaacgaacattaccctgtctctatcactactgatcaagacagagccatacagacagctgtttcacaagtttttcctcaaacacgccactgtataagcaaatggcatgtcttgcgagaaggccatgaaaaggtggctcatgtatgcaacatgcatccaaattttcagattgaactttataattgtattaatctgacggaaaccattgaggagtttgattcatcttggaattttatcatcaataaatatgaactcacgaaaaatgattggcttcagtccttgtacagtgctcgtgctcaatgggttccagcatattttcgtgattcattttttgcagcaatatctcctaatcaaggatttgatggttctattttttatggttttgtcaaccaccagacaacattaccactgttctttaggcagtatgaacaagctttggagtgctggtttgaaaaagaattagaatcagattatgatactatttgtacaacccctgttctgaagacaccttccccgatggagaagcaggctgctaatctctatacgcggaaaatattttcaaagtttcaagaagagctagttgaaacttttgcttatactgccaacagaattgaagaagatggagaaaatagcatattcagggttgcaaaatttgaggatgaccaaaaggtgtatattgtcacattaaacctttccgagttgagagctaactgtagttgccaaatgtttgagtattcaggcattctatgtagacatgttctaactgtttttactgtgactaatgtacttacattaccgtctcattacattttaaaacggtggacaagaaattccaaaagcagtgctggatcagttgaacttgctgatgaatcacatggacccaagtctttgacatcacgatatagtaacctttgttgggaagccatcaaatatgctgaagaaggggcattgactgtggaaacttatgatactgcaattagtgctcttagagaaagtggaaagaagatttctttcatgaggagaagtgttgctaaagttgccccacccagtcatccagtcagtgggactgcttatgatgacagaaaatcccctacttcagcagcagatacaaaccctctgttgtggccattgcaggatgaaacaacacagaggtttaatcttaatgatgatagtactcctgttcaatcagttgctgatctaaatttaccacaaatgaccccagtgtctctccagcgagatgatggtccacctgaaatggtggtttatccatgtctgaaatcattgacgtgggtaatggagaacaagaactcaacaccagggaatagagtagctgttatcagtcttaagttgcaagactatagcaggattccttcaacagaatcagaggttaggtttaatctctcaaaagttaccttggaaccattgtttaaccatatggtcaacatcagtgatcagctgtccataccaactaggaagtttgctgtattgaatctcaagcttccagtcgcggagacaacttctggtgcaagtgaagttaagtttcaggtgtccaaggacacattgggtgctgtactacgatcaatggcctatatccgtgagcaactcttgggtcctggtgatgtacagacagaacctatgtcaaaaaggcctcggaagtga

SEQ ID NO: 105824 - DNA, 126 bp, Glycine max
  Peptide Sequence Number=SeqID_222602
atgtctcgctcaacgcttaattcttgcccagcatgtgcgctcgctcagtgcgcagatccgactcagcacgaaaaggcccacgaggagaagcccagggttattcattgggagaatggtaatgtctaa

SEQ ID NO: 105825 - DNA, 645 bp, Glycine max
  Peptide Sequence Number=SeqID_222603
atggtgttaggcgtgagagagataagctgtagcggagagccagtccttgacagtgataacggggaggagttgatgcaggtgcaaccgggcatagacatagtcctcggcgatcttcctcgccagtcccccggcacactctatatcactaacaagcaagtaatatgggtgagtgatgtagacaagactaaaggatatgccgttgatttcttgtgtatatctctccatgcagtctctagagaccctgaagcctaccctcttccttgtttatatacccagattgatacaggagaagcggatgatgaccactctgattctgaatccaatcatatccaacaagatttgtcccacatcacagagatgaggctcattccctctgatcctactcaattggattctctctttgcaatattctgccagtgtgcagagcttaatccagaaccaaacgatgaggaaggagaaggacatggttgggtttttagtgctgatgagatgggagatgaagaagcagaggacgaaggttatatctttcacaatccagccaactctattggtcactcaaatggaaatcatgacctaactcgtacgacacttgagtatgattctctgacacagggatgtagctcttctaataaaatgagagaataa

SEQ ID NO: 105826 - DNA, 2583 bp, Glycine max
  Peptide Sequence Number=SeqID_222604
atggcagcagatgactctaccaagagaaactcaaatgttcagctccttgaggaactagaggcccttagtgaaacccttaaccaatcgcacacctcaaacacaaatagaagaacagcttcattagctataccgagagcctcaccttcttttgtctcatttgctgatgatgacaatgacactgctaaagttaacaacaagcaaagcaacaaaacccggtctcgccgcatgtccttgtctccatggagatcaaggccaaagcctgaagatgccaaggcacctctcactcagccagatacgaaaaagtttgatgacacagcaaattcaggtgacaagaaagggatttggaactggaagcctatgagggccctttctcatattggaatgcataaactaagctgtttgttttctgtcgaagtggtcactgctcaaggccttccttcatccatgaatggactaaggctttctgtttgtgttagaaagaaagagaccaaagatgggagtgttcagacaatgccatcaagggttgatcaaggtgctgcagattttgaagagacccttttcataaggtgccatgtttattgcaaccatggtagcggaaagcagcttaagtttgagccaagaccattttggttatacctggttgcagttgatgccaaagaacttagttttggaagaaacagtgtggacttgagccagttgattcaagaatccgttgagaaaagccagcaaggcttgcgtgtgaggcagtgggacacaagctttggcttatcagggaaggcaaaaggtggagaactggttctgaaactaggcttccaaatcatggagaaagaaggaggggttcagatatacaaccaggatgagaatatgaagtccaaaaggttcagaaatctcacatctgcatttgctcgcaaacaatccaagtcatcattcagcttgcctagtccaagaataacaagcagaagtgatgcttggactccttcacagagaaggttagcagaagatcttcaaggtatagatgatttgaatcttgaggatccacacctagttcatgatgcccctccctctatccagaaacttgatggtggcaaagagaacgtggaggattttgatctcccagacttcgaggttgttgataaaggggttgaggttcaagagacgaaagaattatatgacggagaagaatctgagaaatccatagaagtgaagtcagctacaagtgaggtcgtcaaggaaataatgcatgatcagttgcgcctgactagattaacagagcttgattcaattgccaagcagataaaggctctagagtccatcatggtagaagataacaagttcacaaaaggtgaggaagctgagtcactaagattggattctgatgaagaaaacgtgacaagggagtttcttcatatgcttgaggatcaaaaggccagaggtttcaaactcaaccaatctgaaacccccccattacaaattgcagaggcagaatctaaagtgtatctcccagatcttggcaagggcttggggtgtgtggttcaaacaaaggatggaggctacttgacatctatgaatcctttagataatgctgtggctagaaatgagactccaaagctagccatgcagatgtcaaagccttatgtgttggcatcaaatcagtccccaaatgggttagagttgtttcagaaattggctggcattggtcttgatgaactcagctgtcaagttttctccatgatgcccctagatgaactgataggtaaaactgctgaacagattgcctttgaaggcattgcttctgccatcatacaaggaagaaacaaagaaggagccagttctagtgctgcacgtatagtttctgccctcaaaggaatggcaaatgcaatgagttcaggaagacaagaacggatttcaacaggactttggaatgtggacgaaaccccatttacagcagagaatattctggccttcacaatgcagaagattgagttcatggcagtggaagggttgaaaatccaagctgacatgacagaggaagaagctccctttgatgtttctccacttagcactgaggaagggaacaaagagaatgaactattagcttctgctgtttcacttgaggattggatcagagaccaaagctacagtgacactgcttcaagttctgatgatgagacatcaaacatcacacttatatttgttgtccaactgagggatccaataaggagatttgaagcagttggaggtcctatgatggtgctcattcatgcaacaagtgaagaacacacaaaagggagtgaatgtgatcactaccaagataatgaggaagagaaagagttcaaggtaacaagcatgcatgtgggaagtttgaaagtgaggagtgttacaaagaatgcatgggacagtgagaagcaaaggctaactgcaatgcagtggttgattgaatatgggttgggaaaggcagggaagaaaggcaagcatgcattggtaaaagggccagatttgttgtggagcatttcatcaagaatcatggctgacatgtggctcaaaaccatgagaaatccagatgtcaaacttgtgaaggaataa

SEQ ID NO: 105827 - DNA, 179 bp, Glycine max
  Peptide Sequence Number=SeqID_222605
atggcggtggcgaagtgctgcgatttcgcgacgatgccgaacaagaggttgaagtcttggatgcagggaaaggggtttagggttagcattcggtggaagaagtcgacggagacggagacggcggcgtcggcggattggagggtgcggatggagttcaagaggcgggttcgggctgcggc

SEQ ID NO: 105828 - DNA, 1293 bp, Glycine max
  Peptide Sequence Number=SeqID_222606
atgggtgtggatatacaaggtaagcttcgtttagctcttggctcagtgaaagatcatgcctctattggcaaggccatgatgtaccattaccaacatgatggcttttccaacatagagattgcagtcctgcgtgccactggccatgacaatggcaccattgatgacagatacatgcatgaaatcctcttccttgtgtcaaacactccagggtccattccttttctagctgaaaggatttcacgccgcctaagcaaaactaaggatcatgctgtggccctcaagacccttgtcttgattcatcgcctccttagagggggaaacaggtcctttgaacaagagctatgcaaggcacatgtctcaggtcacctacaaattagtacaaggtgtttcacaaagagttctgatcacccttcagttggtttcctacacaagtatgcagcttatcttgaagagaggatgagttggctcatcaatcaagcaggaaaacttgaacctgtcatgtctaaagggttagagtttaggcgctatgatgagaaatccattgatatggcattcagaacattgcctaaatgccaagtgcttattgacaaggtgttggaatgctcccctcatgatattttatgctcagatcatagcctggctcaagctgccatgagcaacaccttgagagaaagcttccaagtttatatgacattctctgaaggaattgcagctcttgtcaacatgttttttgatctaacagcatcagccagaggcctagcctgtgaaatactcaagaaagcttctctgcagagccaaaagcttcatgatctgtatgaaagttgcaaacaagtggttgaaaacaagaatttggattacccttctgttcagataatcagcatgaatcatgtagtggcattggaacaacttggtagtccacaaaatgaacttgcagcttcacttgtctctctttctagcatctcaaggccacctccaatttcaggccactttacaaaatcaagagagatagagttggcagtggaagcaaaagaaagcaaaaggagtgaagagaacattgatatagatttgtcaccaaccccaactcttctttcatggacactagagactaaaataagcatggtgtgggtggtgtttgaagatgaagttcccaatgaatcacaggttcttccagcaccgcaaaagcttggaggtgctgatgctgtttgtgatataaaaagtgaatacggtaggcctagtgtgttcctgaatccattttcttctagttttcaaacaagcatgtctacaaaggtatga

SEQ ID NO: 105829 - DNA, 1170 bp, Glycine max
  Peptide Sequence Number=SeqID_222607
atggtgaagagaaatttggagcctaatgttgtggtttataatgcgattttggatgggctttgcaagagagggttggtgggtgaggctttggggttgttctacgagatgggtgttgttaatgttgagcctaatgttgtgacttacaattgcttgattcagggtttgtgtggtgaggttggtgggtggagggaaggggtgggtttgttcaatgagatggtggcggagaaggggattgtgccggatgtgcaaacgttttcgattttggtgaatggtttttgcaaagaggggttgcttttgagggcggagagcatggtgggttttatgattaggattggggtggagcttaatgttgtgacatataactcattgattagtgggtattgtttgaggaatcggatggaggaggcggtgagggtgtttgatttgatggttcgcgagggggaggggtgtttgccgagtgttgtgacatataattcgttgattcatgggtggtgtaaggttaagaaggtgaataaggctatgagtctgttgagtgaaatggttgggaaagggttggatcctgatgtgttcacttggaccagtcttataggtgggttttttgaagtgggaaagccactggctgcaaaggagttgtttatcactatgaaagaccaaggccaggttcccattctccagacatgtgctgttgtgttggatgggttgtacaagtgctggcttgattctgaggcaatgacgttgtttagggcgatggagaagagtggtctagatcttgatattgtgatttacaatataatgcttgatggaatgtgcaagatgggaaaactgaatgatgcaaggaaacttctttcttttgttctggttaaagggttgaaaattgattcatatacttggaacataatgattaaaggtctgtgtagagaaggactgctggatgatgctgaagagttgcttaggaaaatgaaagagaatgggtgcccgcctaataaatgctcatataatgtctttgtccagggactattgcgaaaatatgatatttcaaggtccagaaaatatcttcaaataatgaaagacaaaggctttccagtagatgctaccacagccgagttgcttatacgtttcttatctgctaatgaagaagataatgcatttcaagagttcctgcagatctga

SEQ ID NO: 105830 - DNA, 798 bp, Glycine max
  Peptide Sequence Number=SeqID_222608
atggcacacaaaaccctcttcaaaccaagtctcatcctcacactcagactcaacaaaacggccatttcattctcacaccatcatccatttcgccactcgcaaccaccctttcccttcctcaacactagtccaatctcacttcctccaacaacgagaattactaactacacccacttatggtgctctaattacaccaccgtcagcaccatcgaggagggttccgaaaaatgctacctgaacctctcggacgaggagctcatgcggcagtgcgaaatggacacgtttaaggcctcgggaccaggtggtcagcaccgtaacaagcgtgagtccgcagtgcgcctcaaacacctacccacaggaatcattgctcaggcttcagaagatcgctcccagcacaagaaccgcgcttcagcgattaatcgccttcgctctcttatagctctcaaagttaggaaaacagtggatcttgaagcttattcaccacctcgagagcttcttcagatattgcctcctaaatcatccattagagggtcagattgtggttcacaaatcggacctaataatccaaagtttgcatcgggaatgcaagctcttttggatctcatttttgcagttgaggggtctgtctcagaagctgcaaaatatcttgggttatccactggggcactgtctcggttaatcctatctgatgattcacttagaaaggaagtaaacgatctgcgggcaacaaagaggggactgttagcacccaatccccaattaggaaatttctacattagggaaaaaggaggggcctga

SEQ ID NO: 105831 - DNA, 180 bp, Glycine max
  Peptide Sequence Number=SeqID_222609
atgtcaccttcgcaccgcactaaacaccaattactgccacccaccattgcgttgcacctcctccatatagttttggatggtgtgacgtgggggctcgtggttcacaatgatgtgcatggtggtgtagtgttggcttgtgtgtgtggagataacattggtggtggttgggtggagatataa

SEQ ID NO: 105832 - DNA, 1008 bp, Glycine max
  Peptide Sequence Number=SeqID_222610
atggcagagaaagatgttggtggtggcggcttgactcgagacatctgttggtatgtcaatggcaaagaaacccgtgaaatactatgtggtatgtttgtggtgttggcatacgctgaatctgagttagaaaagcaggtggacgcgtttactgagtcagcattcaaggggaaccctgcatctgtgtgtttcttagaggaagagagagatgaggagtggctgcaagcagtagccgctgaattcaatatctctgagacttgttacttatcacgcatcacccactcgctccatggaatctctaatccccgttttcgtctcagatggtttactcctgttgctgaggttaaactttgtggtcatgccacattagctgctgcgcacgcactattttcatctgatttggtggataccgatgttattgaatttgtgacactatctggagtattaactgccaaaaagattccagccatccatatcaccagtgcctcagactcacaaaacggtgaagctcaggatggattttatattgaattggattttccggttgatcctgttacagaattcagctttgatgagagtacttcactactttctgaggcattgaacggtgcatccataattgatgtaaagaggacacaaattggagatgacttacttgttgaactcacatctgtaaaagctgtctcagaactacagccaaaacttgatgcaatagttagatgtcctggaaggggggtaattgtttcagcgattgctcctccaggctcgggatttgacttctatagtcgattcttctgcccaaaattgggaatcaatgaggatcctgtttgtgggagtgcacattgtgcattggcatcttattggagcaacaagcttgggaagttcgatttgaatgcttatcaggcatcatccagagggggagttctcaatattcatcttgatgaaaagatccagagagtgcttttgcgtgggaaggctgttacggtgatggaaggctgtgttctggtctag

SEQ ID NO: 105833 - DNA, 2775 bp, Glycine max
  Peptide Sequence Number=SeqID_222611
atggccaagggcgccgattccgacgagttcgtggtgctttctagggttcgtacgggtctcaagagagagttcgcattcgccatgaaggcccaatctgagatatgcggcggttctctgggccgaacgcgtgccagcaagaaccgggtcgaggctccggttcagcctgcctcggcccggaaaaggtcgaggaagtccgaggagccgaaaacctcggaggatgctatgagcgaggaagaggttaagagcgacgtggtggatcttcagagcgatgataataatcacgtgggagaatcagaatccgcggcaatgcaggtttgtgaagaggaaccgaagatgttggaacctaaacctgaacctgttatcagcgaagaggaaccgaaggtgttggatgatgttatcaatgaagaggaagctgttgtggccgagacgttgaagggagaggagcctatcgtggctgagacattgaaggaagaggttgtggatgagatggcagaacaacccctttgtaaagaggaatcggagaagggtgtttcggatgagatggcagaacaacccctttgtgaagaggaatcggagaagggtgtttcggatgagatggcagaacaacccctttgtgaagaggaaccggagaaaggtggtgtttcggaggagaaagattctaatggggtagccctagctttggttaatgatgatggtgatgaggggaataagaagaagaggagaatgaagaagcggttggagatgcctcagtctgagagaaggtttacgcggtcggcattgaaggtaaaatctgaggaaacaaatgatgtggaacatgttggtgtggctggaattgatgatgatggtgttaagggggaaactgaagcctcagctgaggcttcgttgttaatgactcctcctagttcggcaaaattttcgaattctaggttgaagaagtttccttccaagttgaaggatcttctggcaacagggattcttgaggggctgccagtgatgtacatgaagggagcgaagacacgttggaaagccggagaaaaggggcttcaaggagtgattcaagactccggtgttttgtgcttttgtaagatttgtaatggggttgaggttgtcacgcccactgtgtttgagctgcatgctggcagtgcaaacaagcggccccctgagtatatttacatccatgatgggaattgtggaaaaactctccgtgatgtcatgaatgcctgctgctgctgcgattttccattggagtccatggatgaagccgtccaaaagctccttggtgacttcacaatgaagaaatcttccatctgtttgaactgcagagcatgcaagggcgtgtcaaagcttgtatgtgatttgtgcttagcaagcccccctcaaacagccatggctagccgcaaagtaatttcacaaccagttcaacccagatcaccagaaccagttgtgattcaaaaatcattagacaatgaagtacagccaaattcattagacaatgaggtgccgccaaattctttagacaatgaggtgcagccaaattcattagacactggggtgcagccaaaatcgtttagcaatgggatgaagcacagtgcatctcgtggtaagagtcagggaagactaactaggaaggatttgcgcttgcataagttggtatttgaagcagatgttttgccagatggaactgaactagcctactatgctcatgggcagaaactgttggttggttacaaaaagggatgtggaattttttgtacctgctgcaatgagcagaatgttttccagaaagacaggcatgggcaacatgaggtgaatgctctggcggctgctggaaggattgcaggccctgatattttggaactgatgaacaaaagatgcattcgtgttgtcaaaactgtagaagttgaccatggtggatgtgccttatgcagtcgccccaatttcagcaaaagctttggtcctcggacagtaattatttgtgatcagtgtgagaaagaatatcatgttggatgtttgaaggagcataacatggagaacctagagaaattgcctgaaggaaattggttctgtagtggaaattgcagtcatattcatactgctctgacagatctggtggcttctaaggagaaggatgtcccagatccccttctaagtttgattaaaaagaagcatgaagaaaaaagtttagaaattggagctggtctagatgttaaatggagggttatgaactggaaattagattctgattctgatgattctgttgaaactaggaaattgctttcaaaagctgttgccattttccatgagaggtttgatcctatagttgattcaacatctggccgtgatttcattccaaccatgttgtttggaaggaacattcgtggtcaggattttagtggaatatactgtgcagttcttactgtcaatggggatatcgtgtctgctggagtatttcgtgtctttgggtcagaaatagctgagcttccattggttgcgacaactgctgatcatcaaggacagacgctacttggatctttaaatgtgaaaaaccttgtcctaccagctgccgatgaagctgagtcaatatggactggtaaatttgggtttacaaagctaccccaagatgagggaaccacccttgcttcatacatatgtccatgtcatgaacaaagcaaaaagatgggtaatacttcagaatttagcgggtatgaacgatcgtgtgcgaaattcgatggcggagttttgcccgtttattggcagttcaatattaatctgtag

SEQ ID NO: 105834 - DNA, 231 bp, Glycine max
  Peptide Sequence Number=SeqID_222612
atggaagaaaaagtgaaattggctcattacaaagtcgggtctttgccaactctattttatgttcctgacttcatcacagacagtgaccaaagccttctactcaacaacgtaatttatggagcccctgcatcaaagtggaagatattgaagaatagaaggctacaaaattgggaatatacagatattcaaatactcaaaattttggaaagttgggatttcagagagaagtga

SEQ ID NO: 105835 - DNA, 1164 bp, Glycine max
  Peptide Sequence Number=SeqID_222613
atggtggctacttgcttctcgagtttagtcttctacaaacaggggtatcgatatggtttgacatttaccgatgtagagatggctggtcgagggggtgttgtggggaagacgaagtgtggtcttgggttgggatttgcgctaaatggaacaaagcaacaatgctttggagtgatgggttggcccaaatacaagaaggacatgggtgaatgtgtgtccttggacaaaaatgggtacctgcgaagaagaggtgtcacaatccaatatgctactgttgcccaccattacttggagcttggtcatctgggatgtcggcagattcagaaacctagccatacgcgactagataaaattatgagtactgttgtagtcgatgaggatcacgacacgatgatgacgaataaagccatacattctaaaggtttttggtgtcgacatccctgccgacgcgttaaggctaatctgaggtggagaattagggtcgtctgtggtagctgggttgttgggcataaatgggttggaggagtaaccgtggcacaacttgcatctgtgatcgaggatccatttctcgtcacaatgatagcaggggcctttgtctcatcaggtgttggagggtcccactatgtttggttgtgggcaaaatcagggaaggaacagtgtgacggagcagggactgctgcatcgatcattgagcttgtcttcctggagtttggcccaggcagccgcttggggcagagaataatgattgaagagcctgaacctcccaaagattttcgtagaatgaaggagcaaagcaggactctaaggcctggagcattgtcgaccacaatgtacaccttgataatcaaagaattgggaaattttaaagatccatcccattggatcttggccgtcaaatcgaggaacttcgagctttatgtgaggccgagactgtcagatcggatttggtgtttgtggagattttggggatgtgggggtggtggtgatgggtgcgaagaggttagtggtggtttttctgttgttttggttgggcatggtggttggggagtaaaagtagaggcagtccttgaggtggttaggcctcttagtgatccttatgggtctgctagtggatatcgtggtgttgaagttgctatcaacttctctttatacactttctttctctag

SEQ ID NO: 105836 - DNA, 687 bp, Glycine max
  Peptide Sequence Number=SeqID_222614
atggctcggttcaatgttgggtccttatgccacactactttaaggcttgatatggatattgtgttaagctgggagatagtgtggtttatgaaaaagggaagaagagacaaaaaaggagagggtagaggagcgctcactaactttgaaacctcttattcgcatccctctcacttgaacgctttcacactctcatttgcaacttcttgcgacactaaaacttcgtcaccatcggcattgcaacctcttgtagtgctgcaacaccatgtcggtgtcactcatgacgctgcaacctcactgtcactctcgaggttctgcaacctcagtgttggtgacaaaagtgtcactcacgatgttgcagcctcactgtcactcccgtggttctacaacctcaatgttggtgacaaaaggacccgaatcatttcatttcttctcatccttcgtgttactctcacaggatgcaatataaaagaagggagagggaaagtttacgaaaagaaaagggaaatgaaagcagtggccaatgctgcgaagtgtggtagagcttgtatcgccattggcagtagcgggacgaaggcggtatcgccagtagcaccagcgagacaggtgctgactagcaccagcgagacctacatgcaccttctgcacgcgctacagacaccttcttcacgtcttgatccagctacatag

SEQ ID NO: 105837 - DNA, 234 bp, Glycine max
  Peptide Sequence Number=SeqID_222615
atgtgggagaattgggaacaattgcaagattcttatgaccttggggacaaggtcgttttaccagatggggggaatgatagcaactccaacaccacaatatccactagcagacccataaggatcactaagaagcctaaccaccttaaggactattgtctgcaaaaaaagctaaggtggagagttgttgaaggagatggagggtggggacatttagggttcatagctgcattttag

SEQ ID NO: 105838 - DNA, 1350 bp, Glycine max
  Peptide Sequence Number=SeqID_222616
atgtatgatacattggaaagtgattcgaagaagcctttttattcggggtgcaagaaatctttgaccctgttgtcagcggtgttaagtccagttaatgtcaaggctagatatgggtggagtgacaagagtttcacttcactacttcaggtagtgcagggtatgcatccaggggaaaacacattggcaaaaagttattatcagccgaagaagatactctacccgatgggtatggaacatgagtatgaagaacatgaaataacgccaataccgttaactgatcagcaggttcttgagcggaaaaatctgtgggatagtgtcataggcatgcttcgtagctttcaaggcaagacaaaggatggtttgaatacttgtcaagatctagctgagatgggtatacgagaccaattacatccaagtgtcatatgtagcaaagtcatagatcctaccaagttaaatgagttagaaaacgagggcgaagacgataaagtatgtggaaagtacgacataagcaaagagaagtggaatcagttttgtcagagccgtagagacccttcatgggagaccatccaaaaacaaaacactgccccttacatgttgtctcatgggggttatgattatctagaagaaaagttgatggaggacaagaaaaagaaacaattggagaaagcatcccaatcagggagtactaacataatcgttgatcctccatctcccattagactacacgtgaagtggaagatggctcgcatgaaaaaatatggtcaattgacgtctaaggtagcaaaagaaattgcaaataggattataagtgaattttttatgtcagtgggacgctttgtcacccaagtacgtcaagatgtactgactattgccattgggcgactaaatcaccttggtcgtgtccgtgctgttggagctagtacacaaatgcaatcacaggaactcgtactgcctcctgagcctaaggacccagacacgggtgacttagagaaatttggtttgtatgttgatgagaatcttcctcgcttggttgcccttagaaaagtttatgagggattgacgactgtccacaacgttcctttggacaatgatcaagtgaaggtcagtgttgaggaagttcaagatgctaatgctagcgttcctatccccactcaagaggataaacaaggacctgtgagatcgtcgaaacttgtagataggctagatcctgatgtcgatcacctatacctaatgacattgaccatcccacaactttttctcaagcctttgcaggtgtcgtgggctgctaccattactttgaaaggattcaatgatagtcaaggaagtaaatccaaggttgctgctagatga

SEQ ID NO: 105839 - DNA, 698 bp, Glycine max
  Peptide Sequence Number=SeqID_222617
atggggatgcagtggacaaatgaccatggtaagtatcttggtgtccttaatttttatccaagggtgtctcgtgggaccttccaattcattgtgcataactttcacctaaggttgagtgcttggaaagcaaagactttatcttttgcagacacacgagatggtacaaagattcatcttgttccttgggacgacatttgtactcctaaatttaagggagtggatgatggttccttctctgtaaagccagcttatgaaatagcttgtcaatctcagtctattcctgagatgaagttatttaagcttatccataagtgggcaattttctgtcatgaaattgggagtgcaaatgacattgctcaaaaggctttccatgcaagtcaagtgtatagagctagcagtgatatgatgacgtccctatctttttctcacaaactgcaaattaacaaaagtgatcttcaatggacctccccccaacctggccaggttgtgataagttgtgatgctgctatatctaaggcaaggcctcagtgctttatgcagaattatccaccatctgttgggtttgaagctagcttgggcaaaagtcaacaccacccttgcttcaatctggttgaagacatcgaaatagtgcttagtcgtattaatcaggtttcttggaatcgggtttttagggaggctaatcttgtagcggatatcat

SEQ ID NO: 105840 - DNA, 405 bp, Glycine max
  Peptide Sequence Number=SeqID_222618
atggtgataacaatggtggcggtggtgtggaaggatgatggtgatactaatatggtcgatcgaatcaatttaactactacccagaggtctgaccaggttgagttgcctattggatcaccatgcatgcatggaacttggtgcaacctgcgacagaatggtcacaatgacaatggtgacggtgggagaatggtggtgatggaggcgacaaaggcgaggtgcggtggtggtggtgatggtggcaatggtggtgaaatggtggaggcgatagtggcgatggtggtggttgtggcgacggtgtggtggtggaggcaggggcaagggcattgtgatggaggcaggggcacagtagcggtggcaaaggcgatggtggtaatggtggttagaatatgttttttattttactaa

SEQ ID NO: 105841 - DNA, 1596 bp, Glycine max
  Peptide Sequence Number=SeqID_222619
atggagaatcttggaaaaacattcctactactcctattgttatcttcaatattctcaatagcctcatcaagaagaagaccaccagcttcatccagcaacatagattggtggtgcaacctaacaccacatcctgaacaatgcaaacaacacctcagtactcaaatgaagagccaccatttccaaatcaagcacaaaactatcttccgggaaatgcttcttcaaaatgccttaaatcaagccctcatcatgcaaaaagaagcaaatgacaatgaccaaaacaacatgctaacaaagaaccacagaaccgtacatggtgattgtttgaagctctatggaaaaaccatcttccacctcaaccgcacccttgaatgctttcatgggaagcataactgttcatcggttgatgcacaaacatggctcagcacttctctcacaaacattcaaacatgtcaagatggcacggttgaacttggtgttgaagacttcaaggttcccaacaacaatgtttctgagatgattaggaacagcctggccatcaacatggacttcatgaaacatcatgatcacatggaagaaaaaccagaagatgcgtttccaagttggttttcaaagcatgagaggaaacttttgcagtcttcatcgataaaggcacatgttgtggtggccaaagatggttctgggaatttcaagactgtgcaagatgctctcaatgctgcggcaaagaggaaagtgaaaacaagatttgtgatacatgtcaagaaaggagtgtatagagagaatattgaggtttcggttcacaatgataacatcatgctggttggtgatgggctgagaaatactataatcaccagtgcccgaagtgttcaagatggttatactacctatagttctgcaactgctggaatagacggcctccacttcattgcacgcgacatcaccttccaaaacaccgctggtgttcacaagggtcaagctgtggcactccgatcggcctcagacctctccgtcttctaccggtgtgccttcatgggctaccaagacaccctcatggctcatgcgcaacgccaattttaccgccaatgctacatctatggcactgttgactttatctttggcaatgccgcagtggtgttccaaaattgttacattttcgcaagaagacccttagaaggccaagccaacatgatcacagcccaaggacgaggcgacccatttcaaaacactggaatttcaattcacaactctcaaattcgagcagctccagatctcaggcccgttgttgacaaatacaacactttcttgggtaggccttggcaacaatactctagagtcatggtcatgaaaacgttcatggacaccttggttaacccattgggttggtctccatggggtgattctgattttgctcaggacacactttattatggagagtatcaaaattatgggcctggagcatctacaaccaatagagtaaaatggcctggttttcatgtgattaatagcccaactgaagcgtcacagtttactgtgacacaccttcttgctggcccaacatggttgggttctacaactgtgccatttacctctggcctttga

SEQ ID NO: 105842 - DNA, 501 bp, Glycine max
  Peptide Sequence Number=SeqID_222620
atggatattgaggttccacaagcggtacttcttgatactgtatttgaagcagttgttcgaattccttatgatatgcaagtgaaacaagttcttgctaatggtaaaaaaggagctttgaatgtgggggttgttcttattttaccgaaattggcaccaccgatcaagaggaagaatgaaaaaaaaacataccttgagttcaatagagggggagggaggaagaagggggagtgggaggggacgaaggaagaagaagggacagggggaaggagtaagcaaagggaccacgggagagggagggggaagaagggtgagggggaagggcgaaagaaagaagaagaagaagaagaggtaggagaaaaagaagaagaagaaaggaaaaaaaaaagagacaagagagagggaggaggagaaagtggacatgttgggaagtggagaaagtggagagagaggaagtgggatgttggggaaggaaaaggtcattgtgtacacattcatgtttga

SEQ ID NO: 105843 - DNA, 234 bp, Glycine max
  Peptide Sequence Number=SeqID_222621
gatggtgatgttgatttgaatgcttctccagaagcactcgataaaatcctgggttatacacttgcacttaaagtcaaggttcagccaaagttcaggaattctattgttttaaaatactcatttaactcaagtttgatgaacaccatggtagacttacttccagatgctgagatggttatccagtttatggtagaagggagcatgctaaaacaattccaaaaaatgaggttataa

SEQ ID NO: 105844 - DNA, 510 bp, Glycine max
  Peptide Sequence Number=SeqID_222622
atggggcccaataatttgagcatgactcaagggcagcaagaagaggtccaaggtgaactggtgaccttggataacaatgaggacatgaacttagccatcttagtttgcacaaaattatgcgtgcttccgtcatcaatgaggatcacgactcgatggttggcgatggtcccaaagattttgaaggtctctggtgctggcatgcctgacaaggcattgaggctgatttgtgggagggacgtggggtccggaggggcttttggcagaatgggagagataagggagcccccacaaggatctttggatccatgggtatcgtcctcgtcatcagcgatgaggaggtggagatggggccagaaggcagtgtggttagtggagagaacaatgaaagttaagagttatggcggcggacatggagcttatcttcctgtaactttgcctacgccactgcctaaggaagcaagtgtggttggtgaccaagagttgagaaagctgtttcgtgacatccattga

SEQ ID NO: 105845 - DNA, 225 bp, Glycine max
  Peptide Sequence Number=SeqID_222623
atggcacggatgcagaagccaaccatgttgggccagcaaggaggccatgattgtaaactgttatgcttcagctgggcttgtaatcacatgaaaactaggccattttactctattgctagtgaaggtaccaatgttgagcattgcggtggttgtcggcggcatccgaggtacgcagaaggtggtgctgttgtcgggaaggtacgaaaacgttacggatcaagttga

SEQ ID NO: 105846 - DNA, 327 bp, Glycine max
  Peptide Sequence Number=SeqID_222624
atgacactcttgcgtaaggatcactttctgtggactcccgcttctcagcttgcttttgacaggttgaagtcccttatgacggaggcccctattttagcaaccccagatttcatcgcccctttcatcatggaaacaaatgcctcaggcattgcgatgggagtcgtgttgatgcaaaattcccacccattgcttatttcatcaagttgttctgccccagactcaaacaagcttcgatatagtccattcatcaccttgctaatggatgagtttcataaaactcctattggtggccacatgggtgtcgccaagacacttcatcatctctag

SEQ ID NO: 105847 - DNA, 474 bp, Glycine max
  Peptide Sequence Number=SeqID_222625
atgaatgattttagtgaggatgaggatcaacacttctttgatcacatcgatcaccaaagcgatgaccaaagtgatgaccaaagcgaagacgagggtgttggcggatcaacgacacttccgtcacctctgttgcaatatcaccaacctaggtgtccaatcgacttgaaccttgaccacctaccacactacattgatcgacaccatttcgttcaacaacaacataatgtacaaccacccatcggtgcattcgaggttggcatggccttcgatgaaaaagcacaatgcattcgagaagcgcatgtagttcaaagaggcataagaaatggattatcaagagtaccagaggtcatcacacttatacatggcaagaaaacccgtactcgtgggtacccgtctgaatccgtcccgactttgacgggtaatacccgagttgaccgggtatgggttcgggttcaggttttccccgataactaa

SEQ ID NO: 105848 - DNA, 1053 bp, Glycine max
  Peptide Sequence Number=SeqID_222626
atggagcaatcagtgaatgcccaaattcacatcacgtggttgggctcaaaatgtagaagcaagcaagaaaaagcagcatggtcagattgcgtaaccctctaccaagacaccatcaacattctcaaccaagcacttaaccctaccaaacaaagcactagctatgatctccaaacatggcttaccacatccttaaccaacactgacacgtgccaaaccggattccacaaggttggtgttggcaacaatgttctacctctcattcccaacaagaatatctcgaagatcataagcgactttttgactcttaacaatgcttcctcatttattcctccaaagactaacaaaaatggcttccccagatgggattttaagacaatcaaagaagctttgaaagcagtccccaagttgagtccaaagaggctcactgtcatttctggtagccgaagtgttggaggaggttctaccacttttaattcaacgaacgttggtctaaatattgtttacagctgtgacaaagatgggttcattgcacgtggcatcacattccgcaacacagaaggcccagaaaaccaccaagcaggagcactgcgttgtggtgctgacctctctgtcttccatcgctgtgcatttgaaggctaccaagacactctctatgtccactcccaaagacagttctacaaggaatgccacatttttggcacagtggatttcatctttggcaatgccgctgtcgtcttccaatcctgcaatatatacgcaacaaggtcaatgcagaaacagaaaaatgccatagcagcagaaggtaatctatttatggttctgcctggtggtgtggatagtgctgctagccctcgctttatggcgccgagccctgactcaagggggcgtattgcgattcccacatcgggcttaattgctgatgtggtgttgtggatgaattggcgtggagcagttgcggtgctcgtttatgccaccgcattgtggtacctcttcgagcgtgtcggttacaatttcttgtccttcgtcaccaaagtttttgccaacaagctttga

SEQ ID NO: 105849 - DNA, 576 bp, Glycine max
  Peptide Sequence Number=SeqID_222627
atggcacttgcaaataccagtgttgcaagtatagcggttctgagttccatgtcaggtctctttgcccttttctttggagccattcttggacaggactcagtaaatataaccaaaatagcagctgttttaatcagcatggctggtgtttccatgacaactgttgggaaaacttcggcagcagatgagaatattagcatgcatgaatattcaattgctaatgtcatattgaattggaattctgctggatcaggagacaaggtagacatgcaaaagctttttggctgtattggtctctacagtcttcttggcttttggtggctagcatggccattaaatgttgtgggaattgaaccccatttcaaatttccaagttcaatgtccacttgggagattgttattgcaaatagcatttggtcaaacgtgatttcagattacatatgggcactttcaatagtttggacagctcctttggttgctacattgggcatgtccttgacaattcccattgccatgatagctgacatggttatacatggtcacaagtactctgcaatgtacatccttggatgcatttag

SEQ ID NO: 105850 - DNA, 930 bp, Glycine max
  Peptide Sequence Number=SeqID_222628
atggaggagcttgtctcatgtaacaacaacgatgccaccaacatagccaaaggcaagcgcacaaagcggcgcttgaggcctttgtctccttgtgccgtcgttcctaccaccaccaccatcaccactgtcactgccgctaccacccccatcatgacatctagctgttcaagtgcttcttgtggcggtggttcttcttcatccacaacctttgaggaggaagaggaagacatggctaattgtttgattctcctagcacaaggaaaagtaggaggggaccctcctcatcgtcacaaggacttatatggtagtgatgttaagacagagaagctgggtagcaccaaagtcgatcatttctatgtttatgagtgcaaaacatgcaaccgaacattcccttcttttcaagcactaggtggccacagggcaagtcacaagaagcccaaggtggaggagaaaaagtcgtcatcaccaccactgtcgttgccgccgccgccaccaccaccaccaccgtcttcgtcgtcactatttaattttgaagaagcaaaacaaagtcatcacatgaagaatattattagcccttctgtttcccttcaattagggtgtggcaataataacaaggttggtttaaatttccatggcaacaaatccaagattcacgagtgttccatctgtgggtcagaattcacatcagggcaagcattgggtggtcacatgaggaggcatagagcatctaccaataataacaatattgttcagacaacaacaacaacttctaatggtgctgttgatgttaagcctcggaatgttctagagttggatcttaacctcccggcgccggaagacgatctccgggactccaaatttcagtttccggcgactcagaattctatgatgcggtcggctgctccggctttggtgggatgccattattag

SEQ ID NO: 105851 - DNA, 729 bp, Glycine max
  Peptide Sequence Number=SeqID_222629
atgttggggaaggagcttggagaacctgtagactttgaacttccagattcatttaataaatccaagccaatgcagtacacctatataaaacgcaatatatatctcactaagaaggtcaagagatcccggtttgatgatgatggcatattctgttcctgtactccttcccctggatctactagtgtatgtggtagagattgccactgtggaatgcttctgtctagctgttcatcaggctgtaaatgtgggagctcctgtctcaacaaaccatttcagaaccgtcctgtgaaaaaaatgaaattggtcaagaccgagaaatgtggttctggaattgtggcggatgaagatatcaagcttggggagtttgtcattgaatatgttggagaagtcattgatgacaaaacatgcgaggaaaggctttggaacatgaaacatagtggggaaacaaacttctacttatgtgaaatcaatcgagatatggtgatagatgcaacatacaagggaaacaaatcaagatacatcaatcatagttgctgccccaatactgagatgcagaaatggttgactactaattgttttatttatcaagattgccactgtggtgctgctgagtgtaggcgtaagttgggtgtccgacctaccaagtctaaactttcttcagatgctgcattaaaattagttgcatatcaggtggcttcatcttctcgtaaaaattctcgtaaaaaatag

SEQ ID NO: 105852 - DNA, 330 bp, Glycine max
  Peptide Sequence Number=SeqID_222630
atggattcgccaatccgtattatctttatggaaggggtgaaaactccattatgttgtacattgttcaacagaattgagtttctttttgcctcttcttcttcctttgtgcttcacacccacaccaacatatctatgtgccacaacaccaccgcacaacggggaagtcatgtgcgtgcagaacctcagaggttgaggtcacgcacgcaaggaccctcaaagattggttcacgaacgcagatggaggcagtgatgcacaatgttgttcaagaagaagggggttgtgcacgcatatttggagtttggaacaacggagatgagcaacaattaggg

SEQ ID NO: 105853 - DNA, 696 bp, Glycine max
  Peptide Sequence Number=SeqID_222631
atggccatatcacagcacacaccttactgtgtgtgccccctttgtctagtaccactgatcttgcttgtttttgctggttttccatccaaagcaaaaggctctctgctaccattcacaaatcatccaaataccctcttggctgatctatggtctaatcatttccctgatccatttcgcgtgttagagcaaatcccatttggggttgacaaagatgaaacattcacagctctatcatcacatgcaagagtggattggaaggagacaccagaagggcatgtcataatgctagatgtgccagggttgaagagagatgagatcaagatagaagtggaagggaatagagtgctgagagtgagtggagaaaggaagagggaagaggagaaggaaggggatcactggcatagagtggagagatcctatggcaaattctggaggcatttcaaggtgccagacaatgtggactctcaagatgttattccttatggttcgagtaataataacgatttttttttgcataaaacaaagaggggaacgagcaacaatttgaaggttgtacattcaggaactaaagaattcaaaatagctagtaataagagggatttgtttttgggattttctgagcaccaagagcggctacgcaagaagcttgcacttgacgagggaaggatatttgcagctaatgaacaactttcttaa

SEQ ID NO: 105854 - DNA, 138 bp, Glycine max
  Peptide Sequence Number=SeqID_222632
ggcttcctggtctcgacgttgcgcctagcgccattctcgcgcttagcgcaaatgtctttccagattcccctttactctctaagcgcgctggtgctgggcttagccatttatgcgtgctaagcgcattgagcttgcgta

SEQ ID NO: 105855 - DNA, 324 bp, Glycine max
  Peptide Sequence Number=SeqID_222633
atgtgtcaccggagtttgagcacagactgctcagagtctagagcagcctctcaacagactcagggagagcaagctcaagtcaagccaaaaccctttaaacctagccaacccagactcaaactacctaccaaaagaaaagacccacctccatcatctgacccaaaaccctcaaaccaatcaaagaaatccaagaaacaaccaccatctgaccctaaacattctaaccttcaaacaacccaaaagaagaaggaactagactctaagtctgaacctaaatctcataccccaccaaaaataccaataattaaaatcaaacacccttaa

SEQ ID NO: 105856 - DNA, 327 bp, Glycine max
  Peptide Sequence Number=SeqID_222634
atggaagagcttgagagaattcaatccactattgagcatgaaaccgaggtattctctacaaatgttgttgcaagacaagtagaaattgaagtggctttaatccataaaaacttggaccccattgaaaaggaagctcttgaagaagctatggtacaatctgtcattgaagcttttctcaataagtctgaggacaacattgttgagatagaccttgtgggtgaagacaacatcaaacgttttgaagctatatatggaccactgacatccaatactattgcaaacctacaagctggtttggaacgaaggttgcaagccactaaagactaa

SEQ ID NO: 105857 - DNA, 393 bp, Glycine max
  Peptide Sequence Number=SeqID_222635
atgatgtcaatctcattgtcaaacacacccttggagaaaactgcaatgtatgtcacaaatatattgcttgaaccaaatttgtacatattaaaaaataaaaaatcttggggagcaactgcccccaaacctcaaaacctagatccgttcatgtccttaaaaacattgtccatagtgtcgcaacctacccttttgcgggcgagcgaggtgaggctcacgggtgcatcttccaaaggaggaaaatgcgtggagtcgccaccaacatttatttgtggaaaacgtcggaaaaaccgaaggaaaccggtcatgaagaatattccagattcgggagttgtatttacgtttgaggaaggtattagcacctctcacgtttgtcccaaaggacaacagccttaa

SEQ ID NO: 105858 - DNA, 933 bp, Glycine max
  Peptide Sequence Number=SeqID_222636
atggctaatttgctgacaatgttttttgttatggaaatgatagtagtgagtggtttcagttttggagcaagtggcttgagcatgaattactacttgttgagttgccctattgctgaacctgttgttaagaacactgtcaacacagctctgcaggatgatcccaccctagcagcaggtcttgttagaatgcacttccatgactgtttcatagagggatgtgatggttcagttctgattgactccactaaggacaacacagcagaaaaggattcaccagcaaacttgagcttgagaggctatgaagtcatagatgacatcaaggaagagcttgaaaaacaatgcccgggagtggtttcatgcgctgatattgtcgctatggctgctagagatgcagttttctttgcagggggtcctgtatatgacataccaaaaggaaggaaggatggaacaaggtccaaaattgaggatactatcaatctacctgcacccattttcaatgcttctgagctcatcaagatgttcggacaacgtgggttttctacaagagacatggtggctctatcaggagctcacacattaggagtggcaaggtgttcttcattcaagaacagactgacccaagtggactcagaatttgcgaagacactctccaagacatgcagtgcgggtgacactgctgagcaaccctttgactccacgaggagcgattttgacaaccaatacttcaacgctttggtctcaaacaacggggttctcacatcggaccaaacgttgtacaacagcccacaaaccaggaacattgtgaacgcttatgcaatgaatcaagccttgtttttcttggatttccaacaggcaatggtgaagatgagcatgctcgatgccaaacaagggtccaagggggaaaatcaaatcaaggctttgttgttcaattga

SEQ ID NO: 105859 - DNA, 231 bp, Glycine max
  Peptide Sequence Number=SeqID_222637
atggaatgtgtcgagtcaatggttggcatgagaggtagaaggacttctaatcttttgatttgggatctgattgatatttggtctccttcggtagcccgcattcgccctaagatgctatatgcaacatccaaggacaggttcagaagggagctgcagggcatccattatgagattcaggcaacagacccaaccgagatggatcttgaagtcctcagagagcgtgcaaactga

SEQ ID NO: 105860 - DNA, 658 bp, Glycine max
  Peptide Sequence Number=SeqID_222638
gagtgtcaccaagcataggaccataaggggattcttgatcgtccccaacaagctcgtccgtactcctgagcgcagcgtgcaagaaaacgaccacggccgcaatgagcaccgcgaggaggaggtagagccaggcgccggtggcaaagagagcgacgagggtgacgagggagagagggatgattgcgatggggaggtcgtcgcgggagaagtagaggaagtaccaggcggcggagaggaggaggaagaggaggagggggaaggggtggcggaggagggtgaggaggaagacgaggaggaggaggagggcgtagttgaagaggaagtaggtcaggttgtgggcgaggcgcgtggtggtttccgagatggaggatgggaggctgagggaggagggcctgtggatcaacaggaaccaaaaccatatgttggatttctaggtggccctaaggagatgtcactattgaactcatacgctaatcatatggcctgggaagtatggggaggcatagtaaactactacgaatgtggtgatcttaaattagtatcacatgtgagaaattatcagacaatagacaagggactcttgtctgcttttgctgagaaatggcatagagacaaacaccttccatttgcccatgggagagatgacgataacacttga

SEQ ID NO: 105861 - DNA, 510 bp, Glycine max
  Peptide Sequence Number=SeqID_222639
atgtggccctcggcggagatgctatcaaacataaaggaagcaagtcaaagcgtggtgtcgacgcggcgcccctggcgcgtgttccttgacccctcctccctcagcctcccatcctccatctcggaaaccaccacgcgcctcgcccacaacctgacctacttcctcttcaactacgccctcctcctcctcctcgtcttcctcctcaccctcctccgccaccccttccccctcctcctcttcctcctcctctccgccgcctggtacttcctctacttctcccgcgacgacctccccatcgcaatcatccctctctccctcgtcaccctcgtcgctctctttgccaccggcgcctggctctacctcctcctcgcggtgctcattgcggccgtggtcgttttcttgcacgctgcgctcaggagtacggacgagcttgttggggacgatcaagaatccccttatggtcctatgcttggtgacactcctgctactggtgcctatgtccctgtttga

SEQ ID NO: 105862 - DNA, 105 bp, Glycine max
  Peptide Sequence Number=SeqID_222640
atggacaacatgggaacaataattgatggtatgaattgtgcaaaatgggtgacacgtccacagattctaaggaagatgcatgctgaacagaaagcttttaattga

SEQ ID NO: 105863 - DNA, 150 bp, Glycine max
  Peptide Sequence Number=SeqID_222641
atggagaattactttgaaatgccaagaggcactaaccctatgaatcccttgcaaggttatcaaactggagagtttacgcaaactcgtgagagttccataaactcgactcgtgactcaactcgtagactcgtaagagtctacttcatataa

SEQ ID NO: 105864 - DNA, 1281 bp, Glycine max
  Peptide Sequence Number=SeqID_222642
atggcctttgtgacttgttgcaacgacggttgcactagagcttctgttggcgaagtttcccttcatgaaatcgaggcacctcgttttaggatatcatcccctccttgtcttgttgccacgcttgtcatccttggggttgtgtcgcttcatgtatcttcctcttgtttgtccttgtgccatgtgttggccaccccaagagggaggacaatccattgtcccttaagttttaaagctgttaaggctgccaaacacttaagtcatgaatgtgtctcccttgtctgtccctatgagttagccttccaagatgggaggatgatccatagtcccttaagtgctaaggatgggagagcgatccataatccctcaagtgttaaggctgttaaggatgggtctttgcatgacgttgaaagggatatcgtagatgaggaagtggtgcccttgactatgaattttcaagaggaggaggaagagagtgaaggggagaataacattggtgaatacaaatgggtggacaaaggtgttgttgctctagtgactaatggtgcgagattgagagaattgagcagaaggaaggaaaaagtcattaccactaatgcaaaggaagggaataaaaagaggaaacatgatgactttgttgattgtgaggtgaattcaaagtctgagttgcacctggttcaaacacaattttccttccttgttatgaatggtgatgtaagttggtgtaaaacttttgcttttgaagaatttgaaggtaaggaggctttgtgctccatttggagtaagccctttccatttcatgaagttttgggccagaatttttctggtgttggtgatttggctaagatggagaagaagaagatggtagcaactcaagtgaaaaagttgaatggtgaggtgtcaaggttgaaagaggaggttaaaaagtataaggaagaagttggttgtttttcaaataaactatctgtttataagaagcatgttgctagagttgaagaattggagcaatatttggttgagatacaggttaagttggagtcaaatattaaagctttcgagaagtatttagtgaaacaacttcatctcaaggggaaggaaaaaagcttacttgaagaagtagagaggtggaggtcagagtgcaacccaaaagatgttactgccattgatgatcatgcaaagggatttaataaggccttggcacatgttgttgccctttgtcctgatattgacctttcagatattacagtgaaattaaatttctatgctaaggatttctacacttga

SEQ ID NO: 105865 - DNA, 699 bp, Glycine max
  Peptide Sequence Number=SeqID_222643
atgacattgggtttacaacagctgatgggtaccttcaatgttgttcttccatgggatcattctaagtctgatgtgaccttccaaactgaagacaatttgttggaggaacctaaagcgagtctaaattttttctgctgggaactatttgattatgggctagatatgaaaatgaagctatctacctacataaaagagattagattaaggcaagcttctattcggaaaatcaaaaggctcaacactcacatgtctttcatgttgggctcacaattttcttgcctaaccaatctagaaactcgctttcagattgttgttgataagctagtcttgtataagaagataaaatgctacaatgccaaagaaatattgattgaagatgaagaagatgttgattatattcattttgttaaagctcgacctggtcgtttgttcaaacatgagcttgaagcactcaaacacaagttcgagctcccatccctagatggatatgccattaagaagttctatggactacaagcatgctcctctagattggaacctaaggagaaaccacctattgatgcttatcatcatgaagttgagtgtttttatcaaactctgaaccacttcttcttcactcaagaaactcccttcaacatgatctacacaagtatagtaatcctattcatctcaaacaagttacctctcttggaaggataa

SEQ ID NO: 105866 - DNA, 222 bp, Glycine max
  Peptide Sequence Number=SeqID_222644
atgtatagtgtggagagggatctacaagtccttgttgatagggtttgttacggtgacgtaacaacctttgcagatgattatcggcttatagataatagccggtggcttatagataacgttagagagataacttgtccattgaagagcccaactgctaagggttggacgtttgaactcctctgccagggcttgatgtgtgtcttggagtgtcacgtagcatga

SEQ ID NO: 105867 - DNA, 1566 bp, Glycine max
  Peptide Sequence Number=SeqID_222645
atgtgcattgagatgtttgcattcatagcgggcagacatatgatgcacagtgtaatcatagctaatgaggtggtcgaagaggcttatgattcagcatcgtggaatttcctgatatacatgttgaggcgcatgggattctgttccagatggatacaatggatcgaggggtgcttaagatcttcctctgtatcagtgttggtgaatggtagtcccacgacggagttcattccccaaagagggctcagacagggggactcactggcccctctcctgtataatattatggctgaaggtttgaatggcctgatgcgagcagctactcagaaaaatctgtttagaggtgttcaggtgggtgccaatagagtggaaatcagcattttacaatatgctgatgacacaatattttttggtgaggcgacaatggagaatgtcaaggcaatcaaggtcattctaaggagctttgaactcgttgcgggtctcaaaataaattttgcgaagagtagtgttactgcaattcgaatgcctgatcaatggagccaacaagctgcttccctcttgaattgtagtctgctgtctattccttttgtttacttgggtataccaattggggcaaacccaagcaagtgtgagagaaagttatcaaagtggaaacaaaaacacttgtcatttggggggagggtcacactgatacagtccatcttaacatctattcctatttatcttttctcttttttcaaggtccctagcaaagtggtggacaagctggttagattacaaagacgattcttatggggtggcgaagctgatcataataagattgcttggatcaagtgggaaacagtgtgccgttcaaaggatgaagggggactgggcatcaaagatatcagaaacttcaatcttgcactgttgggaaaatggaaatggagcctattctaccacaatggagatatatgggcaaaggtgctagagtcaaaatatggaggttggaggagcctaaatgtagcatattgggaccatactgattccatttggtggcgggacctaaaacaggccctccaccaccaacagcttgcaagcacttttcagaatggattatcgtggagggttggctgcggtgataagataaaattttgggaggatatttggattaatgatgacatatctctagtagcaaagtatccaagactatattctatttccaatcagcaaaaccatcttatacagcaagtgggagcgcacacggattctgggtgggaatgggactttaggtggaggagatcattatttgacagtgaggttatcattgctgacagctttttaaatgatattgagggcaagacagttcacccatgtagaagagatgagtgggtttggaaagcggagcccagcggcatctattcgacacaaagtgcgtataatctgcagcaaggggaaatcatagaggccagcgatgatggagtttttgcggagctatggaaattaaaggtctcaaagaaaatttcagtttttgcttggagattaattcgagatagattgccaacaaagacgaatctgagaagacgatag

SEQ ID NO: 105868 - DNA, 1158 bp, Glycine max
  Peptide Sequence Number=SeqID_222646
atgagtataggacataggtattgtcgtgttgtgacaactatgagtagaggagataggttttgtctcgcagctaagtttaaagtttttggtgagctagctgaaggattcgagactttaactagaataaatgaggcttatgtggatgagaaaggaagaccctataaaaatataagaatcaagcacacatacatcctggaggatccttacgatgatccttctcagctatctgatttcattcctgatgcttctccagaaggaaaacctaaagatgagcctagtgcaatcgactatgtcttcttcgaacaattcgttctcctcctcttccgcatttccaaaaccattgctgaaaagctcgatgattccaattttttgatgtggcaacaacaggtggaactggtgatcaaatctcatcatcttcaacgtcgatcctttctcgactgcttggaggcattttctcttatcaagtctgggagaaaatccatgactattttcactaacaatcacgagcaagagctcgtcaattgcgaactgaactacgcgcaacagagcacatcaatgcgatcgtcaaaggtcttcctcaagattatcactctgatttctgttattgaaagcaagtttggacctcttccgattgaagacgttgaagtgttgctcttagctcatgaagctcgtcttcaaaggctaatcctagttttttcgtctgcacatggatatgatggctacaatgtgccaaacaaagcatcgcaacctaattctgagaattttttgtctaactctcgtggtggttttggtcgcggaggtaacttcaatcgcagtggtcgacatggtggtggttgcagctgtggcagacgggtaccctcaaaagtagttgataaactggtcaccattcaacgtaggttctggggtggtggattagagaaaaggaagattgcatgggttaaatggaaaacggtgtgcttaccaaaagacaaagggggcctcggtataaaagatatcaagaccttcaacacagctttgttaggaaaatgtaggtgggacctgttccagcagtctggggaaccgtgggccaagatattagactctaaatacggtggctggaggtctttggaagaaggaaaaagaggtcgccatgattccctggtggaaggacctgattag

SEQ ID NO: 105869 - DNA, 438 bp, Glycine max
  Peptide Sequence Number=SeqID_222647
atgcgaagcctccaaactggagaaagaaaggaggaagtgacggccgtgcacttcaagctagtacgtctaaccaagagaagcaatctccctcaagtccacttcctttcactaaggaacaactcgaccaactctcaaaagggtagctttttaacatctgctttccttagtgtcaattccaattatacttggattgttgattccggtgcttccgatcatatgacgggagagtccagcttctttgtttcatatagtcgttgtgaaggaaaaggctgtgttgtcatatccccaacactcattctccaaaatgtcttgcatgttcctaacttatcttgtaacctattgtatgatttgaactcggggaggacgattgacagtgctaaggagagtgggggactctacctccttgaagatgtaagtggatcaagacaacaatcataa

SEQ ID NO: 105870 - DNA, 255 bp, Glycine max
  Peptide Sequence Number=SeqID_222648
atgggtgagagcagaggcggagtcagacctcaagccatggaagcttgggatatgagctttgtgaaagagagtgaaaaaacaaacactgaggttttcactttcgtctttgtcgacgctggaggaataatctgctttcgacgaaatcgaggcactagatctactcttggaagcattgagggaaaggtgaccttggtccctctcgtgacgacttgggggagtcgaagagtgaggggaagtcgaagagtgagagcatga

SEQ ID NO: 105871 - DNA, 225 bp, Glycine max
  Peptide Sequence Number=SeqID_222649
atggggtacctcaattcagttttgtcctcttcaagccaggttcatgctgcagaagattcacctgtcagtggagggggcctcagtcagaatggaaaattcagctatgggtatgctagctcccctggcaagagatcttcaatggaagatttttatgagacaaaaattgatggtgttgatggtgaaattgttggcctttttggagtttttgatggtatatttacataa

SEQ ID NO: 105872 - DNA, 294 bp, Glycine max
  Peptide Sequence Number=SeqID_222650
atgctgctaaccgaagaaaaggttgatagctctcttgagtttcttatattggctagtgatgggctatgggatgttgtctcaaatgaggttggcaatgatgttcatttcttcccgtttcctgttgataactacagtgaagctgttgctatgattaaaccaattgaggatgccgaggaggcagcaaagaggctaatgcaagaagcatatcagcgaggtagttctgacaacattacgtgcgttgtcgttcgttttttgtcaaaccaaggtgcatcttctcatagtaactctggctaa

SEQ ID NO: 105873 - DNA, 684 bp, Glycine max
  Peptide Sequence Number=SeqID_222651
atggcttcttcttctccttcgtccctctcactggacactgccaaagacctttcccactcgtttagtgaggttcatgtcatcatcggtcccatgttcgctggcaagacaactgcccttcttcgtcgcatcaaatccgaactcaacgctgccaataatgtggcgttgttaaaatcgagcaaggatacaagatatgcaattgactcggttgtgacgcacgatgggattaaatttccttgttgggcgttaccggatctgttgtcgttcagagaaaaatacggagaggatgcttatcaaaagttggatgtgattggcatagacgaggctcagttttttgtagatctatacgagttttgctgcaaggctgctgatgaagatggcaaaaccgtaattgttgcaggcctggatggtgagtacttaaggagaagctttggctcagtccttcacataattccacttgctgaatcagtgaccaaactaacagcacgttgtgaactgtgtggcaaacgtgcttttttcaccttgaggaagacagagcagagagagactgaactaattggtggagctgatgtgtatatgccggtttgtcgccttcactacatcaacagccaagttgctgagaggagtgttctcgaatctgaaaatgagaaaactgattcccttcttgaggcagctacagatgtttaa

SEQ ID NO: 105874 - DNA, 431 bp, Glycine max
  Peptide Sequence Number=SeqID_222652
ctcatatcggaggagtgggagggtcaagcaatgccgacgacgatgctagtgcagtgtgcttcttattcttcttcgtcttcttcttcaacttgggagtggggacctcagcgctgggtgctaccacgggtgtcggagttgtcggtaccagtgcagggggagagctcaccggaacaggcgatggtggagaactcattggatctggcactggcggcaagctcacaggtgtcacagcaggaggtgtagccgtaggaggagtggccgcgggaggtgttgccaccggaggagtgattgctggagctggagcagcagctttaaacggaggagatgctaccatgggagatggaacgagaggggttgcggttgcaacattggggatgaagatggagaagatgaagtgggagaagcaacaagcacagttgattttggtttag

SEQ ID NO: 105875 - DNA, 252 bp, Glycine max
  Peptide Sequence Number=SeqID_222653
atggaaggttttcctgttaggaagttggtttgtgcttctgcattggttatgcttgagttgattgatgttcaagatgacctacaaaagtacttatttgcttattcaatccgattgtcccttgaacctcaaggatgcattattaatggaacgtccttcagctcctaccagctccattggaggcactggatcatccgtgctaatgatattgttatatctgatgtcaatggagaagctgttataggacaagtataa

SEQ ID NO: 105876 - DNA, 201 bp, Glycine max
  Peptide Sequence Number=SeqID_222654
atgggtgagagaaattttgagctcatgtgttatgctcgtcatcctggtaaattgaactctatctcaacttctaaggtgcttggtacctttgacatcaattcgagggcaaattcttcccaagaaggagggaatgacagaagactatccaaggaggaaaagtttgacttgggtgggctcgacatggatggagcaatcacttaa

SEQ ID NO: 105877 - DNA, 639 bp, Glycine max
  Peptide Sequence Number=SeqID_222655
atgtacagacaaaaaggtagtgttgtgtctttctcctttgaccctaagttgctcgaaacaaatggaagcatgttgcatttacattcacttcgtgtttttgatgatggccctttgtttcttgagacaattttgagcaccaatttctctggtctgactggaacagctcactttgatattgaaaggaatagaaatcatccagcatatgatatgttgaatattggaagatgtggaatgcgcaaaattggttattggtctaattactcaggtctctcaattgtcactccagaaattttgtataagaaaccagctaacacttcaacaagcagccagcaactgtatggtgttatatggcctggagaaactgcagctaaaccaagaggttgggtgttccccaacaatggaaagccactaagaatagcagttcctaaccgagtaagctacaaggagtttgtttctaaagacaataaccctcctggagtaacaggctatggcattgtcttggaagctgccataaagttggtgccttatcctatcccacgagaatatatattatttcgacctggtaatagaaatcctagctatgatgaccttaaaagtcaggttacactaaatggttggttgaggtctcttcagacataa

SEQ ID NO: 105878 - DNA, 861 bp, Glycine max
  Peptide Sequence Number=SeqID_222656
atgtcgccaccaggtccttgtgagcttgtcaggggttacctacatttttcaccacatgcctggaatatcattctgattaagaggggtgctacatgggttcaaatgctgattgatgcttgtcgacctcttgatataagacaagagaaagatcctgaatatttttgcagtgaaagggggctccttaaacaccgtgtattaagatctgcaatttttatggagtatgtggaagggggctccttaaaaaattatctggagaagctgtcagaagctggtgaaaagcatgttcttgtggagttggctttgcatatcgccaaagatgtctcatgtgctttgtcagagctgcactcaaagcacataattcatcgtgacataaaaagtgaaaacatactgtttgatttggataggaagagagatgatggaactcccactgtgaagctctgtcattttgatagtgcagtgccactaagatcaactttacatgtgtgttgtattgctcatgcgggaacatgtcctccctgtatatgtgttggaacacctcggtggatggctccagaggaagctaacatttggttgtttggatgcttgcttttggagatgctgactctacaaattccatattctggactttcagattcacacttccttgatagtctgcagatgggtaaacgaccacaattgactgatgaactgagagtattgagttcaatgaatggacccactatgattccatccggtgaagagctggaaaaatcagatgctggggtagacatgctgaaattccttgttgatttgtttcataagtgcgtggaacaaaatccaagcaaatatgtgttcagttcaatcatatggtggccactttaa

SEQ ID NO: 105879 - DNA, 549 bp, Glycine max
  Peptide Sequence Number=SeqID_222657
atgagaagcactcctattcctcccaccaccaaaaccaatacattagcaccagcaagttctacagcagtggtgacgacgacgacaacgacaaatacaacctctgttgcttccccatggcactctccagtgccctacctcttcggaggcctcgctgccattatggctctcatagccttggcactgttcatgctcgcttgctcctattggagactcaccagaatcactcaacaagagagtaacaacgacgatgatgatgacgacgatgttgtcaaagaggttgatgatgattctgaaaagaaggaacagcctaaggtgtacgaggagaagatcctagtcatcatggccggggatcacaaaccaaccttcttggccaccccttcatcctccttaggttgtagcaatttcgatcacaagcacctcggaatttccgaggattccaacaagtcccagaaagaagttattgtggacgaccatgttgttgtttcggatgctgaacatgaaaatggaagttttcgacatgaacaacgtatagtcagtgaaagattatga

SEQ ID NO: 105880 - DNA, 264 bp, Glycine max
  Peptide Sequence Number=SeqID_222658
atgctcctgaagaagtatagcaagatttgtataagcaaggaaaattttacaaacagttcaagaagaatggatgtgagcatgactatgagatccttggtgaaatattcaattccagcacaatttataacaggaaagttaagtcaagcttctactcaagagccaccaacctctaatgatgagagagaaatggagggaaactttctttccaaaggtgtttatgttgatgccaatgatgatgttgatggagactacataagaacttga

SEQ ID NO: 105881 - DNA, 1775 bp, Glycine max
  Peptide Sequence Number=SeqID_222659
taattggtaatgcaaagtcaaataagcactgggaggcagaattaccgccaaattttgacagaaatggatatggagttgagaaatttattcgttccaagtatgtggagaaaagatgggcttcaaaaggtggactacagccagcttcaaagtcagctgaaataatctttaactcgaatgaatcaccagctgctggggccaagagtgccactcagaggaataggagattgtctcttgaggaaagcattcttgtgaaacatgtggcacaaattcggcctccagtcacgagatatcatgaggttcttggtcttttaggtggaaaccaactaaacaatgctattaactcagagaaagctgtgaagatggatagtgctgctgttgctgagttacttgacttgatagacactggtgatttgaatgactcctcatggaacagagtagctagtgaatcactaaaaaatgatgatccctttgctgatgtgtcatttcattctaatgacaacaaagagcatgctgatatcttttcaagcatgactgttgttgatgataaattggatcatcatgtgagtcatgaaaatatgggcagaaaatgggcaaaggaaatccatgcccccgagcttactatcgatgcactgcttctccatcttgtccaggtttgtggagctggtttggatgtattcacctctgaaccagctggttacataaccactgcttgtactttcagtacctctggaactcacaatcaccctcttcctatgtcagccactgcaatggcctgcaaaacttctgctacagcttccatgctccaatctccctcattgagttcacaacatggattagttgattcagctatatcctccatcatcaactctagtgctcgttattacaaccctaataatgctctaaacttctctacacaccaagtttcaagaccgcaacaattctacttccccaactcatccatttcaaccttgaattctcaccccacaatcactttagaccttacaacacctctaacttcttcctcaaactcaagcttcacttgcatgccaaaatactcatcaacaaaccttaacttttcctccggtttctctcctctacattctcagcattctttccctaatcccattgttgctgcaactgaggcaataatcagaagcaacccaaaatttcaatcagcactagcaactgctctcacaacatatgttggcaatgaagctagtagtggtaggacaagagaaaatcatgttcttgagagtgcagaactaatgaagttaaagctgctacatagtgaaaatagtataggaaactcaagtatatttccactaccactatcggagcaaaagaacaggttggggagctatgggtttcctgatccttgtagccctcttttcagcaaagcaagtgcaacccttgtagccaactctctgcaatattgtgccattcttttggatttggacgatgaagtcgaagaggtgaggtcaatgccaaagaaaggagcttcaatggaagaaggggtagggcttcaatgtcaaagagctgaggtcaatgtcaaagaaaggagcaagcagaaaggtgtagggttcacagtaaggagaaagcaagcagaaagctctagggttcacagcaaggagaaagctagcagaaaggcggttttcaataaccgccttagaaagtgcgttgtaaaatgcaatttattacacaaaaattacaaaagtgccaccgcaccactttctaaagcggttccgcaaataaccgtcgtagatcacgtgtcgtaa

SEQ ID NO: 105882 - DNA, 195 bp, Glycine max
  Peptide Sequence Number=SeqID_222660
atgacgaatctcaaatatgatatacaaaaaatcactttcatattcaaaattagagacagttccgtcaacttaaaaatccatatcaaagcaaaaaaaaaacactcgaaagcagagaagctgaaaagtaaacaggagataaacatccgagctacggaaacggcggagaaaacgaaacgaagaagaaacaaatactaa

SEQ ID NO: 105883 - DNA, 3192 bp, Glycine max
  Peptide Sequence Number=SeqID_222661
atggcggacaacaacaacgattgtacaaggcttcaacatatgcaaactcagatcaataccttgaattcgtggatggaagagcagcacaagcgcgacatagaaaatcatgatcgttttgagaagctgcagaaatctatggatatgttacttcagcacccatttttgtccattggtggttcgaactcaggcagttcttcttcgggtggtattctgataactccaatttcttcatctgcgcctgtcaaagacatttctctgggatttccccattttgatggccatacacctgttctggaatggattttcaaagctaaaaatttcttcaattatcatcatactcttgactctgatagagtgaagattattgcgattcattttgagaaggatgtcataccgtggtttcaaatgcttcagcacatggagtcggtgaattcctggtccgatctaactcatgctttggagtctcagtttggaccgtctccttttgattgtcctatgggtgaattgttcaaacttcaacaaactggtacagtttctgactactatttgaaattcatggctctagctaatagacctaaagggttgtctaatgaagttgttttaaattgttttttgagtgggttaaatgttgatattcgtagagatgtgattgctcagaggcctatgacattaattcgagttgtgtccttagccaaattatatgaggaaaagtatcaaccagtaaactctaatcagacccacaattattctcatagatattcccctatttctgctcatactgttaatttcaattctgctccttctaatgctgctaaaaatactaccaaaacatctttgccctcattgttgcctactcctaatactcctcctcttagaaataattttgatgatgaaggtgaagctgagatgaattttgatgttgtgtctggagataataatagtactgctgaaactgtgattgacaatcttcaccatctttccttgaatgccttgaaaggagttcttggtgttggcactattagatttttagctcatatcaataacttacccgtgagggtacttgttgatggttgtagttcagacaattttctccagccaagagtggccaaagttttgaaactacctataaaaccagcacccttgtttaaagttatggttggtaatgctaactggttgaaaacacttggttctcacattgcggattatgattccttgcaacttaagttcttacatgatgggaaatttataaccctacagggcgatgatgatggtactcctactcaggctcaattacatcatattaggagaatgatttctactgattctattgctgaagttttcaatttagaaccggagttggcacttcttttgcatacatatgaacctgtttttaagactcccacatccttaccacctccaaggtcttatgatcatgctatacccttgttggagggatcaaaaccggttaaagtcaagccttaccggtatttacatagtcaaaaagatgaaattgagaaattggtgcaaggaatgcttgaggaaggcatcatccagccaaatacatttcttattccaacaattgatgaattgattgacgagctgtttggagctgaatttttctccaagttggacttaaggtctggtgtaggagtgactgtggaaaccactaagttggaagccattactaattggccacaaccagctattataaaacaattaagagggtttctaggactcactgctatgacttcagctccagtgttagcaattcctaattttagagaaccatttgtacttgagaccgatgcttttggttcaagtaatggaacagtactgagtcaatctcaacatcctattgcttatttctctaagttgtcccctagaatgcagaagcaatatacttatactagggaattctatgttatcaatgaagccatggccaaattcaggcattatttgttaggccataagttcattattagaactgatcaaaaaagccttaaggagttgttggagcaaacattgcagactccggaacaacaacaatggttaccaaaattccttggttataatttcaccatacagtataaaccaagtaggaaaaatatccatgctgatgcattgtctagaagcttgttcatagcttggtcagagcctactaatcattggttagcaaaagttgtagcagttactaaggaggataagttactgagtgaactaatcagttgctatgatcatggaggaaccattgatcctaagtatgatgtaaaggatggattaatatttggaaaagggaaattgatgattcctgaaaattcagctttgagaaaccagattttacaagaatttcatgacactaaaatgaggggccatgttggaaggaataaaatcattgctagaatttgcagtcaattttattggcctaaattgcaagaagacattaagtcctatatcagatgttgcagtatctgtcaacaggctaaggtggatcaagcagtacctacaggattgctgcagccattacccatcccacaacaaatctgggaggacattgctatggacttcatcactaatttaccatcttcccatggctattcgactatcacggtcatagttgacaggctttctaaatttggccattttattgctttaaaagctgagtttaatagcaagttggtggctgatgcatttatcaatcatgtggcaaagatacatggatttcctaagtctattgtgtatgatagtgatagagtcttcatcaattctttttggcagcaactatttaaagctcaaggaaccactttagcaatgagttcatcttaccatcctcaaaatgatgcccagacgaagatccttaataagactcttgaaatgtacttaaggtgctttgtgtttgataatcctaagctatggtaccccatgctagcttgggcacaatattggtacaactcttcttatcatcacagtttggatatgagtccatttaaagatgtatttggcagagaaccacctgcagttgttccttatcaagtccatcctaaggatcctatatctctccaagaaactcttgtgggagatttggctttggtgaaattacaaccatataggcaacactttgttgctcttagaaagaatcagaagctgggaatgcatttttttggaccctttgaagtggtggaacgcgtgggacag

SEQ ID NO: 105884 - DNA, 1494 bp, Glycine max
  Peptide Sequence Number=SeqID_222662
atgagtggtgttcctaagagatctcatgaggatgctgttcatcagtcttcaaagcatccacatcaagattcaggtgcatattccaagttgatgccttcagtttcaaatgaccaccatattccttatgatatgagtcaggattcccgggtggcaaagacagtccgtactgaacctcgtgatgcagatagaagatctcctcttcatacagtgtatcggatgccatcatcttcaaatgattctcatgcagatcatcccattggacctgagaacaggatagaatctagggattttaaggagagtagagatccccggtttgagaatcgtgatacgaagacagagaagaaggaattgcatggtgaagccagaagggattctcagattgcaaagagtgagaaggatgtgcgagttgatggcagagaagacgacaacaaggatatcagatatgaacgggatagccataatgattcaaaaggtgacattaagacagacaaggatggctatggtatggtaagcagcagcagccacctgagttggaaagaatcaaaagagtataggggtaagagattttctgatgcccctggtgggagtttggattcctggcatacatcacgtggcaatacacctactgaagttggaaaggacagttcaatggcagaagaaagggactatttggaaacacatgaggctgttggagaaaacaaaattgattctaaaagtgaagatagatttaaagaaagaaaaagaaaggatgtcaagcatcgggattggggggatagggaaaaggagagaagtgatcgcagaagcagtacaccagtaaacaataatagtggtgacaacaaagaatctgccaaggaagatagagatgtagaaaaatgggagaaggagaggaaagatcttccgaaagagaaagaaagttcaaaagagaaggaaaaggataatagcaagagggaatccttgaacggaatggagaaagatggtttgaatgatgggaaggaacttggtgatggatcagcaaaaaatactgagcaagaaaatgtgttgaaacagaaagatgttgatggctggaaaaatgtagatggagaagttagagagaggagaaaagaaagggatgctgatttagaaggagatcgacctgataagcgctgtaaaattgacaagcaatcagaagatggaagtgctcacggggaagggactggagagaaggagagggaagtccataattataatgttcaacatcgtaaaaggatccatcgatcgaggggaagccctcaggtggccaatcgcgaggctcgttttagatctcatactcaagctccagacaatgaagagaataaggacagacatgggaataagaattctgttggagaagaagtggagggatctaatggaatgcatgctgtcacgaggaaaatactggtggacaggctgggatcatggcatcatgcaagaaaacgtgattatgaggggtccagatggggtgaagaagggtattga

SEQ ID NO: 105885 - DNA, 1125 bp, Glycine max
  Peptide Sequence Number=SeqID_222663
atggttagaggtggccagctatgggggactgatgtttacacttatgactcagatcttgttgctggttattgtcgcccaacagcttctccacctcccatggctgtacaagagttgcgcacaaccattcgagtgctacctccgcaagattgctatatttctactctgagaaacaatgtacgttcccgtgcttggggtgctgcaattggttgtagttataaagttgagcggtgctgcattgtaaaggggtgcttgtgcttggaatgggtctgcactttgcatgtgtttgtgttcgcattttacctgtctattttcgttcattctcaattggacaagaaaggaggtggaactattgatcttgaaccttgccttacacatacctcaactgttgagcctacccttgcaccagtggctattgagcggacaattactactagggctgcagcttcgaatgcattgcggcagcaaagatttgtacgtgaagttacaatacagtacaacctctgcaatgaaccttggatcaaatatagtataagcattgttgctgacaagggtctaaaaaagccactctatacatctgctcgtttaaagaagggagaagttctttatctggagacacactcctgcagatatgagctctgttttactggagagaagatggtgaaggctataccagcaactcagatgcatgacccagatacagagaagtctcaaaatcaccatcaccatcaccatcctgcaaatggtgacaaagctgattctgatgtcatggttgatgtatttcgatggtctcgatgtaagaatcctctaccccagaaactgatgcgcacgattggaatccctctgcctcttgaacatgtggagaattttttctcctcgattatgagtaactcttgtatttctattgaatgttttcatttgcctgttagtctacctttgcatttgcttaggcttacaacctatgaaatgggagacgatgttagggtgtttttaaaaggtagaggggaatatcatatggtgctagaggaaaacctggactgggaagatgtacagtggtcacaaactggcgtctggattgcaggaaaggaatatacccttgctcgggtgcatttcttgtcaatgaattag

SEQ ID NO: 105886 - DNA, 938 bp, Glycine max
  Peptide Sequence Number=SeqID_222664
actcccaacaaccaaaaccggttcttccttggagggcacgcatttcaatatctttcctatgtaccctttccgacgccgctcgtcgctctaacggcaccgttaatcgcctcctcataaacctactcgacctcaagtcccaccccaacgccgcccccgttaacggcgtttcctccaatgacgtcaccgtcgacgcctcccgaaacctctggtgccgcgtcttctcccccaccgtcgccgccgcctccggcggcgctctccccgtcgtcatcttcttccacggcggcggcttcgcgttcctctcgccggattcattagcctacgacgccgtctgccggcggttctgccggcaaatccccgccgtcgtcgtctccgtcaactaccgcctcacgccggagcaccggtacccttcgcaatacgacgacggcgaggacatcctcaaattcctcgacgagaaccgcgcggtcctgccggaaaatgctgacttgtcgaaatgcttcctcgccggagacagcgccggcgcgaatttggctcacaatgtggcggttcgggtccccaagtcggggctccggataatccgggtcgtcgggttggtttcgatccagccatggtttggcggggaggagcggacggcagcggaggagaagttcaagggggcgccgctggtgtcgatggccaggacggattggctgtggaaggtgtttttgccagacgggtcggatcgcgaccatgtggctgcgaatgtgagtggaccgaattcggaggatttgtcgggtttggattacccggataccctcgtggttgtgggtgggtttgacccgttgcaagattggcaaaggagtttagtggtggctcgtggtgaaatgataattaatactaacaggcacatgcaatgttgcaactatggaccatgtttaggggtcccggaatgccaaatttaa

SEQ ID NO: 105887 - DNA, 1028 bp, Glycine max
  Peptide Sequence Number=SeqID_222665
atggatgcagaagatggtgtaaactgcagtgattatgagcatgacatagaaaatgaagatttgtgggatgggaatgaagaaagtggagggtactggtcagggatatatgacagaaacaaggctcatacaaagccacttcttatgaaggggactaacaccacctcccagattgctattattggtgccaacctctgccctattgaaagccttgactatgagaagaaggttcagataatccattatgtgatgcttaagtggggatttgctcttcttattggattaggtactggattggttggcttctttaacagttttgcagttgagaacatagctggtttcaagctgtttatgaccaccagtctcatgtctaaacacagatatcttgaagctttcttagcatatgctggtgcgaatatgtgtttagcagcagctgctgctgcactttgtgctttcatcgctccagcagctgcaggctctggcattccagaggtaaaagcatatctcaatggtgtggatgctcaacatatattggctccaagcaccctttttgtaaagatatttggttccatccttggagtttctgctggatttgtggtgggcaaagaggggcctatgggtggatctcgcaagtatcacttgacttgcacttggcttagatatttcaaaaatgaccgagaccggcgagacatgattacttgtggtgcagctgctggggttgctgctgcctttcgtgcaccagtaggtggtgtcctctttgctcttgaagaggcagctacatggacttttttcacaacagcagtggttgctattgttttaagagttgcaattcagttttgtgccacaggcgggaaatgtgggctatttggggaaggtggtctgataatgtatgatgttagttcagccaatataacatatagtgctagtgggatatttgcagtactactaatgggagccattgctggaattcttggaagcatatataattaccttgtggataaggttgttcggacatatagcatcatcaatgg

SEQ ID NO: 105888 - DNA, 633 bp, Glycine max
  Peptide Sequence Number=SeqID_222666
atgggtttcctgcaggacttcagtttgaaaataattgtgaagttggagccttctctaaacttaccaatgcctactgtttggttgccattggaggttctgaaaacttctacaggtttatttgaagccgagttagcaggtgttatccctgtggtcaagacatccattagtggtattcgtgttattggtcatctttgtgctggaaacaagaatgggcttctcttgccccataccaccacagaccaagaacttcaacatttgagaaacagtctacctgatcaagttgttcagcggatagaagaaaggttatgttctctgggaaattgtatagcatgtaatgaccatgtggccctcgctcacactgatcttgatagggagaccgaggagattattggagatgttcttggagtagaagttttccggcataccattgctgataatattatggttggtagttactgtgccttctccaacagaggtggtttgacatctacagtgtcttttgacaatacacttgatgcagacaccacagcaacagagctatctgtgattgagagtgttttcaagctaagagaagcacagcatagtgccattgtggatgagatgaggaaatccctcattgatacctatgtctga

SEQ ID NO: 105889 - DNA, 465 bp, Glycine max
  Peptide Sequence Number=SeqID_222667
gttggcattcaagatgttagggcagaagttatgcctgcaggaaaggctgatgttgttcgttcattccaaaaggatggaagtatagttgcaatggtgggtgatggcatcaatgactctccagcattagctgctgcagatgttggtatggcaattggggctgggacagatgttgcaatagaagctgctaactatgtgctgatgagagataacttggaagatgtgatcactgccattgatctttccaaaaagacctttttccgtattcgattgaattatgtatttgcgatggcttacaatgttgttgctataccagttgctgccggggttttctttccttggttggggatcaagctgccaccatgggttgctggtgcatgcatggctctgtcgtctcaatatgcgagggtacatgtgaatgtgtctctatttgcaaaaccagggcaggaaaatactgagattgagtag

SEQ ID NO: 105890 - DNA, 747 bp, Glycine max
  Peptide Sequence Number=SeqID_222668
atgcataaagcattgcggtctagtgcacctctaccttaccctcagcttgtgactttatttattcaccattttgaaattcccttgaattctgagtcctttgtgcaaattaaacgttcctttgctattggtgtcggtgcggtaacctccttcagctaccgtaaggacaaggatgggcaatggttgaaaaaggatgcgcaacctccgcaagacgaacgtactccctctcctctatctcaacgagatgactcctcaaccctcatgcatgaagttctttcggagttacgaggcctccgcacctatgttggtgagcgctttgattccttggatggtcgtatcgatgttgtcgcaacgtgccctttgcgggcgagcgaaggcgaggctcacgggtgcgctttccaaaggaggaaaggtgcgcggagtcgccaccaacgtttatttgtggaaaacgtcgggaaaaccgaaggaaaccggggaggagcttgccacccagctcgcccaggcgagcaaggttgcttcctccagaagcaacagccttctggaggaagaatctggaaggcccaactttcgaagaagttacgaaaactcacggacagtgacccagcactcatgctaggtcagacacgaggagacgacctcacatctctaccaccaccagctctccttgcacccccaaaaatagaagaggggaggatcactataaccgagactggctccctgacaatagcagaagaccctgcccttccgtga

SEQ ID NO: 105891 - DNA, 297 bp, Glycine max
  Peptide Sequence Number=SeqID_222669
atggcagtgatagtggtggcgggaacaataatgattgtggtggtgataacgacgatggtggtgagttgtagtgatggtgatgatggtagtggtagcaacagtgatggtagtagtaatagtgaaattgtggtgatgacgacaatgacgatgataaggcaaaaaaatggcaacgatgacaaaggcaacatagatggtaccagtgacagtggtggtactagccgtagtagcgatggaatgatggtgatggtgacgactagtgtggtggtgatcgaggtggtggtggtggtggaatggtga

SEQ ID NO: 105892 - DNA, 228 bp, Glycine max
  Peptide Sequence Number=SeqID_222670
atgaagtttggtggctcctctgtggcttctgctgataggatggaagaggtggctacccttatattgagttttcctgaagagaggcctattgttgttctctctgttgtgggaaaaacaacaaacaaggactgtggatcagcttggtgtgaagggatctgttatttcaacctgaagcaacagctacattgtatatgcattaatgtctctgatgaaatagaccttgtatga

SEQ ID NO: 105893 - DNA, 198 bp, Glycine max
  Peptide Sequence Number=SeqID_222671
atgcagccgcggcgctcgaaatcgagtttgaggagtgcgagcgaggcgtcacggagggagaggaggcgcgtgacgaatttggtgaaacccttgaaagtccagaagtcggaggagtgcaaaattagggttggaagacgcttccagaggttcaaagacggagtgagcggaatgcaagaggcaactgatgttgagggttga

SEQ ID NO: 105894 - DNA, 552 bp, Glycine max
  Peptide Sequence Number=SeqID_222672
atgcgtgttttatctttaacccgttttttctcctctcctctggattttactggaatccctgctgttgttgacctggcttgcgtgcgtgatgctaggaataagcttggcagtgattctaataagattaatcctctggttcctgttgatcttgtcattaatcattcagttcaagttgatgtagcaagaaacaatgagagatttgcttttcttaaatggggatcaaatgctttccgtaatatgcttgttgtccctcctggatctggtatagtacatcaggtcaatcttgaatatcttggacgcattgttttcaatactgagggcttgttgtatcctgacagtgtagttggaactgcttcacatacaacaatgatagataggcttggagttgctggatggggctttggtggtattgaagcagaggcaacagtgcttggcaagttatctggaaaactgtgtaatggtgttacaacaactgacttggttctaactgtgacacaaattcttaggaaacatggtgttgtagggaaatttgttgaattttatggtaattaa

SEQ ID NO: 105895 - DNA, 201 bp, Glycine max
  Peptide Sequence Number=SeqID_222673
atggaaagagaagcggataaatctatttggaacgtagaaaaggaaagaaatataatctttcattcggttcggaagaaagttacagtaaaatctgtaggaaataggtgggctccacgagtacagacttcttcacaaaacacagcagaaatgcgaagaaagaatatggcgacaaatgtgagatgggatttggtgatttggtaa

SEQ ID NO: 105896 - DNA, 2514 bp, Glycine max
  Peptide Sequence Number=SeqID_222674
atgtctgccattgtaagggatctttcaatcagaaaaggactgactctgatacttttcttccaggacaaagagttgcgctatcgctttatctacaatcattttccgagtttacaagaggaggacatcataggaaaaacagatgttgaaattttcacaggatccggtgttaaggaatctcaggatttcaagagggaagtaatggaaaaagggttgcctgcaaaaaaggaaattacttttgagacagaattatttgggtcaaagacattcttgatatatgtagaacctgtctttagcaaagcaggagagacaattggagtaaactacatgggaatggaaataacagatcaggtaagaaaaagagaaagaatggcaaagctcagggaagagattgcagtccagaaagcaaaggaaacagaacttaataaaaccattcacattacagaggagactatgagagcaaaacaaatgctggcaacaatgtctcatgagataagatctcctctgtctggagttgttagcatggctgaaattctttccaccacgaaacttgatcgggagcaaaggcagctcttgaatgtcatgatatcttcaggagatttggttcttcagcttataaatgacattcttgatctttccaaggttgagtcaggagttatgaaattggaagctacaaaattccggccaagagaggtagtaaagcatgtactccagacagctgcagcttcattgcagaaaatgttaaccttagaaggaaatgtggcagatgatatgcctattgaggtcattggagatgttttaaggattcggcagattctcacaaatttagtcagcaatgcggtaaagtttacacatgaaggcaaagttggaataaacctttatgtcgttccagaaccaccttttgccaaagcagaaggccatcaaaagatgatcacagaacagtcaacaaattcagcaaatggggtgaaggaagagaaacgtgcatcaacgccgcgaagcagcagcgatcaaaattgtcttgatggtcagaaacacaatgaccatcctagccaaaatcatgcattcaatgatgaatgtagatcttcagttaaaagtgaatgctcaatgaatggagatactgaggagcaaacgcattcaactgaaactgtgtggatacgttgtgatgtatatgacacaggaatcggaatacctgaaaaggctatacctactttatttagaaggtacatgcaagtaagtgctgatcatgctcgaaagtatggtggcacagggctgggactagcaatatgcaaacagctggttgagttaatggggggtcgcctaacagtgactagcaaagaacatgttggttctaccttcacattcatacttccttacaaggtttcaacagcttgtgatgattctgatgacccagatgagctctcagatgtggatgataatgatgatgacacaacagaggggttcttccaattccaaccacgcactttgggctctctcttcacttctaatggacctaccaggccccaaaatatactaccaggtttcagaagctcacacaagttcaatggcatttcagaaaattcttactcattcctcactaccaacacaagatcaaaagggattagttcaactgaggatgcatcttcagtcattgttgatgctccagagatgtctgaatcaacaagttcatcaagtcacagcccagaaacaaagcaagaaagtgtaattaacacaaacaatgagaatcaagataaggcacatgctcggttacagaatggtagtgtagactcttctcaacataaggaggtaatggtaatgactcttggaacaatgtcaaatgaacctcaacaaacatgtcaactagtgaacacagacataacctcccaacgtgttattagtagtaataataacacattatcagaagtaaccaaatcctcattagggcctaagattcttcttgttgaagataacaaaatcaatgtcatggtgacacagtcaatgatgaagaggttaggctatagcatggatgttgtgaataatggagtggaagccgtacgtgcagttcagcaccatacttatgatatcatattgatggatgtttacatgccagttatgaatggtcttcaaacaacaaaactgattcggtcttatgaggacacgggcaattgggaagctgcaagaaaagctgggatagaacaatgtttaccagcttcaaatgaatgttctgtaccacctaaaaaccggatccacatcattgcgatgacagcaaacacaatgtcagagagtgctgaggaatgttatgcaaatggtatggactcgtttgtgtcaaaacctgtgacattccaaaaattgaaagattgtctagaacagtacctgagtgtctaccttaaaaactgtatagatctactcatctacaatattctttttcatctctccgaatgcataatagctattagaaagctagtaggactagctggagcgtgcaaagtagaggtatataacataagcctttcctattag

SEQ ID NO: 105897 - DNA, 156 bp, Glycine max
  Peptide Sequence Number=SeqID_222675
gaattcgatccagtctaccagattattccatcgatgtcgaggctaaacatcgctactctgagtttgaatctcttcgcaaacttctctcgaaagcatatccaacaagcgtaattcctatcaagcttatcgataccgtcgacctcgagggggggcccg

SEQ ID NO: 105898 - DNA, 405 bp, Glycine max
  Peptide Sequence Number=SeqID_222676
atggacacaggaatcccttgtatcgaaattctttttggcattgagtccacacatggaggccaagcaatgtgtcttgtggagagcgtgacaatgcaagatactagagcattcttaaacacaaaaagttggtatctagagcttcggtctaaatctttccgcatatgttatatgctttgtgacattaatgttaaattagaagatgaaaatcttggaatgattctattagcctctctcccttattcatacgagaattttatgagtactctaagtgttgcaaaggaatgtatcacacttgaagaagtcaagtcctgtctctattcaagagagcttcaacacaaagtatctggaaatggtgaagaagcctctgcctctagattatcaatgaccaattctgcaaaaggatag

SEQ ID NO: 105899 - DNA, 336 bp, Glycine max
  Peptide Sequence Number=SeqID_222677
atgttgaggttaattattcttcgaatgcctatcttggatttgtcaaaacaagattctattatttgggaagcatctaaggatggcatctactctatgagaagtgcctataagcttatcatgcttaacctaacagatgtaaaattcatctttgcactcttcaacgacttgcatgatcatcatcaacaacaaatggctatgttgctttggaggcggaggaatgataaagtgtgggacaacaaagcttacccagattcgcatgtgatagctcaaggagatgagttcttccagtcttggtcgagagtgaatagggaaattggatcacgtctatgccaataa

SEQ ID NO: 105900 - DNA, 114 bp, Glycine max
  Peptide Sequence Number=SeqID_222678
atggcctgtgacacatttctgacaggccttcccatcactattgcagatcttgaaccccatcagatacattccttctatgaatctaaatccattatcgcatcatacactaagtaa

SEQ ID NO: 105901 - DNA, 534 bp, Glycine max
  Peptide Sequence Number=SeqID_222679
atgagcacaggcccaaaaggacacgtagcaaaccaacacttaaggattaagtctgaagaagataaggatcagaaatcaccaaatattctattagcaattttgttactagttcataacaattggtccaacctgtcatccttatgtctgagcacaataccaggtaggccaccacagaacgacctcgaggaggttgttcattgccttactcaaaaccatgcttccatcttgcaagctcagtccatcatgaacattaagatcgactctattttagagcatcttgcaacacttacagtccaaccaccctcaccccaagatcaccccaccccctcccacactcatcctcatatgaaacttgagggacaaccaccagaggatattgatactttgcccccaacgaattctgataaccacccagtggttgaacctttaacaatccttgactggaaatgggataccattggtgtttcgccttcgaagctcgttctggttcagtggttgggattagctctgaaagataccacttgggagcactag

SEQ ID NO: 105902 - DNA, 354 bp, Glycine max
  Peptide Sequence Number=SeqID_222680
atgagaaatggaggggagggtcttactctagggaatgagaggtgggtttggagtgtgaggttgaaggaggggtctggagtgttgaagaggttggaagggaattgggagagagcctgtttgaagcagtcttcaaaagcacccaggcgtcaatgcattgtcccttggcaggaaccacctccatgtatgatcaaatgtaatgttgatgctgtcatctttggccctcaaagactttttggtgctgctaccgatttattatcaatcttcaaaatgactttttcaaggccaaaggattgcagaaactgcaatgctgagagaaggctccaagcttcatcttcagtgactgaaagaaactag

SEQ ID NO: 105903 - DNA, 261 bp, Glycine max
  Peptide Sequence Number=SeqID_222681
atggaatgcagagctaataatgctgagagagaagcagagctgctaaaagaacaactgaaacatcttaaggatcaacttgataagtgtttgcatcagaagattgaagttgaaaaaaagctatctactttaatgtttcaagaagttgcttctacagagagtaatgttttagttaagcatttgcaacaggagcttcggaactatgttgctgatgggaaccttatggcccttgattcttgctataatcacttaagtcacaagtag

SEQ ID NO: 105904 - DNA, 301 bp, Glycine max
  Peptide Sequence Number=SeqID_222682
cttgggaggattgatggggacccggtgttgagagaaacgaggatatgggctacgtgggagtacgtgagctcagttggaggtgggcaacaggggatgagtggtacctggagatatgtcgcggggggtcaggagaccttggggacgtcaggtggggtgctattgcccaaaaccaagcttgaccaatcccgacccaacccgggcatagtcggggactggaacattgtggaggcctctggtaatcgattactagcctatgtaatcgattacacagagggatgggtcactggtaatcgattaccag

SEQ ID NO: 105905 - DNA, 291 bp, Glycine max
  Peptide Sequence Number=SeqID_222683
atggctgacggcggagtcttccggaagttccggaagaaccttttccggaaagtttccggaagaagtgttcttccggaagtaaccaaacgtcttccggaagaacacttcttccggaagactcccggaaaaggttcttccgggaactttccggaagaagtggttcatccggaagaatttcggaagacgccctcttccggaagaactttcaaatttccggaagaccttttcggaagaatcacttcttccggaatgtttccggaagaaccacttcttccggaagtgattttatga

SEQ ID NO: 105906 - DNA, 2160 bp, Glycine max
  Peptide Sequence Number=SeqID_222684
atgcttgttgcggttggagcgtcgtgggatctgaattggttcctgcaattgttgctctccgtcatcgtcgtggccattggggttcactacttcgtcaaggtcaccgcttccaaatacttcttggtcgacgccaatttcgaaggggaccaccaccacgccctcgccaccgacgccatgcccggtgccctcgctgccgccgatcctctctgtgccgtctgcgccacgccagcccctaagaattcgcaagcatgtcagcagtctcactggatgtctgggcataagacagtgtgcaaggattttcgtgagaccagtgcaagaagctcggctcagaatggggtaattaatcgtgggtttaaggcttctgctgctgggggtaaaagcttatcaacgattgcgctgatacctggctgtggagcaggagcaatttccaggccaatcaagcaggctaaagatgttcttttttcttacgatgaatttgtcaagtttttcaactgggacaagccaggatttcctccttgtggactcttgaattgtggaaacagttgctttgcaaatgtggttcttcagtgcctctcattcacaaagccacttgtcgcctacttgttggagaagggccaccgtagagaatgcagttgtaatgattggtgcttcctatgtgaatttgaaaatcatgttgaaagaacaaggctaagttcacaggcattttctcccatgaatattctctctcgtttgcctaatattggtggtacactgggctatggaagacaagaggatgctcatgagttcatgaggttttccattgatactatgcaatctgtttgccttgatgaatttggtggagaaaaagctgtccctcctaaccttcaggagaccacccttattcaacacatttttggtggtcgtcttcaatctgaggtgatttgcacaaaatgtaataagatttcaaatcagtatgaaaatatgatggacttgacagttgaaattcatggagatgctgcttccttggaggaatgtctagaccagtttactgccagggagcggcttgatggggaaaatatgtataaatgtgaggggtgcaaggattatgtcaaagcatggaaacgccttactgtgaaatgcgctccaaatattcttacaattgccttgaaaagatttcagagtgggaggtttggaaaacttaacaagagaatatccttccctgagactttaaatcttagcccttatatgagtgaagctggagatggatctgatatttataagctatacggtgttgtagtacatattgatatgctaaatgcttcattttttggtcattacatctgttacatcaaagatttccagggaaactggtataggattgatgactggaaggttatgactgtggaggtggaagaggtactttctcagggagcatacatgctcttgtatagcaggtgtagtgcccggccatcaggccttcaaattcaaactagtgaatcttcagggatagcagaagttcaaacagaagtggaagtggagcctggacaaactgaacaagatgaatgcctctcaaatatgaaggctttgacttgtagtagaggttctgaggttttgccatctgatgttagtccagaattgaaggtttcttccagctatgactgtgagtcttttgctggattgaactcaccagtcaaaagagaacagtttaatgatgtggacatgatggatgttgattcaactggtattgtgaatgagatttcttgtggtgctgttgaatcatcttatgtgcccatttctcaaacagacagtgatttgggggatgtagatatgggcagatcattagaagagacttcaggctgcaaggaagagcaagatgatactgatatggttagttctggtctttgttcgggtccaccaaatgacaattcctttgataagcacccttccgtttcacgtgatcatcaaaacatggaagaagattcagaacatatcgatgtggttaactgcaagttgattacagccaaagataatgcatgctattctaatggatatgtcagtgcaaatgagccttcaattccagttgaagacgcaggctcacaaatttctggcatcagttcttttcccactgaaaatgacaaaggaaatggaattaagaaagtggaaatatcagccgacatctag

SEQ ID NO: 105907 - DNA, 288 bp, Glycine max
  Peptide Sequence Number=SeqID_222685
atgaagggtcaccaaaccgttgtcaataatatcctaaagtacttgggaaggactaaggattcattttacactagctttcgagatagggatgattctcaatcgcaatcagggtttgtattttgccttaatggtgaagttatgcctttggtgcaagctgaggagtgggatgtttggatcgggatgtttattactggacttggcattgttcctagcatcgcaggcctgattgacctcgattgtgataacaaaggagtaatcccgcaggctaaggaacctaggtctcactag

SEQ ID NO: 105908 - DNA, 308 bp, Glycine max
  Peptide Sequence Number=SeqID_222686
atggaggatgagtactctgaggccactatcctagagccatttactgcagaggaggaggtaggcgacacaaagacgacgcaggtagctgctgccattcctgagagatcacttgaggccatttcattgcccccagcaccagcagtggatccatcttcacctcagcacacaacaaacccttccactcttgtcttagagatacttaagggccagaccacaccagtccttactttggacacttcttctccagctactccaatgcttcatctgacagatgaggaggatgtgcagacacaggacactcaggacca

SEQ ID NO: 105909 - DNA, 438 bp, Glycine max
  Peptide Sequence Number=SeqID_222687
atgaagactgccaaggatgtgtgggagagttgtaagcaaaattatttcaaggttggtgatgttggtcaaatttatataattaagataaagattacaactaccaaacaagaagatcgattcgttggtgagtatgtccaaaatctacataatctatggttggagttagaccgttatgaaaagtttgaagcaaagtgcacaaaagatgctaacttactcaaaagttataaggagaaggacataacctataagttattgataggacaaaacaatgagttcaatcctgtaaggattcaagtgctaggaaaagagttaccctcactcaatgaaaccatgactacctttcggggaaagaagattgatcaagtacaaaccaatcaacatggaggtatagctcacaggatggagattgacaaaggggataacaaggattctctgtaa

SEQ ID NO: 105910 - DNA, 633 bp, Glycine max
  Peptide Sequence Number=SeqID_222688
atggatgcactagagaaaaatggaacttgggagttggtggaacttcctaaagaaaagacacttgttggttgtaaatgggtattcacgtcaaatataaggcaaatgggacactcgaaaggtataaggcaagagtttgagattaaagagcaagatagattaaaatactttcttggtgttgaggtggcacattctcgtcacggatgcaattgtggacaaagaatcttatcaaaagctgattggaaaattgatttatttgtcccatactgcggatccattaatgatagaaaacctatgatcatgactttccctaacaaagaagaccttcttgaaatttggaggattgaaggaaatcctataattcttgttgaacaccggttcaacatcaacatgctagaagcaatgagggttccgttcagggacaacctacatctgtgcaatatcatcaacttctttaccaaagatgaagttgttgttgcagagatggttagggaattctggagaaatgtgtttgaaaaagaccgcattaccagaataatgcttggtattcaggacattgaccccaaacttatcaaggcctttctctacaagcctagtgcttcagaaaaattggagttgaccaagttttttgactag

SEQ ID NO: 105911 - DNA, 432 bp, Glycine max
  Peptide Sequence Number=SeqID_222689
atggtagccacaacctaccaaacatcccatgagtgttcggaagaaacaattattgatatcctagtggcaggattttccagacaattaaaaggttggtgggataattatctcactaatgatgaaaagtcaaaaatttacagcgcagtcaaaacggatctcaatggaaaagtcattactaatgaaaataataaagagattcctgatgttgttaataccctcatttttacaataactcaacattttattggagacccgtcactttggaaagataggtctggagaattattatccaatcttaagtgtagaactttagcagattttagatggtatagagataccttcctaactagagtctacaccagagaagatagtcaacaacctttctggaaagaaaaatttctagttggtcttccaagatcattaggagataag

SEQ ID NO: 105912 - DNA, 1614 bp, Glycine max
  Peptide Sequence Number=SeqID_222690
atgtggggatgggattatgatttaggaattgtggttacaaatgatgggaatgctatcttacgtgaattagaccttgctcaccctgctgcaaagtctatgattgaattaagtcgcacccaagacgaagaagttggagatggaacaacatctgtcatcattcttgctggtgagatgcttcatgtcgccgatgcattcattgacaaaattcaccctacagttatttgccgagcatatgccaaagctttggaggatgctattgctgttcttgacaaaattgcaatgcctatcaatgctcaggatcgaggtataatgctggggcttgtaaaaagctgcataggtaccaaattcacaggccgatttggggatttaattgctgttctagatttgtgggacggttttgtagcagttattcaatttcttagaactgtttcctcaaaggagagcttggctctaaggctggacttggctattgatgctactacaacagtaggtgttgaggttggccaaggtttgagagatgtggatattaaaaattatatcaaagttgagaaggtcccaggtgggcagctagaagattcaagagttctcaagggagttatgataaacaaagatgtggttgcccctggcaaaatgaggagaaagattgttaatccacgtatcattcttcttgattgtccccttgagtataaaaagggtgaaaaccaaacaaatgctgaactgctcaaagaagaagactggagtctcttattgaagatggaagaagaatatattgaggagctatgcatgcagatattgaagtttaaaccagacttggtaatcacagagaagggtctgagtgatttggcttgccattatctcagcaagcatggagttagtgcaatcaggaggctgaggaaaactgataataatagaattgcaaaggcttgtggtgctgttattgtgaatagaccagatgaattgcaggagtctgatgttggtactggcgctgggttatttgaggttaagaaaattggagatgagtactttgcatttattgttgattgcaaagaacccaaggcttgtactgttctactaaggggtgctagtaaggatctattaaatgaagttgaaagaaacctacaggatgccatgtctgttgcaaggaacattataaaaaatccaaaacttgttcctggaggtggtgctacagagttgacagtgtcagctgccttgaaacagaagagttcatctattgagggcatagagaagtggccttatgaagctgctgccctagcttttgaagccataccacgaactttggcacaaaattgtggagtaaatgtgatccggactatgactgctctacaaggaaaacatgcaaatggagaaaatgcgtggattggtatagatggaaatactggtagtatcactgacatgaaagagtgcaagatctgggatgcctacaatgtgaaggcacaagcatttaagactgccattgaagctgcttgcatgcttctgaggattgatgatatagtgagtgggatcaagaagaaacaggcccctggagccactccttcaaaacccaaggttgagaccgaggcagatgctgacagtgagcaaatccttcccgattga

SEQ ID NO: 105913 - DNA, 282 bp, Glycine max
  Peptide Sequence Number=SeqID_222691
atgtacacccctctcacaaaccaaagattaaaatcaagaaatatacgaagtcagcaagttactattgaaaaacgtgagtccttgataagttggagttttattaaatggcgcctcaagcagcagtggttcagagagaagaatgcgaattacctgaacttggccggagactgttcgatcggtgccggaagcgggagggatacggtggttgacggcggaggaaaaggcgctagggcacagaagaagaataatcggtttggagaaataatcggcggaagagtgtag

SEQ ID NO: 105914 - DNA, 318 bp, Glycine max
  Peptide Sequence Number=SeqID_222692
atggatgctctagggttttgctctctctgttctgctgctattgctccacagagggctcgcacgttggagggaggtgacaacaatcgtgtgtgcaaatctgggtggtgcaaaggtgactacagtttgcatcttatggtgttattgttgggtgacgcatgcacaaatttgggggatggaggtggtgttgtgaaatggaaggaaaagagggtgaatggtggtggtcacacaaagatggtggataggaaggtgatgacgcgatgcgatgatgatgttgttgtgtttggtcgcgtgggtacaagggtgatggtggctcagtga

SEQ ID NO: 105915 - DNA, 693 bp, Glycine max
  Peptide Sequence Number=SeqID_222693
atgggtgatgaacctcatgctggttctttcgggctggaggaaatttatgggggggttccgacccccatgagaaggaaaaggaaatacaggacaaagaaaaaggaatatcaaggatggggatcgacttcccttatttggtttctcgaatccattggtagagataccagcaccgagataactcaaagtgaggttgcaaatattgtaatggagtatgttaagcagcacaacctctttcataagacaaaaaagaagagaattgagtgtgatgagaagctgcatttgctgtttgggaggaagaccattagccggctgaaaatcaatgacttgcttgagtcacactttgcggagaactgtgaggagtcctctgatggtattttctttgactcagaagatgatgagagtgccttaacagcttgtgaaaccccgagaacagcaccttcggagaggaagagtcaaccaaagaaaccagcttttgaaaaaccaaggagctgttttgctgccattgttcctgccaacatcaagcttgtttatttgaagaggagtctagttgaggaccttttaaaggaccctgaaacttttgagactaaagtagttggaagcttcataagaatcagatgtgacccaaatgattaccttcagaaaaactcacaccagcttttgcaagtcacaggtaatttggctgctgttggttga

SEQ ID NO: 105916 - DNA, 282 bp, Glycine max
  Peptide Sequence Number=SeqID_222694
ttatctaagttgcttgaagaagcaacagcaagaaaccagactgagggaaataaggatcttaaccacaatgagaaggactatttgcttcctaaagtagttgaattctctgaagagaatagacatgggggaaaagacacatctaaggtagagctttcagccaatgaaggactcaactcaaacaaagcttacaggaataaatcattgatgacagagaagtggaaccttggaaccagaggaataattcctccttgtcttttaccccttgtctgcaatccatggtag

SEQ ID NO: 105917 - DNA, 342 bp, Glycine max
  Peptide Sequence Number=SeqID_222695
atggtgaagggacgccaaggagaacgtgtcagactctacgtgaggggtacaatccttggatacaaaaggtccaagtcaaaccagtatccaaatacatccctgatccaaattgagggtgtgaatgccaaagaagaagtagcatggtatgctggcaagaaaatggcctatatctacaaggctaaggtgaagaagaatggaagccattaccgctgcatatggggcaaggttacaaggcctcatggtaacagtggtattgtccgtgcaaaattcaagtcgaaccttccacccaaatcaatgattcaggtgataaaacgctcagtagaagtcccagctgatttgtag

SEQ ID NO: 105918 - DNA, 231 bp, Glycine max
  Peptide Sequence Number=SeqID_222696
atgaaagcaacaaagaaatcctctgttagtattatttatgctccagccaaagtaaacaatgacattcaaagatcagcagagccaatcaatttggtgaggccaaatgttatggccatagccatgcaacctccaaccagaaccctacgacaagaccttgtcaccggagtttttccaagaactgctcctactcctccaaacaccaacaatgccaagcttttctataagcactaa

SEQ ID NO: 105919 - DNA, 243 bp, Glycine max
  Peptide Sequence Number=SeqID_222697
atgataattatgaaaggcaccaacagacagataggttgggattctatatctggagaagatcattctatttcactcttgagaggagaagtttttcaagccttggctacctttgatcatgataaaacacagcaagaagcattacaccgctttcagattttgttagatggcagaaatacttctctgcctccagccaacattagaagggttgcttatgtagctgtaatgaggaatactaccacataa

SEQ ID NO: 105920 - DNA, 1590 bp, Glycine max
  Peptide Sequence Number=SeqID_222698
atggcctctccctcaatcttcaattcagaatccgatgaagattcctgggtcatccaaatcaaccagttggtgagtgaaaccaacctctcaatcttgaacaaaatgcctgtgtgcatataccaagtccctaaatcattgagttgtgccaagccagaagccttttccccacaacttatagccattggtccttatactcactttcatccagacctctatcccatggaaaggttcaaagtttttgcagccaaaggggtcctagatcacttcaaaaaacatgacttcaaacaactaattgagcaactccgcagcacagggcaattcatccgtgctagttaccacaaatacttggacttcaaggaagataccttattatacatcatagccattgacggtttgttcttattggatttcttccacaattatctcaatgaggaagtgtctggttccttcatgacaggattacaagaccaagttcagctaagtggtgtgaagctaaccaaggatgccatcataagggacatcatcatggtggagaaccaaattccaacctacatcttagtgaggatcttggtgcttgaaagctccaaacctgctgattcagttctagagttcttgggttcaatgctcttgtcattctgcaagaaacactctccactcaaggtaactcacatccccacagattctgaagctgtctctaagcattaccatatcttggatcttatgtaccatttggtggtctctcaccctgaaaagtctgaaacaccaacaacacctgatcaaagcgaaggtacttctacacttaagaaaagctcaaaatctgaaggcacagcggcatctaatcactttaagaaagttaaaaatgtactatcatggacactagagtctgcaaaaaagctgaaggacgtgaatattccgcttgtgcaacctattaaacgacacatagatacaatactcaacatgtcctcacaccttgaaagtctttcatcacacccaaaactttctgaagaagaagaggctcctgtggtggtcaacatcccttgtgtgcgtgagcttcactcagttggggtctatttccaacccgtggaaggtggcaacatggccatcgatttcgacgaaaagaagggcatattttacctccctgtgctcaaattggatgtgaactcagaagtgataatgagaaaccttgtggctcatgaggccttgaccaaaccagattttctaatcttcacaaggtacactgaattgatgagaggcatcatagacactgtggaggatgtgaagcttctcaagaatgcagggatcatagattcaagtagctctctcagtgtggaagaaactgaggaacttttcaatggaatgagcaaatccattggaccaaccaagactgagaagttggatgagactattaagaaagtgaacaagtactaccatgataagaggaaggccaacctctacagaaccttaactgaatatgtgtacaattcatggaagctcttcacacttcttgccacctttgtgctcttggcgatgacagctcttcaaacgttttgctcggcttatgattgtcccagttattttagacccaaataa

SEQ ID NO: 105921 - DNA, 328 bp, Glycine max
  Peptide Sequence Number=SeqID_222699
ttttgggaacaaaaggtgtcttcgtctccatgattttgctcttccatttgaagaaagtttagggcatggaaaatttttggaggcctcagagttggattatgggaagattgaaccgggaatgtggtgtccaaagccaaatgagcatgttgtagagacagggttttctcaagatgctttgatggttaaggagtttgctgatttggttcaaaaggttaaggggtgtgaaatgaagcctgagaagacttggccagttttgagtaggaagcaagactcaggtggtgttggatgcagtgaaagagtcgattcagagaggttaccagcctgttga

SEQ ID NO: 105922 - DNA, 641 bp, Glycine max
  Peptide Sequence Number=SeqID_222700
gtgagtacattggactaactggtgcacagctagatggagcagaaatggtagcatgcggtttagccacccattttgtcccttcagtgaagataaatacactagaaaatgtgctacaaactgttactaattcgaatttaccaatagcggaagttatagaaacattcgcagagaaagcaaatgtgaaggaagacagctcattcagaagattggagattataaacaaatgtttctcaaaagggacactggaggaaattattatatgcttggaaaaggaatcagaaaatggagcagaagagtggataaaaaatgcattaagttccatgcgatcgtcttgtcccttgagcctcaaaatatttttgaaatcaattagaacaggccgtgtacaaaatattgaacaatgcctttaccgggattacaccattgctggccacttcctcagaagaaccattagcaatgatttctatgaggggacaagagcaaagctgattgataaagacaacaagcccaagtgggaaccttcaaagctagagctggttagcgaagaaatggtagatcagtgcttcagggatatcgatgaggaggaaatggattgtctgaaacttcctgatagatccaattctcaaattgcaagcaggttgtag

SEQ ID NO: 105923 - DNA, 285 bp, Glycine max
  Peptide Sequence Number=SeqID_222701
atggctcagagtttcacccttgacagagatgaaaagcaggtacttttcactggaaattcttgtgtgaagatagtgactttgaacagaacccagaagttaaatacccttaattatgaaatgatttatcaaataaaaaagaatttacaaatgtgtgagaatgacccttccgtgaaactcgtgatattgaaggctaatggaaaagctttttctgctggtggcgatgtagtgtcagtaatcatgtcttcacttgcaggtcacctggcaagcttaagtgatagcgaataa

SEQ ID NO: 105924 - DNA, 1632 bp, Glycine max
  Peptide Sequence Number=SeqID_222702
atggacatagcatcaccaccatcatcatcatcgatggctcttccttcattgcaaccccgcaacacaaccctttcaaaagtttccattttccaacgtttaacccctctgacaaccataattccctcatgggcatgttccaacaaacccaacaccaccaccctctctccaatctcctcgaagttcccatctttcctacgctgctccacaaaaccagacaccagcgccaacagcgagacacaacacaacaacaatcaaaacaatgaacccaattcaatttcaaactcccaaaatgcaccacaatcatcagattcatcatcaagtgcagccttttcttcatcaccaccacctttggggccatcacattcctcttcctcaagagggttggtgcttgatttgggtccttcaaactcttgggacagtgcagatatagggtccccattggtgaagaggtttctgagtgacgaagaagagaggtggtacatgtggtaccatgggagggcaaaagggcacccttcttctgatttgatagggttggctgtttcaaagaatggggttcattgggagcgtggtggaggccctgctaggtcaagttctgatgtggggtttgtgatgagttctggtaaggattggtggggttttgacactggtggcattaggccttctgagatggtggtcatgtctagttctagggttagggcctccagtgctgtttactggctttactacactggctttgtttctgagagggtggagttttctgatcattctctggagttcagtgtggaaaaccctgatggagtaatcaatggtagtgtgagttgtgggtatgggaatgggaatgggaaagttttgaagtccttgcctggaatggctattagtaaggatgggaggtattgggctaggattgagggggagcatcatagtggagcattgattgatgttgggtctgagaaggagtgggattctttgtttatttcttccccgcaagtggttttacatgggaatggtgatctaaggatgtattatcactcatttgatgtccaaagagggcattttggtgttgggattgttaggtcgagggacggaattaggtgggtgaagttggggaaaataatggggggagggaaaggtggttcctttgatgagtttggagtgatgaacccatgcgtgacgaggaaccggagtggcgggaactatgtaatgacgtatgaaggtgttgctgctgatgggagaaggagcattgggatggctgtgtctcctgacgggttgaaggaatgggcgaggcttcaggatgaggcaattttaaagccgtcggaccaaggttgctgggatgataaggatgttggatccccatgtttggttgaaatggatatagaaggaaatgagtggaggttgtattatagaggtattggcaatggaggaagagttggaataggaatggccgtttccgaagggagggatattggaagatttagaagatggacagtaagattggaacttgtcctgacttttatgaatatggtttatgttttaacattaattctctgttcctcgagaacttctaaaattgtaatgtactatgcgggtagtaaaggagctacgcttgagaggttgagaattagctttgcttag

SEQ ID NO: 105925 - DNA, 417 bp, Glycine max
  Peptide Sequence Number=SeqID_222703
atgagaagacagcttgatgggacatcacaatgctgtcttctgaaacaagctaaacaggaaataaaagcaagcatgtttcatgcttttgatccccctccgtctcgtgtatttgccttgagggttcttgaattgaaggagcagggcgttagtgaggagcaagcaatggctatagctgatatggaatatgtgacagagaagaaggcaaagaagaaagcatatacccgtttgaaggaaattgcacgtcttcaagggaagagacttcctcaaaacccatatcctagtgccatcaaggagatacaagctgaggagaggaaatatgttcgtgatcgtttcttcaatcccaagatacttgaaattgtggagaaacagaaagccgaggcagcagcagagagattgagtcgaggtggtgattggtga

SEQ ID NO: 105926 - DNA, 735 bp, Glycine max
  Peptide Sequence Number=SeqID_222704
atcatggttagaaccagaggtttaggtcgtgccctaggtagggttatagacaaagccctagggagagaggatcatcatgattcagatgatgttccccaacggcaaaggcttacaacatccgcacgtaggcaacggggagctgcccctgttcctgaggatgctgctactattagtgaggacatacctgcacctggtgcagaagctgttgatggtgctgagggatttgctgttgatgatgttgaggaattcctaggtgagccgtatgacccatcagtgctgactgagtatggtgaccatgttgcacttagtatatggaatggagaggaacgccctgaattgaagttagcctcccatggaaggaaagttgagaaatttgggaggtctgcaccagaaattgaagggctaaggtggcacaaggaaactagtagttttcatcttcctgtaggagagttgaccatcacgctggatgatgtggcgtcactgcttcatctttcgatcataggcaccttccatagcttcgagcctctgcatgtggacgaagcggtgctgatgttggtggagttgctagaagtctcgggcccgacattggactgttacaactcgtgcgtatctcctacacttgttagtggaagctatgcatggggagctgccgccctggtgcatatgtatgatcatttgaatgatgcttgtaagagcggcggtcgacagcttgctggttacatcactttattacag

SEQ ID NO: 105927 - DNA, 1224 bp, Glycine max
  Peptide Sequence Number=SeqID_222705
atggaacatagtttgaaaagaaagtctccagagagtggagacaatttactcttcagcagcttttctctggatgaccttaatgaagatctcttggagagggtactttcatggctaccaacttcctcattctttcgcctcacttcggtgtgcaaaaggtggaaatcagctgctgcttctgttagtttcaagcttgcctgctcacgagttcctttgcgggatccttggtttttgatggttgctcccaatctcaaccaatctattgtctttgacactgctgaaaacagttggaaaagactcaatcacccgcatcttccgctcaaagactctaacattagctgcatgccggttgcagcctctggtggccttgtttgctaccgcaaactttcaggaaacttcattgtgtgcaatcctgttaccggatcttgtactgaactccctccattgcatttcaccccagaaaaccagtctctcaacgcggttgtgatgagtacaactttcaatgatcaattgtcctacaagattgtgttagtctttggcgaactccctaacctgttgtttaaagtctacaactctagctctggctgttgggaagatgaggctgcgctgaggaggaatgttgatgacaattccctggattgtgattcaactgatgatgacaatgttgtgtacttccttagcaaggctggaactgttgtagctagtagcatgcatagaagtccatctaagcaatattcatcggttattactaacaaagaaggtcaggagacagtgtattttctcagctcctcagggatggtagtagcttgcaatttgacatcaaagtacttctttgagtaccccaggttgctgcctgttttcagtgagtactccattgatattgtggagtgtggcagtgagatgcttgttgttttgctatcagaattcttggaaagcgcaagtcttagggtgtggaaatatgatgaggccaaccgatgctggaaacagattgctgcaatgcctgcagcaatgtctcaagagtggtatggaaagaaggcagatattaactgtgttggagctggcgatcggatattcatatgcttgaactcccctgagctatgtgcttatgttctgtgtgatttggtgaccaacaaatggacagagttgccgaaatgttgcttgaatggagaactcatggagttcatgtctgccttttcatttgagccaaggatagaggcttctgtatga

SEQ ID NO: 105928 - DNA, 258 bp, Glycine max
  Peptide Sequence Number=SeqID_222706
atggtgaaattctcaaaggagctcgaagctcaactaataccagaatggaaggaggcctttgttaactacaggcagctcaagaaacacataaagaggatcaaactcaatagagtttcgaagcaattacaagccccagaagagacctttggtcgctccgttttcgattcctttcgcttcataaccaacaagttctgcaattcagacaacaatcataaacaagacatgatccagctcattcttttggtgtggttccggtaa

SEQ ID NO: 105929 - DNA, 1665 bp, Glycine max
  Peptide Sequence Number=SeqID_222707
atggacgaccaagaacaacaccgacaacctcaacccaacagcaacaacggttccaacgccgacccttttctcctcaactacagcacctccgatctccgaaccgcttcagagtttctcgccacgtggctccctttcctctcacgagatctctgcactcgatgcaccctgtccctctccgatcgcatccgctccatcgacccaggtcgcaataccctcactttccttcgaaattctcgttttttccatctgggtataaacgttttccttctcacaccatttctttcctttggttttcaggtgaagcgcctcaaaacgaaatccccagtgaccaacacgacgtcgacgtggaggataactgcgacaactgcgacgcgcattctctcgggagttgtaaggactgttgcggatgtgaataactccaatgtggagactccgagccagaggatttcatgggccgacatggcccaagaagatgacgagttcggcgacgaagaagacagcaacaatggcgggaattttgcggtgggtgattcgaatgctttctctcatgtggctaaggttgtggctgagaagcctactctgccgagggagcagagggagtacattaggttcatgaatgtgaggcgaaagaaggactttatctgctttgagagggttaacgggaagcttgtgaacattcttgaagggcttgagctgcacactgggattttcagtgctgctgagcagaagaggattgttaattatgtcgcctcgttgcaggaaatggggagaaagggggaattgaaagagcaaacgttttcagctccccaaaagtggatgaggggtaagggacgccaaaccatccaatttgggtgctgttacaattatgcagtggatagagatggtaacccacctggtattcttgggaatggaatggttgatcctatacctgctcttttcaaggtcattattcgacgtcttatcaagtggcatgtactccctcctacttgtgtgccagatagttgcattgttaatatctatgaagaaggggactgtatacctccacatatagataaccatgactttgttcgaccattttgcactgtatcatttcttagtgagtgcaatatagtttttggatcaaacttaaaaattgtaggccctggtgaatttgatggctcaattgctattccgttacctatgggatctgtacttgtcttgaacggaaatggagctgatgtagctaagcattgcgtgcctgcagttcctaccaaaaggatatcaatcacatttagaagaatggatgtgtccaagcggccttttgggtatgttccagaacccgatcttcaggggatccaaccattggcctatgaagttgagcaggaaaagaaatcaagtgggcacagacctagtcgtcacacaaagagacataaagacaggagaggaggtggcaggaatgatgcaatgggatctgcaactagaaatgataggttcttagagccccatgactcaaatctaaattcaccaagatctgcaactagaaatgataggttctcggagccccgtgactcaaatctaagttcacctagatctgcaactagaaatgataggttctcagagccccgtgactcgaatctaagttcatcaagatctgcaaataggtggagtaggaaacctggtagttaa

SEQ ID NO: 105930 - DNA, 519 bp, Glycine max
  Peptide Sequence Number=SeqID_222708
atgtacaaggagtttttcaaaaacacgttcttaagctcttttgacgcatttatgcagactgggaggctgcagcaaaccctagcggattgcgtggagcggcaaggcaaggcgttgcattcgggaaaggtttcgacggtgagactgtgtcccgaacgcgcttcccgaggcaggcgggttccgaattcgaatgtggaagaagttggtttgacggtggccactgatcttgatggcaaaagtgttgagaaaatggcaccacatgtgaatgaaccagtgtatgcttggagaaatgattcttttgttgctgcatttccttccgaagtggttcgaataacttatggcattaacttttcgcagggattgtgtttcatggatttgagcattacccctgttaatctgcttcccatcatgagaacaatgtctagatttgtgtctaaagtcaagattatagcatttagtattttagttgtacagataaaaggaacttggttgctgactgggtacatttggacatttggttga

SEQ ID NO: 105931 - DNA, 294 bp, Glycine max
  Peptide Sequence Number=SeqID_222709
atggatgaagtaatctcaacgttggaaagaaatggtctaagttttgcgaattcggcaatgagggtaaagacaaagaagaagggaaagcctcatatggccttaaaaattgatattccagccaccactcccacgggtgttacttccatgttgtgggaggatttggtgaacagtccaattaaaccagagtatgggggagagttcattaacaagagaaaaattctgtgtgctgagaagatgattaaaagtgcatttgtagagctctataaaggtcttggccttctcaaaacttacagg

SEQ ID NO: 105932 - DNA, 843 bp, Glycine max
  Peptide Sequence Number=SeqID_222710
atgaaggactcaagcccaagtagaaccagcaggttcctccagattggtggtttgaagatgcctcaatccttaggattgatcactttgttagagtcatcactgccatcaagtgacacagcaacccctggtgatgaagcaagcaactgcagcatgagtaacagtagtagtagtggcggcggtagctggaaaagtggacttcatatggttgtgactggaacaaaagatgacaacacttcaagtcttcaagctaaagagcaaaggatgatcatagagagccttgtcagcattattccacctcagaaggacagtgtctcatgcagcttccttcttaggctgctgagaatggcaatcatgttaaaggttgcacctgcactggtcactgagttagagaaaagggtgggaatgcagtttgagcaggctacactggctgatcttttgattccttcttataataaaggagagactatgtatgatgtggatcttgttcagaggctgttagagcattttattgttcaggaacagactgaaagttcaagtccaagcagaaattccttttctgataaacagcatatgggaatgggaatgggaatgggatgcatcctaaatgccaaggcaagagtggcaaggcttgttgacagttatcttacagaggtgtccagagataggaacctttcccttaccaagtttcaggtacttgcagaggctttgcctgagtcagctaggacctgtgatgatggactttacagagcaattgattcctatcttaaggatatgtgtgcctatgtcacagatataagagtggccttacccgactcgaacaagattgtttgcggtagaagttaa

SEQ ID NO: 105933 - DNA, 294 bp, Glycine max
  Peptide Sequence Number=SeqID_222711
atgactaggtggatgactttaaagaacctcgtgttagaggatgttgggacacgatgttctgataggatggagatgcgaaataaagggcatggtggtggtgtggaaagaggcagtaccgagaaggcttttctgaagcaaccaaaagtgtttctcaagaaaacttgtgtcttttcatcgcaggtcatctattgcatgttctccggttggcgcttcagaagtaaggtttatgtgcataacttggtcactgaaaatggtctagttagtctttcatctgtgggtcatttccatttttag

SEQ ID NO: 105934 - DNA, 429 bp, Glycine max
  Peptide Sequence Number=SeqID_222712
atggtcattcccaagttcaaggtgtcggactttgacaagtacaaggggactacttgccccaagaaccatctaaagatgtatcgtcggaagatgggggcatgcgcaaatgatgaggaattgctgatacattccttccaagaaagtcttactggggtagctgttacctggcagtatcagtacaattgtgatatggttccggataggatgaaactacagaacatgtgcaaaaaggggcatgaatctttcaaagaatacacccaaaggtggagggatctggcagcccaagtggcacccccgatgatggaaagggagatggtaatcgtgatggtagacacattaccagtattctactatgaaaaatggtgggttacacaccttcaagttttacagatttggtcttcgccagcgaaaggatcgaagtgggtctga

SEQ ID NO: 105935 - DNA, 135 bp, Glycine max
  Peptide Sequence Number=SeqID_222713
gagccagtacccactcaagtgcagcatcgtgtatctggaattcaatatcctgaaagctatcaacaaccatttggtcctagatatggaagaggctatggtgttcctactccacccccagcaacctctgcaacctaa

SEQ ID NO: 105936 - DNA, 603 bp, Glycine max
  Peptide Sequence Number=SeqID_222714
atggttacaatgattttgtgcagtgtgtttgcattattaagcctgcacttgtttatgtatggatgcaacctgtacatgtggaagagtacaagaatcaaccataatttcatatttgaattctcaccaagcacaacactgaagcacagagatgcatttctgatgtgcactaccctcatgacaactgtgtttggggcaatggtggtacacctgctactaagggctggaggtttttctcctggccaagttgatgccattccctggaatcatttttttggtcttctcatttgcccatttgacattttttatcgccctactcgtttttgcttcatccgggttattcgtaacatagtttgctctccattttataaggttctgctggtagacttttttatggctgaccaactaactagccagattccattgctaaggcatttggaaacaacaggttgtcacatttttgctagagttttcaagtcacaccaccctgaggcatgccattctggaaggctatacatagaaataacttaccttatctcatttttgccatattggtggcgtgcattacagattctgtatcaactgcttctagaattggtggcatga

SEQ ID NO: 105937 - DNA, 261 bp, Glycine max
  Peptide Sequence Number=SeqID_222715
atgccatttgatcaggtgtctaatcaaaaggcttctgcaaattatatgaaagaagtgaagagatcccatttcattagttctgacaaggttgttagactaatggacgaagtggaatccatattcacaaagcactttgccaacaatgataggaaaagagcaatgaagtttttaagaccccaacagccaaaagtttctcatacggtcaccttccttgtcggtaatgcccctctctctcccctaactcttaactcgtgtccttaa

SEQ ID NO: 105938 - DNA, 2252 bp, Glycine max
  Peptide Sequence Number=SeqID_222716
atggatataaagggaatacaatggcaaaatgccaatgccatggttgtaaaccaaggcaatgataatttcttggtatgctccttccacatgccgaagggcacaacaatagcaacctctttggcattaagattcggaaaggctgcacttgaagcaatagcagcagctttatcagatagacttggtaatccgccatggccactcgccgccgcggcggccacgatgccgccaccgtccgtccccgtcccctctccgcctctcgccgcttcccttctccttctctttctctccagaaagaaaacaccaaccctcgccgctccaatcccaatcccaaccacaaaaccctccctcgcggccgcagctccagcccctccctcgaccgccccaccgcccataagcccaccaagcccaccaccaccgccccaaagcccaaaccttccacctccaggcaaagtaaagcggatagcttccgacataaagaagactaaagagatgcttgacatgaacaaccctgacgcctccaaggtgatcctctccgacattcaggacaagatctcaggtatcgagaaagccattgttcatgtcgtttctaacaaggaaagcgaaaatggtgcggttaaagttgctgctaaagacaagaacttagcgaaagagttgaaattgaacaccgacgaactcgaggcaaggttgttccctcaccagaaactgcttcgggacaggacagtggttaaggataaggataaggactctgtggtggaggcacagaaggtgctgagtccggtcgacgataacttggttgcagtcgagtttttggctctgatcggtaaagagaaagacaaggtgaatgctggggaggatgtgaaggaaagtggtggtgggaatgggcgctggaatgataagaggaacaatgacattgacgcgctgctcggggcggatgagaagcttgaggatttcgatgatgatcaggagaataaggagaacaaggaaggtgtggttgttgaggaagagatggatgaggcttttaattttaggctgaatgggattggtagcaatgttgctactggtgggtggttcgtgaacgaaggcgaggctgtcctccttgctcaccatgatgctgacaattcatcaaccttccaggaaaaagctgtatatatgccaccctcagaagtttcacccaacacatggagagattgttgggtaattcgtgcccctggttctgatggttgctctggaaggtttgtagtagctgcatctgctggcaatactatggactcaggattttgctcatgggacttttacaccaaagaagtgcgtgctatgcaagttgatgctggaacagcctcctcaagaattgcacttagaccgttaccaaacaacattagaagaaattctacatctagcactgttacagtagaagctacgcagtggtggtataggccctgtggacctctcatcgtctctaccaccagctcacagagagctgtgaaagtttttgatgttcgcgatggagagcaaatcatgaaatgggatgttcagaagcctgttttagcaatggattattgcagccctttgcaatggaggaacagagggaaagtagtggtagctgaagctgaatccatttctttgtgggatgtgaactcacttacagctcaagctctgctctctgttcctacaggcggtaaaaaagtttcggctctccatgtgagcaacacggatgcagaattgggtggaggggttcgcaaaagagtaagttcatctgaggctgaaggaaatgatggtgtgttctgcacctcagattctatcaatgtcttggactttcgccagccatctggtgtaggccttaagatatcaaagcatggtgtcaatgtgcaatcagttttctctcgcggggattctgtcttccttggttgttccagcacaagttcaatgggcaagaagcagacctcactgctgcaacagttttcgctgcgcagacaaggactgttcaccacctatgctcttccagaatcgaattcacactcacaccatgcagcaatctcccaagtttggggtaattctgactttgtcatgggtgtttgtggcctaggactgtttgtgtttgatgcagtgaaagatgatgcactaagggttctcaacatggactactccagtgatcaaagttttagagaagtaattggtccagatgacatgtattgtccttcctttgattatcttggatctcgagctcttctgatatcaagagatcgacctgctat

SEQ ID NO: 105939 - DNA, 630 bp, Glycine max
  Peptide Sequence Number=SeqID_222717
atgtcgaccaaggtgaaaggcatccttaaaggacttagatacatatcccaaatattcgaagagaaagaagaagaatttcaaattgggttgccaactgatgtaaagcatgtagcacatattggatcagatgatccatcagcaaatgcaccaagctggatgaccgatttcaaaggaggaaaagaacccccatcaggaaaccctactcagacagttgaagaacgtgagaaaaaggcatcatcaaattccaaacgttccaaaattcgcaaccacttgattcctaagtctcggcacaattcaatcgacattgatcctgacgcacccaaacagaaggccacacgccgccacaatcgctcttcagacccctccgcggactcctccaaccatgaatcctctagcggctcccgccaacgccaccaccgtggatccaaccacgacccagggtctctatcatcgcaagagatgccgccgaccggccccaaaaccaatcgaagaaaatcgaaggcctccgaagacggttcaacgaagaagccctcatctcggagatcgtccaaaggagattctctaactgatatttctatttcagattttggatctgactctaggcctgaaagtgagctcacgacccattag

SEQ ID NO: 105940 - DNA, 375 bp, Glycine max
  Peptide Sequence Number=SeqID_222718
atgaagctcatgtcgccttcaagacgtgtgatacgtgagtccattgcatcaaagcgatcaccgacgaaagcccgaagatcccatagctcaattaggatgtcatgcaataaggaagaggaggtatctcattacgatggtggagagggtgtgcgttcatcgggaatgagaggttgcaggtcttgtttactcacccattggccatccatatccttttggtatccgaaggagtcatcggaagaaaacagagtcaatgacttgggagatgaaaaagaaggaggatttggtgggtcaccgaatgtgccgtggtggcattggcctgcaacggtggtggtggaggatgaacactttctcttctttgagggttcttccatttga

SEQ ID NO: 105941 - DNA, 606 bp, Glycine max
  Peptide Sequence Number=SeqID_222719
atgagcaacgtattggttctgaaatcaagcatcctggcgacctattctcaatctaaccaactggccgatttcttcgtagagcaatggagcaacgcccacagcggcgacaccatcaccgtgcgcgatctggccgcacagcccatcccggtgctggacggtgaactggtcggcgcgctgcgtccttccgatgctccgttgaccccgcgtcaacaagaagcgctggccctgtctgacgagctgatcgccgagctgcaggccaatgacgtcatcgtgattgccgcgccgatgtacaacttcaacatcccgacccagctgaaaaactatttcgacctggttgcccgcgccggcgtgaccttccgttacaccgaaaacggtccggaaggcctggtaaaaaacaaacgcgcggtgatcctgaccagccgcggcggcattcataaaggcaccccgaccgacctggtggaaccttacctgcgtctgttcctgggcttcatcggcatcaccgacgtggagttcgtcttcgcggaaggcatcgcctacggcccggaagtggcgaccaaagcacaggaagacgccaaggcgaccctgtctcaggtggtgtctgcctaa

SEQ ID NO: 105942 - DNA, 297 bp, Glycine max
  Peptide Sequence Number=SeqID_222720
atggatttcttggtggctttgttccgaaacttaatcgagcatgaagattggccaatgtcacaagcatgtacagattcgtataacaagactctgaagaagtggcatggctggcttgctagttcaagcttcacagtagtcatgaagcttgctcctgataggaagaagtttatggacgtgataggaggcactggcaatatcagtgctgacattgagaaattttgtacaaccttttctcctctccttgaagagaatcacaagtttttgcatattccattgataatcctagcagttccatga

SEQ ID NO: 105943 - DNA, 555 bp, Glycine max
  Peptide Sequence Number=SeqID_222721
atggatggagagggcatggctgagatcaaatcattgggagagcaacatcaaatggaatggaatgacaccatgagtttgggcacttcagcttggtggttcaattgcttaaagaacatggaacatgaagtaaaaaatgaagatggtgcatgtcatatctttgatgaactcaatgaatttccaaccgggttgaataatgcaaatgagtggtgcttagaacatagctccgaggattacttccaagattataccgtaccttgcatagctgcgaaaagattctataaatctttccaagtaaaaataatggaaccaaaaattcttaaaaggaaaaaacagacaagaactagaaggccacacacagacattgttgacagaaggacaggaaaagggtatactatttgcatcaaaatggtccaagttctgtcttctgaacagactcaacttaaacagaaatatagaggccaaggttttaaatatcggttgcggtggcattgcggttttgtcacgcttattgatatcatgacaaatcatggacaaatgtggttgatgcagttttaa

SEQ ID NO: 105944 - DNA, 321 bp, Glycine max
  Peptide Sequence Number=SeqID_222722
atggcagataagtttggagctgctatggcccttgttaaatctgacataggtggtaacatatcgagattggaaactatgtattcttccaatccaaccagatttaactacctgtacagtttggtacaggtagaggttgaaactaaaacagctaaatcatcatccagttgtaccaatggacttctttggctcacaagattcaacaggacaaatgctagaacaagctttgaggtgaaaattggaggtcattcctaccgcaagttacatggtttagctaacttggttcttctgcacatagtgatagaaaaatggagggagatgtaa

SEQ ID NO: 105945 - DNA, 300 bp, Glycine max
  Peptide Sequence Number=SeqID_222723
atgtatgctatgatgcttgccactgatgacatagagtctccaacatccacattgtgcttccccgagagaacaacaagtagtgagggtgcaattgaaactgtgaatggtgggggtgacagtgagtcgtggaggtacttcaccaaacacaacaatgaagaagaactcgttgaaactgatgagaagagaataatgtacgacacgatgtcatgtttgcaagacgatgatgacattatggtggctgttgaggcattaagaggtgcggatgagtttcaagaaaattggaaattgaaaggagattaa

SEQ ID NO: 105946 - DNA, 334 bp, Glycine max
  Peptide Sequence Number=SeqID_222724
caatcggagagaggatagtgatggaattgaatttgaaagtgattcatggagtgaggatagtggaagtgataacctatctagatcattaagtaacaattccagcaaagcttgggaggatgctgtttctgaggattcaagctgtgaccaggagggttcatggctaagggataacaagcttggctacctttacttacagtatactgagatggcttctccttactcaagggttccactagcagagaagatagacaagttagctcaaagccacccggcattattgacattgaagagtgtggatctctccccagcaagttggatggctgtttcttggtga

SEQ ID NO: 105947 - DNA, 663 bp, Glycine max
  Peptide Sequence Number=SeqID_222725
atggtcaaaaaagccaacgacaaatggagaatgtgcaccgactacattgatctcaatggggcatgccccaaagacgcgtaccctctgcccagcatcgacaggctagtcgatgggaagtctgggttccaagtgctaagcttcctggacacctactctagatacaaccaaatcagaatgcatcctccagacaagcggcaacaagttcctcgacttcatgatcacacaccggggattgaagccaaccccgacaaatgcactgccatactcaaaatgcacaacccaaccaacatacaagaagttcagaagctcaacgataggttaccatccctgtccaggttcctcccaaagctcgccaaaaaggcgaagcctttctacaaactgctcaagaaaactaagtccttctcatgggacaagactcgtgaacaagcctttctggcttttaagaagaccatagccacaccgccaattttgagtagacctaggctaggagcacccctactcttgtatctgttagtagctgacaaagatgtcagcttagccctcgtacaaaaggaagggaaacaccaactccctatcttcttcaccagccacatgctccgtgacattgagaagcgctaccaaatgatcaaaaaggtggcactagcactcgtcacctcaacctga

SEQ ID NO: 105948 - DNA, 243 bp, Glycine max
  Peptide Sequence Number=SeqID_222726
atggctgactttctagcagaattctctggaaataacacaaccaccccaggctggtggatcctttatgttgacagtgcatccaacgtaaaaggaagtgggatagggatcatcctcaaaagccctgacattatcactctagagcaagccctcaaactcaattttagagcctcaaacaaccaggcagagtacgaagcgctcattgcagatctgaagctagcaagagaagtcagagccaagatgtag

SEQ ID NO: 105949 - DNA, 466 bp, Glycine max
  Peptide Sequence Number=SeqID_222727
acagaagcacgacaagcacaaagcaaacactaaggccgacttgcacaagtcgaacaagaggcacaagccagacaagtgccagcctctcttcaaagggctcaagtatgagcgttacacacctctgatgcccaatcataccatgattctcgaggaagcctgcaacctagaggtacccatccggctaccccagatgaaacctcctaggtcgaggtcagatgcaatcaagtactgtagggacttcaagggcatcaattctgtcaaccaatacgaccatgtggttgtctccatcatcatagcaaactttatggtgtctagggtcctcatcgatcaggacagttctgttgatatcctatattggaaaaccttccagagactcaaggtctcacccgacactgtccaccctcacgccgatccactcctcgactttccggcaagagagtcgagactagaggctatgtgcacttga

SEQ ID NO: 105950 - DNA, 1494 bp, Glycine max
  Peptide Sequence Number=SeqID_222728
atggttctttttttcgctttgattctcctcgggtttcttcttggggtggtggcggttgtggctgccgaagctcttgggtttttgtgggtaataaaacgattgcaaagcaagatcagcaaagaccaagcgaaaatcgcgtcgaaaacgcaactgggtggtgctcaaagtgatcatccccaacaacaattgctaaaaaaggagggtgtggtttgggttttggagcctgataaggtttcaaaattttgggtggagaaacagtcaaaggagcagaagaggaagaaagaagtgttggaggtgactcctgttaggaagtatgggaaaatcaatgggcaatcacttgtgcttacagacactgatggctttcacaccaccattcagcttaagggatgcttagtggaagctgtttcagctacaagtcttccttcaaaaaaatgggcaaaaaaattccccatcaaagtggaagccaagacctctgtgatctaccatgcaagcaaaactttttacatatatcttgagactgcatgcgataaagaagcatggtgtaaggccctccgtctggcttcttctgataaaaaagaaaagcatgagtggtttgcccagttgcaagatgggtttcatagctatttgtcatcattaaatactgaacatcactcccttgcgaaaccatcggtaggatcaagtgctgaggcaatagaaagggctagtaagcctgatggtagttcctcaaaggttcgacaatttttgaaaaaacttacaaaaaaaagttcccgagttggtgtggaaaataaatcagcttggacttcattatcaggccgtgaagaaagaaagcacactgagaagcttcatgcttgtcaagatgcagttttaaccactggtttgatgaaatctgctgcagcagcaaaccatctgaaaagtcccctgttagacaatgctgcacaatcattttcaaccttatctcattcaggaagccagagtcaattctctgtcagttctgatgctgatgccgatgaaaagccaggtattgatgaaggaacattatgttggaatttgttggtttcccgactcttttttgatgtcaaaggaaatgtacaaatgaagaagtccatccatgaaaggattcagaggacattggcaaatatgagaactcccagttatgtaggggaagtaatctgtacagacatcaacatggggaatgttccaccccatatcattcgaatgagggttcttccaatggaaatgagtgaggtgtgtgccttagaggttgacattgaatatgctggtggtgcattattagagattgaaacaaggcttgaagtacgtgaaccagagcatgaaagggggacagaggactcaaatccagagtcgagcaatgttggtgctgtgccatcagatcttcttgaaggatttgaatgtttgggtgagcaattgaatcttgcagaagggatgaatgatttacaggagccaaaaggagatggtgagtggaacattggttag

SEQ ID NO: 105951 - DNA, 1584 bp, Glycine max
  Peptide Sequence Number=SeqID_222729
atgtcagggtggacgtggttgagtggggtcccaaacttcacacatcagctaggagaagtgccattgacaggaggggggacctggaaaacaaaggactttgtcgctcaagccaaacgtccgcgctcctatagtagggctaacgtggagggtggacacatgtcttcgggtgccacgtgggatgccactagattgtcctgtgtcgaaggagtctgtctaatgtctggagtagtagtcttgacaagtagagggttgatgtggcttgttaagcccctgagcctggacaagtcttgtccgagctgcttctctcaggttgtctgtgttggacgtgtctttggtgtgtcaagtaagggcaccactttgactcctgccagctcattctcgattccttgcactttcttggctttcgatttccctttcttcccttgtcagcttctaaaggtgcttccatccaccgcaatgtctttttttctgtctgattccgccattggactaggtgggagtgattctagggctcgattgagcaacctatcatggattgagaggtcatctcaatatgcaattccttgtttgaggatactcatcgaggtgcctctgatagcaagtcctcctcctcagagaggcgtaagtgctgggtcaccatcatccaccccgatcgttgctggctatgagtgggcttgcgtgaatgatgacttcccattttttagggtggcacctggtcgtccgcccttcttctttatgtacagatgtctgtttgaggactttgagattcagtgcccattctcaacatccgacctaaagctattcgagtttaactcaaacatctttcgccattttaaggaccattttttcaaggtccttgctactaatgtcatggctgatggcatgccattgatgcttaacagggacggggagccctgcttcccattctactgcgatcctctcgttgtcttggatggtactatgggtgacttcacctggaggccactcgcgaagcaggttggacttataggtgcaaccctaccaccatctgttgctgctccgtttattggagaaaatggtcaacctgccagagaggttggccctgctgctgttgctgttgaggatgatggtgctgggccgtctggtcgtaagaagccgaaggcctttatgagcctttgtgccctgaggcaggctgcagggctaaggcctactgtaggttgcctcacgactgtgcatgatatgtctccgactccattgatcatcgagactcctgctactgctattgctgctagtgttactccttctacttctgctcattcacctcttctcacgcttttgtttaagagtgtcggtgtggtgatcactagtgctcccacggtgccgcctgcttcttcgtcggctccgatggtcttccttgttgttgttttggtggttatggtgttgccttcttcatcctcatgccctagcatctctcttgatcatttatacacctctagtgatattgacacactatggggtgcaacttacaagctggagcagaagaccccaactatgggtgtggcaattctggaggagaatgaactgcgacaccaagaggctatgtag

SEQ ID NO: 105952 - DNA, 1740 bp, Glycine max
  Peptide Sequence Number=SeqID_222730
atggcacactctggtgtccatggcaacaacctcacctaccctttgctcctcaaggcctgtgctaacctcccttccattcaacatgggacaatgcttcatgggcatgtcctcaaacttgggttccaagcagacacctttgttcaaactgccctggttgacatgtactcaaaatgctcccatgtcgcatctgcacgccaggtgttcgatgaaatgccgcagagaagtgttgtctcatggaacgccatggtttcagcttactctcgcagatcttcgatggaccaggcattgagccttttgaaagaaatgtgggttcttggttttgagccaactgcttccacatttgtttcgattttgtctggttattccaacttggattcttttgagtttcatttgttggggaagtcaatacactgctgcttgatcaaacttgggattgtgtatttggaggtctccctggccaactcactaatgggtatgtatgtccagttttgcctgatggatgaagcaaggaaagtttttgacttgatggatgagaagtcgattatttcttggacaactatgatagggggttatgtgaaaattgggcatgctgtggaagcatatggtttattttatcaaatgcaacatcaaagtgttggcatagactttgttgtgtttctaaatcttatttctggttgcatacaagtaagagatcttttgttagcttcatctgttcactctcttgtacttaaatgcgggtgtaatgaaaaggatcccgttgaaaatttgctaattacaatgtatgcaaaatgtggaaaccttacatctgctagaaggatatttgatctgatcattgaaaagagcatgttatcatggacatcaatgattgcaggatacgtccatttaggtcatccaggggaagcactggatctgtttagaaggatgattaggactgatattagaccaaatggagcaacgcttgcaactgttgtgtcagcttgtgcggatttgggatcactcagcattgggcaagagattgaagagtacatttttctaaacgggttggaatcagaccaacaagtccaaacgtctctcatacacatgtactccaaatgtgggagcatcgtgaaagccagagaagtatttgaaagggtaacagataaagatttaactgtttggacttctatgataaatagttatgcaatccatgggatggggaatgaggctatcagcctctttcacaaaatgacaactgcagaagggataatgccagatgccattgtttacactagtgttttcctggcctgtagccattccggattggtagaagagggactgaagtacttcaaaagtatgcaaaaggattttggaataactcctacagtagaacactgtacctgtttgatcgatcttcttggtcgagtcggccagcttgacttggctttaaatgcaattcagggaatgccaccagatgtccaagctcaagtttggggtccattgctaagtgcttgtaggattcatggcaatgttgagcttggggagcttgcgactgttaggttattagacagtagtcctggaagctccggaagttatgtattaatggctaacttgtatacctctttgggcaagtggaaggaggcgcatatgatgagaaattcgatggatggtaaaggattggtcaaagaaagtggctggagccaagttgaggtcactgatacctatcatacatttgctgtgggaaatcagtcacaggttgcttag

SEQ ID NO: 105953 - DNA, 984 bp, Glycine max
  Peptide Sequence Number=SeqID_222731
atggtgtcaactggccttgctgctctaggataccaatatattaacatagatgattgttggggagagctcaaccgagactcaaagggcaatttggttcccaaagcctcaacgtttccttcaggaatgaaggctctagctgattatattcataaaaaaggtttgaagttgggaatctattctgatgcaggaaatcaaacatgcagtaaaactatgcctggatcactaggacatgaaaaacaagatgcaaaaacatttgcttcctgggggattgactacttgaagtatgataactgtgagaataacaatataagccccaaagaaaggtaccctccaatgagtgaagctttggcaaacactggaagaccaattttcttctctttgtgtgaatggggatcagaagatccagcaacttgggccaaaagtgtgggaaatagttggagaacaacaggagacattgaagataagtgggaaagtatgatatctcgtgcagatctaaatgacaaatgggcttcttgtgctggacctggaggatggaatgatcctgacatgctagaagttggaaatggaggcatgacaacagaagaatatcgcgctcatttcagcatatgggcattagctaaggctcctttattgattggttgtgacattagagcattggatgccaccacaaaagaattgctaagcaacaacgaagttattgcaagaatgcttttaaaactaataaccctatggtattgcagacaagcttggagttcaaggaaagaaggtcctctcagtaataacaaggtagcagtgatcttatggaatagaagttcatccaaagcaaaagttactgcatcctggtctgacataggcctgaaaccaggaacttcagttaaagcaagagatttatgggcgcattcaacacaatcatctgtttcgggagaaatatcttctgaattagattcacatgcttgtaagatgtatgtcctaagtcctaactaa

SEQ ID NO: 105954 - DNA, 684 bp, Glycine max
  Peptide Sequence Number=SeqID_222732
gcagtaatccgggaaactttagtgctcccaaattgtgaaagcatatgcattccatggatgctagctgaaaaggacgattgggttcctaggagtgttgctccgttcatatgggtccacccagaattggggaacgagacttcaacctcagttgataccaataatcaagcttgtggtggattaaaagccagtgctagcaccttaagtgatgatggtccagaactcaaacaacataaaccaccaaagtgtcccaaatctagtcaggaaccagctaggaaatcagattctgtggcactcacaccaatttcctctagttcagtaacattaaggagcagcaaaagttcagaagaactgacaagacctttgttagagaatgacaaaccaccagaaactagagatttgcaagaacttagaactacttcattgcagaatgacaatactaatgaagctagtgaagctagtgaagagaagatgggagatatttctgtgagtgaatcacctccccgaaatgtggtgctggataaacaacatcgttcaattgaacgggatgattcaaggccaaagaaaattgggagaagggaaaaaattctggatttgaaaaagagggtgagtgagaaattggaagaacagaagcgtaactttgaagaaaagagtaggcacattgtcgagaagatgagaggaccatga

SEQ ID NO: 105955 - DNA, 1767 bp, Glycine max
  Peptide Sequence Number=SeqID_222733
atggtcttgtgtattgaacttgaggaatactatccagaagaaagagatgctttgatgctcataagggattctttgaattcttctgtcaatttgcatgggaattggacaggccctccttgtatagacaatcgtagtagatggattggtatcacttgttcaaattggcatgttgttcaaattgttcttgaaggagttgaccttagtggttatttacctcccacattccttctaaacataactttcttgagccaacttgacttcagaaacaatgcactttctggaccactgccaagcctcaagaatttgatgtttttggaacaagtcctgttatcattcaatcacttctcagggtcaattccggtggagtatgttgaaattcctagtctacaagtgttggagctgcaagacaattacttagagggtcaaattccaccctttgaccaatcatcattgacaagtttcaatgtgtcatataatcatctgtcagggcctattcctgaaacttctgtgctgcaaaggttcccagagagttcatatggtaataattcagatctttgtggagagccattggataagttatgtcctattgaacctcctgccccatctccatctccattcccagcactgaagccaaataagaggaggtttcaagcatggattgttgctttgattggtggtgcagctgcactgattcttctttctctgatcattattattgctttcatgtttcgtaaaagacgtacaaatggaaaagaatcaataagaaatgattcaacagagtatgtttttagggcatgggcaaagaagatggtgtcttatgctgggaacagtgatgtttctggaagattagggaaattggaattttccaacaagaaattgccagtttttgacttggatgatttattgagggcatcagcagaagtgctaggaagagggaacctaggcattacatacaaaacaacacttgaaacaggaactgttgttgcagtgaagagacttaaccacatgaatgaactcaacaaaaaggaatttctccagcagatgcaattgcttggccagatgaagcatgaaaatctagtagaaataatctccttttattattcagaggaccaaaagttgatcatatatgaatttatctctgatggcactttgtgtgaactcctacatgagggtagaggaattggaagaataccacttgattggaccacaagactttccatcatcaaggacatagcaaagggtcttgttttccttcatgactctttgcctcaacacaaggtccctcatgccaacctcaaatcatcgaatgtcctaatccatcaagatagtaaaggttaccattccaagctcacagactatggtttcttgccactactctcagccaaacagaatgcagaaaagctagccataaggaggtctccagaatttgttaaagggaagaagctgacacacaaagctgatgtctattgctttggcatcattatgctagagattataactggcagaatacctggtcatatcctaggtgaaattgaagaaacaaccaatgatctttcagattgggtaagaactgtggtgaacaatgattggtccacagatatattggatttagaaatactagcagagaaagaagggcatgatgcaatgttgaagttgactgagttggctctagagtgtacagatatgacaccagagaaacggccaaaaatgagtgtagtattggtgagaatagaagagatagagcaaatgagaaaagagaatgactga

SEQ ID NO: 105956 - DNA, 3030 bp, Glycine max
  Peptide Sequence Number=SeqID_222734
atgacaataccattaattcaattatgtttggaatttccatgtcacatttttcttgttttgttcttcttgcttggtcatacaagctcacaatctttgtatgatcaagaacatgcagttttgcttaacataaagcaatacctgcaagaccctccattcctctccaactggacttcaacttcctcctctcactgttcatggccagagatcatatgcaccacaaactcagtcacttccctcactctctcccaatccaacatcaacagaacaataccatccttcatctgtggcctcaccaacctcacacaccttgacttcagcttcaacttcatccctggtggcttccccacacccctctacaactgctccaagttggagtaccttgacctttcagggaacaactttgatggcaaggttcctcatgacattgatcaattgagtgctaatttgcaatatctcaaccttggttccaccaatttccatggtgatgttccttctagtattgcaaagttgaagcaattgagacaaattaaactacagtattgcttattgaatggatctgttgctggtgagattgatgacttgtccaaccttgagtacttggacttgtcctctaacttcatgtttcctgaatggaagttaccttggaacttgaccaagttcaacaaattgaaggtgtttaatttgtatggcaccaatttggttggggaaatccctgagaacattggagatatggtggccttggacatgctggatatgtcaaataatagcttagctggaggaattccaagtggtttgttcttgctgaagaatctgacctcactccgtctttatgcaaatagtctttctggggagataccaagtgtggtcgaggcattgaacttggccaaccttgatcttgcaaggaacaatcttacagggaaaatacctgatatttttggaaagctccaacagttatcatggttgagtttgtctttaaatggcttgtcaggtgtgataccagaaagctttggcaatcttccagctctcaaagattttcgcgtgtttttcaacaacttatcaggtactcttcctcctgatttcggccgttactcaaagcttgaaacctttatgattgcatctaatagtttcactgggaagttaccagacaacttgtgctatcatgggatgttacttagcttgtctgtttatgacaataatctgagtggtgagttgccggaatcactaggaaattgcagtggtttactggatttgaaagttcacaataatgagttttctggtaacattcctagtggtctttggacatctttcaatttgacaaatttcatggtgagccataacaagttcactggtgtgcttcctgaaaggctatcttggaatatttcaaggtttgagataagttacaaccagttttctggtggaattccaagtggagtgtcatcatggactaatttggtagtgtttgatgcaagtaagaacaattttaatggaagtattccacgacagctaacagctcttcctaagttaacaaccttgttgcttgatcagaaccaactcactggggagcttccatcagatataatatcatggaaatccttagtagctctaaatttgagccaaaaccaactctatggacaaatccctcatgcaattggtcagttacctgcccttagtcaacttgatctatcagaaaatgaattctctggtcaagttccttctctaccccctagactcaccaatctcaatttgtcttctaaccatttgaccgggaggattccaagtgaatttgaaaattctgtgtttgctagtagctttttgggcaattctggtctttgtgctgataccccagcactgaaccttaccttatgtaattctggccttcaaagaaaaaataaaggctcatcttggtctgttggtttggttataagtttggtgatagtagccttgttactgatccttttgctatcactcttgtttattagatttaacagaaaaagaaagcatggattggttaactcatggaagctcatttcctttgagaggcttaatttcacagaatccagcattgtctcatcaatgacagaacaaaacatcattggtagtggtggatatggtatagtataccgcattgatgttggttcaggctatgttgctgtgaaaaagatttggaataacagaaagttagaaaagaagctcgagaactctttccgggcagaagttagaatactgagcaatattcgtcataccaacattgtgagattgatgtgttgtatctctaatgaggattctatgctccttgtgtatgagtatctggaaaatcatagcctagataagtggctgcacaagaaggttaagtcaggttcagtaagtaaagtggtccttgattggccaaagaggttgaaaatagccattggaattgctcaaggtttgagctatatgcaccatgactgttcaccacctgtggttcatagagatataaaaacaagcaacatccttttggatactcaattcaatgcaaaagttgctgattttggactcgctaagatgctaatcaagccaggggaactgaacaccatgtcagcagtgattggctcatttggctatattgctccagaatatgttcaaacaacacgagttagtgaaaagattgatgtgtttagctttggggtagtcctattggaactgacaactggtaaagaagcaaattatggagaccaacactcatctctttctgaatgggcgtggcgtcacgttctgattggaggaaatgttgaagaattgctagacaaagatgtcatggaagccatttactcagatgaaatgtgcactgttttcaaacttggggtcctgtgcacagcaacactgcctgcaagtaggccttcaatgagggaggccctacaaatattgcaaagcttaggagaaccatttgcttatggagatcagaagaattttggccactactatgatgctattccccttctcaagagttcagaaaaggaaactaggttggatgttgttgatcatagcgaatga

SEQ ID NO: 105957 - DNA, 732 bp, Glycine max
  Peptide Sequence Number=SeqID_222735
atggcaggaagagaagttcgtgaatacaccaacctcagcgaccccaaagataagaaatggggtaagggaaaagataagattgacgatgaagacattactttccaacgcatggttgcaaagatgcaagaggttgctggggagcgtggaggttaccttcatggacgaggcgccttggacagtgatgatctactttatctcaaggagcaaatggaagccgaggaggatgcagagcgcctcctgcgtcgcactgaaaaacgggcatttgctgcatttaagatatccttttgtgctgcgtacaatgaccctcctccataccttcacatagtgacgagccctttggcacctggagctgcaagtttagcagattcttcacccacctcagtacctctggcatttcgggttgagccgaaacccaaaagtgggatcaggcagcaagatttgctgaagaaagtcgttgagattaaacctaagcggccaagatgtgatagcaatcagtcaacccctgctagtaatgctcctgttacaaatcgtaagccttatcacgattcttcaaaagagaaagagcagtctttaccgggaacaaagaaagtggaggaacaatctttgtctggatcaaagaaagcaaaggaacatgcttcattagggtcacaagaagccgaagctaagcctaaggttgaaagctctggtgggggattactgggcctggcatatgatagttctgatgatgaatga

SEQ ID NO: 105958 - DNA, 1356 bp, Glycine max
  Peptide Sequence Number=SeqID_222736
atgagagaaaatatttcagaatcatggctagttatgatcactgtgatattggccactgcaatatttgcaaaactatttcaattcaagttaaggaaggaagataaaagcaaatgcagattaccaccaggaaggagaggctggcctttgattggtgacagcatcaattggtacaatgctgttgcaagttctcatcctcctcagtttgttgaagaaatggtgaaaaggtatggtaagatattttcatgcagcctatttggaaaatgggcagtggtgtcagcagatccaagcttcaaccggtttgtgatgcaaaacgaaggcaaattatttaagtcaagttaccctaaatctttcagagatttggttggtaaaaatggtgtgatcacagtgcaaggagagcaacaaaggaagctacatggaattgcctccaacatgatgcgcttagagaagcttaagttccatttcttgaatgatgtacaaaaggtcatgctccaaactttgagcaattttaacaacaaccaagtcattcttctccaggatgtttgtaggaaggttgctatacatttaatggttaatcaacttttgggggtttcaagtgagtctcaagttaatgaaatggctcagctgttttctggcttcgttgatggttgtttatccattcccatcaacatccctggctatgcataccacactgctatgaaggccagggagaaaatcataagcaagataaacaggaccatagaggtacacagacaaaatggtgcttctattgaaggtaatggtgtacttggaagactattagaggaagaaagcttgcctgatgatgctgttgcagacttcattatcaatcttctctttgcgggaaatgaaacaaccaccaaaacaatgctctttgcagtctatttccttactcaatgtcctagagccatgaagcaactgctggatgaacatgattctctgaggagtaattctggagataaatttctcacatggcaggattataaagcaatgtcattcactcaatgtgttattgatgaaacactaagacttgggggtattgcaatttggttaatgagagaagcaaaagaagacgttcagtaccaagattttgttattcccaaagggtgctttgtggttccatttctttcagcagtccatttagatgagaatgtatacagtggggctctaaattttaatccttggagatggatggaacctgaaaacgaggaaaagagaaattggagaactagtccattctatgcaccctttggaggaggtgctagattctgtccaggaacagagttggctcgcctccaaattgctttttttcttcattacttcgtaactacctataggtaa

SEQ ID NO: 105959 - DNA, 192 bp, Glycine max
  Peptide Sequence Number=SeqID_222737
atggacagacacaggccttgccataatggagttaaacactatgaaagcttctccatgaaagaagaagaatttgtggacaacatgtttggaagacttcaagtgattttgaatagtcttgaagctttaggatacaccttcaccaaagctcagataaatagattctatacaactttcccaaggagttacttctag

SEQ ID NO: 105960 - DNA, 660 bp, Glycine max
  Peptide Sequence Number=SeqID_222738
atggtatgtagggttaaaataaatccaaaaaatgcgataaatgagcacttcttgccatgcttcctagacttcattgtgtggggccatgagcatgaatgtttggttgacccgcaggaagttccagggatgggatttcacatttcgcaaccagggtcatcagttgctacatcacttattgatggagaatccaagccgaagcatggaaatcaatatctcccaactaagatacctttgatgtctgtgcggccttttaagtatactgaggttatactaaaagataagtcggatattgatcccaatgatcaaagttctattcttgaacacctagacaaagtgatgatgacaaaggtgaagacaaaaagctcaaaggtcaaacaaagaatgagttcaaaatgttcaagatggaatcaagaacaattcaagactcaagaggaaaagttgaagaacacttcaagattcaagaggaaagatgaattcaagaatcaagattcaagatcaagattcaagattcaagaatcaagagaagacttaatcaagataagtatgaaaaggatttttcaaaaattgagtagcacatggatttttcataaaacatgtttaccaaagagtttttactctctggtaatcgattaccagattgctgtaatcgattaccagtag

SEQ ID NO: 105961 - DNA, 261 bp, Glycine max
  Peptide Sequence Number=SeqID_222739
atggtgttttgtactattgatgactttccaacagatggaaatttcactggatatagtgtcaaaggacaccatgcatgtcctatctgtgagagaaacacaagctttacccaattgaaacatggaaagaagaaattttatacaagacaccgaagacttcttaaaccttatcacccgtatcgacgattgaagaaaacttttactggaagtcaggagactgaaagtgcgccggaaccattagctgtaaacgaagttcatgatcag

SEQ ID NO: 105962 - DNA, 258 bp, Glycine max
  Peptide Sequence Number=SeqID_222740
atggaagcagttaggggacataaaagaacagaacatggcaggtggcatttgattttgtggttgagagagataggaaatcatttctacaaaagatttgaagttctcagagtgatggaaaaaggatcatatatagctgacaataatgggggaacaactaaggtacttcttgcagcatgcaccaatgaagatcagactgagcaagttactactgtcattagaacaatgcacaaggatatgaagactgttttgccattttaa

SEQ ID NO: 105963 - DNA, 2070 bp, Glycine max
  Peptide Sequence Number=SeqID_222741
atggtgcgggaaaaggtgaaacctgatgagagaacttatgctggggttttgaggggttgtggtggtggtgatgttcctttccactgtgtggagcatatacaagcaaggactataactcatggttatgagaatagtttgttggtatgcaatcctctgattgattcatattttaaaaatgggtttttgaattcagctaagaaggtttttgacagtttacagaagagggatagtgtttcttgggtagctatgctatccagtttaccacaaagtggatgtgaagaagaggtggttcttctgttttgtcagatgcacacattgggagtctatcctaccccttacattttttcgagtgttctaagtgcctgtacaaaagtagagttttttaagcttggagagcagctccatggctttgttctgaagcaggggttctcttcagaaacctatgtttgcaatgcccttgtgacattatattcaggtttagctcaacaaggatatagtgacagagctttagagttgtttaagaaaatgtgtcttgattgcctaaagcatgactgtgttacagttgcaagtcttttgagtgcctgttcatcagttggggctcttctggtgcaattccacttgtatgctataaaggctgggatgtcttcagatattatcttggaaggtgcactgcttgatctttatgtaaaatgcttggatataaaaaccgcccatgaatttttcctttcaactgaaactgaaaatgtggtgttgtggaatgtgatgcttgtagcttatggcctgttagacaatctaaatgaatcatttaaaatatttactcagatgcagatggaaggcattgtaccaaatcaattcacctatccaagtattttgagaacttgctcttctttgagggttcttgatctaggagaacaaattcactctgaagtcctaaaaactggctttcagttcaatgtgtatgtctctagtgtgcttattgacatgtatgctaaacttggaaaattggataatgccttaaaaatctttagaagactaaaagaaacagatgttgtttcttggacagccatgattgctgggtaccctcagcatgaaaagtttgctgaaactcttaacctctttaaagaaatgcaagatcaagggatacaatctgataatataggatttgcaagtgcaattagtgcatgtgcaggtatccaaacacttaaccaaggacagcaaattcatgctcaggcatgtgtctctggctattcagatgatctttcagttggtaatgcactcgttagtctttatgctaggtgtgggaaagtacgagcagcatactttgcttttgataaaatattttctaaagataatatatcacggaactcattgatatctggttttgcacaaagtggacattgtgaggaagcactgagtctattttctcaaatgaataaagctggactagaaatcaattcattcacttttggtcctgcagttagtgctgctgccaatgttgctaatgttaaactagggaagcagattcatgctatgattataaaaactggccatgattcagaaactgaagtttctaatgttttgatcacattatatgcaaaatgtggtaccattgatgatgctgagagacagttttttaaaatgcccaagaaaaatgagatttcttggaatgccatgcttactggttattctcaacatggccatgaatttaaagcattaagcgtttttgaggatatgaagcagcttgatgtattgccaaatcatgtcaccttcgtggaagttttatcggcctgtagccatgtgggtttggttgatgagggaattagctattttcaatcaacgagtgaaattcatggtttggtgccaaaacctgaacattatgcatgtgctgtggatattctctggcggtctggtctcttaagctgcacaaggagatttgttgaggagatgtcaattgaaccaggtgcaatggtctggaggacccttttaagtgcttgtattgttcataagaatattgatattggagagtttgctgcaagtcatcttctggaactggacccaaagattcagtaa

SEQ ID NO: 105964 - DNA, 1029 bp, Glycine max
  Peptide Sequence Number=SeqID_222742
atggctcgatgtgtgactgagagataccattgctcagaaggaatccatttaaagcggctcgttggactgagatccgaccttgccagcgctggaggaaccgaagaaaggccgaatgaatcattgccgacattcgaatcagcgctaaccgcctccttgaagcgctcttcgtcgcagtggagcagcctcaccaaggcatcaagcctctacaagtcttccttaaagaagatgcttgcatgcgttagtatcttcaagacctttgatcgcttggaactagaagagtctggagttctgagtgaattggttcgattgcggaaagatttttggggcttgcataagccactagtttgtccagatggcgctgtggtcgcttatgcgtggacaacttccaggacaagctggcggactttttttccagctactggtcttaagataggagaatataagcctacagcctctggatattgccaatttggacttgtggtatatgctactgagaatgaaagcatgtcctcatcatacgaagggtaccaaacaaccctcaagcttgaagatgtgccttcagttcctattgatttcagagcagagaaaatgtcggagcttttccatagcagttggccaaagccagaggaaaacagcaagcaccccgttggactaatcttgttcagatgcttctggaagcacatagccttcactggcagcacctcctgggaaggccttgttctgatactgatcctgtatttggcaaaaccaaccgaagtcctctctgtgcaccaattcaatttccactctcagaagctcggcatgctcattcactgttttgaagttggatgttattcatttcaccgaaatgctgggcctgaagatttggttgctagggaatctatgcttgctaaaatcacaaagaatcctggagaatatagtgaaccgttcttgaaggaattcaagatatttcatcaagaactcaaagacttcttcaatgctagcaggtttgacatgactatcacaaacatgactcagtatcccttgtaa

SEQ ID NO: 105965 - DNA, 936 bp, Glycine max
  Peptide Sequence Number=SeqID_222743
atgtctgattcatttggtagcacctttcactcttccgctccaaactccaccctcaattcccatgcacccccgaaaatcaccacattctgctcaatagcccaaccttattgcatttgcacccactgcaaccacatcctcaccttcaaccaccatgttggtaatttagcagaggaagggacaaatagcacagggtcccataacaataatgtgcagtctcagccgcaacatagcacaaggtggagtccaacgccagtgcagttactagtccttgaggaattgtataaacaaggcacaaaaacaccctcagctgaacaaattcaacaaatagcttcgcagttgcgccagtttgggaagattgaagggaagaacgtgttctactggttccagaatcataaggccagagagagacagaagcggcgtagaagggaaatggaggaaaataataataacaatgctgctgcttcttcttcttctggtgaagggttgaaagagacaggttgtggagttaaagagacaaagaagtgggcatccacttcaaactgcagtggacatgcagaggaatctgcactggatatagcagaaaagggatctaatgggtggactcagtttgaggagagaggcagcatacaagttttaaggagaaacatatcagaaaaacaagctaagttgcaagaaatggaaatgccttgtttccttcctattactatagcagctcctactacaacttcacacagaacaacaacacataacacacaacttttatcccctcaaaactataataatttatcatcttcactcatcaacagagaaagtttaaactactatggtggtgatgaaaatgcagattctcgaacccttgacctatttccacacaagagggatgaccaagatggaatttctcttgctgagaggaaatcatcatctatgtttgtgcta

SEQ ID NO: 105966 - DNA, 804 bp, Glycine max
  Peptide Sequence Number=SeqID_222744
atgaccgcaacgacgaaggtgcgattaatgaaagacaggggcaccggagaacacaaggattatgcctttgtggcttttaaaacaaaacaggtaactcaaaaggctattgaggagatacatagcaaggaatctaagaataataaggttgtcaatgagatacatgggtcttctactaagaagaacaaagagtaccaagagaagctacacgttgttgtgctcagggcagaggaaattattttctctaaagccaatttcgaggctgaatacatggaccttacaacacttttggagagaacaaatgatgctattgatacaataattcaacatgatgagcatacagaaactggagagtacttgcgccgttgcttcaaagaggtggtaaaatgtgctgctgatctacaccctagtggttcaaatgatgctgaaaaaaaagtgtgtaagaagcttggtgaagagggagcaagggatatttatactggagaggattttgttgcttactttatttctttgtacgatgttgctggaaagatcttgtcattttcccagaagggtccaagaggaatatgcattctctctgccaatggagctatctcgaatgtcaccatacgccaacccggttcttctggtggcatattgacatatgaggcatgttgcagacaacagtggcatgaaaagccgaaccggtggattgaatgtacgtctcacttgcatggtcctgatggtcaggtgattggtggtggtgttgctggacttttaactgcttcaggccccatccaggtttggtatatcacatgtgatacttag

SEQ ID NO: 105967 - DNA, 749 bp, Glycine max
  Peptide Sequence Number=SeqID_222745
atggggatacttagtccagaacagctccaattcttcaactctcaaggttatcttgtgattgaatctttcgcaagtagcgatgagattgagtccatgatgcagaggatggagcagttggtggatgagtttgacccttcttccaccgcctctattttctccaccaagaaccagcaaaagttgactgatgattactttttcgatagcgtggagaggatttctttcttctttgaggagaaggcatttggtgatgatggtaaattaaagcagccgaagcaattgtcccttaataaagttggtcacgaaatagagtttcatgttgataatccttgtaataaagctcttcatgagattgagccggcattcaaaaagttttcttcttctgagaaagtttccagtttgatgcactccttaggttacaagagacctgtagtcatgcagtcaatgtatatatttaagcaaccaggcattgggggtgaagtagtgccacaccaggataactcgtttctttatactgaaccacaaacgtgcaccgggctgtggctggccctagaagatgcaaacatattaaatggttgcctttgggcaattcctggatctcataaaaatgggctagttagaaggttcttaagagataaagatggtgtcaaattcgatcaaccatcaccatcttatgatcaaaaggattttgttcctattgaagtaaaagctgggtcattggttgtcatccatggggatcttatacaccaaag

SEQ ID NO: 105968 - DNA, 294 bp, Glycine max
  Peptide Sequence Number=SeqID_222746
atgagatctttgtctcaacacattggagggtacatcctttgtggtacaagtagagggtacatctacttgggtttgactgagaacaagagagggtacatctcttgtggatcagttctagtggaggatacatccactaggttcaaagagaacaagggagggtacatcccttgtggatctttgcttgtaaaaggatttttacaagtgaaattacaagcttatctcatgtcagacaccctaatatcagcagttgcaaacaatcacagtttacttggtgccaacttaaagtggaattaa

SEQ ID NO: 105969 - DNA, 249 bp, Glycine max
  Peptide Sequence Number=SeqID_222747
atggagaacttccctgtgatcaacttggagaatatcaatggtgaggagagaaagactatcttggaccaaattcaagatgcttgtcagaactggggattttttgagggaggctcagaggtacagatgcgcactgaaatgaagaagcttgacaaggatgtctctcttagtgtcattgccatgaaaactccgggattcagtggtgcagacctagcaaacctcatgaatcaagcctcgattcttgccaattga

SEQ ID NO: 105970 - DNA, 450 bp, Glycine max
  Peptide Sequence Number=SeqID_222748
atgaagctggcttctacaagcttgttttcattctcactatctagagaagctaagaggtggcttcattcattcaaagccaacagtcttaagacatgggatgaagttgtggagaaattactaaagaaatattttcctgagtctaagactacggaaggcaaagttgcgatcttttcttttcaccaatttccagatgaatctctgattgatgatttagttgaacttgaagaaattgttgaggaagcagaaggtgatgaagaaggagagatatcaataaaagactatcaagagagaataaagaaggaagaaaaagaagaagaaacaaaagaaaaggaggaaaaagtaaaaaaattgaaaaatgaaaaacaaaaagagaaggttgttgagattgaaaagaagaagggcaagagtaaggctaactcagaaaagaagaaaaaggttactctctattga

SEQ ID NO: 105971 - DNA, 171 bp, Glycine max
  Peptide Sequence Number=SeqID_222749
atgggtagcattgcagcaccaggaaccactgtcggggggggtgacttaaccagagtggtcaaaagagcgtgcaatgatttcaaccgcggtcagttcttaaccagtcttagcaaccggctttaccgaatcaaatttataaccataaaatacagagacgttcgttacacttaa

SEQ ID NO: 105972 - DNA, 306 bp, Glycine max
  Peptide Sequence Number=SeqID_222750
atgacttcccatgtgggatttcttgaccctcaagcttccttcacttccaaagctgatcatgatgtcttcttgagctcaaataattactgcaaaggcaagagtactgaagtacttgttgatagtaagaagaggaagacgtgtaataatattattggagaaggtgggtcggggttgaattatgattctgatgagatcagtgatgacaataataagatggaagagattagtgcaaggaacggtggaaacagccccaatgccaatagcaccatcactggcggtgtgcatcaaaagggcaagaagacgtga

SEQ ID NO: 105973 - DNA, 420 bp, Glycine max
  Peptide Sequence Number=SeqID_222751
atggctgaacgccgccgaaggaagaagctcaatgatagactctacatgctgctgagatccgttgttcctaatattagcaaaatggacagggcttcaatccttggggatgcaatcgagtatttgaaggaacttctgcaaaggatcagtgagcttcgcaatgaattggagtcaacacctgcagcaggtgcctcttcaagctttcttcttcatcctttgacacccactactctaccaacacgtatgcaagaagaactttgtctcagctcgttgccaagccctaatgcccaacctgctagtgctagggttgaggttgggttgcgcgaaggaagaggtgtaaaaacatccacatgttttgcaaccggaaacccggactcatgtcctcgacaaccttggataagctatggatattttcagagctga

SEQ ID NO: 105974 - DNA, 291 bp, Glycine max
  Peptide Sequence Number=SeqID_222752
atggaatttctaaggaggaagtttgacagacaattttcttctgaggaggtcctacaattgctggatcggttctacaacttagaaatgctgctggttattctattattcctttcccctcttccctcttttgggattatgttcatggtagacccgttaagtgttggtggtgttcttatcataatgtatttagctacactggtaggaattctcactaccggaacgacatttgctgcaggcattggaccttggacatttaaaatgcacggttattttgacaagcctgttggttga

SEQ ID NO: 105975 - DNA, 336 bp, Glycine max
  Peptide Sequence Number=SeqID_222753
atgatagtagcaaatggcgatggtggtgacaacaacggcagtgatagtagtaacaaaaatgacagtggtagcaatagcaatggtgacaacattgatagggtagtggtgacaatggtgggtaaatctcaagagcttccaacaatctcagctccaattcaacctgtgactgctcctatcaccataaccatatgtaaattcccattccaattccaaattcagagagagagagagagagagagaccttggggagagaggaagcagaggaaggaggaggggaaactgttattgaaaatggacacaaacaatgaactacgagctcaaattgagaaagaatga

SEQ ID NO: 105976 - DNA, 2376 bp, Glycine max
  Peptide Sequence Number=SeqID_222754
atggcaaaagagcaaaaccagggcaaaggccaagagagagaattggaactggaaagggaggttgagattgaggccccattgcctctcactgttacttctcgggttttgtatatgttgggagatatcactgcagggcctgcgtttaggttcacgcaatggctccaattggttcgtaaacgcaccgcaaattatcgttcttctggcttccctcaccgcacttccaccaccatgccttctagctcttgcatcagaggatcgttggagaattcaaaattggagctgcatcctgatcagacagaaactagcttgtgggagaggcttgggaaggctgcaatgttggacattgaatctggctccttttcctgggacatgctctcttcactgcaccacactgaacacagcagtagcaacgaacattccgaggatgagatgaacaaagctctcgaggtaactgtaaattcaggaggagttgtcttctttgcctttttcaatatccctgggaatgctgatgctagtccaaaagaagcagcagctgttataaagatagcatcatcaagaatggcaacacagtctgaacgccttggctatgaacttgccaagtggatgggagtccaaactccacaggctagagttattcacaatacctgtttagaatggcaacaaataaaggaagcttcagaaaaagctagagaagcagcaaattctgagggtgatgaaattggtgaagtgacatgttttgaacttttggaagcacttgagcttagccgatgtctcttttttatgagttatgtacatggttcacccttgcttgaaaactccagtgcatttaagtcaagggaatctgcagaaagaacgtcagaagctcttggcagggtactgatgctggaccttgtcatcagaaacgaagatagactgccttgccgtgagcttagatggcgaggaaatcctgcaaatttgctgttggctggaaagaatatctgtgcaaatacagatgcactagaagcagcttttgattctgcagttaaccgatatagaccaaaggtgatcagggcatttcataaagaaagaaggtcaacttcagtagattgcagacttgattctcataatcccggcttgatatcacaatcttctgatctctcggacatcacagaatcaccaagatctgctgacatgagctttcaaacatcgggagaatcactgtctcctgactttaacattgtagctattgattctggtgttcctcggcgaccgcctgctggaaaacgtgcaaatgatcaggttaattatcctaagttggttgagttgctggtcaatagttctgaatttgcctcaaacctgttatatgatataaccggagcgaaattaggatgtcccccaccagaagacatggaaaaaactgatgtacgtattataagtgacacaatgtttgtagttcatgcatttcgtaatggtttccgtgctgctcttagggatctgcagggattccatatattcctactcacacttcaccaaagacttgatactttgttgcgatcatttatgaacattataagcaaaatatctttgggggaatttgacaaagaagattctgtggttcctgactcaccttcactaactgctggtgggagttgttcctctccaacatgtaaggaaagacttactaatgataaccatcaagattttattgattcagaatcacagagaactgctttaagatcatcatcttctggcaatagagattgcagtgactctactcctatgtcaagagaaacttggcatggaaagttctgtaaaggaaatggggaaccacttcgtagtctccgtttgactgctaagctccgtgacttccataaatttgccaaggttgatgctgaatccaataaagaattggaacagtggaatgaaatgcttaaaagtgatgccatcaaactatgccaggagaacaatttcaacccaggattttttgagggtagtgataataactgtgtcgttgatgcatatgaacttaaggtcagacttgagcatattctcgagagaattgcattgatatcagacgctgcaagtactgagaaaccttcagcagtgacaagtagtctgttcattggtggagcactggctgcaagatctgtatacacactgcaatacttgggaatcacaaatattttgtgtttgtgtaccaatgaaattggacagtcagaaactcagtatcctgatctatttgagtacaagaatttctctaatgaaggtggcaagagttacactattgaccaattacccatagaggttctctggtgtgaagataaatctatgattcgagatcagagtagcctccaagaagaatcacatagaagagagaaattggacttcattcattaa

SEQ ID NO: 105977 - DNA, 1068 bp, Glycine max
  Peptide Sequence Number=SeqID_222755
atggctccctccgatcaatctcgccactctcttgtccctggattcttgtactcatcaaaaacactgtcccatttgaataataacaccaatcatgagttgccaccatcatcatcgccacaaggtgggaccaataccaagagtcctatgatcctttcaccaaaagagggaatccgcatgttttctcctgcttactatgccgcatgcagtgccggtggcatcttcagctgtggccttacccacatggctgtcactcctctcgaccttgtcaagtgcaacatgcagattgatcctgtaaagtacaagaacatcacatcaggatttggagtgttactgaaggagcagggggctaaaggtttcttcaagggatgggtgcctactctgctaggctacagtgctcaaggagcatgcaagtttgggttttatgagttcttcaagaagtactactcagaccttgcaggacccgagaacgcaatcaagtacaaaacgatcatatatctagctggttctgcttcagcagaagttattgctgatgttgccctttgccccatggaggctgtcaaagttcgtgtacaaactcaacccggctttgctcgcggtttgtctgatgggttacctaagtttatcaaggctgatggtgtttctgggttgtataaagggcttgtccctctttggggccgtcaaattccatacacgatgatgaaatttgcttcctttgagactattgtggagaagatatacaaatatgccatcccaaccccaaaagagcagtgcagcaaaactatgcagcttggagtgagttttgcagctggatatatagcaggcgtgctgtgtgcaattgtctcacacccagctgacaacctcgtttcttttctcaacaatgcaaagggagccactattggtgatgctgtgaacaagattggagtagtaggtcttttcacccgtggccttccacttcgcatagttatgattggaacactaactggagcccaatggggactctatgattcatttaaagtatttgtagggctgcctactactggaggaagtactcctgctcctgttaagtag

SEQ ID NO: 105978 - DNA, 1524 bp, Glycine max
  Peptide Sequence Number=SeqID_222756
atggaggaggaacagagggttgcacaagtggaattggcgaagcagaggtgcaagtgcgtcattgatgccattaacagtttaccttgttccaccaacatcactgtctcgtgcaggcgaaccctcctcaagttggcacgtgccgagctcgctttcctctctcgcccctcttcttcttccgtgcccctcagtgtcaacatcgggcacctcgaaacagttgtacatattctccagcaacccttcgtaactggagtttctcgagtttgcaagccaatccctctctcaccttcagttagcagtgaggagaggcgccattctcctcttaataacatccatgttgatgtggtttgtaccctcaacaagaagcctgtctggattatagtatctgacagaaatccagagtacatttcttgggatcgatgccataaaagtaagggtttaaagctacgtattgaagaagtccttgctgctgcccagtctaacttaacattaagaccttcctcagttattcttttctttgccaatgggcttccaacccagatttacaataaacttcgagatgagtttgggggatctgaaatttggttggatttctctgttttcagttctgacatgttggaagaaactgaaggtgactggataaatgttattgcaagatcttacagaaatgcatgtgttcttgaaatcaaccccgctgatggcaaggatgttgagggtacaaagtctggatgtagtgttcaaggttcaactgtggactcttcccaactagagccttcagtaggaaaagctgaaactcagccgcaactagtggacgaaaatgctagaagtggggactcctttcatcttgagctttcagtagatgaggccgaaactcaagcacagcctactgaagagaatgtcagaataaacttgggggttatgttctgttccattcttatgggaatgaaactaagttcaatggagagtaaagcttgtgaatcttctaatcctgggaatcttttaggtgagactgatctggtaaattttgatacaacagctttgatagctcttgtatcaggaattagtaatggtggaacagagaaacttttggccactccagagagtggaatgaggcagcggtttaagggaaactacgattttgtgattggtcaaataacgtctgaaattcaaaacccaatccatatggaatttgatagaatcctacgtgggaagaatggcctaatttgtgagagtgttcttacggaatttaaggagttagtatcaatgtgtggagggcccaatgagaaactgagagctgactggttaataaattgtctcagggttgttcctgatactccctcagaacgcatgatgggcctcccatcaactaggaagctggcattgaaaaacaaggttgtctttggcactggtgaccattggcatgccccaactttaacggcaaatatggcatttgttagagctgtttcacagacgggaatgtccctttctaccatcgaacatagaccaagggccttaactggtgattag

SEQ ID NO: 105979 - DNA, 870 bp, Glycine max
  Peptide Sequence Number=SeqID_222757
atggcagctttttcatcccaatactaccatccgtttctggttgactccgcatgcctctcaattactcctcccattataaacacttctagtacccttcctccttctcctcattatcttctcaataataataacattcatattcaggaaacctcttatagcgtcactaataatcaggaaacaagctgtgttgataatcaaagctccaaggttaccaccatcagtgacactgagtattctgtggtcaacaaaaaccatagtcctgagacatccatggttgttgacaaacttgaaaaaggtgagcagttcactcagaaggtggtgacccccatggagaaggagaagaagagaagagcaagaaatggatcttccaaggaatcaacagaagggggaaacgagaaacaaaagaagccaaaagaagtgaagaaggatgagaaaaaaggtgctgaagatcctccaactggctatatccacgttagagctagaaggggtcaagcaacggatagtcacagccttgctgaaagggtaaccggaaaggcccttgtgttggacgaaataatcaattatgttcagtccttacagaatcaagtggagttcttgtcaatgaaacttgcattagtgaatcccatgttctatgacttggccatagacttagacactctcatggttagacccgatcagaaattaaattataatatagcatcaccatcaccatgtttagcacaattcagacccaaccaggccattgcttttgctgacacaaccactaccaacagtttccccacagctaataatggtgactatcttttggattattcatcctcactttttcttcaaggcccgagatcaaatctcttctttgaggtatgctag

SEQ ID NO: 105980 - DNA, 3573 bp, Glycine max
  Peptide Sequence Number=SeqID_222758
atgactgtgtcagcatccttcagctacgatgtgttcctcagcttcagaggctctgatactcgctacggttttactggcaatctctataatgctctaagtgataggggaatccataccttcattgatgaagaggagcttcaaagaggtgatgaaattagaccggcacttgttgaggccattaaacagtctaggatggccatccttgtgttctctaagaactatgcatcttcttcgttttgcttagatgaacttgttaaaatcatggagtgtgttaaggcaaagggtcggttgatttttcccattttttatgatgtggatccttgtcatgtgcggcatcagtctgggagttatggagaagcgttggctatgcacgaggaaaggttcacaagtagcaaggaaaacctcaaggagaacatggagaggttgcagaaatggaagatggctcttaaccaagcagctgatgtgtctggcaagcattacaaacttggaaatgaatatgaacatgagtttattgggaagatagttaaagagatctccaacaagattaaccgtacacctttacatgttgcggattaccctgttgggctggagtctcgagtacaaacagtaaagtcacttctggaatttgaatctgatactggagtacacattgtagggatttatggaataggcggcatgggcaaaacaacacttgctcgagcagtttataattcaattgcagaccaatttaaaggtttatgttttcttgatgatgtgagagaaaatgctactaaacacgggttaatacatctccaagagatgcttctttctgaaatagttggagagaaggatattaagataggaagtgttagtaaaggaatttcaataataaagcacaggctccagcgaaagaagattcttttaattcttgatgatgttgacaaactagaacaactgcgggcaactgttggagggcctaattggtttggttctggcagtagagtcatcgtaactactcgggacaaacatttgcttgcaagtcatggggttgatagaaaatatgaggtagaggatttaaatgaggaagaatcacttgaattgctttgttggaatgcttttaaagatgacaaagttgatccatgttacaaggacatttcaagccaagcagtggcttatgcttctggccttccactagctttggaagttgtaggttctctattgtttgggaaaggcataaaagaatgggaatctgcgttagaacagtataaaaaaattcctaataaaaggatccaagatatacttaaggtaagctataatgctttggaagaagatcagcagaaaatttttctcgacatcgcttgttgcttgaaaggatatgaattggcagaggttgaagatatactttgtgctcattatggtgtttgcatgaaatatggcataggagtgttggttgacaaatctctcataaaaattaagaatggccgtgtgacacttcatgaattgatagaggttatgggtaaagaaattgatcgacaagaatcaccgaaagagcttggaaaacacaggaggctatggttccataaagatataattcaagttttagcagaaaatacagggactagtgagattgaaataatctctttggatttccccttatttgaagaagacgaagaagcatatgtagaatgggatggagaggccttcaagaagatggaaaacctcaaaacattaattattagaaattctcatttttcaaaaggtcccacacatcttccaaatagtttaagagtattagaatggtggacttacccattacaggatttaccaaccgattttcattcaaacaaacttgccatatgcaaattacccagaagttgttttacatcacttgagttatctggcatatcgaagaagttcatgaatctcacagttttaaattttgacgggactgaatgtttaacccagatacctgacatatccagtctccagaatttagtaaaattgacatttgaatgttgtgagaatttagttgcaattcatgattcggtcggttttctagataaacttaaaatcttgagtgcttttggttgcggcaagcttatgagttttccacccatcaagttaatctctcttgaacaacttgatctttcatcttgttcaagtcttgagagttttccagaaattttaggaaagatggaaaatataacacagcttgagttgaagtacactcctttaaaagaattcccattttcattcagaaatcttgctcgacttcgagatttagtgctggttgactgtggaaatgttcagctaccgattagcattgtcatgttgccagaactggctcagatttttgctctgggatgcaaagggttgctattgccaaaacaagacaaggatgaagaagaagtgagctcaatgtcttcaaatgtaaactgtctttgtctctcaggctgcaatctatcagatgaatattttcccatggttttagcatggtttagtaatgtgaaagagttagagctatcgtgcaataacttcacatttcttcctgaatgcatcaaagaatgtcactctttaatattacttaatttggataattgtgagcatcttcaagaaattagagggattccaccaaatttagaatatttctcggctggaaattgcaaatccttgagtttctgctgtacagccatgttattgaatcaggagctacatgagactggaaacaccatgttttgtttgccgggaacaaggagtccagagtggtttgagcaacaaagtataggtccatcattatctttctggtttcgtaacaagttccctgtcatggatctctgttttgttattggaccaatgggtaaggactctattttgtttagacccatcatgaccatcaatggcaacacaatggagacacagttaactgaaaagaggtgttgtttagacttccgagcattagattatcatatacttatcattggtacaaaatacatgaagttcggagagtgtctagataaacctctcacaaaaaatgaatggaatcatgtggtggtttccattggtattgaaccaacccctaaggatgtgattgtcaagcaaactggactccatgtaatcaaaccagaaagtagcatggatgatgtccaattcaccaatccttataagcaaccatcctttaaagagaagcaaagattggtggacatagttgattgtcatagacaatttatgcagcagcaaaccactttggtttcattaaaaccacatgtgagacagggcggagagtcattttcattgcttccacctcaagcatgcaaaaataatatgaattgggattcaaattcaactggaataactagcacttccagtgtccaggcagcgaaaaagattggctatattaggtttatcgcaacaacgccgaatggcttcattggatttacagcagcggcggggcagagaaatggtttccttgctttcttctccatcattggagttgatggtatcatggcagaggagatgcatcaccagtgtccaagcaatgatggaaacgacaatgacagaacctcctcaccggtggagcaattaccaatggcaaag

SEQ ID NO: 105981 - DNA, 3510 bp, Glycine max
  Peptide Sequence Number=SeqID_222759
atggaactaaatgcgtgcgaggaattggcgaaaattgcttcggatttcaagtgcgagaagttggttgatagggcacgagctttattgaaatgtttgctggatgttgctgttgaaagtgtttttgagactcgtttaaagacatcctttgaacatgaaaaacgcgtggctgtgcaggattcaaagtctccagtggcagccaacatttctcaaagctctgtaacatatccaacctgcagtaaaatgacttcagtgaaggaagagcagcctcagttgaaattactatcaaagaaagaactgccagagctgtcgaagttttgcatctctgatgatggaggaacaaaatgtaacacactatgcagcataggtgaggaaagcagtgtgatgcaacagaattcagtcaaggaaacaaatctacctaatgacaatggcatttttcccaacatagagagtaatcttaacaagcaacagcataatgatgtaaatgctttatatggcgatggtgagaacacagaagaatcattacaaatgtttgatgcaaaagctggtgagcaaaatgaagagaataatatgtcattgcagagtagaattcaagaagctcaaagtgattctaatgctgccaaacaggttgaacatccggatcaaaagggtgatttctctgatgatttggttaatgcaatcaaaagaattgagtcccggattttggctttccaactttgttcaaatttaagtggttccactaagaacagtgcaggtcttcatactacacatgaggcagcaaattcagactgtcctgtaataaagagaaacaatggggcttcaggaagtcagatgaatagtggaaagtccctcttggatggacgtaggttggtgaatcagaagacatgtaatgaaagttctaagggtgaaaattctatttcatcaaatgcattagtggaacccttttgtgctgtaaatggatcattgagtcagagtcagatggcaaatcagaatcgttggcatcataatggtgcagaatctgcaaagagcattgatataccacagcagattggtaccaagcaggcatcggtaggagagtggttgagaagtcggaataggattcaaaattcagtacaaaacatagctatgatagatagagttaagtcactgaaaaggttagttagcggtgatgcctattttgggagtcaagctagtgagtgtattcaaggtttgagggtccctttgaatcaagatgagcatactaagaagcactctatgttagtaagtaaaacaaacagggaaagtatggtccgtttaaatccagtggcttggtcaaagactgatcagaatcggaaggaaaagggttctgaatcttcctatgcacagaagttagcaggatcaaaggcccttatttcagggagagaaaagccaccacttcatcagatggtaatgaagccaactctattggaccagagatccagtgagattaaggtaagttcccatgaacacagagactctcgagttttggacagaagaataactcataagactggccatcttgaaccacggaagacaagggttctaccacaagatcataaactggaggaggcaaactcaaactctgactcttttcgcttgagttcttggcaaggcagtgccaatagtagtagtgactctgaggactactctttgccagatggaacacagtatccctcatccgcaatgatggtggattcagcatatgagggaagttcagaagagagcaacaactcatatctcaagaaggaaggtggtacttctcgtagatttggcagtttcaaaccatatagacatcaccgcgaaagaaatcctaaggaaacagttggaagactaaggaggctgaaaaataagttaggactaatctttcaccaccaccaccaccatcaccattaccatcatcatgatgatgatgttcatggtcatagacatactatgtggaatcagttgcagaatgtcttccaccataaagtcaagcatggggtgacaacaaataaagtagacaagacaaggagaggggctgttgcaagagtgttgcctcagagaaaccatgtcgggcagtttcatagacttgcggaaggggtcctgagacacatccggcattcaaagaaaccaaatcctttcaagcttgatgggatgaaacagttaaggaatggacattctcagaagaagctgcgttggtggcaaaaccttcgaccgcaccggagagtgaggctgaaaaagaaaggccgagttaaaatgggatactctacgcttgctgatttgtttggtcacatgagttgttcactcagattgctgcatctgtgtaaaaagactccaatttttcaaaatgtttgccgccaggtcgaagttctttcgaagaggaaattctcccatgcccatcttgcgcagatgaagtatatactccctaaaagtgtgtgtattgataaggtgcttgttcatgataagaaaagcttgtgtatggtaactgatatgaagatcaccttgaaatttgaggttgtgaaagattgctctggcgaatctgctgatctggctcttcgacgatattttaaatctaagctgattgatttctttgatatgcatcctgaggttgctgacattccagaggccccactgccagaaccctttggcaaaaaatcttgtagatcgaattgtaaagattcacatgttgaagaatttactggccaatccccgcataataataccgaccaggcagaaaaggctcagtgttttttacccacaaaaacttctccatcatctcatgcatttgattttctggataatgaagaaagtgaaaaaacactgcagaaagaatgtgtaccattatatgatgatgtggctaatcctattatggaaagagggcaccagaaggaatcattttctatgtcttttgaacctagtgttattaatacaccagtacatatgatccatcctccacattctgttacatgcagtgattctgaaagcccatatttgaaaaatatctcctgtgctgctgatagttttattgcagagacacctgcccagtcagcacctgcgagattattgcccatttctgatgttaagcttcaggacatgcctacccaaaagtcaacatcatcttataagccagcaaaaagagtgcttgacttttccctcatggaggacaatgatggcttgggcattgaagtggacaagttagaatctatcagagatctgcatgaatttgatagcttccctgaatctagcagaggatgttctgaggattgcaactcttttggttctgtttctgcacctcaggaggcagaagagagccttggttatgcttctgagaaaattacccaaaagcaagctgatttagatacacagcacaaaaaatcttcaccattgctgaatctgccaactaatattctcattgctataggagaagttgaagaacaaattgagtatctggaaaagttggtgccagactggatctgcaagaaattggttgctactggagatactgtgtactggtga

SEQ ID NO: 105982 - DNA, 1980 bp, Glycine max
  Peptide Sequence Number=SeqID_222760
atgaaggtttccattgccaagtttcactcccttcccctatgttttctccttctcttggccatcaacacacagccactgctagcagctgaaccagagccagtggtagataagcaagggaaccctttggtgccaggagtagggtactatgtgtggccactttgggctgataatggaggcctcacactaggccaaacaaggaacaaaacatgccctcttgatgttatccgtgacccttcattcatagggtccccagtgaggttccatgcatcaggccttaatcacattccaacactcactgatctcaccattgatttccctgtggtgacagtgtgcaaccagccaacagtgtggaggctgagcaaggaaggatcagggttctggtttgtgagcactaggggtaaccctcaggacctcattaccaagttcaagattgagaggcttgaaggggatcatgcctatgagatctacagcttcaagttctgccctagtgtgcctggtgtgctatgtgctcctgtggggacttttgtggatgctgatggaaccaaagtcatggctgtgggtgataacattgacccttactatgtgagttacaagaatgtgggaaaaacagaacaagcacaaagggtctttgatcagattaaggatcctgatatagtatcatggacctgcctccttaacctctacctccactctggtcttccttccaagtccctctcagcgttttcccgttgcttgcatgtgggtctaagacctgatagcttccttatagttgcagctttatcctcttgtgggcactgcaaggatttggttagagggagggttgttcatggaatggtgttgaggaactgtttggatgaaaacccagttgtggggaatgctttgattgacatgtattgtagaaatggtgtgatgggaatggctgcatcggtttttgagaagatggggttcaaggatgtgttttcttggactagtttgttgaatgggtacatactgggtaacaatctgagttgtgctcttgagttgtttgatgcaatgccggaaagaaatgtggtttcttggacggctatgattactgggtgtgtcaaaggaggagctccaattcaggctttggagacgtttaagcggatggaagctgatgacgggggagttcgtctttgtgcggatttgattgtggcagtgctctcggcatgtgctgatgttggggctcttgattttggtcagtgcatacatggttgtgttaataaaattggcctggagttggatgtcgcggtgagcaatgttacgatggatatgtactccaaaagtgggaggcttgacttggctgtaaggatatttgatgatatcttgaagaaggatgtgttttcgtggactacaatgatatcagggtatgcttatcatggggaagggcaccttgctttggaggttttttctcgcatgttagaatcaggggttacccctaatgaggtaaccctgttgtcagttttaactgcttgtagccattctgggttagtaatggagggagaagtattgttcactagaatgattcagtcctgttacatgaagccaaggattgagcattatggatgcatagtggatcttctcggtcgagcaggattgctggaagaagcaaaagaagtgattgagatgatgccaatgagccctgatgctgctatatggagatcattactgactgcttgcttagtccatgggaatttgaacatggctcaaattgcaggaaagaaggtaattgaactcgaaccaaatgatgatggcgtttatatgcttctatggaatatgtgttgtgttgctaatatgtggaaggaagcctcagaggtaaggaagttgatgagggaaaggagggtcagaaaaaggcccgggtgtagtatggttgatgtgaatggtgttgttcaagaattctttgctgaagacgcatcgcttcatgtctttgcaactgaagcaaatgacggagaagtggactaa

SEQ ID NO: 105983 - DNA, 177 bp, Glycine max
  Peptide Sequence Number=SeqID_222761
atgtttataaaagtgcagctggtggagaaaggaataaaagtacacatgcttaattttgaggatcatgtgtataagctgttgcttgaaggctgggtttcattgattgcaaaggaaccagaaccagaaaacaaaggcagttcatgtaatattggaaccacaattattatcactgtttga

SEQ ID NO: 105984 - DNA, 998 bp, Glycine max
  Peptide Sequence Number=SeqID_222762
gaattgcatcaccaataccaagatcctcggtccctactgtgcttcttcaacccaactctctctttgagagcatcttcatggaggacagtgccaacctcgcgaagctgaatggggttttcatcaactcgtttgaagaactagaaggagaggcgctagcagcactcaacgaaggaaaagtggctaaagggttgcctccagtgtatggtgttggtcccttaatggcgtgtgaatttgaagaggtggatcaaggtggacaaaggggtggttgcatgcgttcaatattggagtggcttgatgaacaaagtgaaacttcggtggtgtatgtttgcttcgggaataggacagcaacaaggagggagcaaataaaggacatggctttggggttggtagaatgtgggtatagttttttgtgggtggtgaagttgaaggaggttgacagagaagaggaggaggatttggaggaagtgttggggagtgagttgatgaataaggtgaaggaaaagggtgtagttgagaaggagtttgtggagcaggtggagattctggggcacccttcagtgggggggtttgtgagtcatggagggtggaactcaataatggagactgtgtgggaaggagtgcctattctgtcatggcctcagagtggggatcagaagataacttcagagacagcaaggataagtggggtggggatttggcctcatgagtggggatggggagcacaagaggtggtgaaaggtgaggaaattgctaagagaatcaaagagatgatgagcaatgaatctctgagggtaagagctgcagaaatgaagaaggcagctaggaaggctgcagctgctggtgttggtgggagttgtgagttcatggtggaagtcgccgccgacagccagaagaacaacaaaaaggccctcgatgtggcggcattcagggcagagcggttggccctcgacgcagagacccagctagccatggcggaggctgccgaacatgggatgtga

SEQ ID NO: 105985 - DNA, 165 bp, Glycine max
  Peptide Sequence Number=SeqID_222763
atggctaaagccagagatagagatagagatagaagaatatgttccaaaaagtcaaactctgggagggaccaagctgctcatacatatcgtggcagcagggatgaaaatggcagaatcgtctgcagcaagtggaaagtcgtcactacttctttgtgtaataattaa

SEQ ID NO: 105986 - DNA, 1668 bp, Glycine max
  Peptide Sequence Number=SeqID_222764
atggggtgcaagctcggaaagccggcggacgccggtgaccgtctccggcataacactgcgactaccagcggcggcaataatgccgttaaggttagggagaagcagaagcctccggacgccggcgaactttccggcgtaataccggcaccggagcgccggacacttcgacttgactcattcacggcgagccatcaggggtggccgccgtggctaatggccgtcgccggcgactccatcggagattggactcctcgccgtgccaacacgttcgagaaacttgctaagattgggcaagggacttatagcaatgtgtacaaagcaaaagaccttgtgagtgggaagatagtggctttgaagaaggttagatttgataatttggaggcagagagtgtgaagtttatggctagagagattcttgttttgaggaggcttgatcaccccaatgtagtgaagcttgaagggttggttacttcaagaatttcatcgagtatttacttggtatttgagtacatggagcatgatcttgctggtctttcagccagcgtaggtgtcaaattctctgagccacaggtcaaatgctatatgaagcaattgctatctggccttgagcattgccacagcagaggtgttttgcaccgtgatattaagggttcaaatctgcttattgacaatgaaggaatacttaaaattgcagattttggactggcaactttctttgatcctaagcaaaagcatcccatgactagtagagtcgtgaccctttggtaccgtccacctgagcttcttctggggtctacgtcttatggtgttggtgttgacctttggagtgttggctgcattttggccgagctacttactggaaagccaatcatgcctggccgaacagaggttgagcagctgcacaaaatatttaagctatgtggctctccatctgaggaatactggaagaaatatagattgccaaatgctgcactctataagccacaacaaccatataaaagaaacactttagaaacgttcaaggattttccatcttcttcattacctctgattgaaactcttcttgcaatagatcctgatgatcgtggttctacctcagctgctttaaatagtgaattctttaccactgtgccctatgcttgtgaaccatctaatttaccaaagtatcctcccaccaaagaattggatataaaactgagagatgaaaaagcaagaaggcagaaagctctaagtggaaaaactaatgcagttgatggtgccagaagggttagagtacgtgagcgaggtttggccgatccagcccctgaagccaatgtagagatccaaaataacttagataggtggagagttgtgacccatgcaaacgcaaaaagtaagagtgagaaatttccacctcctcatcaggatggagctgttggatatccactggatgattcaaacaaaggagctgtttcgtttggagccactgaaacttcctctgtctctaccatatttgattcaaaatcttgtggatcggttataagtcatgatgctgcaagagacaaagggaggaaaactagtaaagcagattcccagatggcatcatcttggaaatttatgcgttcattcaagctatcagcagttggccattcatttgatttattatttagaagcaattcaagcagataa

SEQ ID NO: 105987 - DNA, 606 bp, Glycine max
  Peptide Sequence Number=SeqID_222765
atgaagatgacattggtaacattggtccttgtgtttgccttgatcacaaaggcactagctggtcctgcatccgagccagtgctggacgcattggggaagaaagttcgagctgattcgatttactacatcgttccggcttcctccgatatcggtggccttgcttcggcaagaaccgatgtagattgtccacttgatgttgtagctgttgatggtgacttaggtctgcctttgagcttcacacctgttaatgataagaaaggtattattcgtgtttccagtgatctcaacatatacttcaccagctacacaatattctgtccacagaccacagtgtggaagcttaagtactatgatgattcaacatcacagtggtttgtgaccactggtggtgaattgggccaccccagttcgcaaaccgtggcgaattggttcaagattgagaagtacgaggatgcttacaagttggtgtattgtccaagtgtgtgcagtgattgtaatcatcaatgcagtgatattggaatataccaggatcaatatggtaagcgtcttgctctaagttctgagccatacaaagtgcagttcgagcgatgttgggcatgtgaatga

SEQ ID NO: 105988 - DNA, 912 bp, Glycine max
  Peptide Sequence Number=SeqID_222766
atggcagagattcagccgccggagggccaaataaacggtggcgccggaaccctaattcttcactcctcggaaccctccatcggatccaagcggcagcggcggccgagcgttcgattgggcgacatcggtggcgaccagccctacgattcccacgcgcgccgcaacacgaagccgtggaaactcgccttcgacaaccaccaccaccaccaccgcagcaaggacaaggacccaggtaaaccctccaagactcgtcctttaacgaacctgagcgagtttaacgaaaccctagaaccttccaacgaccgagaaccggggaacatcgacaccgtcgcaattggcagctggaaggtcaaggagtccaaaaagagaggctcagtcgccaccaaaagggtcagatcgaattgggtttcgcgaatcgacggcggcggcgaaggagagggagagaagtataataacgaggacgaagatggggatgacgatgatgggtatcgggaatttgaggtggagaattcggagagccctttgaaggagcaaagccctattcatagtatggagaatttgggggtggatgggcataggagggtttttaagggtagggaaagggagcaacagcaacatgatggggttgagctatctgtaccgtctgatactgatgttagggattggaagtgtggggataggaacaatgagaatggtggtgggagggttaggggtggtgaagatggggttagggtttggcttaatggattggggttagggcgttatgcgccggtgtttgaagtgcatgaggtggatgatgaggttttgcccttgttgactctagaggatctcaaggatatggggattagtgctgttgggtcaaggagaaaaatgtacaccgcaattcagaagcttggaaagggcttctcctga

SEQ ID NO: 105989 - DNA, 144 bp, Glycine max
  Peptide Sequence Number=SeqID_222767
atggatcctcagcctgagccagtcagctacatatgcggagattgtggaatggagaatacgctgaagcccggtgacgttatacagtgccgtgagtgcggttaccgtattctttacaagaagcgcactcgtcgcagtaagctttaa

SEQ ID NO: 105990 - DNA, 1278 bp, Glycine max
  Peptide Sequence Number=SeqID_222768
atgactattgggagtttcttgatgtttttaatgattttgatcaagaatgttcatgtgtccagcaaattccgggacatttatgatgaagagttttttgtcaataccttgaaaaatgatgtacgggtggttgacaagattcctgagtacctaatggaaagatttggcagcaacatgacaaatgttcacaatttcaggatcaaggcatggtcatctattcagtattacaaagatgtggaggagaaagcagtgcacaatgttgtagtgttgtggcctctttgccatcatatgccagtagaagagagtgttgctagcactcctcatatagatatattttcattcttgcttgttatctatccatttggattatatgggagggagttcggggttataaggatttcaccttttgcaaatagattatcatttgatgctcctccagctgtccagcgtcttagatgcttagcaaattatgaggctttacggttttcaagtcctatattgacaataggtgaatctttggttgaaagaatgagaaaacatagcgccattaatggtggtaaatatgtctccgtacatcttcgttttgaagaggatatggttgctttctcttgttgtgttttcgatggtggaaaacaggagagagaagacatgattgcagctagagaaagaggttggaaagggaaatttacaaaaccaggacgagttatacgtccaggagcaatcaggatcaatgggaagtgcccccttaccccattagaggttggcctcatgcttaggggaatgggtttcacgaagaacacatctatctttttggcatctggaaaaatatataatgccgagaaaacaatggctccgctacttcaaatgtttcctaatttacatactaaggagaccctagcttctgaagaggagcttgctccatttaagaattattcttccaggatggctgctatagattacacagtttgtcttcaaagtgaggtgtttgtcacaactcagggaggcaacttccctcattttctgctgggtcacagaagattcttgtatggtggacatgctaaaacaattaagccagataagcggaagttggcattactgtttgataatcccaatattggatggaaaagtcttaaacgtcaactgctgagcatgaggtcgcatagtgattccaagggagttgagcttaagagaccaaatgattctatatacagctttccatgcccagattgtatgtgtcgttccaacagaactgacgatttgagatcttcattagcaacttga

SEQ ID NO: 105991 - DNA, 276 bp, Glycine max
  Peptide Sequence Number=SeqID_222769
atgtactgcagcaaaaaacattcacacgccaccaccgccgtccaacccaactccacaactgtcgattgcactgtcaactctgccctcggcactgacctcggcctccgcctctccttctccttcttccccttcggatctaaagtttctgttgatggaaagaatgacaaagtcgacaatcctgatggaggatttgaactggtttatggaaccggaatcagggacaacaaagacggttatcacattgggaatctagagcttcatggacgggatcgttag

SEQ ID NO: 105992 - DNA, 336 bp, Glycine max
  Peptide Sequence Number=SeqID_222770
atggcaaccaaaagcaaaacttaccaaggcacagtagacacagcagacacgagaagaggagaaaaaagtgctttggtgccaatggctgcaaggaaagcaacgtcagcagacacagtaaacacagtagacacaaagcaagaaaacttaccagagcgtagtgaagagggtggctttgcgaccaaagcacgactagggtggctttgcgagactccgcttggtgggtcaaggacaatggcattgcagaaggtggctttgcaaggtgggtcaggagcaatggcagtgacgaggattctcgttaacatcagttttgtcaaaaccgatgttaacatgacctag

SEQ ID NO: 105993 - DNA, 177 bp, Glycine max
  Peptide Sequence Number=SeqID_222771
atgacagccctgaatttccccacgtgctcgtgctcatctggtcttactgagtcagccccatacgtgactgcaccttatcatttggccacgtgcccacactcgttttacgctctttcggagaacacgtttagagctccaaaatcgtggagcaccttcgcctccttcctcactatataa

SEQ ID NO: 105994 - DNA, 579 bp, Glycine max
  Peptide Sequence Number=SeqID_222772
atggatgcccatgttgttagtgtggagagtcaagaaatagaaagtagtatagttgatgcttcagctgcttcaagaaaacgtagaagagatgaagaggaggaagaagaacttgaacaagcatttttcattattgttagtgttgccactatgcttttgggtgcaatgacttggtatcataacaagtactttgttaaggaacctgctcaaaatttggaattagaaaggcatagcttcctcaatcgtctatatagaggaacaaaaactgattgcattgaacaattaagggtcaacctatgtgcaaaggataaagctactggatttagagcaaaaaatgcattagatgcagatgctatcatgagtaaagaagcaaatgaagaggaagcaattcacagcgtgagtattgacttagagggatcaagttctgccacaaggaaaaacattcacccaagtaagagtggagagaaagaagggatgatttcctcaatgaaagaagtagtcgagtcattgaaagaatttgttgaagtgattaagaagaagatggagaaccaaaaaaagatggagataaaagaagctcaagaa

SEQ ID NO: 105995 - DNA, 243 bp, Glycine max
  Peptide Sequence Number=SeqID_222773
atgcatgaagatgaagagcatggcattctccaggaagctctggagcctttggacaagagacgcttcatgtccaaatccaaacaacaaagatatgcagaacttgagtccagaagcctgatctcttggcctggggacaacctaattttctcaggggggatggaagctactggtgatgctagtgctaatactgatgcaatacagggcgctgaagatgttgatgaaggaagagatggactagcatga

SEQ ID NO: 105996 - DNA, 279 bp, Glycine max
  Peptide Sequence Number=SeqID_222774
atgggtggagggacttacagcattggtgtatatggcttcaagggaattactaactataaaatactagtcatggtccaggataatttcaaccaaaatgttggtcagcaagcatcatcttccatgtcatctatggaactggataccgaacaattgtttcttaggattgaggagtccaagaaccacattcactgtgacaagtgtggtcaggctttccagcaggaagaattagaaaatcacatgaaagtttttcacgaggcacttcactgccctgtggaataa

SEQ ID NO: 105997 - DNA, 495 bp, Glycine max
  Peptide Sequence Number=SeqID_222775
atgtgtcccctaacacccagtgacttgaagcggattttcaacaaggtggacatgaatggcgatgggttattgagccttgaggagctgaagatgctgctggagaagacagggttcagttacagcattgaggaattggagtctctagtgggaaagaagagccttgacttcagtgagttcttgttcttttatgaatctatgttgaagcagaacaataatggggaggaagaattaggagctagtaattatggggatgatagtgatgaggttgaggaagtggagagggaccttgtgaaggcttttaaagtgtttgatttggatggtgatggattcatcacaagtcaagagctcgagtttgtgctgaagaggcttggcatgtgggatgatgaaaggtgtggcaaggattgcaaatccatgatttgctcctatgacactaactttgatggcaagcttgattttcaggagtttaaggacatgatgctgcttactacttcttga

SEQ ID NO: 105998 - DNA, 3699 bp, Glycine max
  Peptide Sequence Number=SeqID_222776
atggctaatttattgtgtctaagcaatgtggctactgttctttatgtagttatccaagtagtggtttgctatctaagaggagaaactagttttggtaatatgcacataaggttaggcgcaacagattatactgggtttggtcttttgattctgcaggcgaggaagatgcattgtgcccctcaagagataggcaatgatagtccaaaagtttcagaagcaagaaaggattccatatcaaccgtatatcaacagcaaaataaactcacatctttagaggattgtcaagaatcttctcttttaaagattaacactgatagtaggtgtgcaatccttccaatctttagcttcgagcctgatggaacctggagaattgttgccctaccagtgcagtgtcaaaatcacattaacttagcttctggtgtaaatatggatggtctgcaactccttttccctccacctctcaataggttgaagattgatcaatgtaaggggcctagagtacctcttcctccctatgcttattcagctaaatcatgtactaaaaaaggctttactggctcaaatgtgcatcgtcgatgtcaaaacaagattgctaacagagtttctaaactgaatgaactccccgacaattcttgttctcaaagttcattagtcagtggccctggcttgttccctggtagttctgctgcacttaattcatctgataagtacacaagtcattccaaggaagatgacaagtctttgaagaaaaactcaagaaaaagggcaagaaagaaagttaaacagagtaagaagaagtcaagtgacagtggctctcctgaacgtgaagttcttactgaggaatatgtctctgtaagtttgacttctgagacctgcagcagcaatgatgtggataaggaggatgtgggagaattttcaacttctgatgataggttaataaaatctgattgtgaaaggaattgcaacatcaatattatggaagcacctaatagttgcaactcttatcttaatcagggcatgtcaaaagctactgaacctattgttcaaagttctgccagagaatgtgccacatttgaacccaagaatcagctccaagatgagggccctgattttgaagtcattgatagaggaataaaggacatccaacacatggagccatgctgttttaatgatgtacatgactctttggtgctggattcagtttcaggtggtttcagaagtgatgaaagtataaatgctaatgatacaggaaagccgtccaacaaggcaaattgcacaatcacttcagattcaggagatggatattctcttggtcaaaacttaacgaatggtattcacaataactgtgaacataatgaggggatttggcatggtggtcaaaattgcatcagtaatgataagagagttaagcagaagagaacaatgtcgaagagttcagatctaaacaaatttgggggtgctggaattttgcatggtcgaaaagggaaggaaaatagtcattctgtatggcaaaaggttcagaagaacagttctgatgatggtagtggtgacttgaagaaagtaaacacaacttcatcacaatttgcttctactctagaaaaggatccttcagttatcaaagaatgtaattctgttagtgtaaatggtgtatcaaaaactgaagataagaaacacttgaaaaataaaattggtaggaaatcaaaagctaaagtggagtcaggtgcaaaaacgggcctcgacaattattcctggaagagtttccaatttaacgggtctttgtctaatgatcatgggaaggctagttttcaacagaatgacatgttgcatatctcttctcaggaaattgatcaacaaggattgaacactgtctctggattttctgatattaattgccttatggatggggtccagaccaatggagttgaacaggtaacatctgaaataggtcacagtgcagagtttcatctggaggagtcaggtccacaaaaaagtgccagcaatataattgcaaagacaaacaatgaaaatatagatagtcaggatagctcattcataatgccaggtgagtacatcaatcaatcaaatatgtctgaggagctgtctccagattcttgtaatcttgaaggtgatgaggttggtcaaaatgagaaagaagtttcttctgcagactacaatgcacaaaaccacagttctggaactaccctatggaaatggataccagttgggaaaaaagatagagggttggaaaaatctgaatcaaatagtgcaccaccagaaaattctgatgcatcctctcgtaacaattctaactctgaaagcagtgttgaaccagaagtggcctcttctgaaaatccggattcactaaatgcaagcagagcatgcaacggccagatttacgacaaagtgtcttgtctagatgagggtgagaaccacaaaatgggtagtcaggttgcacgtacattgacagagcacagggacaagcatgaagctgctaatcacatgttttatgaatgtgaaaatcaagatatgttagaaaattattcttacagaatagctcaagctgtgaatgatgcctgtaaggcacaactggcttgtgaagcagtacacatggctacaggtggtccagttgcagagtttgaaagactactacatttttgtagtcctgttatttgtaagtcactcagttcacacagttgttcggcctgctcacacaaccatggtggtggtgcctcactgtgcagacatgagatccctgacctatctttgggatgcctgtggcagtggtatgagaaacatgggagctatgggttagagataagggctcagggtcatgaaaatccgaagagacaaggaggtgttgctgattttccattccgtgcctattttgtcccttctttatcagcagttcagctgtttaagaaccatgaaaatttatgtgtaaataacggtgacaggctcccaaattctgaggtttcagaggcatgtgaaatggttgacatttcagcaaactcatctactgccagtcaacattcaatattttctgttctctttcctcagcctcgcaatcaggacaaaagcagtcaaacaccaaaggagacggcttctatcaataatgcatctattccgtctatcaactcaacctgctctggtgatttagaacttctttttgaatattttgaatttgagcaacctcaacaaagacaacctctttatgagaagatacaagaactggttagaggccatataccaattgaatcttcaacttatggggacccaacaaaactggattcaattaacctacgagatcttcaccctagatcttggttctcagttgcatggtatcctatttaccgcataccagatggcaactttcgtgcatcttttttgacttaccattcacttggacatttggttcgtagaagaacttcagatttgtcaactgtaggttcttgcatagtatctccaactgtggggcttcaaagctacaatgcccagggtgaatgctggttccagctgaagcattctgcacctgcagcagaaatggtgaacttagaaccttctttacttcttaaagagcgtttgaggacacttgaggaaacagcatctctcatggcaagagctgtggtcaacaaggggaacctaacctgtacaaacagacaccctgattatgagtttttcttgtctaggcgacggtattga

SEQ ID NO: 105999 - DNA, 465 bp, Glycine max
  Peptide Sequence Number=SeqID_222777
atggctcaaaatggaagtggggatagagtagtggtggacaatggttttgaatccattgatgatgcatacgatcatgaacacaagctgagtcaaaagggtagcaccaaggtcaaggaggaagaggtttctgtggagagggtgttccagcaccttctggtgccatcatggaggaaccaattgacagtgagagcctttgtggtcagctttgcactcagcatactcttcagcttcattgtgatgaagctcaacctcaccactggtattattccttcactcaatgtctctgctggccttctggggttcttctttgtgaagacatggaccaagttcttggagaaatctaacatgttgaggcaacccttcacaaggcaagagaacactgtcatccaaacctgtgttgttgcatcctctggcatagcctttagcggtaccttctttctttcactctattctatgcctttgtga

SEQ ID NO: 106000 - DNA, 810 bp, Glycine max
  Peptide Sequence Number=SeqID_222778
atgcctttgatattgtttaatttagctcctctaaatggaggaaaggataaacttatagaagaagcatttttaaattttttcttctctaaagtaagcacttactttaaaaaagctgcttatggagaagtttatcctgatagggccgagattactttaccctttaaagttagggttaaagcagcacttaacaggcagtccaagactcgtttgataggaccaaactgccctggcattatcaagccgggggaatgcaaaattggaatcatgccaggttatattcataagcctggtcgcataggaatcgtctctcgttctggtaccttgacatatgaagcggttttccaaacgactgctgttggccttggacaatccacttgtgtgggtataggaggagatccctttaatggaacaaacttcgttgactgccttcagaagttcctaactgatcctcaaacagaaggtatcattcttataggagagataggaggaactgccgaagaggatgctgctgcactaattaagctccttataacggaggaagctctcataaaaatagaaaaagtagaaaaaaatggtataggaaataaggagagtggaactgagaagcctgttgttgcttttattgctggtttaactgctccccctggtcgtcgtatgggtcatgctggagctattgtgtcgggtggcaagggcactgcacaagacaaaattaaaaccctcagggaagctggggtcacagttgtggagtcccctgccaaaattggagctgccatgctagatgttttcaagcagaggggcttggttcaatag

SEQ ID NO: 106001 - DNA, 2439 bp, Glycine max
  Peptide Sequence Number=SeqID_222779
atggcgtttacttacgcggctgcgatcgctccttctatctacggcattgctcgcatcggttactgtgaccagaaggtttcgctcgccggttatcacggcgaggtgaatacgacgtcgttttgcgtttcgtcgcacgcggggaggagtgatgtgttgctcgagaggaggaagttgaagttggctgatactcgcattgttgaaaacacgcagatgaaatccagcgctgaaattgaaattccggtttcgtgctaccagctcattggtgttcctgatcgagctgagaaagatgaaatagttaaggctgttatgggtttgaaaaatgcggaaattgatgaaggttacacaattgatgtcgttgcagctcgtcaggatctgctgatggatgttagggataagcttcttttcgagccagaatatgctggtaatctgagggaaaagataccccctaaatcttcccttcaaattccttggtcttggttgccaggtgctctttgccttcttcaagaggttggagaatcaaagcttgtgctggagattggacagacaagtattcggcatcaaaatgccaagccatatactgatgacctgattctttccatggcattagctgagtgtgcagttgcaaagattggctttgagaagaaaaaagtatctcaaggttttgaagctcttgctcgtgcccagtgccttctaagaagtaaaccgtctctagcaaaaatgacactgctatctcagattgaagaatctcttgaagagcttgctcctgcttgcaccttggaactgctgagcatgccacatgctcctgaaaatgttgatcgaagacgaggtgcaatttcagctttgcgggaattgctcaggcagggtcttgatgttgaagcttcatgccaagtacaggactggccttcctttctaagccaagcatttgacagtttgctggctaaagagatagttgatcttcttccttgggataacttagctgtgatgcgaaagaataagaagaccattgaatcacagaatctaagggcagtaattgattctaattgcttctatagagtttttaaagctcatattgcgattgggttttccagcaagcaaaaagagttgattaacaaagcaaaaggcatatgtgaatgtttgatagcttcagagggtattgatttgaaatttgaggaagctttttgcttattcctacttggacagggcacggaggctgaggtggttgaaaagcttaagcaactggagctaagctcaaattccaaaaatatctcagtcttggggaaggcaataatggatgcttctgctgtaaacccgtcactggaaatgtggctgaaagattctgtgcttgcattatatccagatactaaagattgttctccagctctagccaatttctttaatgctcagcagaaattttctggaagcaagaattctaaaggagctcaacaaatgttgcccactatatgtcatagacctctatcctcatctggttccttagaacgtagagatgttgaggaatctcgctcatacatgagctcttctcctaatctagggtttgctgtcaagcagctgacacctactgatttgaggagttcattgctatctggaagaaatgaaacaggaagcaatcctgttgagtctcctgttcaggtgaaaaggaaccttggtagtcatcgcaattcaggaatttggcatagttacttccctcaaggacacatatttgaaagaataacatacttaaccgtattgggttgtattgcatttgctagcattaagttgtcgggaattggtcttagcaagactcttactggttctcattgggcttctactaaagctaatgataacattgcttggactgcagattcagctgattaccctgtagtcccagcttatattaggcaaagtaccatggccaacaaagtgaagaggatcctttcaatgtttaagatactcttgttgcaccagtcaggtactggaaatcatagtgatttacacactactcttacctcatcatcctaccctattaatgtttccagaaggctgatgcctgtggaagaagcagaaaccatggtcaggcaatggcaaacaataaaagctgaagctttgggccctagccatgaagttaattgtctagctcaagttcttgacgaatctatgcttgctcagtggaaaggtttggccaatgctgcaaaagaaagatcttgttactggagatttcttttgctcaagttatctattattcgagctgacattctatcagatggaaatggagatgacatggcagaaattgaagctctcttagaggaagcatctgaacttgttgacggttcacagcagaagaacccaaactattatctcacttacaaagttaagtatgttatgaagaggcaagacgatggatcatggaaattttgtgaaaatgatataatggaaacaccatga

SEQ ID NO: 106002 - DNA, 933 bp, Glycine max
  Peptide Sequence Number=SeqID_222780
atgaagttattcgggaccattgtatatccaaagaacagatacttgactctacagttccctaaaggtggaaagagtgtaatgtgtgaggattattttgataacatgatagtattttcggatgcatggtggatcgggaggaaagaagaaaacccagaagaagccaagctggaatttcctaaggaattgtatgagggacaccaatctgaatatgactttaaagggggtgcaggtgctggtgcagcttctgtagttaaccaaggtgttcccagaaccaagattcaacgtgtagagcaagagtcaccgaagacacccactgaagatgatttgtcagacagtgaaatcaatttagaagatacaaaggaattggttccggtccggcattcaacaagaactgcaaaaaaatcatataaatttgctgaaatttcttccggtgatgattctggtgaaaacagccctgacctttctgatcatgaagagaaagtggcggaagttgatactgctgtaaatgatcataatagctcaaatatccttataatacagaaaaaaactgtagtttttgacctcgatgatgaggatgatgcaccagtagatcaacctgccaagaaaaataatgagtctgcttctcgatcaaaatgtaaggaagtgtctcaatctgcttcagcgagtgcatctactgaagttaagtccagtaatcgtggttcacttgttcaggctactatatccacattattcaagaaagtggaagaaaaggatgaaggatccaaaaaaagggcaagaaagaccaaggacaaagatcctggtaaaaaaatcaaggcgaaaagcaagaaagacaatgttgaagatgatgatgatgatgatgatggtgatgacattgaagaattttcaaatgcttcggaggatactaatgaaagtgatgaagactggactgcttga

SEQ ID NO: 106003 - DNA, 1110 bp, Glycine max
  Peptide Sequence Number=SeqID_222781
atgtcttctgccggcggcgacaggggcggcggcgctacctccggcgaccctcgccaatacttctgccaccagtgcaaccgcaccgtctcaatttccccttccccctcctccgatctcctctgccccacttgcaacggcggcttcctcgaagaactcgaattcccaatccccaaccctaaccctaaccctcccaatcccttcttccccgacttccccctcgccggcgccgccaccattcccctcgtcctccccggcgccgccgcctcccctcccttcgaggatctctccgccctcttcggaaaccgacccgacgccgccgccgatgccttcaaccccctcgtcttcctccagaactacttccaaaccctaagagccggcggcaacctccaattggtgatagagtccggcgaccctggcggagcgttccgcttccccggcgtcacccacggcgactacttctttgggccgggcctcgaggagctgatccagcatctcgctgagaacgatcccaaccgttacggcaccccgccggcctccaagtcggtcgtcgagggcctgccggacgtctccgtcaccgaggagctgctggcgtcggattcctcgcagtgcgccgtgtgcaaagacaccttcgagctcggcgagaccgcgaagcagatcccctgtaagcatatatatcacgcggattgcattttgccgtggttagaattgcacaattcttgccccgtttgtcggtatgagttgcccacagatgatcctgattacgagcagagggctcgtcgtggtggtagtggtggtggtggtgctgccggcagtggggcagctccacaggtgaattggaacatggcattggggtccggtggttctgcggattcatctggtagcggtggcggtgataattcacagaggagaaggtttagggtgtctttgccatggccgtttaggcaatttgctgagacaagtaatgttgggagtggcaacaatgatagcaacaataacaacaacagcaatagcaatagtgacagtagtggaaataatggtgggcaatcgaactctggaaaccgggggaatcagaattttgactcggagaccagacaggaagatctcgattga

SEQ ID NO: 106004 - DNA, 1206 bp, Glycine max
  Peptide Sequence Number=SeqID_222782
atgtcgccgtcaaacgggttgcataacggcggcggaggcggcagcggtggtggcggaggtaatggggtgagttatatagagcaccaggtttcaaaacttgacactcttgctggtgtggcaatcaagtatggtgttgaggggtatgctgatctgacacaaccgtttgagttaagtgcgtctgtttttcctctaatgattaataatgccaacgggggaaatgcctttataagagacagatatgattgtataacatgtaaaatcacttatgctaatggcagtgtagctgacataaaaaggatgaatgggttggccacagatcttcaaatgttcgcactgaagacattgaaaattccattaccaggacgtcatccaccatctcctgctcctggtccacatgatgaacctgcaaagtcaggagaagctagtattgagaggaaacccctacgcataggtcaatctgccatgaaggaacctctccagtccttaggactgaaaccacctcaaccgaatatttctccagctatgagcattttacagaaattctatggcctcaaatcttcaaattcaagagatacattgaatggaacagaaatggcagtttatttgtcctcaaattctgatcattctagtggggaatggcttcccaaagcctcacccattttagacctaccatcagcatcaaatgattaccccaggtcaacaaatttagtgtatgatctactgaccggggatgatgaatatgtgcctcttgcggaaattggggacacaggagttgagaagtctgatgagaaatctgtccgaagacgtcagaaagctgaagttgataacggaaccagtaccccagaaaagattatgaaagaaggaaatggtaatggatcaaatggtctttcttcaaatggaaaaacattagccatgaggccgaaatcggctagtcgagcagcgctgttccctgagtcagaatcaggatggttagattcaattccagtggggttgggagaatctatatttactgatggcttttccggagtgcgcaaatcgtcaagtgcatcaagcctcagagagcaggaaaaaaacaattcagcagcagcctggccgcctgcaatatggagcttgaaacctgacttgcaagcagccatttcgaaacctatctttgatggtctacctatcccaatatctggccgcagaagcaaagctgcccttgattag

SEQ ID NO: 106005 - DNA, 141 bp, Glycine max
  Peptide Sequence Number=SeqID_222783
atgcctaaagaagcagtcatggagaatcatttcatttgggaaaagaaacaagaaagagagtataaggcattaaagttgcagatggagtggtgttcatggtggcacttgagacttatattggtcgactacataaccttctaa

SEQ ID NO: 106006 - DNA, 657 bp, Glycine max
  Peptide Sequence Number=SeqID_222784
gaagaagaggaagaggaagagagcgatgaagaggaggagagctttggtcatggtgttgggccagctggccaaggcagaggtaggggacgaggtatgatgtggccgcctcatatgcctctcgggcgtggagcccggcccatgcctggaatgcagggctttaaccctgtaatgatgggtgatgggttatcgtatgggcctgttggccctgatggctttggtcccccagcagccatgatgtttcgtgggcgaccctctcaacccgggatgtttccaggtggtgggtttggaatgatgttgaatcctggacgcggtcctttcatgggtgggattggggttggaggtgcaaatccaccaagaggtggtaggccagttaatatgcctccaatgtttccaccacctccaccactacctcagaatgcaaaccgtgctgccaaaagagatcaaagaactgctgatcggaatgataggtttggttcaggatctgagcagggtaagagtcaagacatgctcagtcaaagtggcggacctgacgatgacccgcagtatcagcaaggatacaaagggaaccaggatgatcatcctgatgatagtgaaagtgaggacgaggcacctaggaggtcaagacatggagaggggaaaaagaaacacaaaatatag

SEQ ID NO: 106007 - DNA, 381 bp, Glycine max
  Peptide Sequence Number=SeqID_222785
atggccaagcccctcaacttgaagctatctatgttttggcagggttgtgcaaagatgacatccaaaattggtggttctgttgctggggggaattggaaatatgctcatggaactgcacattatggacggaatttctctgttaaatggttgaagttatgtgaactgtcattccacaaaactcgccatttaaggaatccatacaatgagaacttaccagtgaagataagtagagattgtcaggagctggaaccctctattggagagcagctggcatccttgctttatcttgagccggatagtgaacttatgaaactgataggcaataatcatgatgtacaaatgggagaaaagcaaaatgttttgttattagttagaaattga

SEQ ID NO: 106008 - DNA, 885 bp, Glycine max
  Peptide Sequence Number=SeqID_222786
atggaggattccgagggagtcctcagcttcgatttcgagggcggcctcgacgccgccccctcctccgccgccgccgccccctccggccccctcatcccgcacgactcctccgcggccgcctccgcggtgtctaacggaggccccgccgcccccgccccgtccgcggttgaccccgtgggcggcggcaacgtccccgggcggcggagcttccggcagacggtgtgccggcactggctgcgcagcctgtgcatgaagggtgacgcgtgcgggttcctgcatcagtacgacaaggcaaggatgccggtgtgccgcttcttcaggctctacggagaatgccgggaacaggattgcgtctataaacacaccaatgaagacatcaaggagtgtaacattttgtacttcaattattcattgcattctaactgctggaccgtttggcatgatgactttggcttgtcttctgagcggtacaagttggggttttgtcctaatgggcctgattgtcgatataggcatgcaaaatctcctggacctccacctcctgttgaggaggtccttcaaaagatccaacatttatattcctacaattataactcatccaacaagtttttccaacaaagaggtgctagttataatcaacaagctgaaaaacccctgcttcctcaaggaaataattctacaaaccaaggggtgactggaaacccattaccagcagagttaggaaatgcccagccacagcaacaagttcagcagtctcagcagcaggtcaaccagagccaaatgcaaaatgttgctaatggccagcctaatcaagcaaatagaactgcaacccctttacctcaaggaatatctaggtgtgttcagggtcctgtgtttttcaattga

SEQ ID NO: 106009 - DNA, 168 bp, Glycine max
  Peptide Sequence Number=SeqID_222787
atgactgaatccatgcatgtgatgagagggccgaaggagacaaataagttgggattaaaggttaggtggcccaataaacatatctggtggggtataggcaatgttgtcaaacttgagattggaaggagggggggggggggggggcgtaaaaagatcacaactctctag

SEQ ID NO: 106010 - DNA, 291 bp, Glycine max
  Peptide Sequence Number=SeqID_222788
atggaaataaagtgcaatgacagcgtgaaaccgatgggagagcttctgccttttgtccatgggaaaaacgaagagggcaattcccttaggaatccagcttccaaagcttacgaacaggtgtttgcacctcaccatggttgggcaatcaggaaggctgtttccgtgggaatgtatgtccttcctacaaaggaacagcttctgaagaaacttaatgaggatgagcttgagcaggggtggcagacagggagagagatgatatatgtgaaacctatttatgatgaatgtggaatg

SEQ ID NO: 106011 - DNA, 240 bp, Glycine max
  Peptide Sequence Number=SeqID_222789
atggctaaatctataaaagctgaagcttcaatttgcccgctgcgtctaattacattccagttctgtggtgatatggttcaagctgggatgtctgccatggacgtcagtgacaaattaagaggattgtctgagcatgagagtatttgttgttctaggactgccccgtgtgattcctgtgggcattcaatgatgttgaaggacatggatattcatcagattgttgttcatcaaagtggctaa

SEQ ID NO: 106012 - DNA, 375 bp, Glycine max
  Peptide Sequence Number=SeqID_222790
atgaataaaaagctcataattcagatgatgaattaccttttagtcctcgccgatttcatcaacgtgttctttgatatatttccacgtgactggcttccaccgtcgaagtcatcatctctgtggaatcttatttatccagttcagaacaacatgaatccccaagaaccgtgtcatggatcgcttccctctcttcaaaactcgcaaatccgagatcctccaagaaccgcgccatcgttcgtcgctgcaactcgcacatgtcaaagtcctcaccacctttgcctacagcaacgccgtgaacaggcgatttctatcgatggagaccttgtcgtggtcatagagccccaagacaacggatttgagggcggaggaggatag

SEQ ID NO: 106013 - DNA, 279 bp, Glycine max
  Peptide Sequence Number=SeqID_222791
atgattcctatgcttgagaaatgtgcggtagggacttccttccaagtctctggtctagtggccaaggatcgtagccgtgtggctttgtatgtccgcttcaaggtagacggagactatgatgctactgtaggaggaggaggaagaggcgagccaggtggagtagccattgtggaagcaatgacttccaagattattttgatgatgccaaagaatccagagttaagcaagtttcaaagaattaggagtcaaaaagcttcaagaatcaagattcaagaataa

SEQ ID NO: 106014 - DNA, 294 bp, Glycine max
  Peptide Sequence Number=SeqID_222792
atgccgcctgaaccattgccttgggatcgaaaggacttcttcaaggagaggaagcacgagaggtccgagtcgcttgggtctgtcgccagatggagggattcctcacaccaccgcgacttcaaccgctggggatccgccgagtttcgccgaccgctaggtcatggtcatgggtatgcgatttctcggtccagcaacgacaagatgctggaagattatagtcggccgtcattctcatggggtgatggaaagtatggcaggagcagtagggaaaatagaggagggccctttggttag

SEQ ID NO: 106015 - DNA, 150 bp, Glycine max
  Peptide Sequence Number=SeqID_222793
atggagatgaaaggcttcgtacgcgggacgccaagaagaatgcggtttataggcgttcagaatccagacaatgtcaaattccgagaggttgagccgtggagacaaagcatgtctagtggtagacccaagatcctaagtcaatggggataa

SEQ ID NO: 106016 - DNA, 219 bp, Glycine max
  Peptide Sequence Number=SeqID_222794
atgtccactataggagtgtccaaagctggcgtctcttctagaagaaccactagggccaaaactactgttgcaaaagttggtagaaaggaaactcgtgatgcacccttttcaaagggtttcatctcaaaagttgatggtatcaagtccacacccacttcgtcaaagaaaagacaaccaagcttcatactctcgttgcaaaagataagagacaaaagataa

SEQ ID NO: 106017 - DNA, 207 bp, Glycine max
  Peptide Sequence Number=SeqID_222795
atgaaacaaggaacgcgtgcttggtatgacagattgaggtattttcttttagaaaatggttttatgagagctactaaggaatctctgtgcaaagatttctctgatctaatgaagaatgagttcaaaatgagcacgatggaagaacttaagttcttcttggggcttcagatcaagcaagacagtaaaggaatatacatacatcagtag

SEQ ID NO: 106018 - DNA, 609 bp, Glycine max
  Peptide Sequence Number=SeqID_222796
atggatcttgccttcaagaccttctgttcagacataactagacattcaagtattgaccttttctcttatccatcttgggaaatcttgcatgaagaagaagagtactcacttggtgtatataaagataaggaacaagtgatcaaggagttgcctccacgacagactgttgctcccaaccctaacagtgtgatcttggagcatcatcttacaaatagaaaagtgtatcctcttggtgtaagtgtttggaaaagtagagaggctaagtctgctgaaatgtctttatctactctcttggatcttcaacagttgatgggtttcatgtgttgcatcaatgttgtccttccttggcatcgcaccaactatctgcttatagagaatagattagatcaaggcaagtttcttttcgaaatagctattgataagcttgttctatatcagaaggctagttgctacaaaggcaatgagttgctaattgaagacggtgacaatgctccactaaccatatatgccaaagcttgtcctggtcaacttttcaaacatgagcttgaagatttaaagcaaaaggttgagctcactaatatggaccggtatgccatgaagaggttctaa

SEQ ID NO: 106019 - DNA, 471 bp, Glycine max
  Peptide Sequence Number=SeqID_222797
atggttgttcaagtgtatgatccctcatcttctcgcgtttatgctcattttcttaaagctgaacttgccataagcagagaaactcttgctcaagccttgaaggatcgtgctcatgctgaaaatgaggctcacaaatgctttttcttctccatcgtgctgaagactgtcaaagctctctttttcttgtccatcgccacattacctaggtatgtttcatctaagctctattgttctattgattacctaggtttgtttggggaaatcgtggttaacccaaggacctttattggtttctgctgcaaggattggggaagtcgtggtgatctgaggtttgttcctgtaacacatattcaggtatctgatcctggaaaccaaattgagcttcctggaagaaagttagcagttgattcaagggttttacacagttctgttattgttgttattgtttgtccaggtcatcctcaatcctaa

SEQ ID NO: 106020 - DNA, 384 bp, Glycine max
  Peptide Sequence Number=SeqID_222798
atggcacccaagaggagtgaagctattgtgtttccaggaatcaactctgaagaagaggccaggaacgtctttcatttggagtctttcatccctagacgttcgatggacttccaaaccctagaagaagagggtttccctatcaaaggacggggagatggaataacccagaagattatggatatcatgctttatggtactccacgacatctaaaagatgataagaaggcgatgatcaactttctcaaaactgcaaatctgacctacatgtgcagattgatccatactttccttttcagcatggtgatgcctagaatgggatcacatgattgtttgagtaatagggacaaattctgcaatgcaaagtcatggtacaagaaaatgtga

SEQ ID NO: 106021 - DNA, 348 bp, Glycine max
  Peptide Sequence Number=SeqID_222799
atgaaaaaagctaacttagatgagatgcttgagaagaatgaagcttttgagctagaagaagagtgcttgcctttgttaaagcactatttgaggaagaacacaagagaaagttggaggaagatgccaagcttgttgcctttagaagcaaaatatgcaacacaaatcttctctctggatattgttcaaaggcaagtagaaatagaagttgtcattattcctgaagacatggaccatgttgaaagggaagctcttgaagaggacatgcttcagccaataattgaggcatctcttgtagaaataaatgatgatatagtgtttgatactgatgaacaattatttgctacttag

SEQ ID NO: 106022 - DNA, 1251 bp, Glycine max
  Peptide Sequence Number=SeqID_222800
atgccacgtacaagaggtggtgaccacaccagacctactgcatttgtacgtaggtgtgcagttgtagatgaggagcaaaagatttacgaagctcccgaacatgttgtcgctgatgatgttgcacctaaagatattgtgtttggtgttgtagatgaggagcaagagatttacaaagctctcaaacatattgtcgctgatgatgttgcacctgaagatgttgtgtttggtggtggacctaaggacaaatcagtccttactaaatatgttgatcacatggcttgtaaattgtgggatagcttggactgtggagagttaaagctagtagcacatggaaggaagttgagggatttgccccccctcccccataaggagatcatgcaattggtgcaagttttagggttactttcattgactaaatgtagttatgaaaccattgacaagggacttttatttgcttttactgagaggtggcatcgtgagaccaacacatttcatttgccaataggagagatgacaatcacacttaatgatgtgtcatcattgctacatattcctattgttggtgaagggttcatgttcgcctatcttggttgtgaggcgtttatgcagataagtgtagggacaagcagtgggaccaagctactagagcttacttgttgcaatgagtggcatagggagctaaatggaaaacatacaaagggattaccacgagtcagtcgttggacaattggcaaaagattattatcattggctgactatcgttcagcactagacgagttgaccatagatagagtgctttggatgccatataaggagcactgcaatgtttgtccatttgggatgttatcactattttctggatatattcagcttgggtcaaacatgcatctacattttcctaagagagtcttgcaacaatttgactatacacaaaactattcctcaacacccatctatgtttacaacggttgtgttataggttacatggagtggtattttaggatctcgcatccgtttgtgctctcagttaataaagaatgcattcctattgtccaaccagtgataccagacatgagagatgtgttaaactcaagtacccaacataatttagtttatgagatgatcaacttaaggatggtgactgaaggcaccacaacatgggagaaggatgaggtggaagaagagtttggggtagttggggaggtcgtgaatggccttggagatatcctttgtaaaaacttattgacatga

SEQ ID NO: 106023 - DNA, 759 bp, Glycine max
  Peptide Sequence Number=SeqID_222801
atggaagatgattatgtgaggaagatgtcaaatgaagtggatatggaggttgacatggataatgacataagagtggacgaagatattcataaagattacagacaagagattgaaaaaattgttgattgtagcaaaggattcataactacaaaggatgttgcatttgaaatgggttttgttgttgtcattttgagatcagatacatcaaaaggacaacctagacggaagacatttgttgtgttgggttgtgaaaggggtggaaagagaccactgaagaatgatgaaggatggatattgaagttaatttgtggggtgcataatcatgatttacctaagtctttggttggtcatctgttgaatgagatgataactttgtttggccactccaaaagcttagaggacattttttttagagttgatggattgcctaaagtgattgtcattgacagcgatttagccttgataaatgcagtggaatctgaccaagtcatggatgcatggggtagtgttaaagattgtcttactcggtctaagtatgaggggcgtgtcaagatgtttgaaattgtatgttcaccatcagagtactttgtcaagtatgtgaagaatgcattgttgatccctcacaaggaatgttttgtaaaagcatggacgaataaagccgatgaccattgtggataccatgcaattgctagcttactacatatgggtgaagacacttggcctatagtgcgtaacaatttgcttaaagaacttggttag

SEQ ID NO: 106024 - DNA, 1719 bp, Glycine max
  Peptide Sequence Number=SeqID_222802
atgagcttatccaagaaaggttcccaaacagacgcaaaattgagctccttaaacaaagcaacctatttgaatccaaatgcagcagagtttgttccatttgccctcagatcatcgccatctggaagcaccagcttggtagatgcaacagcgaggtttgctgctgccggatctcttgggaaagcagttttagatcgagcagaatcatccatttcaaataattccgatgatgaggctcaccagtactggcgttgtcagcttcctgatgatatcacccctgacttcaaggtcatgggagaggatgaatcccaaggtcttaacaacctctctttagcaggcttatctataaatgatgataatgaatcctcaatgtttccttcttccaagggatttagatatatactaaatgagcagcaggaactgtctcaacagcaccttaatggcaatacttttgctgataaattaaggttttccaattcaacctacagggatgagccatcttcagcaagcattttgaactcatcagcaaagccttgggataggcaaatcaggaatactgatttgcatgttagcagtggtcaagaggcacttgtttatgatgacaacactggacatggattctttaatgatgttttcgctgggaattctcttgtgaatgatactgatttgaaccctttggagtttttagcttctctattccctggttttgcttcagaaagcctttctgaagttttctttgccaatggatgcgatttacatctgacaattgagatgctcactcagttagagattcaagttgacagtagcttcaatcagaatccgagtccaaagactctgtcatctccgaatctgagtgcaatggactttccagctcttacttcatcaaatggccagaatgcttcaaaatatgctgcagataacgttcaacaaagtggcaatccttacttatcatctgataaagacatgctcatgttcaaatctgggtcttctattccatctagaggtgctgttgactttgcttcagctgtcaggaaattggcttctcaggattctggtatatggaagtatgataaaaatggttctggtgatgcttccactggctctagtaggagtttaaatgctctggctagtgcctacaatggtggacaggggagagtcaacaatggtgatagattacagaatcgtggctctgctcgggcagctcctgtttggcttgaaactggtgacgcagttgcaaatatgtattctgagctgcgggaggaggctcgtgatcatgcacgtttgcgtaatgcatattttgagcaggcacggcaagcctaccttgttggcaacaaggcccttgcaaaggagctaagtgttaaggggcaactgcacaacgtgcatatgaaagcagcacatggaaaagctcaagaatctatttatcgccagaggaatcctgttgctccagagaatggaagagggccccaaagaatgatagacctacatggtctgcacgtaagtgaagcgattcacgtgctgaaacacgaactgagtgtgctacgaagcacagccagagcccccgagcagcgtttgcaggtttacatctgtgttggcactggtcaccatactcggggctcccgcactcctgcgagactcccaatagctgtacagcgttatcttctcgaagaaggccttgatttcactgaaccgcagccgggcctgctttgtgttgtgatatactga

SEQ ID NO: 106025 - DNA, 340 bp, Glycine max
  Peptide Sequence Number=SeqID_222803
gtttccatggcaaaacatcttcctaacatattgcttggaagaagggcatagtactcgtgtgaaaggtatcgttgtgaccactgatggtgatggtgatgactattacctaatggcgtttgggtcatctgatggctttatacgtttctgggatgttcgaatggctgctagggagaagccactagttgagtgtaatacaaattctagattgacgtgccttgctggatcatatcataaattaaatatgaagcaggggaatgaaatacagaggaataagaggaaggttaaaaacttaggattggagccaaacgaaacctataccgcaaaatcacaaagagtgtga

SEQ ID NO: 106026 - DNA, 2859 bp, Glycine max
  Peptide Sequence Number=SeqID_222804
atgaacaccttggagcaaaggaaaaatctgtggcatgatatagagggtctgcatgccagtatctcaggtccttgggctctcatgggggattttaacaacgtacttcatgctcaagacagaatagggggtaacatggtcacagaaaatgaatacagggatttggagaaaatgcttgaaataacggatcttcatgaaaaagatagtagtgggggctattatacttggacaaataaccaagctaatggtgtgatatactctcgtatagaccatgtctttggcaacttaagctggctgcagcagcacgtagacttcaatcttcaaattatgaattctggggtgtcagaccattccctcctctgcttgcgcaaacaggaagacagacgtcccagtagaactcccttcaagttccaaaatgtgatcactaatgtcttaggttttcaagaatccgtgagagataactggaataatcctattacgggtgctactgctatgtgcagactttggaaaaagcttaaacgactccagcccgttgagcttctaacggatcgttttaatatgcaggttattgagaatgtgagaagatgcacgatgcaagttctgaatctgagcaaccttgagaagcagcttctcaagaagaaatcgaaagttgagtggcttaaactaggagacgggaacaatgcttattttcatgcgtctttaaaatcgaaaagtaggaaaactcaaattctatcgcttgttactgagaatggtgatacgatttttgagcaggagaaaatagaagatgagattgttaatttttacaggaagctagttggcacgaggagcagtcagttaaatagtattgatcttgtagctatgaggcaaggcaagcaactgactagtgatcaaaggacctctttgacagcgcctataactgaagaagaaattgttaacaatctcaaaggcataagtgatatttctgcactggggatagatgggtacagtgcgaaaattttcaaagcgacatggaacataacgaaggttgacgtcatttcggcggtgaaggaattttttgaggaatgtctaatctacaaagcagttaattgttccttaatcactctaattcctaaattggacaatgccaatatggtgaaagattttcgccccatctcttgttgtactgttgtttacaaaatcatatcgaggataatgtctacgcggctggggaaagtgttgagttcagttctgcatcagagtcaagcagcgtttataccgggccagcgtattcatgaccatatattgttggcttatgagctgatcaaaggttacaacaccaagggaggaactccgagatgcatgctccaaatggacttacaaaaagcgtacgactccgtggaatggtcggcgttagaagccattttaaatgaattaagcatccctcacatgttcattaagtggattatgattatggtgactactgtgtcgtatagataccaagtgaatggtgcgctttctaatattgtgcaagctaagagagggctcaggcaaggggaccccctttcccccttgctctttgtgatcgttatggaatatctctaccgtgttctgcagaagttgaaacaggttccgaacttcaattttcatccgaagtgcgaaaagttagccataatcaaccttagctttgccgaagatctgcttatgtttacaagaggagatcccatgtctgtaagattggcgatgaatgcttttaatgatttctcagcagccactggtttaaaggttaacccatccaaatgtaacatttattttggaaatgttacggatgaggtgaagaaagagattcaggccaatgtgaactacaatgaaggcaccattccatttcgttatctgggcatccctttatcgaacaaaaggctttctgttgcgcattgcctgctcatagcggataaaattacggcgagaatcacacattggagtgcgcggcttttgagttttgcgggcagggcgcaattgattaacagcgttctttttgcagtttcgaatttctggctgcaatgcataccgctacccaaggaagttatcaagaggattaatgcaatctgtcgctcgttcctgtggtcgggtggagataagcttacgcgtaaatcccccatagcttggaagcgagtctgtacaccgacgaagcaaggaggtctgaatattatttctattgaggaatggaacaaagctaatctcatcaagttattgtggaatctaaatggtaaaaccgatagtttgtggataaaatgggttcactgttatttcttaaagaaatggagtatcatgaatgtccctatgaagactaacacttcctggatttttgaaagcagttttatctcaaagacaagaaaggttaaatggagatacttattcaaaggtaacatggcccgtccgagagcccgctttatcctttggatggcttgtcatgagagaatggcaactaaagatagattaatgcgatttggaatgctcaatgatgatacttgttgttactgtaaagaaaaagagaccattcaacatattttcttccaatgtaatgtgttgagtcaattttggaaacacacccttaaatggctagaggttccacattctccgggtggttggaatgaggagttggattggattattaagaagtgcaagagtaaggggagcaaagcgaagatcataaaatgtgcgttcacggaagcggtttatgaaacctggatgttcagaaacaacaagtgttttggtctggatactactagtagtaatgtaggcactagaatcaccgacaccattgtttacagatgttggttgaatcctaagcttaggaatcatttgggtaggcttatgatcccttag

SEQ ID NO: 106027 - DNA, 1314 bp, Glycine max
  Peptide Sequence Number=SeqID_222805
atgatttcagcatatgcggggaatggatgccccaaggagtccttagaacttgtatactgtatggttagattaggttttagacctgacttgtttacggcaatccctgcaatttcttcggtcacacaattgaagtataaggaatggggaaagcaaatgcatgctcatgtgataagaaatggctcagattatcaggtatcgattcacaattctcttgttgacatgtattctgtgtgcgatgacttgaattcagcacagaagatttttggcttgataatggacaagaccgtggtttcatggagtgcaatgatcaaaggatgtgcaatgcatgaccaacctcttgaggctctgtctctattcttgaaaatgaagttgagtggtactagagttgacttcattatagtcatcaacatcttgccagcctttgcaaaaataggggcattgcattatgtaagttacttacacggttactcactgaaaaccagccttgattcactcaaatccctgaagacatcgtttcttactagctatgctaagtgtggttgcatagaaatggccaaaaagctttttgatgaagagaaaagtatccatagagatataattgcttggaactctatgatcagtgcgtattctaaacatggagagtggtttagatgttttcagttgtacagccaaatgaaactatcaaacgttaaactggaccaagtaacatttctggggctgcttacagcttgtgttaactcgggccttgttagtaaaggcaaggagattttcaaggaaatggtggaaatatatggttgccaacctagtcaggaacaccatgcttgtatggttgatctactagggcgcgctggccaaattgatgaggccaatgaaataataaaaactgttccattggagtcagatgccagggtttatggccccttgttgagtgcctgtaagatacactcagagacccgtgtagcagaacttgctgctgagaagctcataaatatggaacctaaaaatgctggaaactatgtactgctctctaatatatatgctgcagcaggaaagtgggacaaagttgctaaaatgaggagttttcttagagatagaggtctaaagaaaacaccaggttatagctggcttgagttaaatggacaagttcatgagtttcgtgttgcagatcaatctcatccaagatgggaggatatttattcaatattaaaagtgctggagttggaagcgggggatatggaggatgatcttgaactctttgacccttctgttattaaggggtgtgaattgcacatgaatcaactcaaccaactttaa

SEQ ID NO: 106028 - DNA, 579 bp, Glycine max
  Peptide Sequence Number=SeqID_222806
atgaaatcaaataaagggaaagaaactatttatttaaccccttatctctcattcaaaaccctaatcttacatctggtgtccatcctgatcttctccacgaccttccctgacccttccaatgacacggggtcgacctgcaaagtgtcgactagaagccagcaagagaccattcagtcgccaacttcaatgtcggtggtctcagagggacctctgtgtcgtagatgcatcgcccttggcagcgacagtgggggcgctgacgaggatgacgtggtcgggggagttcggtggcacatcttagatttaaatcttggcatcggtggcctcttagagcgtcttgatgagcaagttggacttgccaatgatggcgcccactcgcgacatgtgacaaaggagacagaaggtcacgtgagtcgtgtagggtttggaacagttcacgtcaccattagagtggttagggttggaggttggttagccatcaaagtggaacactctgctttctactttctactttctacttctgctttagaggaagttgttgtttctttttcccataatgttgttgcttcagaggagatttaa

SEQ ID NO: 106029 - DNA, 382 bp, Glycine max
  Peptide Sequence Number=SeqID_222807
atggatgtgaagacaactttcctaaatagtgatttacaagaagagctatatatgactcaacttgaagggtgtgaggttcctggtcaagaaaacaaagacgactgggatgcacttgcaaacctcctaagatatttgagaggtactatggattatggtattaaatatagtggattctttgttgtactagaagggtatagtaatgctaattggatctctaattcaaatgagacaaaatccattagtgaaatggatggtagcaagactgagtggttgaaaaacttcttggccaatattcctttgggaatgaaaccaaccccaatagtgtctatgcactataattctcaatcagcaaccattgtagctaagaacaaaactttcaatg

SEQ ID NO: 106030 - DNA, 380 bp, Glycine max
  Peptide Sequence Number=SeqID_222808
atggaggaagaacctcgcatggagctgttgaaggtactgtggtttggtgcagagatccaatacggaagaggaagtggtgaaaaaccttgtttggaagagtggtggaaagtttgggattttgggaacgttaaagagatgaaaccaatggtggtgggtgtggagcatgtgttgagtgagtccaatagtagttgttactatgggtatgaagcttggaaaggctttttgaaaggatactttggtagagcttatagaggcttagagaatattgggcttagagaatactatgaaagatcgatgaggcttgaggaaaaagagtaccttgttgttggtgcttatgttagtggaaatcttatagttttagggactagacataatccaag

SEQ ID NO: 106031 - DNA, 135 bp, Glycine max
  Peptide Sequence Number=SeqID_222809
atgccatcaccccttctctccagctcagccaccccaacaatgcaagaaccattgtattacatcggtttgaaaagcataaagcttaagctggatccaagaagagaagttgataggaaattggagcaattggggtga

SEQ ID NO: 106032 - DNA, 543 bp, Glycine max
  Peptide Sequence Number=SeqID_222810
atgttgaatcgttttgggatggcatccataaaaccaatttgtactcctttgacaacattcattcatctcactgaactcaatgccactcagtcaaaatcagaaagggaatacatgtctcatgttccttatgtgagtgttgtaggtagtctcatgtatgtaatggtgtacacaagaccaaacctagcacaaacagtcaacgtggtaagtaagtatatgggtaaacttgggaaagaacattggcaaactgtgaagtgtatatttaggtaccttaagggtacaactgatattggattggtctatcaaggtgacacatcttgtgcccttgctggatattcagattctgactatgctatagatttggatgcaagacaatccgtgacagggtatgcattcacaattagatattctcttattagttggaaggttacacttcaatccacaatttccttatccactacagaggttgaatacatggctctagcagaagtaacaaaggaaggtatttggctgaaaggtcttattagtaatcttaggtttctatag

SEQ ID NO: 106033 - DNA, 471 bp, Glycine max
  Peptide Sequence Number=SeqID_222811
atggccaagaagagattgagtgcaaacttcccatcctttatcatacaatgttcatatggtggtggtggtagtaatgtcggtggtgctagtggtgagggtgatggtagtgacactggtgagattgtggtggtagtagcaagtgattgtgtggtggtggtggtggtggttgtggcgacgttggtggcgattgtggtgacaatgatagagcaatgtcagtgtgatggtgacagtggcgatgatggtggtggtgatgacaatgacggtgatggtggtagtagtgataaaaatgctgatagtaatggtgatggtagtgacaatgatgatgacggtggtggtagcgatgctagtgatcatgatgatgacaagatagcgatcgtgacaataacagatgtggtattcgtagtggtgataaatggtggtagtagtaaagaatgtcattgtcaagggtggagcaagatcgttttattgtaa

SEQ ID NO: 106034 - DNA, 276 bp, Glycine max
  Peptide Sequence Number=SeqID_222812
atgaagttgattttcgatgggaacaaaaacaccatgagatatcttccaaatccaccagtgttagtgcctcttgtgttgaaggaagggatcttaagttccaacaacaagatgatgaagactatggtgactaagtctcacccaagtgtgggaaaagaagaccctccaaagaagaaagtcattccgaaagagcttaaatggagtaagaagaagagagtggattattatgcaggaggatcagggcaagaaggacaaatcaccttgttcgatggtggttaa

SEQ ID NO: 106035 - DNA, 165 bp, Glycine max
  Peptide Sequence Number=SeqID_222813
atgatgcaggctctaagagaggaggtagcatttgttgagcgaagagcagaagaagagcgtgttgcacataatgcaaccaaaatggattctatggaaagagaagtggaattggagcatagagcagttgagtcatccactgcgcttgcaaggatacaactaatgtaa

SEQ ID NO: 106036 - DNA, 324 bp, Glycine max
  Peptide Sequence Number=SeqID_222814
atggattcaactagggtttggaggttggtgtcggagacgaggaaatggaagatgttctctagaaaaagggagttgtggaggatggagtgcacggcgacgattgagctgcagagagtagggatgcaatgggggcgaagcgagttgggggagaggaatccatggggttctctcttccatcattggatatacgcgcacgtggtgagggaggccaagggtcagctagtagggaaagctttacttttgacatacattattcttggcttaacaatcataaacacaaactattacatgacgaagattattacagtccttaccaagaactaa

SEQ ID NO: 106037 - DNA, 267 bp, Glycine max
  Peptide Sequence Number=SeqID_222815
atgataacaaatatagctctaactcatggccttattcccaccatcaatgcaactcacatgccaaaaggggtgacccatcatggaaactccaaaagaaaggttattagaggagtgatagagagtggagaaagagaggaactaagagaaagctccaaggttgactccacttcaatgaaaaggaaaggagaagggtttaaggcatatgttggtggtgataacagtggtcatgcgacgatcatagtgatcgtgctagtggtgacgacgtga

SEQ ID NO: 106038 - DNA, 333 bp, Glycine max
  Peptide Sequence Number=SeqID_222816
atgaaaggacgtacctcaatcgataagtggcagagacgaactccacaaagacgaactccacaatgtggttgcagtcacggaagcgtaggccagtttgcgacaaagacgaactcaggcagaaggagaaagaagaagaacgataagagcatgagacaatacatagaaaaacccttatcaagtaatgtgagcttcttgaatcgacacaagttgagaccctttctacaacgaagaatgaaaatgcaggagcacgtgtgcagaatcaacacagctcggcgaggtgacatgataggtctcgtcaaaatcagagctaatgagtgggttaattcaaattga

SEQ ID NO: 106039 - DNA, 579 bp, Glycine max
  Peptide Sequence Number=SeqID_222817
atggcatttgagttgtatgggatgttagttgggaatgttagtccactgactggtgaacttgtaaagcctgcctatggtggtgataatgaggcttttcttatgaaagtagtaaaaccaatatatgatgtaatagccaaggaagctgagagaagtaatatgggaaaagcaaagcattctcactggagaaattatgatgatttaaatgaatatttttggtcagttgattgttttcggctaggttggcctatgcgtgttgactctgatttcttctctgttccttttcctcaacagcaacatcaagttaacaaacacgaggcgatgataaccattgcttggaatggttccggaaaattaagctcaatatttgatggtgatattttcaagcaagttctcagcatcttcataactgctgcaatattgaagcttgcacaagtgtttgacactgcaattaaggttattctcgaacctccaaggaggaaagaaatggcaaggaagaaaaggcatagaaggtatgcttatgctgtggcatctgcattgcatggtgcaaagcataatcttcgcaaacactttatggttcag

SEQ ID NO: 106040 - DNA, 489 bp, Glycine max
  Peptide Sequence Number=SeqID_222818
atgaagcagatacatacagaggcttgggttaggttctacgacctgccacaagaatattggcgcccaaagacactgtttgagatactagcagtagtgggaaccctaatcactttagctgactcaatgagacgcaaagctttcaaacatatattatgcaaggcttttggtggatgtagatttagctggaaccctcttggaagaagtgatgagtacaaaaaactaccctttttctgtacccaatgcaacacaatcaaccacaaggagcctcaatacaagaaaaaagttcaatctttaggcgaaagggtgaaacaacaacctccgacaaatcttaaacccctaaccctaaaccaagcaattgcccaaccagaggaacccaagcctttggagcctacaactcataatggagttttaggggagcaaaatccgaaagagaatttgattgagaacactgtatctcctaatttacagatgaatgagcatattgcatag

SEQ ID NO: 106041 - DNA, 231 bp, Glycine max
  Peptide Sequence Number=SeqID_222819
atgaaagttgcccacctgtactggcctgagagattgaacagatggctgcctaacagtttgaagtacaagaacctacagcaagaaaacaacagaggatctgtaggcagcaaacattccaggctatttgttgctccactgcttcaattacgtgaatcgtggcattcactcagtgaattttatactgctgatgatccttctcaagcagatcagaggatggaccatttcgtgtga

SEQ ID NO: 106042 - DNA, 312 bp, Glycine max
  Peptide Sequence Number=SeqID_222820
atggcgaccatgacgagcttgatcggactcatcaacaagatccaacgtgcgtgcacggtgttgggtgaccatggcggcgagggaatgtcgctgtgggaggcgcttcccacggtcgcggtggtcggaggacagagttcagggaaatcatcagtgttggaaagtgtcgtgggaagggattttctgcctcggggatctggtattgtgacacggaggccactagttctgcaacttcacaagacagatgatgggcagcaggaatatgctgagtttcttcatgcatcaagaaagagattcactgactttggtaaatga

SEQ ID NO: 106043 - DNA, 147 bp, Glycine max
  Peptide Sequence Number=SeqID_222821
atgtcatgggtaagatcagcggtgaacaaagcggtggaaggtggccagagaaatatcggacgtgccgttcgcacctacgccgactccgtcatggtccatgcaagcaacgccgtcgctggcggtgccagaatcatccaggatcgcatt

SEQ ID NO: 106044 - DNA, 243 bp, Glycine max
  Peptide Sequence Number=SeqID_222822
atgtggtgttatgagtggaaaaagagtgaggctttgagagttggaagagttttctgcctttgccctgttttcttggctgtgcttgggaggattgatggggacccggtgttgagagaaacgaggttatgggctacgtgggagtacgtgagctcagttggaggtgggcaacaggggatggtgggtttatgcgcgctttgtggatgtggaaaacttgttgtgcaccatcgcccgactgccacctag

SEQ ID NO: 106045 - DNA, 576 bp, Glycine max
  Peptide Sequence Number=SeqID_222823
atggccgaaagtggcggtctcgaggctgacctgcgggtagcaggcgcggtaacgcccggcaatcggcgcgcccttggcaagagcgcgctcaaagccgcaacagcttctttcgggtccgtgaatgtctgcggcgcgaaaggctctggactgatgaaggtgaggggcggaatcgttggttttgctattgtcatggcccattataagaggccaatttcgacaggcaagcgacagaaatacgaagaaactgaaaagaaacgcgaaaatgcagccggacaatgctggcgcggcagaaactcagccgagcgcgccgcgctgcaggctcatcagcagcacgaagccggcgcctttggaggctgggcggggatcggccttgtaaaccgcaagtccggccaccgggccgagaaagatcgaggccatcagcatcagccgcagtgcggagaacaggccgttggaaaaactggtggtcattggccggtcctcacaatacgacggggcaattggcggcgggcgccgagccgtgctggcatgcgattgccgcaccggcattcacgcgctggaaactgcggttcggattaa

SEQ ID NO: 106046 - DNA, 132 bp, Glycine max
  Peptide Sequence Number=SeqID_222824
aagttgaagaaggcagagaccttaatattagtggactttgtggagtgtcctaaggttgaagtagtctatggttcaagttggaaaactggggaccttaaaatggaggaccttgacatagacttgatggagtag

SEQ ID NO: 106047 - DNA, 1359 bp, Glycine max
  Peptide Sequence Number=SeqID_222825
atggccggcgcttacgttggcctggcgatcatcctgatcttcaccctcggcaacctggcggacccggcgtatcgtccactgctgatgggcgccaccttcggtattgccctgacgctggtgatcatcgccggttccgagctgtttaccggtcataccatgttcctcaccgtgggcgtcaaagccggcaccatcagccacggccagatgtggtgcgtgctgccgcaaacctggctgggtaacctgatcggttcagtgtttgtcgccctgctctactactacgccgctggtgcgctgctgccgaacgccggttcgctgatccacagcgtggcgctggcgaaaaccacgcagacaacgatggcgctgttctttaaaggcgcgctgtgcaactggctggtgtgtctggcgatctggatggcagtgcgcagcgaaggggccgcgaagttcatcgctatctggtggtgcctgctggcgtttatcgcctccggttacgagcactccatcgccaacatgacgcgccgacctgacgctgagcggcatcggccacaacctgctgtgggtgacgctcggcaatatgttctctggcatggtgctgatgggcctcggctactggtatgccacgccgcaggcgcagcgcccacagacgcaagcccaggcttcgccgctgaaatcggcgatgtggctgaacgtaaagcgcgtttgctgctggaggccggcgcagagctgtacgtcggcgcgcgggatttttccccggcgtttcagctgtgggctcaacagggaaaagtgacgttactgcacggcgcattcaccgatgactggctgaatgaatgctggctggcgattgcggccaccagcgatgatgccgtcaatcagcaggtggctgacgccgccgaacagcgccgcctcttctgtaacctggtggatgcgccgcagcaggccagcgccattatgccgtcgatcgtcgaccgctcgccgctgatgatcgccgtctcttccggtggtcgcgcgccggtgctggcgcgtctgctgcgcgagaagctggaggcgatgctgccccagcatctcggcgaactggctgcgctggcgggctcactgcgcgagcgcgtgaagcagcattttagcgccatggcgccacgccgcgccttctgggagcgcttctttaccagcgatcggctggcccaaacgctggccaacggcgatcgggcacgcgcggccgcacaggtcgatgccttgtttgcggcgccgctgacgcagcagggcgaagtcgtgctggtgggtgccgggccgggtgatgccggtctgctgacgctgaaagggttgcaggctatccagcaggctgatgtggtggtgtatgaccggctg

SEQ ID NO: 106048 - DNA, 279 bp, Glycine max
  Peptide Sequence Number=SeqID_222826
atgatacgcggagataccttacggttattcgcacccatttgtcatccagaggcggcgggcccgatgacaagcagagaccaagtttggtcattctgcacccttgtatcatccagaggcggcgggcccgatgatacgcggaaatacccgagtggttatccgtataaacattcttttgctatctgtaagacagaacgcttgatagcatgcagaggagcgaaatttcatggtcgcccgcgactctcgtcaaccgagaggagcgaaattagtgtcatacactga

SEQ ID NO: 106049 - DNA, 192 bp, Glycine max
  Peptide Sequence Number=SeqID_222827
agttattttcataaggagacaggctttcggtgtcagtctttgaaggagattaagaattacgagaaatatggaagtcctcctcgacgtcacaaagtgaaaacacaagccaaagaagaaagcaatgaaaaaaccaaaaatgaaacagaatttactgacaactacaagctcatgagtaggactgaaagtgattaa

SEQ ID NO: 106050 - DNA, 205 bp, Glycine max
  Peptide Sequence Number=SeqID_222828
atgcatggcgccattggtgatgacgccttcgacagggacgagccacgtggctgtgtcgccactgcgactgacgacaaaggactgcatatcgcagctcctattggcgcgtccaagggcgccactggaggtagcgatttgagtgagagggaggcgccagtgaggcttgcgttttcagcttcagtggtgattgcttgtgttgagaaag

SEQ ID NO: 106051 - DNA, 339 bp, Glycine max
  Peptide Sequence Number=SeqID_222829
atggccgtagatcaaatgaaaagtatagaaagcccaaaggttaaacaatataccattaagcatagcttgcccaaaagagcagtggcgagagggaacttcaagatgagcaaccttggaatccttcttaatcaaagaagaccttctagaaggaagaggaggaagcaaggctttgtcaatgaaggaagtgcttcaggagtgtgcctccttgttagtgatgtagaaaggaaagaactgcttagtcttgacaatgagggtgtgcccaaaaatccaatgtttggtgatggcacactactatatagatcaatagattgcctgaaacatcatcaattacaacaatag

SEQ ID NO: 106052 - DNA, 888 bp, Glycine max
  Peptide Sequence Number=SeqID_222830
atggttaaggtaattttgacatgtgtaaagaaggttattggaagcattgaagaacaaagcataaatgttctttgtggtgttggaatcctttctacaccttatgctgccaaagtaggtggatggcttgggctttctatattggtcatttttgcaattatttcattttatactgggctgctcttgcgttcctgcctggacagtgaacctgagcttgagacgtatcctgatattggccaagctgcatttggtactactggacgtattgccatttcaatagtattgtacgtggaattatatgcttgttgcattgaatatataattttggagggtgacaatttgtcttctttatttccaagtgcacacttgaatttgggtggaattgaactgaattcacgtactttgtttgctgtgattactaccttggctgttcttcctactgtttggctccgtgacctaagcattctcagttacatatccgctggtggagttgttgcatcgattttagtggttctctgcttgttatgggttggcatagaggacgtaggctttcatagcaaagggaccacactcaatctttcaactcttcctgttgctgttggtctttatggttactgctactctggacatgcagtgttcccgaacatttatacatccatggcaaatccaaaccaatttcctggagtgctcttagcatgttttggtatttgtaccttattgtatgctggggctgctgtaatgggatacacaatgtttggagaagctatactgtctcagttcactctcaacatgcctaaagaattggtagccacaaatattgctgtctggactacggtggttaatccatttaccaaatatcctttatacgtgccttacgtaaattacatatga

SEQ ID NO: 106053 - DNA, 2074 bp, Glycine max
  Peptide Sequence Number=SeqID_222831
tgaccttactcgcaactacctaaacggtacaattcctaaagaatggggctccacgaaacttgccataatggtcttggagggcaatcaactgtctggaaatcttcctcctgagcttgggaatctaacccaaattcaaagactgctactttcctccaacaattttattggagaattaccagtaacattggtcaagctcactacgttgcaggatatagtgattcaagggagtggattaagcgggccaattccgtctggaatttcatttctagaaaacttaacggacttgagaattagtgatctgaatggatctgaacattctcttttcccacaacttaatcagatgaagaacttgaaatatctagaccttagctttaacaaattgactggaccaattccaagtacctatgatgccctaagaaaagtggattacatatatttaactgggaatcttctcaatggacaagtacctgcatggacagagaaaagtgacaatgtggatatttcatttaacaacttcagcgtcacaagccaagggagtacatgtcaaattggaaatgtgaacttgtttgctagctctatgacgcacaatgactcaggaacagttgcatgcttaggaagcagtgtctgtcaagaaacgttatattctcttcatataaattgtggtggaaagatagtaacagacaatggaagcacatatgatgatgattcagatactggaggtccagcaagatttcaccgaagtggaacaaaaaattgggcatatatcaatactggtaactttatggataatgacgctggcgcctattatatcgtgcaaaataaaactttgctttctatggacaatgttgacctatacatggatgctcgagtttctcccatttctcttacttactatggattttgcctgggaaatggaaactacacggttaatctacattttgcggaaatcatgttcattgatgatcaaacatttaacagcttaggaagacgagtatttgacatctatattcagggagcgctagtgaagaaggactttgatattgtagaagaagcaggaggaattggtaaggcagtcatcacatcattcactgctgttgtgactagtaataccttggagatccgcttgtattgggctggaaaaggaacaaccagtcttccatttagatcagtatatggtcctcttatatcagctatatctgtggaacctgattttacacctccttcgaaaaacaaaagtagcatatctgtaggagttgtggttggagttgtggcagcaggagcagttgttatcatccttgtacttggtatactttggtggaaaggctgcttcggaaagaaaagttctttagagagagagctacaaggtttagacctgcgaacgggtttgtttactttaagacaaatcaaagcagcgacaaacaactttgatgttgccaataagattggagaaggaggttttggtcctgtgtacaagggatgtttctcagatggaacactaatagctgtcaaacaactttcttctaaatcaaggcaagggaatcgtgagtttttaaatgagataggcatgatttctgctctgcagcatcctcatcttgttaaactctatggatgttgtgtggagggagatcaactattgttggtatatgaatatatggaaaacaatagtcttgctcgcgctctatttggcgccgaagaacaccaaataaaattggactggacaacaagatacaagatttgtgttggtattgctagaggtttggcatacctccatgaagaatcaagattgaagattgttcatagggacattaaggcaactaatgtgttgcttgatcaagatctcaatccaaaaatatcagactttggtttggccaagcttgatgaagaggacaacactcatattagcacccgaatagctgggacatttggatatatggctccagaatatgccatgcatggttacttgactgataaagcagacgtctatagctttggaattgttgctttggaaatcataaacggaaggagcaatactattcaccgacaaaaagaagaatcattctctgttcttgaatgg

SEQ ID NO: 106054 - DNA, 699 bp, Glycine max
  Peptide Sequence Number=SeqID_222832
atgaaagcccacctcgaagcgaatgatctctgggaagctgttgaggaagactatgaagttcttcccttaatagataatccaaccatgactcagttgaagagtcatactttaaagaaatcaaggaagttgaaggcaaaagctacattatttgccgctgtttcagaagagatttttaccagaatcatgcaccaaaactcagcatttgaaagttggaatttccttaaaattgaagatgaaggagatgacaaagttaaagctggcaataagaagagagactttcctccttgcaaacattgtaacaagaagggttgtcctcctttcaaatgttggagaagacctgatgtaaagtgtgggaagtgccataaacatggccaccatgaaagaatatgcaaaagcaattctcaacggaagaacaatgcccaagcagtaaccgaacaagaggaagagcaacaactattcgtagcatcatgttttacaagtagctgttcaagctctaatggttattggcttgtagacagtggttgtactaatcacataaccagtcatgaagaactctttagagattcgaataagtcacaagtatccaaagttagaattggtcatggcgattacattattatcaaagggaagggaactgtgacgccatctacctctcacatatatgtactaataattaaaggaacaagaaatcaaaattga

SEQ ID NO: 106055 - DNA, 246 bp, Glycine max
  Peptide Sequence Number=SeqID_222833
atgtgggatcgacacagacttaaagaagcactcaaagtgggtgtatttacccccaaggcctacactccaaagagtccgttaagacctctcccttctgattcaggatctctacacatgttcattttaaccccaactgcgataaatttatcccttacctctaagtgggctcatgcgtgtttcgacagcgatagtggcatctctaacggttccttgacattcctcaagcttttcctctggttgccctga

SEQ ID NO: 106056 - DNA, 231 bp, Glycine max
  Peptide Sequence Number=SeqID_222834
atggcattagcgcgggatttttgtagggaaacaacccatggggcaatttggtttagaataggtagcaaggtattagaaataccaagatgtgcacatgtgcaatttttggtaccccaaaatgcttggagtatgcatgtatgtgaatttagccaaggagatgtgtgtgatgaatggccccgaggaagcttgcctcaagaggtccaggaaggacaaggcggccgaaggaactag

SEQ ID NO: 106057 - DNA, 543 bp, Glycine max
  Peptide Sequence Number=SeqID_222835
atgtctccattgagagctttagggaagaagagagaaaagatatctgggagaggaaggggaaaaacctatgtgaatgaggcacaaagaaaaaaggaaaaatacctttgggtttcaacttttgttgtgagacagcctaatagtatcttgagaccagcacaaacagcgttccctcccatcgttccccccgaccccctcgccctcctcggctttagcgctaacaccaccgcccgcctcctcctccactgctgggagctcgaccccgccgtcatccaagttgcccgcgagtacttcaacctcgcccgcctcgagagggacaaccaaaaccgcctcttcatctacttcggcgatgccctcaacgccactatccccaacatctccagggcttcctcatcttcaatgctgtcggcggtggcaccggttccggtttcaaccgcagtcatggagccctacaacaacgtcttctccaccctctcccttttggaacacaccgacttggctgttctcttggacaacgaagccatctatgacaataacggaggttag

SEQ ID NO: 106058 - DNA, 237 bp, Glycine max
  Peptide Sequence Number=SeqID_222836
atgaagaaacaagctcgtttgccaggggcggattccctgggaaaagaacaaaaagccctgggaaatggacgtttgccaggggctgaattcctgggaaaaacgcccatcgcaaatcagtttgccagggatttcacccctggcaaaaaaacgaggggctggccctggcaaaatccctgtcttagcccctgtcttctcactgacgcatctgcacacttttctgacgcgctgctgtactga

SEQ ID NO: 106059 - DNA, 1360 bp, Glycine max
  Peptide Sequence Number=SeqID_222837
atgtcattttgccaggggtttccttggcttagtccctgggaaatttgccagggatatttaactggaaacttcctcactggactggtacctgagtggacaagtgccaataataaaaatttctatccgagtattaaccatctctttctatgccataggaacttgtttggaagcttttcaaggactaacttaggaccagtttcttgtgagaacagcactagaacctgtactaagaatgttcaatctctatatataaattgtggtggaaagcaggttgttgttggaggtataacatatgatgaagatatggattcagctggaccagcagtgtataaacagagtagaaacaactgggcatttagcaacacaggtcaattcatggacaataatactttagctatacaaggaaagcttcccgcctataccacagaaaatgaaaccaggctttatatgacggatgccgaattatataagaatgcgcgtatttcccccatgtctttgacttattatggattttgcttggaaaatggagactacacagtaaagcttcactttgctgagataatgtttacagctgatagcacatatagctgcttagggaggcgtctatttgatgtatatattcagggaaggcgagtactgaaggatttcaacattgctaatgaagcacaaggagttggaaaggaactcataaaagaatttcctgctcatgtgagtactaatgacttagagatccgcttctattgggcaggcaaagggacaacaaatatcccgtataaatcagtatatggtcctcttatatccgctatttctgtcaagtatgctcagtatgactctacaggtgacatgtctgcaggagttattgttgcaattgtagctgcattagtgattgttgtcatcttgattgttcttggcatactttggtggatgggtttcattggtgattgttgttggaatgcttcggtggaagggttattgtcaacgtcaaacttcctgcctcattttggtcgaaagaaacatttattaatgaaagagctcagagatctagatctacaaactggtgtatttaccttacatcaaatcaaagttgcaacaaataactttgatatttccaataagattggagaaggaggctttggtcctgtttataagggcattctgtcaaacagcaaaccaatagcagtcaaacaactatcacctaaatcagagcaaggaacccgtgagtttataaatgagataggcatgatctctgctttgcaacaccctaatcttgttaaactttatggctgttgtgttgagggagatcaattgttgctagtatacgaatatatggaaaacaatagccttgcacatgcgttatttg

SEQ ID NO: 106060 - DNA, 930 bp, Glycine max
  Peptide Sequence Number=SeqID_222838
atgcccttgcggggtaggattgcatcaactcccatggttaagtttgacccggatgtagtcctagagttttacgccaatgcttggcccacggaggagggcgggtgggacatgcgccagttcctcggagacccgctagtgttagaggagggccaagagttcgagtatagtcagagaaggaactgggccgatggatttgacgaggaggccattgcccagctgttatgcataccgggtcaagattttgcccggactgctgccgggagatgggtgcggatcatgcacactagtatgaccaccttgactcagatgtggatgacgttgctgctcagcaatgtcctgcccagcgatcataactccgacctccctcaacagaagtgttcagctggtgtatgccacctaccaggcacccttctagacccagataagtctagcagggccctggggtttccaacattgatcatgggtctctgccagtcattcggggttcccgtcacacctagtaaggtgattcgaccgccgatcacccgggccttcattgagaagtattgcacgtctagacaggcgcagggtgatgccccgcaggccgcagatgcaccgccaccacctcatcaggttgatccagctgggtcatttggcatggagcggtatttacagcacttggttcgccagcaggcagccaaccacaaggggcaggtgcagatacatgagtgtctctaccagctcagcctcagtcggcagtgccagggtttcgctccttttacgtgccctactctaaatcagttcagggctgaggttgcatggcccggagaatggcctgaggcccaggcaggggagccgcctgcagaggctcccggcgatgcagaggaggcccgcatggatgaggagatgacaaatttactcggtttcttgggagggagtggagccacgtga

SEQ ID NO: 106061 - DNA, 849 bp, Glycine max
  Peptide Sequence Number=SeqID_222839
atgggtttctctattttggtttcagagaggatcagatttcgggtgacttctagtttggatatgcagatgggcggtgggagtaaggtagatttgcaaacattagatgagggtatgcagcctttggcaaatgggactattgaagacaccttgcagagtgagctggagaagatactgcaagagcagcgtaatcggcaatttatcaatcgagagagggaatacaatattagtaggagtggaagtgcaccgccgacagtggagggatcgttgagtgcttttgggagcctaaggaactctgatttcggattgatcaatgataggaggagtaataacaatggacttttgactgaagatgagatacgatcgcatcctgcatatctttcttattattactcacatgagagtataaatcctaggttgcctccacctttgttgtcgaaagaagactggcgtgttgcacaaaggtttcatggtggtgggtcttcttcaattgagggatttggggactggaggaagaatgtagctcccaatggcgatagttcgtctctattttcaatgcagccaggattttctgtgcaacaggtagagaatgatttgatggaactgagcaaagccagtggatggaatgtctctaggcagggttcaagtcagatgctcgacagacatatgggtggtttgacaagaatgtcaggagctggtcttggtgggaggagaacgagttatactgacattcttcagttttggctaaattctgttgtcaacattccagaacatactggagatgtcagttttgttgaatctggaggcactagttcatttccatttatcatgttcatatatgcagtatactaa

SEQ ID NO: 106062 - DNA, 1545 bp, Glycine max
  Peptide Sequence Number=SeqID_222840
atgagacttcgcagagatggacaaagtttagatgcacaaggaaaccatgttggtcctgaacttcattccacaactctggacccacgcttcatccaatgcttgcagcaaagtgctgattactcgatgcaagggatgagtagttctggtcatcctcttcaaatgagaaatttccccgatgcttcacatggagatttggagggacttaggaaagcatatcttgagacacttcttactcaacaaaagcaacagtatgaactaccacttctgagcaaatctgggctgactaatgggttctatgggagtcagccatatggtcttggcatgccatattctggaaagcagattgcaaattccacacttccttctcttggatctggaaatccactctttgagaatgaacgtatttcacgcttaaattccatgatgagaagttcaatgggaggttctggtggctcatggcatgctgatatttgcaataatatagagggaagatttgctccatccttactagacgagttcaagaacaagaagaccaggccttttgaacttccagatatcattgatcatgtggttcaattcagtactgatcagtatggtagccgctttattcagcagaaattagaaacggcatctgtagaagagaagaccaagatatttcctgagatcattcctcatgctcgtgccttaatgactgatgtttttggcaattatgttatacaaaaattttttgagcatggtaccgaaagtcaaagaaaggaattagccaaccaacttacaggtcatgttttacctcttagtctgcaaatgtatggttgcagagtgattcaaaaggccttggaggtggttgatgtggatcagcagggtcaaatggtgtctgagctcaatggtgcaataatgaaatgtgtacgtgatcaaaatggaaaccatgttattcagaagtgtatagagtgtgtccctcaagataaaattcagtttattgtttcatccttttatgggcaagttgttgcactttctactcatccttatgggtgcagagttatccagagggttctagaacattgtgatgatcaaaatacacaacaaattatcatggaggaaatcatgcaatctgtcagcactttagcacaggatcaatatggaaattatgttattcagcatattgtggaacatggtaaaccacatgaacggactaccattatcagcaagcttgctggtcagattgttaagatgagccagcaaaagtttgcttcaaatgttattgagaaatgtttggcttttggtagtcctgaagaacgtcagattttggtgaatgaaatgcttggcacttctgatgagaatgagcccttacaggctatgatgaaggacccttttggaaattatgtagtgcaaaaggttcttgagacttgtgacgatcgaagtcttgagctgatcctttctcgcatcaaggttcacttaaatgcactgaagcggtatacttatggcaaacatatagtttcccgtgtggagaagctgataaccactggaggtgaggaatgcaaagactag

SEQ ID NO: 106063 - DNA, 1110 bp, Glycine max
  Peptide Sequence Number=SeqID_222841
atgattcctgatttaagtcaagttgaatatgttacagaaggcttttgtcagcatcagtatgtggatagtgacgaggctgttgcacaagcttatcaagaagaattatggcaacttgattccatggtagcttctgggatatccaattttgagaatgaaggaatgcaaggatctgtttatacacaagattggcctcagtcttcaaatggaaatgataacttaggcaatgaatcttgccagaactctgtaggtgagtcctataatatgaaagaagtggggaattatggtccaactccaagtgaaagaaaaaatgacgtgcatgaaaatgatgtttgtggttcgtcttctggatcagtagaggtacctgctactgctactagtgatgacttctgggattcattggaaatatcggatgaatctcttgatggtgaagttggcaaaagattaaaccagatggttcccattcctaaaataacagcaatttgcggctactcctctgtttgcaccattgctggacaggctatgcgacctgtgccatcatcagacagcctttgttctgcgtcttttctagaatttccagtgaggcaaaattgttgggtgaagaggaggagaggggcggctgatgggggaaagaggctaggtttttctttcttgggtgaggggcatgttcctaaaaccaatgaaaaaataccatctgatgacgaagaaatatcagatcatcaaagacttctagacaggaatttggtctttcttagattgcagttatatgatctgattgaatgcaaggttcaaggagatggtaactgccagtttcgttctttatcagatcaactctatcgttctccggaccaccacaaatttgtgcgggagcaaattattcaacagctcaaatattacccagatctgtatgctggttatgttcccttggcgtatagtgactatttgagaaatatgagcaaaagtggcgaatggggtgatcatgtcacattgcaggctgctgcagattggccttacccttgcatatgcaaagaggctatttccggattcgaactcatgaccaatcggtcaccaaggcacaaatttaccgttgtgccagggctctccctcaaatga

SEQ ID NO: 106064 - DNA, 1073 bp, Glycine max
  Peptide Sequence Number=SeqID_222842
tggtcaaaaacctctgcgcttctctctcaagtctcaaagacacgctccctgaaaaccctaacatctaccacttctctgagatctccgccgcaaccgccaatttctccgcgccacgcctttcctcttcctcctggcgctgcgtaattcgtcaccgcgaagtcgtcgtttcgcgccgcgacttccgccgtcaaattgatatcccggagctcagccgccgcctcgccctcatctgccggagtcaccacagcagcctcttgaaactcctcggcgcgtcggtctctggcgccgtcatcttcctcgtcaacgagttcgtccccggcgccagcctcgccgactgcctccgcaaccgccggaaccctagcttcaccgatctcaacacgtggatctctcggatgcagatcgcgtccgacgtggcgcacggtctcgattacatccacaatttctctggttccggttcggattccggttccggatcaggatccggattcgttcacaagcacatcaagagttcgagcattgttatcacggaggagaatctgcgcgcgagaatctgccacttcggcgtgtcgggtctctgcggcgaggccgtcgccggcgacggcgatccttctggcggccggactgtgaggatcgaggggaggagaggctacatggcgccggagtttcagatcagcggcgtcgcgacgaagaagagcgacgtgtacgctttcggagtggtggttttggagctgctgagcggggaagaggcggtgaagttcgaattcaacgacgacggcggttatcgcaggattagcgtggtggagacggcaaagattgcggcggaggagaacggcggcgtgaggaagtgggtggatacgaggctgagggattcatttcccgtgaatgttgcggagagaatgattcgggtcggattggaatgtgtcggggatgacccgaatgagagacccgatatgggttgggtttctgatgaggtgtcgaagttgtatttggatctcgttggccccacgtacatgattgcggatatgaaggaaaaggtgaagtttgaagcactcaaatcagccaattgggcttga

SEQ ID NO: 106065 - DNA, 549 bp, Glycine max
  Peptide Sequence Number=SeqID_222843
atgaagaactatctaattctctctctctctcttatttattcccttgtgtgtgaaaaatcttggtattctcctaccagtgcaatattaaacagttatggattccatcaacggggggtcatgacccatacaaatccaatcaaacctgtctgtgaagatgtagagaataatgaagcagacaccttaaaatcaagtccaaacccagatgaagttgctacatctattagtgttaatgaaacctcttctgtaaagttttctgccaagtccagtttgaagacatcctcaaggcatgatcttgctatggttttcacctgcaaggtctgtgaaacgagatccattaagacggcttgtcgcgaatcgtatgagaaaggtgtagtggtggcaagatgtggggggtgtaataaccttcacctgattgcagatcaccttgggtggtttggtgaaccaggaagcgttgaggacttcctggctgctcgtggagaagaagtgaaaagaggttcagttgacacactgaatcttacattggaagatttagctggaaggaaaccttga

SEQ ID NO: 106066 - DNA, 1071 bp, Glycine max
  Peptide Sequence Number=SeqID_222844
atggcatgtcgctctgttctttcatcttctcctcacataacgaactccatggccatcaaggagggtgtcctctccttcgcacccaaccctcctctgcttcttcgtctcccgaaagccgttacctttctctccttttctgcttccactaaaccccccactaagtcttttcaagtgagatcagttgctggtactacagaagctgcatcggggtttgatgagatgatttctgggactaagaggaagtattacatgcttggtgggaaagggggagtagggaagacaagttgtgctgcttcgcttgctgttaaatttgccaataatggacaccccactctcgtggtttccaccgatccagcgcattctttgagtgattcttttgctcaggatttgactgggggtgcattggtgccagtggaaggacctgattatccactttttgctcttgaaattaaccctgagaagtttagggaagagtttcaaaatgccgcccagaaaaagggtggaaccggagtcaaagacttcatggatggcatgggccttggaatgattgcagatcagggtcacacattacgattattgtccttacccgatttcttggatgcatccattgggaagatactgaagctaagacaaaagatagcttctgctacctcagcaattaaatccgtatttgggcaagaagaaacccgacagaatgctgctgataaattggagaaactcagggagaggatgataaaagtgcgtgaactctttcgtgatactgattcaaccgaatttgtcattgttacaatccccacggtgatggcagttagtgaatcatctagattgagtgcttccttgaagaaggaaaatgttcctgtgaagagacttattgtcaaccagattcttccaccgtctacatctgattgcaagttttgtgctatgaaaagaaaggatcaaatgcgtgctcttgatatagttcagaatgatccagaactctccagtttatcaatgatccaggcaccactcgtagatgttgagataagaggtgttccagctctcaaatttcttggtgacattatttggaaatga

SEQ ID NO: 106067 - DNA, 3480 bp, Glycine max
  Peptide Sequence Number=SeqID_222845
atgtgtaggtggagcacaaacccaatgcatttgagggtgcacattattgtggtattgagcttgttccttgggatgatacagttacagtgccaacaagtgaatgactatgatcagattgatagccctgctgttcttcctctccttactcagcttgtctatagtcaaatctccaacttgacatcaattctcagtcaggaaattagcaaagagtctactttctgtgtcaaagatccggatgctgattggaatcaagcatttaatttttcatctgatttgggcttcttggcgtcttgcattaagaagactagaggagatattgcaaaacgtttgtgtacagcagcagaagtgaagtttttcttaaatagtttgttggagaaatctgtaagtgccaattatttaaagcctaacaagaactgcaatttaacctcatgggtccccggttgtgagccgggatgggcctgtagtgttccctcaagccagaaggttgacctcaaaaattcaaaggagatacccgcaagaactttgaattgtcaagcctgttgtgaaggcttcttttgtcctcatgggattacatgcatgatacgtaacttctgtgatgaagagtctatatcattgaagcatattggtatcaattgtaataacgctagtgattgtctagatgtatctcaaaaactgtctctgatgcttctattctgtcttattgttcttgaagcatgccctctaggttcctattgccctcttgctacactcaataaaacaactggcgtatgcgaaccatatctttatcagctgcctccaatgcagacaaaccatacctgtggtggagcaaatgtttgggccgacgttagtagcagtagtgagatattttgctcagctggatcatattgtccaacaaccacaaaaagaattccctgcagtagtgggcattactgcaggatgggctccacatctgagaaaagatgcttcaagttgagttcatgtaattcaaacaccgcaacccaaaatatgcatgcatatggaattatgctcattgctgctttgagtactttgctactcattatttacaattgttctgaccaagttctaactactagggaaagaagagtggccaaatctagagaagcagcagctagaagtgcaaggaagactgcaaatgcacgccaaagatggcgatttgcaaaagatgccactaagaagggtgcaatggggttgcaagctcaactatcacgcaccttcaagaaggatgctgcaaatctggaaaaagttaaaattttgaatcaagcaacttctgaagtgggtgttgaattgttatcacattcacgacctacaacttcaagcatggttgcaacttcatctatggcaacaaaggaaaagggaaaagaacccagcagtctaatgctgatgatacacgaaattgaaaatgatccagatataaatgacaaccttcatacagaaatagaaactagagatacaggtgttagagaaaatgtgccaaagggaaaacaaccacatactcatagccaaatttttaagtatgcatattctcaacttgaaaaagagaaggctcaacaaaaagaaaacaagaagcttaccttctcgggggtaattaaaatggctacaaacactgataaaaggaaaaggcctttaatggagatttctttcaaggacctgactcttacattgaaagctcaaaacaaacatatattgagatatgttactgggaaaattaaacctggccgcatcactgctgtcatgggtccatcaggggctggcaagacaacatttctttcagctctagccggaaaagcattgggatgcttggtcactggttcaattcttataaatggaaggaatgaatcaatccactcctttaagaaaattactggctttgtgccacaagatgatgtagttcatggaaatctgacagtggaagagaatctctggttcagtgcacagtgcaggctatctgctgacttgtcaaaaccagaaaaagttctagttgttgaaagagttattgaattcttagggcttcaatctgtgcgcaatgccttggttggaactgtggaaaaaagagggatctctggaggccaaaggaaacgtgtaaatgttgggttggaaatggttatggaaccttcactcttgatcttggatgaacccacatctggcttggacagtgcatcatctcagctccttcttagagcactaagacgcgaagctcttgagggagttaacatttgcatggtggttcaccaacccagctatgctttgttcaagatgtttgatgacctgatacttctgggaaaaggtggtcttactgtctatcaaggatctgccaagaaagttgaagaatacttttcaggcgtggggatcaatgttccggagcggattaatcctcctgattacttcattgacattttggagggcataacaacccctggagggggctcaggactcagttataaagagcttccggtaagatggatgcttcataatggatatccaatacctcttgatatgaggcagaatgcagttcaatttgatatgtcccagagtgtaaattcagcaaatgaaatagattccaatggatctggtcatgtcggaaaaacctttgctggagaattatggcaagatatgagaaacaatgtggaactgaagagggagaagataagactcaatttttttaaatccaaggatttatctaaccgggaaactcctggtgttttcaagcaatacaagtactttcttatacgggttgggaagcagcgactacgagaagctaggatccaagccattgattatcttattttgttacttgctggagcctgcttaggatcactttccaaatcaagtgaccaaacatttggtgcagctgggtacacccatacggtgattggtgtatctcttctgtgcaaaatagcggccttgagatcattttctctggataaattacactattggagggagagtgattctggcatgagcagcttggcttatttcctctctaaagacacaattgatcattttaatacactgatcaagcctgtggtgtatctttctatgttctatttcttcaccaatccgagatcaacttttgcagataattatgttgtgctgctttgtcttgtatactgtgtcactggcatagcatatgcattgtccatattttttgaacctggtgcagcccagctgtggtcagtacttctgccagttgttttgactctcattgcaacacaaccaaaagatagtaaagttttgaagaatatagctaatttatgctactctaagtgggctttacaagccttagttgttgcaaatgctgaaaggtatcagggagtgtggctcataactcgttgtggttcacttttgaaaactggctataatcttcacgattggagtttgtgcatatctatcctcattctaatgggtgtaatttgccgggctatagcatttttctgtatggtcaccttccgaaagaagtaa

SEQ ID NO: 106068 - DNA, 231 bp, Glycine max
  Peptide Sequence Number=SeqID_222846
atggtaaggaagcagattcattcacagtcacttctagtcatcaatggaggtgttggcatggtcaaagcccttgtggaaatcaatgacattgacaacggtgacgatgtagcagatgttcttcacggtgctgatgattatgcgatgaatggaacgtttgttgagcgaaagggaaaatcactttggtttcaagcatttactaatagcatgtttggaggtggcaaggagaggtga

SEQ ID NO: 106069 - DNA, 212 bp, Glycine max
  Peptide Sequence Number=SeqID_222847
atgaagaagccaccgatttcaaagcctctccaaattctccttctcctctgtagcagcaacacaaaagcagatctggctcggtgggatggccacgcaagcgcgcgtggcggtttagaaagtgagcttctgccgcagcgcaccgacctcaaccgcgacgccgattacatgctctccaacgtcgccacttcctccgcctctgcgatcctttgggg

SEQ ID NO: 106070 - DNA, 540 bp, Glycine max
  Peptide Sequence Number=SeqID_222848
atgggctcagaaagctaccctgaggttcatcagaattctaaggccttcttcagcagctctagcccaatcctcttggagcctcttgctcatggctctggtgactggtcccttcctagggaggattgcatcactcctaggcattcgacgaggtttttcactgacatgattgattcaaggagttttgatgataacaaagatgatgtcaaaaagctcaaaagtcaagatcacttcatgataacaaagatgatgacattcaagaatgagttcaagattgagtcaagaacacttcaaggatcaagagcaaatttgatttcaagaatcaagaatcaagattcaagattcaaatattcaagaataatcaagatcaagattcaagactcaaagattcaagaatcaagagaagacttaatcaagataagtattaaaaagtttttcaaaacattgagtagcacaagaagttttcacaaaatcattcccaaagagttttactctctggtaatcgattaccagattatagtaatcgattacaagtggttttaa

SEQ ID NO: 106071 - DNA, 384 bp, Glycine max
  Peptide Sequence Number=SeqID_222849
atgcgtggattcgccactaacgtttatttgaggaaaacattagaaaaaccaaaaagagggaaggtcgacaagggtgttgcccttgctcctacgtatcctcaggcaaagggtcactttggggaagttgcagctcgcccaggcgagctgaaacttagtgctgaagcaatgagctcacccaggcgagttggtttcttcaccatgaagctatttggtggcccaagcgagccagagggtagcctgggagagaatacaccaaccatgtgggatcagcacaggcttaaaggagcactcaaaccgagtgtatttacccccaaggcctacactccgaagagttcgtcagggcctctccctcctgattcaggtccaaaccagaaaatattttag

SEQ ID NO: 106072 - DNA, 1173 bp, Glycine max
  Peptide Sequence Number=SeqID_222850
atgagtaaaagaaaatctggtggcactggcaataagtacaaggctaggcttgtggccaaaggtttccttcggcaacttggttatgattacaatgagaccttatctcttgtaagtgaaccaattactatcagaatccttcttacacttgctattactcaaaaatggagtcttaagcaattagatgtcaacaatgctttaattaatagaattcttgaagaagatatttacatgactcagccacctgggtttgaaatttccaacaaacacattgtgtgtaaactgcataaggcaatttatggtcttaaacaagctcctagaagttggtttgagaggttaaaagctactttacttcattttcacttcaaatctagtaagtgtgacccttctttcttcatttacattgattccaataacattgtggtctacatgttagtgtatgttgatgacatcattatcaccgaaaacaactcttcattcttcaaatcactagttactaaactcaattctgagttttctctgaaggacctaaggagtcttgactatttcttgggaattgaagtcaaatctcaacccaatggtgttccaattctaactcaatccaagttcattagggatttgttgagcaaaacaaagatggatgaagctaatcctatttcttctccaagttgcaaattaactaagtcaaggtatgaatccttccctaatcccacacactacagaaggtccatttatggagctgccatattttttggttccaatttggtgtcttggtggtccgaaaaacaaattgtagtttctcgttctagtacaaaagtagaatgttgtagcttagccttggaaacatcaaaggatttggcagcagcaaaggttacaaggatcaaatttcttctacctaaacttcacattgctcatgctacactaagtattttttgtgataacataagcactgttgcttttgctcacaacccaatgatacatcctcgtactaaacctatggagtcaaacttgttctttgtcaaagaaaaggttttggctaagaaagttcaagtcatccatgttctagctattaataaaaaagcagatattctaactaaggctcttactccttcaaatttttctacatacaagttcaagctcagaagggttgaaaggcattttgccaaccactcatga

SEQ ID NO: 106073 - DNA, 549 bp, Glycine max
  Peptide Sequence Number=SeqID_222851
atgcttagaggagtgcatgttggtgggtgctggatagaagagccgagcagagtcaaagaggaaatcaaattatttttcaagaggagatttgaggaagtgaagtgggagagagacctaggttggatggggtcaaattcaagtctatttattggccagcaacttaatgatctttcggtggctcgttttgaagaggatgaagtgagggctgcaatgtgggattgtagtgacttgcttcgcattctggatgaattgcatgacaatggagtcttctcgaaaggaagcaatgcatccttcctgaccctgattcctaagagccccatagatgagttcatccctcagagagaacataggcaagggaacccactagcttcattcctgttcaatattgtagttgagggtctaactggattgatgagagaagctcaggagaagaatctgtttcaaggctttatggtaggaagaaataatgtggacatcaatctattacagtatgctgatgatatggttttctttggaaaaacaatattggtgaatgtaaaagcaatctag

SEQ ID NO: 106074 - DNA, 870 bp, Glycine max
  Peptide Sequence Number=SeqID_222852
atgctccacctccgccagcgccgcgacgccgtcgcgccagccaccacgcgctggcgcaacacggtagttttacggctacaacaacctcctcctcctcctcgcccgaaacgttcgaggagaatctggagcagtggccgcacctcaacgagctcgtccattgctacaccacggattgggtcaaggatgagaacaagtacggacactacgactccgtcggaacgccgtcgtttcataaccagatatatgaaggccccgacactgacattgaaaccgcttttgcattctgtgacttcgggcattctgcgtcataacactattaatagcatgtgggtggaaatgcgccttgctggggcaaggcaaacaaagggtgatgatattagtgaagatgacatacctagtacttcaggaaggcagtttatggaaggtgcagatggtgacttgctgccttcggatgttccaaagcatattggtcaatctctccttcctgcttatgagcctgcatttgattgggaaaatgagagggcattgatatttggacaaaggataccggaaactcctgtattgcatggaatgaagatctctgtaaaagttcagtctttacaatttcaagcaggattggccgagcccttttatggtacaatgtgcttgtacaatagggagagaagagaaaagttatcagaagacttttactttcatgtcttaccaactgaaatgcagaatgccaaaattacatgtgaacctcgtgcagtcttttacttagatgcgccatctgcttcagtttgtttgttaatccagttggagaagcatgctactgaagaaggcggggttactgcttctgtttattcacgtaaagatccaccaagaatttaa

SEQ ID NO: 106075 - DNA, 1152 bp, Glycine max
  Peptide Sequence Number=SeqID_222853
atggtctgcaaactcaagaaagctatctatgggttaaaacaggcacctagggcctggtatgaaagattaaccaaatggaagcttggcaaatggaaatggaagctttttcagaatcagggggagttgtgggtcagggtaatagagtcaaagtatggcaggtggaggaatttaaatgaagcaaggtcagccaataacgaatctacatggtggagggacctgaagattgtagctcagcatcctcaacaggatcaattgctgaatagttcgatagtgtggaaggttggacgtggggataaatttaaattttgggaggacacttggacaggggaagataacaaattactagagaaataccctaggctttacagtatatctgttcagcaaaattatttcattctgcaaatgagagacttcaaagattcagggtgggaatgggactttaaatggcggagaccgttgttcgacaatgagatagatatggcggtatcatttctacaagaacttgaggggaacagaattcggtcccacagggctgaccagtgggtatgggtggcagatcctagtggccagtatacggttaggagtgcctacaatgtgcttagagaggacttattacaggaggaccaggacggagagttcaaggagctatggaaggtgaaggttccatctaaagtagctgtgtttgcatggcggttactcaaagataggttaccaacaagagacaacttgaggagaaagcatgtggagctacaagattttatgtgccctttctgcagaacaatagaggagagtgcaagtcacttgttttttcactgcagcaaagtgtttcctatatggtgtgaaatgctgtcttgggtaaatctggtgggtgtctttccacatcacccaagacatcattttcttcagcacatatatggagcatttgaaggaatacagctggacagatggaaagggtggtggctagcattgacatggactatttggaagcacagaaatagtatagttttctccaattctgccttcaacacaaataaagtggtggatgatgcagtatttctgttatggacttggctcaaaaacttagagaaggatttcacaacccactataatcagtggtcatcaaacctaactgaaggatttttccgcagatga

SEQ ID NO: 106076 - DNA, 1227 bp, Glycine max
  Peptide Sequence Number=SeqID_222854
atgcccttcatcatagacaaaaggcaatctgcattcattgaaggaaggcatttgttgcatagcgcggtaattgcaaatgaggtggtcgaggaagctaggagagggcagaagctgtgcattgtctttaaagtggattacgagaaggcatatgattcagtatcatgggactttttgctttacttgctgcggaggatgggtttccactccaagtggattcgatggatggagggatgcctaaaatctgcttctatctcagtatttgtcaatggcagcccctcgcatgagttcataccacagagaggcctgaggcaaggggacccattagcaccgtttctattcaacattgtggctgaagctttgaatgggctggtaagagaagctattgggaaaaacctatacaggggattctcagtggggtcaaacaatgttgacataagcattctccaggttcctaagaaggtggtcgacaagttagttcgcattcagagaaagttcttatggggaggagcgcttgatcatactctagcttgggtcaagtgggacatagtgtgcctcccaaaggacaaaggggggctggggatcaaggacgtaaacaccttcaatctcgcattactagcaaaatggaagtggcatcttttccagcaccaagggcaactgtgggctagggtggcgtcccatcatctggagcacggcgaagcattacagaggagcacagtctggagggtcggatgtggggacaaaattaagttatgggaagatgattgtataggagatagcggtgcattagcaacaaaatatcctagattgagatcgttgtttgataatgagatagacgtggctattgcatttctaaaagatatggaaatccagcaaattcagccagagagcacttacatcgccatgagggaggctccattagaagtgatagaagatacagcttatgcagaactgtggaagatgaaggctattaatagtttgaagaatgttgattccaccgctttacttcagtttcttcacccaattcttaacatgctacttcatcttattggcaatggcggagaaacactccaggagtcagttgatgatgctgaaagaaatcatttcctagtcaactatgttgattgtgcttttgatgattttggtggtcgtcaaccacctgtatatcctggactgtccactgtttggggaagcttggcacgaagtaaggtactggcgagttcattatga

SEQ ID NO: 106077 - DNA, 306 bp, Glycine max
  Peptide Sequence Number=SeqID_222855
atgccaagtggcaaaagaactagaactattagaaattgtatttgcaaaagaagcatcattaaaactccatttacagaattggagacagaatttgaggaagatgctctgaagacagaattggaaacagaatttgaggaagatgctctgaagacaggttctgaaacatcagaggaaatgattagggaattggtaaagtccatcaataccaaccaacccttgaagcaggacctctttagagacctgagatttgaccaagcaaaactgagaaacaaactcaaaaaacacaagttatctccacaaaactga

SEQ ID NO: 106078 - DNA, 351 bp, Glycine max
  Peptide Sequence Number=SeqID_222856
atggtacaactaagcttgtttcagttcctgttgctgatgctactctctattggttggttggttgttggggcacttcagtacattactgtaactagaccaaaaccgaactacagtgtaaacaaggtctgtcagtttatgtcagaacccatggaggaacattggaaggctgtcaagtgtattttaaggtatctaaagggtactatagactatggattgtctctaaaatctgcttctcagagagaagcctatactttggaagctttctgtgatactgattggagaatggatatggttgacagaagatcaatttcagggggatgtattctctttggccctaatcctgtttcttag

SEQ ID NO: 106079 - DNA, 699 bp, Glycine max
  Peptide Sequence Number=SeqID_222857
atggggggaaaggacctgtggtttgagtttaagaagtggggcgatgtcatgaagagacaaatgaaaggaatggaaaccaacagagttaacaaggatcatcagcataaggaggcagcggccatagagaagttggttgagagagagacaaagcgggctatccatgttccttaccatggggaaatagagcccaaatctaaggcctggattcaggatggtttggattatgtgttgggggattctgttacacgcatgggatgtggaaaacatcacaaagatcgcaaaggggaaatggtgagttacgtagaagatctccaaaggttggatagggcacgagttttaatcaaaacatcatggcctcctacaatcaaccacactataaccgcgtccattaatggggtagattatgtggttatgattgtagaagagttgtgttacaactatcttagatgcaattgtaacatagggagctatgtagagtcctttgaagaaatatcctcagacgggagtgaggtagggctggacctaatgttggaggaagcacaggttctgcagaaattgaaaaaagcggaattggatcttaacaagcttgagaaaggagataatgaacagctgaatgacgaagaggaaaaattgagaaagcaattacaggaggagctttgggtggcagcaatctcaatcgaatccattgcgagacaatag

SEQ ID NO: 106080 - DNA, 342 bp, Glycine max
  Peptide Sequence Number=SeqID_222858
atggcagcttatgctttagtcgttttatacaggctgcggtcagaaataaatcttccaattatgagagaattggttcctcattatctccaggatgcagggcgggagagattggattatttggaagatgggaaaagtgtcttcagattgcgtttacgactatgttcttctttataccctatcaatgagcgtattagagatttctttcttgaatatgaccggcatactcttcgaacaagtccaccatggggttctgaacttctggagactcatgtagatatcattttatatatgctgctcttgatggtatctcaattctccactgactcgtcaggtgttcaataa

SEQ ID NO: 106081 - DNA, 279 bp, Glycine max
  Peptide Sequence Number=SeqID_222859
atggagggggagatagacatagctgcaaaatttatggagggcgtggcagtgcaagttcaacaagatagttggagttgggaggcggatccaagcgggagttacacagtggggagcaccttcaaactgctcagtagacatgtgacagatgaaaataaggatggagtgtttattgatctatggaagctaaaagtcccaaaatttgcgatgaggatgcgtcccaccttttcttcagctgtgctaaaaccatgccactatggtgggaatgactatctttgctaa

SEQ ID NO: 106082 - DNA, 441 bp, Glycine max
  Peptide Sequence Number=SeqID_222860
atgaaactggccaaatacaggctaaaggcccaagtggagaaggacaaagcccccgagtggagaaggatgaaggcccaagtggagaaggatgaaggcccagaggcagagacactatcaagactattaattacttatcaaggtaatccttgtggcgtctaccctgacttatcttccttcaccggaagtggcgtcatccaaacctccgtagcctgtatcaacgatccgctcctactcaggttcacatcatctggtatcagagcttcggctcttgatacaacttatcaaggtaatccttgtggcgtctacctagacttatcctccttcactggaagtggcgtctaccctgacttatcttccttcactggaagtggcgtctaccctgacttatcttccttcactggaagtggcgtcatccaaatcttcgtagcctgtatcaagtga

SEQ ID NO: 106083 - DNA, 324 bp, Glycine max
  Peptide Sequence Number=SeqID_222861
atggcttctgcttctcacaatcctcctcctcctccttcgctgccaatgaacaatgaagttccaatgaatgatgtgaattcgtccaacactactctagaggcgcaagccaatgatgctgctcaggcctcaaacaatgctgctcagagcattgactcgaactacaataatggcagtaatcatttcctcaacaatggccgtgaaggtggccgcaatttctcttgtggtggccgtggcagaggtcgcggctatggtgatggccgtgggggtcgtggtggtagatactctaacattcagtgtcaaatctgtcataaaatagggtcatga

SEQ ID NO: 106084 - DNA, 189 bp, Glycine max
  Peptide Sequence Number=SeqID_222862
atgtatttatacattaatataaggaatgaaaggaacaacgacggattgaagagaaaaattcttgagcttgatcttgtagaagcatgggtaagaacaaggatgaacaacaaagcatgtgggtttggaagcaacgggaattttgagggaaggcacaatgcagatgaggaggtggtgcgggtagtggcgtaa

SEQ ID NO: 106085 - DNA, 321 bp, Glycine max
  Peptide Sequence Number=SeqID_222863
atggtggtggtggtggcgacaatgttggcaatgaaaatagaagtggtgatgacaacaaaggtaaggtgtgatgatagtggcggtagtggaatggttgtggtggtggaggtggggcaacaatggttgcatgagggaagggtcgcgatggtggcgcatggcatgatgatggtggcaagattgtggtggcgtgatggtggtgttgtgaagatggtgctacgatggtggtggtgccctgaagaaaagaacagaaagagaataggggaagtgaagaggtctatgggtgtggcagagaaaagagagaagaggggtgtgggtgtggag

SEQ ID NO: 106086 - DNA, 330 bp, Glycine max
  Peptide Sequence Number=SeqID_222864
atggaagtgttcttactttacatgcttggaaggttaggttttcatgaaaaatggattgggtctaatgaagtagtggaggaggctaaaaggaagaagaagtgcactctttttggctatgaaaaagtgtatgactcagtgaattgggagttctttacatgtttaaggttgagttttcatgaaaaatggattaggtggattagaggttgcttggtgagtagtaaggtgttggtgttggttaatgggaaccttacaagtgagtttgaggtaacaaaagggttgagacaaggagatccaattgcactctttttgttcaatattgtggcaaattga

SEQ ID NO: 106087 - DNA, 542 bp, Glycine max
  Peptide Sequence Number=SeqID_222865
gagaagatacccaagtggttatccgcatgcactcatttgctatccgtccgactcagagtccggaaaacgagcccgttgacacgcagagactaacatcgtcttttgcagagacatcttccaaagacggcgagtctgatgacatgcggagataccgaactagcagtgacacccaagtggttatccgcacatactcatttgctatccgtaagactcagagtccgacaagcgagcccactgatacgcaaatcctaacgtcatcttccgatgacatgcggagatacccgagtgagactaacgccatcatctacaccttttgtcaactagaggaaaacgagcccgttgacacgcagagactaacgtcgtcttttgcagagacgtcttccaaagacggcgagtctgatgacatgcggagatacccaactagcagtgacacccaagtggttatccgcacatactcatttgctatccgtaagactcagagtccggcggagatatccgagtggttatccatacaaacgatttctgttaatcctgacccgtga

SEQ ID NO: 106088 - DNA, 108 bp, Glycine max
  Peptide Sequence Number=SeqID_222866
atgcatgggattatgttagggaagcatgaaggagtctgggttgagtctgcatattggaccttaaagagactactgcagaatagccttggagacctatgtagtgtttag

SEQ ID NO: 106089 - DNA, 390 bp, Glycine max
  Peptide Sequence Number=SeqID_222867
atgacgtatcataagcgcttggatagattgacgtcaaattttgtgtgttggataccttatgttgagctactcacctcaccttgttcgagttctgctttgaaagtcctcactcacatcgtcatcgttggccctcagtcacggtcctcatcgtcgttggtcctctgtcctccgtcgtcgttgcgacctcgttggtcctcattcgtgcaacaagccttgcttcacgtcacaacgctaagtcgagtttatggagcctccacgattctacgtagaatcgtgagtctgataaccttgccagatccacctgtgttgcttgttcactcaatagctatgccacaaccacctgcacctgcggctgccgatgcagacatgcctcgacatgcaatgatataa

SEQ ID NO: 106090 - DNA, 294 bp, Glycine max
  Peptide Sequence Number=SeqID_222868
atggcctgggtgttgctggatgtggagttttgccccaaaaatgagacattagctgatgtcaaattgcggatacagaaaaagttacaagttccagatgtggagttttcaaagccctgcttcaattactttctgggtgtagagctatcaagagaagggatatatatggtgcttgggagcaatatcttggattggaacacgatgacagtgctccaaaaaggtcctatgcagtcaaccagggtcccaatgcatagtgaagctaaaggttcattccacaagatgttgcaatcaagataa

SEQ ID NO: 106091 - DNA, 1149 bp, Glycine max
  Peptide Sequence Number=SeqID_222869
atgcgccagaaatttcaaggctccaccaaggtaaaacgtgctcaacttcaagctttgagaagagaatttgaaattctttctatgaaagataatgagactgttaatgagtatttttcaagaactttagcaattgcaaataagatgactacgcatggtgagtcaatgggtcaaactaaggtggtagagaaggttcttaggtccatgacatcaaaattcaattatgttgtatgttcaattgaagagtctaatgatgtcactgctctcaccatcgatgaattgcaaagtagcctcttagtgcatgaacaaagaatgcagtatactcttgagaaagatgaagaacaggccttgaaagtctcttctgcaggaaggggtggtaatcgaggaagagggaggaatggtggtagaggaaggggtaggggaagacagagtaaagaacttgttgaatgctatagatgtcacaagcttgggcattatcaaaatgaatgtccaacttgggaagaaggagccaattatgctgaattcaatgagaaagaagaggtgttgcttatggcacaagaaagctcgaaagaagaggtgtatgatgagtcaaatgtggaaatgtggtttcttgactctgggtgcagtaaccatatggttggaagaaaagattggttattcaattttgatgatagttttagagattttgtaaaattgggtgataactccaagatgcctgtcatgggaaagggaaatctgaagctgtatattggtggattagttcaggtggtaactgaggtttactaccttccaggattgatgaacaacttgctcagcattggtcagcttcagcaaaagaatctcaccattgtcttctccaatgatttgtgcaaagtctatcatgagaatagaggcttaataatgtcaactcaaatgtctgtcaacagaatgtacatcatacatgcatctgtcctaactcccatgtgcatgaaagtcgcaaatatgagtcaatctcaattgtggcatcatagatatggacacttgaattacaaaggattgcgtgtactggctaaaaaggagatggtcaaggggttgcctgaaatagaagaaacagaagaaatatgtgaagattgcatcattggcaaacagcacagagattctataccaaaaact

SEQ ID NO: 106092 - DNA, 105 bp, Glycine max
  Peptide Sequence Number=SeqID_222870
atggcatacccaacttcaattatgggtgctgctgcccttgtttccaatcagaattgtccacgcataatgcgtctgatgtggcggtgcagtagtactgatctataa

SEQ ID NO: 106093 - DNA, 288 bp, Glycine max
  Peptide Sequence Number=SeqID_222871
atggcgcagagaactcagccagtattggtcatcacggatgttttccaaatatccaatggaaagcaattaaatgtagcatatctaagtgcaaggcttacaaaacaacacttcctcatattctcacagtccttggatttgaacataccagtagcagtaattggcactggattgggcccagagaaggctaattttttgtttccaccctgtgctcctcatggggagaaccataaggagcttaaacccacttgtgcacattttgttgcaacaaagtatggacatgctggatga

SEQ ID NO: 106094 - DNA, 291 bp, Glycine max
  Peptide Sequence Number=SeqID_222872
atggcaggagctggtgacaatggtggtgtatatcatcaactagacggatctcaacgcttattactggacgtgatgactacacaaatgcaatgtttgttgaaccgtaacaatgaagagctctataggcgaatagaaagactagagcaacaactaaatccaaatgctgggagaccttatggtggcaacacaagggtcagtgatggatcgaaccgaatagaggggcaagatagaattgagggagtaaaactcaatgtatcctcttttaaaagcaggagtgacctagacacctat

SEQ ID NO: 106095 - DNA, 246 bp, Glycine max
  Peptide Sequence Number=SeqID_222873
atggatagaggagtatgggaagccattgtaaatggtccttacattcccaaagttgttgttgatggaaaagaggtagaaaaagacttcagttattggacaccgaaaaaaataggcatgctcaatataatgttaaagcaaaagtgtgttgagttgaatcagatgtatgtgaataacgggactgaggataatattgaggttcatgagatattgtttgagggtttaagggttggaagtgtatgtagctag

SEQ ID NO: 106096 - DNA, 348 bp, Glycine max
  Peptide Sequence Number=SeqID_222874
atgccacaacctcatcatcatcaagcagattatgggtacaatccgcagaaagaaagcctcaagaggctaacattaacctctcatacttccatgggaaggacaataggacacattacttctcaatgctccaccaagaaaaccatgattatgaggagccaagacatttatagtagccaagatgaggctactacttcaccttcctctagtgaaagtgaagaagcaaaaggggaagaatctagtgaagaaatctacccccaagaagaaggaaaacctttaatggttaagaaggagtgtaaggaggtaagtgtctcctccaagaggttagctaagaagggtgggatcctctag

SEQ ID NO: 106097 - DNA, 294 bp, Glycine max
  Peptide Sequence Number=SeqID_222875
gtttcagccacaaaaaatagaaatacagaactcaaagaacctaaaatcaacacaaatcatggttcaagaacaaaaacaagaaatttgaaccatagaaaatcaaatctagcttctatagcaagtttaatcggtggaaattctaaaaaaatcatgttaacaacattcagcacaagacatgtgaggagatacatggagaaaaatgaagaaacaacaatggaggagaatgtgaagctgaaaattaatggaggtttaaggagcacctacttgaagctcttgtgctctgataccacttga

SEQ ID NO: 106098 - DNA, 183 bp, Glycine max
  Peptide Sequence Number=SeqID_222876
atgtgtagcgaaattggactgcgcactcagcaacaatgtaatttaactttgagcaagagtgttttctgtgtggggttcattctaggtacacatattcctagtgagttttacaaaaagcaaaactatccaattgaggcaaggagtgccacggttccatgggctgaaccaaggtcaatcaagtag

SEQ ID NO: 106099 - DNA, 336 bp, Glycine max
  Peptide Sequence Number=SeqID_222877
atggcttcctataagttaaagggatctatttggacacaaaatggagttagtgagagtcaagtagtaaattctctcttgcaggctgcagataactggttaaggctgcttcaggtgaatcaccctgattatcagttcttcgtatcgcatggcacatacaacagatttttctgtgtaacaaggtacaatgttggctctaagtcagtgtatctgatgaacaccttgttacttggtgagaggaaattagatgctactgtacaatattctactacttcaaaagtacgaatggagctcttggcagtgtctgtggcatgtttggttaggattaatttgaggtaa

SEQ ID NO: 106100 - DNA, 1440 bp, Glycine max
  Peptide Sequence Number=SeqID_222878
atggtgaagagtggtggaagagaatggagggaaaatggagaggaattgggaagattgctccaaaatgaatgggtcccccctcttggatgtgccctaggaaaacttgaggatgggcgtgagataacgatccagtgctttaacgaagacaagcaccacatgttgcaacagtttatcaatgaaactgttatcctaaactacttgcctcacaaaaatatcgtgtcaatttatgggtgtgcttctcatcacaaggaatcactactggtgcatgaatacctatccaatggaaatctttctgctcatcttcaaagtgaaatagccgaaaacagcacacaaccttggttgaccagattagatatagccattgatattgcaaatgcattggactatcttcactattatggcatcatccaccgtaatgtgaagtccagcaatattctcctagatgtgaacttttgtgctaaacttgctaaccttcatttatctcagaaacttccagatggagttcctgtctatgccacccatgttactggtgatataattgggacatgtggttatatggactcagagttggcatatggccggcttagtgttaaaaatggtgtttatagctttggggtggtattgtgtgagcttctatcattgacgctggcaaaatgctgggttctgaatgaagaggataatcttgctacccttttaagcagaaaaattgaaaaccaagctttggtggagttgttggatccaagacttggcttcgatacaaaccttaagatcaagtggatgatgactgctataactgagcttgcacttctatgcatgaaatgcccacaagaactaaggcctaatatggaacaggtgctagagacactcgatggcataaagcaaggaagacatgaaacaaactcaataaaagaagctactaacaattttgacacttgccttggaaagggagggtacggcaccgtgtactatggaaaacttaaagatggacaagaggtagcaataaaatgtttccatgacgagagcgagacagaaaagaccattaagcaattcatgaaagaaactgagatcttaattctgttgcaccatcaaaatctagtttcactttatgtccgcacttctcgccatagcaacaaacacaagatagtgtatgagtacatctccaatggcactctttctaaacatcttcatgaatcttcccgtggtaaattaccatggcatactagattgaacattgccattgaaactgcaactgccttggtatatcttcatgattcagctatcatccactgtgacgtaaaagggagtaacatcttattggatgacaattttacttttaaagttgcagattttggattttcacggtctcttccagattatgttactcacgtttccactgttccagtaggaaccggtggcagttgcagtttcactcttgcatag

SEQ ID NO: 106101 - DNA, 1896 bp, Glycine max
  Peptide Sequence Number=SeqID_222879
atggagaaatttgcaattctgatcagccacattttacctcacttacatccagcatcccaacgatcctgcaacattcgtaattacctcatgagattgaggcgtgatatctttgtgtgctgtttcactagcacatcttcagacacaatgcaaaaggaaaagcacagaaaacttgaggatggacgtgagattacaattcagcgctttaacggagaccagcgctacttattacaacagtttatcaatgaaactattatcctaaattacttgcctcacaaaaatattgtgtcaatttacgggtgtgcttctcatcatgaggaatctctgctagtgacagaatacctatccaatggcaatcttgctgctcatcttcatagtgaaaaggacgaaaagattacactaccttggcttaaacgattggatatagcatttgatattgcaaatgcattgaaccatcttcacaattatggcatcatccaccgcaatgtgaagtccagtaatattttcctagatgcgaacttttgtgcaaaagttggtaaccttcttttgtcgcagaaacttccagatggagttccggtgcatgcgacccatgttactggtgatagggcagggtcaagtggttatatggacccagagtatttgacaaaaggccaacttagcgtaaaaaatgatgtttatagctttggggtggttttgtgtgagcttctatcatcgacgctggcaaaagactggtttctgaatgaagaggataatattgctaccgttttaagcaaaaaaatggaaaaccaagctttggtggagctgttggatcgaagacttggcttcgactcaaaccttaagatcaagcaggtaatgactgctacagctgagcttgcatttatgtgcatgaaatgtccacaagaattaaggccaaacacggaacaggtgctagagattctcaatggcataaagccagggagaattgaaacaggctcttactcaacaaaagatatctcagctttgaaaatcttccacaatgctgaacttgaagaagctactaacaattttgacaatttccttggaaagggagggtatggaagcgtgtactatgggaaacttaaagatgggcgagaggttgcagtaaaatgtttccatgaagagaacgagacagaagagaccattaagcaattcatgaaagaaactgacatcttaggtctcttgcaccatcaaaatctggtttcactttatggccgcacttctcgcaattgcgacaaacccatgctagtttacgagtacatctccaatggcactcttactaaacatcttcatgaatcttcccatggtaaactaccatggcatactagattgaatattgccattgaaactgcagctgccttggtatttcttcatgactcagctatcatccaccgtgacgtaaaagggagtaacattctgttggatgaaaattttactgtcaaagttgcagattttggattctcacggtctcttccagatcatgctactcatgtttcaactattccagtaggaacacgtgcttacatagatcctgactactatgaatctggaagagttagtgacaaaagtgatgtctatagttttggggtggtcttgttcgaactcatatcatccattcgcccaagttcattggaaggcacagatgatgatactctcgcacagtatgcaaagagaaaaatcttaaacaatcaattaaacgaggtagtggatccaagttttcggtttggttctgataaaaacataatggaaatgataacagcagtagcagagttagcatttcagtgtgtgcagtgtcccaaggaattcaggccatccatgaaacagctgctacagacccttcagggcattagggaaggaacatggggattcaaccagataacatag

SEQ ID NO: 106102 - DNA, 903 bp, Glycine max
  Peptide Sequence Number=SeqID_222880
atggctcttcctcttcttccacctctttcttcaatcatcaacacccttttcttctttacactcttcttcccaaaatatgtatggagtgatgttgaagggtactcagcatgtgaaccttttagctgtggtgaaatcgacaacattcgctacccattttggagtagtgatcatcaacaaagttattgtgggcatccaaagttcaagcttgattgccaacaagacaacgtgacaattgacatgatgtcgcagagattccatgttattgatattgatcaaacatctaaggttttgaagatggcaaggttggatttatgggatgacccttgtactaatgagtatagcaatgtcaagttggattctgatttcttcaactacacttccaatgatgatgactatactttgttatatgattgtggtcctcctgttacatatacgtctagtgtgaatattaaaggaacaatatcatttagttgccccatagatagtggttttcgagatgcattctttgtgtcaagtactgatgtgggtaatttgaaggatctggggtgcaagcatagcatcaatgtttctgttctaagagaggctgtgaaggatgctttgcaagtggaaaatgttttagaaaaaggatttgaggtagggtggattggtgtggatgaaggacaatgtgatggttgcataaaatctggtgggagatgtggacacaacgtatctaaggatgcatttacgtgcctctgtcctaatcagcaatcttatgatgaggtttgtagcaaaagccaaacaagttctcccttagcagcaccaacgcctaaaccaacaccagaacaggaactgtcacccccttttggtccaaaatttcaagaaaagtctccacatgctccgagtatgtattcttccttctcctga

SEQ ID NO: 106103 - DNA, 153 bp, Glycine max
  Peptide Sequence Number=SeqID_222881
atgggaacttgtacacaagaagccccacagttcaaagccaggcctagaacaggggtttccatcaacgtggaaaataaggacacagtcatagaatatggtgatgttgtgcacggtatatgttggaagggggtggaagtcagaattttgatatag

SEQ ID NO: 106104 - DNA, 1986 bp, Glycine max
  Peptide Sequence Number=SeqID_222882
atgatcctccaaatctccttccattacaataaacctcaactatgcattatcaccactatcttattcttggctaccactgttctgtcttctaatccaaaatttgaggcctgctcacctagaagctgtggaactggcccacccattaagtatcctttctggattccttatgaacaggaaccattttgtggctaccctcactttgggatcacctgcatggacaaaaatccaattctcagaacttctaattatgagtttttagtgaaagatatctattactctaactcctcatttactgtggccaacatagatgtctatgaggacaagtgtcctgttcccttatataattacacctttgatcaaactccattcacctacagttcagaaaattggaatctctctttcttctacaactgttccacagaacctatagattaccccacttacgaagtagattgtgctaaaaatgctacacatttttcttttgcggtttttcataaggaggcactggagcacaaaaactattccttgaatgagtgccagtttatggttaatacgccattgaacatcaatgaatctgttaatatcagtagcttattgagaatgaattacactgagattttgaagatggggtttgttttgaattggactgcacctgattgccactactgtgagaaaagtggtggacgttgtggatttgatggcaatcagttcctctgcttctgcaaggataagtcctacttaaaaagttgtggtagtgatccgcggaagttgagactcattataggtgttgtttctggtgtggtgggagcacttggtatgggcattatcggctttctctgttatcgtagaaagaagaatcgttatgcaatctcatatatacaatctcgtagcctctcttctgatccatcttcaaaagacactgagaagggagttcaaagctttactcaaagctttgtaccaggagtgcccctcttcttgtatgatgaacttgaagaggccacaaattactttgactcatctaaagaactaggagaagggggatttggaactgtgtattttggcaaactgcgggacgggcgttctgttgcagtgaagaggttgtatgagaacaacttcaagagagttgcacagttcatgaatgaaattaaaatcctagcaaagttagttcatccaaatcttgtgaagttatatggatgcacctctcgccacagccgcgaacttctgcttgtatacgagtacattcctaatggaaccgttgctgatcatcttcatggtcaacgatccaaacctggaaaactcccttggcatattagaatgaaaattgctgtggagactgcaagtgcattgaattttcttcatcacaaagacgtcatccaccgagatgtgaaaaccaacaatattcttcttgacagtgacttttgtgtcaaagtggcagattttggactctcgcgtcttttcccagaccatgtcacccatgtttcaacagctccacaagggactccaggttatgtggatcccgagtaccaccagtgctaccagcttactaaacaaagcgacgtatatagctttggagtggttctggttgagctgatatcatccttgcctgctgtagatatcacaaggcatagacatgaaatcaatttgtccaacatggccatcaacaagattcataatcaggcactgcatgagcttgtcgaccctaccctcgggtttgaatccgatttcaaagtcaggaaaatgataaatgctgtggctgagttagcatttcagtgcttgcagagttctaaagagatgagaccttctatggaagaagtggtggagactctcaaggatatacagagtgatggcaaacataaaagccagcctgaggtaatggacatcacaagcacagctgatgatgttgtgttgctcaaggatgaccctcctccaccatcacctgattctaatgcggtgagcaagtcgacaacgccaaatgctagcggataa

SEQ ID NO: 106105 - DNA, 183 bp, Glycine max
  Peptide Sequence Number=SeqID_222883
atgaagagaagacaagagaagaagagaaactgtgtggagtctaagtttgaaaacatagatgaagacaaaacaaaagttcaagcaatagataaccagttattcgcctttttacatgatgaggaagtgggtgcaagtccatatcatattactagtcaaaagttgaacccccacaaaggaaagtag

SEQ ID NO: 106106 - DNA, 405 bp, Glycine max
  Peptide Sequence Number=SeqID_222884
atggtttttcctcaccccttcttcaccttttttctactcttcctctcattatattgtctgagcacatcaacacttaatgctaggccttacagtcacaagccacacacagttgttgacatactaaatgacctgcccaacaaccccaaggtgcaattggaacttcgttgcgatgaaggttcttccttttatctcaagctaggccatcgccacaaccacactctcacagcagatcaagattccgaatgcactgctatgtggttgccatggtttaccacttgggacgcgtaccatgccgtgagggacaaaggccaccactctgtttattggtctgtgagaaaggacggtttctatcacagttgggatggatctaattggaaactccttgaagactggtacagtgaatga

SEQ ID NO: 106107 - DNA, 1332 bp, Glycine max
  Peptide Sequence Number=SeqID_222885
atgtccaagtctttgccctactccaccaaagatgttcactacgacaacgccaagtttcgcccccgctctttcttcaaggttgttactcagaacttactcaccagtaacctaaggcgtgattgtggtagctgtagtacaggaaagtttctatttttgctattgatctttggtgtggcttatcttatgctggcacatgccagttcgagtggtgtagtttctgatgatcaagcaattgtgaatagaaagagtttttatgcaaatagcagcattgttaatggtgctggcaaaataaagaggctctggagacggccaccgaggctccctcctcgattctcgccagatgaaacaggaactggtaatggaaatggacatgtattgggaaatccggatgttgttaggtcaatgtggattgctaggcaaaagaaagtcaaggaagcttttattcatgcttggtctggatacaagaaattcgccatgggttatgatgaacttatgcctctcagccagcatggaattgatggattaggtgggttgggggctacagtggtggatgctctcgatacggctatgatcatgggtcttgatgaggttgtggctgaagctggatcctgggttgaagaacaactttctgagagaatcagtaaaaagggtcaagtgaatttatttgaaaccacaattcgggttttgggtgggcttttaagtgcgtatcatctaagtggtggggaaaaaggaacaaacttaactcatgcaggacctaaaccagcagtttatctagaaattgctaaggatttggctgaccgtctgttatctgcttttacagccagtccaactgctattccgtttagtgatgttattctgcatgacaagtcggcacatccagctcctggtggactgagtagcacatcggaagtttccactttacagcttgagtttaattatctcagtcagatatctggtgatcagaaatatagtttggaagcaatgaaagtcatggagcacatgaagactcttccaaagattgaaggactagttcctatctacattagccctcattctggtgaatttagtggagaaaatattagactgggatctcgtggtgacagttactatgagtacttaatcaaagtatggcttcagagtggagctagtagcaacactaatacatcattcctatatgaaatgtataaggaagcaatgaatggtgttagacatcttcttgttcggaaatctatcccaaatggactagtttttgttggagaattgccttatggatctaacagtggtttcagcccaaaaatggatcacctgataatttatttagggctacagtag

SEQ ID NO: 106108 - DNA, 1635 bp, Glycine max
  Peptide Sequence Number=SeqID_222886
atgtcattcaggaaaatcgtcgaacactttcagtaccgtcgcggcacactctcttccttctcgcgtccacttgccacccattccccgcaaccagcggaacaaaaccatgaccctcactccctaatgaaacaagacccaatcgaaatctgcacttccctatgggtcaaaaccttctcctcctccaacctcactggcttcctctccaacttcgacctctggctcctcgcttaccaacgctcctgcgcccacgcaacgggaaccttccctccccgtaacgccgtccacacccccgttctccactccctcccccctctccaaacgcaagctccgcgccgctatccaatccgacaagccctgcttccaggaccgcgtcgttcaggagattctgttgatgatcctcgaaccgggtacctttggttcctcaaaggggacttgaccgagtttttggaccgtgtggatccgaatgttgtaatgcgttacctcgaaaagggtaccagggataagaagattttagggttgataaaatctgcgcttgacggggagaatgagaaattgcgtgatgtgtcgctcaaggaagagaatgttgatgagttgaggaggttaaagaagaggagggctactaagaagaggattttgaaagataatgaaccgaaacccgatccttattggttgagaacgtttttcagtttttctcctgaggaagctgctaaggtgcctgattatggccattgtgggattttaagtcctttgcttgctaatgtttgtcttaatgagttggatcattggatggaggaaaagattgttgagtttttcaggccgtggcattttttgattgggatccgagggcctagggaggatgctgcggaattgaggaagaagattgttgcattttgtgagagtgtgtttggggtgaggttggataattcgaagctggagattgagcatgttaccagggggatacagttcttggatcatataatatgccggaggcaatgcattcgcgagtttaggcggcttcagcttgtgaaaggtgataaggaccccgagccacttccgtgtaatcctatgttgtattcgggtcaagctcatacgaattttcagatgaataagttccttgagaccatggctgattggtatgggtatgctgataatcgcaaaaaggttgttggcttttgtgcatatgttgttcggagcactttggccaaattgtatgctgctaggtataggctgaagtcccgtgccaaggtgtatggaatagcttcaagaaatctcagccgtcctctgagggagagcagtaacaattctgcacctgaatattcagatcttttgaggatggggctggttgatgcaattgaaggtgttcagttttcgcacatgtctttaattccatcttgtgattatactccattcccaagaaactggatcccggatgagagggtgttgcatgaatatataaaacttgaaaatcccaagtttttctgtgagttgcttagatctgttgagcaaaaaggtttaagtctgcctcaagatgaaatatctcaaatggtatgcgactacaaaactcttggggttcgttattttcaatctaacaaggataaagaaataaaatctgaattggaggagataactgagtaa

SEQ ID NO: 106109 - DNA, 593 bp, Glycine max
  Peptide Sequence Number=SeqID_222887
atggcgagtgcgttgtcaacactttgcggacaagcatacggtgcaaaagaatatgtcatgatgggagtgcatcttcaaagatcatggatagttatgtccataacttcactctttcttcttccggtgttcatcttcacgaggccgattttgatgctcttaggccaagatgagaatatagcagaagtggcaggaaatatttctctttggtcaattcctatgatatttgcttttattgcctctttcacttgccagaatttcctgcaatctcaaagcaaaaataccatcatttctttcttggcagcattctcaatagttattcatttgttcctctcttggctattgacaattcaattcaagctcgagattcctggtgcaatgacttcaacaaatttggcattttggattcctaatattggtcaactaatatttataacatgtggttggtgctccgatacatggaaaggtttctcatttttggcattcaaagatctttggcctgttgtcaagctttccctttcatctggtatcatgttatgcctcaacatcaatggatgggaaatgatgatatcacttggtttcatggctgctgcaag

SEQ ID NO: 106110 - DNA, 1215 bp, Glycine max
  Peptide Sequence Number=SeqID_222888
atgcaggggaatgctgatagttttggggggaatctcaacacccttttgaggttttcctattttgatcatcaaaatgatagcacggaagttccatgcggatttctgaataattttccaattagtgagtctgatcgaattgcgatggagaagtgtggcagtgtggttgtgacgattgttaccctaaaaggtcttgaacatcagggattgggttcaataaattcaagagaatacaagataggtgtatggaggattgtaaagacatgggctatatcaaaacacccttattatgttcataccatggaagaagcaatggcatctgcaaggtggaagaaattgttggatgtcaacgccttgaaggagcaaatggagacctactgtgagaatggattgcaaccatggagtcccaacaaacagccctatgcatcagatgtaccagatagtgctttgatattaaggagacatggacttggcagtaacctcttctcctgcctcatattcaatgagttggaggcatttaacccaagagaccaattgccttttgcatttgttagagatcacatggagcccaacctgaagttgaacatgtttgaggtggaagtttttgaacaggtggcagtggagtacagacacaatctcaagagcagtgatggaaccattgtgaagaaattgtccagttcaggaagaaccaaaagggcacaccctgatttattggtaactgttatagaaaagatctcatcttcacaacttaagtcaacatcacttgtacctaagaggtcaagagatactcacttagggacaattgacaattgttataaggaatatttcaacttcaccactaaagctagcatcacttcaaaccttaaatatattttcacacgttgttgttcccttcccgcaaaaatagagcaccaccgcgaagaagctgagatctacgagggcgaagcattgtgcatgcaaaagtcacgtctcctcctagacgagattcttctcccgagaggcttgctcccgctggaaaacatcgtggagatgggttacaaccgccccacggggttcgtgtggctcaagcagaggaacaagaaggagcaccgcttcgccaccatcggacgcaccgtctcgtacgaaacggaggtgacggcgttcgtggaggagcaccgcatgcgggtcaagaccaaagagctcttcaaatttgatttgtatttaaatcaaattctttag

SEQ ID NO: 106111 - DNA, 171 bp, Glycine max
  Peptide Sequence Number=SeqID_222889
atgacgtacaagaacatacaaggacatcaacagttgtgtggcagcaaaggatcattaaattgtaaacatcatgagccacatgatgagggaagcagtatcaaatcaatgctttacaagcttttggtcaatctaaggagtggtgtcttcatgctgcaaattgatggtttctga

SEQ ID NO: 106112 - DNA, 183 bp, Glycine max
  Peptide Sequence Number=SeqID_222890
atgggggcttggacattggcaattatacaccaaatgctggggatagatgaagctagagaacattggcaagaattcatcgtagtacgagacccagctttccgtcgtgaaatcgattttgaacagtttaaacgtcacgtggaacgacttcgacaagctaatgctaggcaaaacgcagaaatatga

SEQ ID NO: 106113 - DNA, 375 bp, Glycine max
  Peptide Sequence Number=SeqID_222891
atgaagaagcatgaaattctttctcaagttctttttgaaggagcaagtgcggtgtctggtgctgatggatatatacttgagcttcaatccaccatggacttctctaagaaaagatggataaagacttgggcactagctccgcgggcatgggctcaagcttggacttgggcccggccgtgggctccgtaccgggcttgggcttgggccatctttttaacacataaatcaaaagagaaagccggtaccaaggatggtacacgatatttttccatacttagaatcgataaaatctctcatatcctcccaacaacttggagcaagagaaaaattacaaaacttttctattccttttcctccacgaagggagaagagtaa

SEQ ID NO: 106114 - DNA, 207 bp, Glycine max
  Peptide Sequence Number=SeqID_222892
gagttgttaagagacaagtatcaagaggataaagttgaggagttgttaagagacaagtatcaagaggataaagttgaggagtttaatgccttgggcaaggggaagccaaaccgaaagttggtggtgacgctcaaatgtttatgcaaatcacctaaatccaaatatatgctattcactacatgcacttacaaaagtggcctcacctag

SEQ ID NO: 106115 - DNA, 204 bp, Glycine max
  Peptide Sequence Number=SeqID_222893
atgtggggtgggacatcgccagttgggagtgaccttgaattgcaatcccaaaggaagaaccacttcaaaatgggttttccctttgccgacggaattcgggttttagcattcgttatttgctctcccttgaggagattctgctgtcctcttcttcgggggaaggatgaggattctcttcatgggccaaggttcaaggtagcttaa

SEQ ID NO: 106116 - DNA, 258 bp, Glycine max
  Peptide Sequence Number=SeqID_222894
atgtctccttccacgagcgtacccaatcatgactctccactctttctaagacaagagaaacaaaaacctcaacctactaaactaatagcagccaccgacggccacaacgacaacaccgtggatgccaacgatcgcatcgtgctcctcttcgttgcaagactcaaaggagtgattaggattttggaagggacgatatttaagtacgcagaggtgcaggagattcttgaacggagagggaagggtgagaatttggagtaa

SEQ ID NO: 106117 - DNA, 174 bp, Glycine max
  Peptide Sequence Number=SeqID_222895
atggaatggataaggaaaaagaaagtggcgagtttatggagggctgaatggaagggatttgattcaaagtctgaatgtgtttggatggagaatgatgatgataacgaaggtgttagagtgggattaaaggctgtaactaaggagattcactctcacactttagaaggaaattaa

SEQ ID NO: 106118 - DNA, 1110 bp, Glycine max
  Peptide Sequence Number=SeqID_222896
atggcaaccaaaacatccaccaacggcacccatcattctctacccgagtacattccaaaccgcattcctgacccacattatgtccgcatcctggacaccacgcttcgcgatggcgagcaagcccctggagctgccatgacgtccgatcagaagctccaaattgctcgccagctcgcgaagcttggtgtggatgtcatcgaagggggtttcccttcagcgtcacaggaagacttcaatgctgtcaagatgatagcgcaagaagttggcaacaactgtgacgctgatggttatgttcctgtcattgcggccctatgtaggtgcaatgagagggacataacgagagcctgggaggctctcaagtatgccaagaggccaaggcttatgcctttcatagcggtgagtccgattcacatggagtataagctcaataagactaaagaagaggtgcttcaaatagccactgatatgatcaaatttgcacggggtttagggtgtactgacatccaattctgttctgaagatgcagccagatcggatagagagttcctttaccaaattttggaagaagttatcaaagctggggcaacaactctgggcataggtgacactgtgggcataacaatgccattcgagattagagaattggttgctggtataaaagccaatgtccctggagctgaaaatgttattatttctattcactgtcataatgatcttggacatgccactgcaaacacaatagaggctgctcgtgctggtgcaatgcaattagaagtaacaattaatgggattggtgaaagggctggtaatgcctcattagaagaggttgtgatggccctaaaatgcaggggagatcatgtcttaggtggtttgtatactggaattaatacaaggcacttattgaagacaagcaagatggttgaagagttctctggtatgtatttacaaccacacaaagctgttgtaggtgataatgcctttctccatgaaagtggcgttcaccaggctggattattaaagcatagaggtacatatgaaatattgtctcccgaagatattggccatgaaaagtccaatggagttaatatggtactagggaagctaagatga

SEQ ID NO: 106119 - DNA, 231 bp, Glycine max
  Peptide Sequence Number=SeqID_222897
atgattcattttaatgatgaatggataaataaagaggaatataaggttgagcttgagcatcctcaaggtgaagatgatggtggcattgacaatgctgaatttgtgggaaatgttggaggaagttcaagtgatcaaactctaaatgctttggatttagataatttagttttgtttgaacctgatgttgatgatgctgaggaatgtagaagcaaatatgatatgaagttttga

SEQ ID NO: 106120 - DNA, 1200 bp, Glycine max
  Peptide Sequence Number=SeqID_222898
atggttacattcttcagaaatttggctttcagctatgcttttcttgcaatttttctctcagcaggtattggagtttttctaggtgttgaatctttcggaatcaactatggccaagtggccaacaatttgccgcaaccagacaaagtccttgaattgttgagcacccttaacctcacaaaaacaagaatctacgataccaatccgcagattctgacttctttttccaactcaaacattgagatcattgtgacagtagagaatgaaatattaagccagttagatgatcctcaacaagcacttcaatgggtgaacagccgcatcgtaccatacctacccgagacaaagatcactggtgttcaggttgggaatgaagttttcaccgatgatgacataactctcattgagcaccttgtgccagcagtggtgaacattcacaatgctctagctcaattaggctactcaaacataaaagtttcaacaccaagttccttggcagtgctcgatcaatcttaccctccttcagctggtagtttcaagagtgaaatctctgggatcatgtaccagttcttgaacttcttgtcaagctccaagtcccccttttggatcaatgcctacccttactttgcttacaaggatgaacctaatgggatttccttgaactatgtgatgttcaatcctaatgcaggaatggttgacccttacaccaatctccactatgacaacatgctttatgctatggtagatgctgtttcatttgccattgctaaaatggggttcaaggggatagaggttagggtctctgagactggttggccatcaaagggagatgctaatgaggttggcgccacaccaatgaatgctgcaacttacaacaggaacttgctgagaaggcaaatggccggtgaagggacacctttgaatcctagaatgaggttggaagtgtacttgtttgcgttgttcaatgaagacttgaagcctggaccaacctcagagagaaactatggtctctttaggcctgatgaatccatgacttacaatgtagggttgtctgctcttgcaacctcatcagcaacaacttcctcctcctcttcaatttctcttgcttcctctggcactaagattaaggtaacaccatgggaatacaaaagcttggtgaactggatgtttgtatttgtgctgatttcaaccctttatgggtga

SEQ ID NO: 106121 - DNA, 1110 bp, Glycine max
  Peptide Sequence Number=SeqID_222899
atgcttattcatgaactcattttggctaaggcacactgcaaaaacattctcttcggacgcaccctcattgcaccacaacctcattctcgcattgaaataatgcaaaaccacctccgaaatccgtcaaattcacaccacatggtcaagaccggtctctgcaacgctcctttcactctgagcaagctcctcgcagcttcaatattagacatggactacgtagcttccattttcagttacattcaaaccccaaatctcttcatgttcaacacaatgctcagaggctattctgtaagcaatttccccaacaaagcaatttccgcaactgtgaacaatgcccttttgcatttccattgtgtttgcaagagaattgaagatgcacttaaactttttgatgaatttcctgagggaaatgatttggtgtcttggaacactttaatgggtgggtgtgtttctgtttctcagccttgtttgtgttgccactgtcttgagtcttttgtcagctgctgggaattatgcaagaaatggaatcaaggaatgaagcctaattcttcaattttgtcagggctgctctctacttgccctgcgtctggatctgtacaagtagttcatcatgtcgctagttttgttgaagagcagaaactaaaactggatgtggttctcggaacagctcttgttgatgtgtatgctaaatgtggctttctagatgaggctatggacatattcgagaggatggaagataaagatgtgaaatcttggactgccatgatttcaggtcttggagttcatgggcagccaaataatgtcattaggcttttcaataggatggaaaaggaggggtttagaccaaatgaagtcacgtttttggcgattctgactgcgtgtagtcatggagggcttgtggttgaggggacggaaatgtttaagcacatggttcaggaatatcggttttcaccacaggttaagcattatggatgtcttattgatctcttgggtcgagcaggaatgctactggaagcacataaactaattgatagcttgccaattaagggtgataaaactgcatggcaacactgctttctgcttgcagaatctatggagatgttaaattag

SEQ ID NO: 106122 - DNA, 389 bp, Glycine max
  Peptide Sequence Number=SeqID_222900
agcaacaacttaaaaggaagcttacttcaaaatcttatggctctcacacttatccaaagaaagaccaaggtcaaggcatcttaggggctgcaccttctaagaccaaagatgataaggggaagacaatagaaaaacaaccccgtaaggctagtatgcaagagaagactagctctataaagtgctttaaatgtcttggaagaggacacattacttctcaatgccccaccaagaaaaccatgattatgaggagtcaagacatttatagtagccaagatgaggttaatacttcactgttgcaacctacccttcagcggggagacaacgcgagactcacgggtgaatcttccaaggaaggaaaatgcgcggagtcgccaccaacttttatttga

SEQ ID NO: 106123 - DNA, 693 bp, Glycine max
  Peptide Sequence Number=SeqID_222901
atgagtcaatctcttgctttctcaaaagggtggacccttggagggctccacaccctcaacttcagaggtctacacgccctcaccttcagaagactacacgtcctcgccttcagaggactacacgtcctcgccatcagaggacaacacgttctcgcctttagaagactacatgtcctcgccatcagaggactacacgtcctcgccattagagggctacaagccctcgcgtacagaggactacacgtcctcctcgctttcagaggactacacgtcttctccttcagaggactacacgtcctcgccttcagagggctacacgccctcgccttcagaggactacacgtccttgccttcagagggctacacgccctcaccttcaggggactacacgtcctcaccttcagagggctgcacgccctccccatcagaggactacacatcctcgccatcagagggctgcacaccctagccttcagaggactgcacatcctcaccttcagaggactacacatccttacctttagaggattacacgtcctcaccttcagaggactgcacgtcctcaccttcagaggactacacgtcctcgccgtcagacgactgcacgtcctcgccttcagtggactacacgtcctcaccttcagagggctgcacgccctcgcctctagagggtcttggagttgtcagctctga

SEQ ID NO: 106124 - DNA, 1547 bp, Glycine max
  Peptide Sequence Number=SeqID_222902
cgggggctttgggtgataaagccgcggacgtttcgagagccgccttgagtgccgtaaaggcggttgactatgaagagaccaagcgcaaatccttggccaccgcaagcgggcttgtcaacaatgccaaggatatgggcagtagagtggcggattctgtacgagaattcgatttcgatgaagccaaggagtccgcatccagcttttccaaaaggtccattgacaagctgcataagtactttcgcactactttcgaggtggacaaatccaccttcgaaatggtcaatgacattcgccgcagattaccgaccccggtgagttcgatcgacgatatttacgaccaatgtcgtaaagaggctgcgcgccgcgcgatcgccgccttcatgctgggaggtatcctcgaccagcagagtcaggccaagtacgacaagctcaccgacagctacgacttctatcgcaaagaccgccagaagtacatgggagattatgggggaatggctcccaaagccggtacgccggacggcgcggtcttcgagaacggctacaacccggacgaacctctcattttcgctcgcgataaggccaacaccgtcacggtcgatcatgtcacgtcgcgtcaggaaattttccagaacacgctgctcaagattgggctgacggacgaacagtttggcgccgtcgtcaatgacccgcgcaatttgaagtacatgcatcgcagcctcaatagccaaaagaatggccacgatatgtacgactggttggccaacaacagtcggccgcatccgaccgatgatggcaagttgatcgttacgatcaaaggctccaagacggaacacgtcgtcgataagaaggccgtggacgcagcgtatgcggagagcaaggaggccattcgggccggccagattcaagcggttaaggaaatatcgactacggtggcattgaccggcgcgaccatggcagctcagcaggtcgtcggcctgatagtcgtcgaaaccattgatgtattcatggatgaactgaagcgagtgaagctcgtctccggtgacggcctgctcaacgaactggcacagagcaaagaacggatatcggcagcgttgaatcaacggtttgaggagcgaaatctctgggatcgtgccaagtcgctgggactggaagcgggtgtggccggtgcgctcagcgtgataccgcagattttgatttcacttattgtgaagatgccggcttttgtctacgcgatcattcgtgaaagcaccctcagtgtggtgcgttgcatccgtgtgttggtcagtaacgttttcgacaagctcgcagcgcttcaggtaatcatgcttgggcccgcatccgccgtcgcgggtgtttatgttgaacgagtgatcagccaaggcatatcgtcggttccgttgctcaatagatttaattcgcaagtgtccgggatcttgtctgggatgatgattacggcgatcccactggcggcgatttatacatttgagcaaaacaaaaacgcgctggttttgaagctcaggggtcatggagatttgccggcttgttga

SEQ ID NO: 106125 - DNA, 378 bp, Glycine max
  Peptide Sequence Number=SeqID_222903
atgcataaggcattacgggccaatgcacctcttccgtatcctcaaatggtcactctttttctccatcattttcaaattcctcttgatgatgaaccttttgttcaagtcaagagatcttttgctataggtgttggtgcagtaacttcatttggttaccgtaaggatcgtgatggacaatggatgaagaaggacacgttacctccacaagacgagcgtactccttctcctcctcctcaacgagatgattcctcagcccttatgaatgaagttctttcagaattacggggcctctgcacctatgttggtgcacgattcgattccttggatggtcgctttgaaggcatggatacccgcatcaccagcttgaagaggatgtga

SEQ ID NO: 106126 - DNA, 1212 bp, Glycine max
  Peptide Sequence Number=SeqID_222904
atgtcatcaagtaataatccccggacgaaattagggtatcacagggtacatgccctcgacaacaaaaggctacacgccctcgccttcagagcgccgcacatccacgccttcagaggactacacgtcctcgccttcagaggactacacatcctctccttcagagggccacacgccctcacctttaggggactacacgtcctcgccttcagaggactacacgtcctcgccttcagagggctacacgtcctcgccttcaaaggactacacatcctcgccatcagaggactacacgtcctcgccatcagaggactacacgtcctcgaattcagaggactacacgtcctcgtcttcagagggctacacgccctcacctttagaggactgcacgtcctcaccttcagaggattacacgccctcgtcttcagagggccgcaaatcctcgccttcagaggactacacgtcgtcacctttataggactagacgtcctcggcttcagagggctacacacgctcgccttcagagggctagacgccctcaccatcagaaggctacccgccctcgcgttgctttcagagaaaaacaacatcctcgctatcagaggactacacgtcctcgccttcagagggctacacgccctcgaatttagaggactacacgtcctcgccttcagaggactacacatcctcgccttcagagggctacacgtcatcgccttcagaggactacacgtcctcgccttcagagggctacacgtcctcgcattcagagggatacacgccctcgccttcagaggacaacatgtcctcgccttcaaaggactacacgtccacgccatcagagggctatatatcctcgcctttagaggactacacgtgctcgctttcagaggactacacgtcctcgccttcagagggctacacgtcctcgcatttagaggactgcacatcctcgccttcagagggctccacgccctctccaccaataggctacacgccctcgccttcagagggccgcacatcctcacctttagaggactacacgtcctcgccttcagaggaatacacatcctcgcgttcagagggatgcgcgtcctcgccatcagaggactagacgtcctcgaattcagaggactacacggtttcgccttcagagggctacatgtcctcgccttgccttcagagtactacacatgctcgccttcagaggactag

SEQ ID NO: 106127 - DNA, 792 bp, Glycine max
  Peptide Sequence Number=SeqID_222905
atgaccatgtccataagccatagccttatattatttatatttacaatgaacaacgaattgtccataagcttccaattaacgattcccccaattcaattcaaacaaattgcaattaaaaataaaaaggttatagagagaggaagcgaacaacgaacctcgacttcgagcttagcgattaagtggacagaggggggacctgtagtggcacacgagttcgagggaggccccggcgatgccgtcgaggagggcgccgccacaggagtcagcggcggccttgggcggctggtcctcctggaggcggacggtgtagacttcgaggacgttggcggcagtgacgacgaggttggggagggagccaacgtggtggcaggggcaggagggccactcgacgtcgatgtcgtcgagctggagagggacgaagtcagagcgggagtgggtgaggaacccgacggcgcaattgtcgatgtcgatggggcactgcatcatcttcgtagttcagtctcagcgacgaaagagaagagagagtatgagagtgtgagagtgagagggtcagctgagtggaggccagcagggagaaaggttcaagaacttgggttcgcgaaaggaagttgtttagaagtgaacaaagaccctttaatcgattacttagagcatctaatcgattacattgttcttgagttatttccagatgttgggaagaacactttaatcgattacttagataatctaatcgattacttcgttgaatcaatcaattaccttgtagatttaatcgattataagcggttataa

SEQ ID NO: 106128 - DNA, 150 bp, Glycine max
  Peptide Sequence Number=SeqID_222906
atggggtcacatttcccacctccttttgtcatcccaaatccatcatgccttcttccatacaccatggtgcaagaagcaaaatggagtacaggaagtaaaaaccctaatctggacccaattacttttggtagaagtcttttctggaaatag

SEQ ID NO: 106129 - DNA, 303 bp, Glycine max
  Peptide Sequence Number=SeqID_222907
atggaagctccgaagatagtgcaaatcgaaacgaggtacgtgcaaaccgatgctgcgaacttcagagacgttgttcagagcctcacggggaagaactcttccacggattggataggacaaaatgctgaatcatcatattcatcaaaaagaggattttctcatgagccaaagaaattagtgggtgctactgctactgcctctaatggaacaaaggaagctactactctcttgccttcttcttattccatgcaaatgaacaacgtgtcgtccttcaaaaactttgacggattcatatggagatga

SEQ ID NO: 106130 - DNA, 357 bp, Glycine max
  Peptide Sequence Number=SeqID_222908
atggcctgtcaccgtccgtttgaatcatcggcttggattcgggttgaatcatcttcgggtgagcatgaaactttcgtcatctcttacacaatcatgtgccctcggatctgcggtgggtgtacgtgttgcattgggttgcgtcgtcgtcatcctggaccaccagttcgcggtcgagcatggcagatcttaggcgactcgtcggcgagaaaaacacggtggtcgtggaagaagcttcataacccatcgatcacgcacggagatggcgtcggagtggaggggctatacgttgaatgccctgttagctctttgaaaagtcagttttcttgtggaagacaagatatcgtcgacgtgcaatag

SEQ ID NO: 106131 - DNA, 2058 bp, Glycine max
  Peptide Sequence Number=SeqID_222909
atgggggcagatcttctaattccagaggaagaggtggcagatctggttatgtatatagaggaggcagaaattatgtgtcaagtctgctacaagtttggccacagtgcagctgattgctatcacaagtttaatccaaattatgtagctcaacagtataatcagaatcattttgggaatcagaacagaaactactcgtatcagaggcctaattctgagcctcagaacaataactctcagtcacagcacaatgcacaagctcctcaagcttacttagccaataacttgatgaatgaagttccaacctcgggcaataagcatgctttccttggcaatgatcaaggtttgcctattatttccactagttcaacagttttccagtttccttttgcctttaatgttgatagttccatactccttagaggtgctcttaaacaagctggcctctatgtcttctcaaatcttctgaattcttttgtcaagtctattgttggagtggttgctgcctctgttcatgcttccatgcctctttcttactgggatcatgcttttcatacagaagtttatctcattaatagacttccttctgcctatcacaaaaataccatcccttatgagatgatctttaacaaatatcctgattattcttttctaaagggtacaatttttctgcctcgtgatgctgttttcaatgagtccagcttccctttttctgttgctaagcctcatgtttcatcccctccttcaagtgttccctctcaattacttcctcttggtgtccttcctatacccactgctcatcctaatcctccttctcattctatggagtctttagagtcccttagttcattgtctcaacctgttgagttgaattctcctcagcttgttcccactgaacaagctacatcttctgttctaacgaatgatgagtctagtccctctgctttaccctctactcctccccctcaacctcaaaatacacattccatgcaaactagaccaaagtcaggtattgtacgacctcggttacatcctactttacttctaattactgctgaccctacttctgttaaacatgctctctcatctcctgagtggaaggaagctatgcagcaagagtacattgctcttatggccaataacacttggtctctgatcccattaccctcaggcagaaaagccattggatgcaagtgggttttcagggtaaaacagaatcctgatggctctcttaaaagtatggtctgcaaactcaaaaaagctatctatgggttaaaacaagcacctagggcctggtatgaaaggttaaccaaaacactactgacttttggctttgttcaaagcaagtgtgatccatcacttctagtgttcaagactgattctgagtgcctttatctgttgatatatgttgatgatattatcatcacagggtcatctcctgttcttattcaaaaattaattaccaaacaaaatgttgtctttgctcttaaacaactagaaaatttggattattttctgggtattgaagtaaaacatttgagtaatggttctctactgttatctcaagctaaatacatttgtgatctgcttggaaaggctaagatggttgatgccaaaccaatactcactcctctgtcctctgatcttaagttgattaaacatggtacaactaagcttgttttagtccctgctgctgatgctactctctatcagtcggttgttggggcacttcagtacattactgtaactaggctagaactgagctacagtgtaaacaaggtctgtcagtttatgtcaaaacctgtggaggaacattggaaggatgtcaagcatattttgaggtatctaaagggtactatagactatgggttgtctttaaaatctgctcctcagggagaaccctatactttggaagctttctgtgatgcttattggggaatggatatggttgatagaagatcaatatcagggggatgtattttctttggtcctaatcctgtttcttggtggtcaaagaagcagtcctctgttgctcgatcgactacagaagctgaatgttga

SEQ ID NO: 106132 - DNA, 213 bp, Glycine max
  Peptide Sequence Number=SeqID_222910
atgcctcatacaattttatttggaacttctgatagcaatacaagatcaagtatatatggagttcatgatgaggcaaaggacaaagattttgagctagaaatgagctgggtgtgtgatgagtcaaaccgccaacatgagaaggtcccggatgagcttctagaagaagcaaaggcagctgccaaagcagctcttgaagaaatggatgcagattaa

SEQ ID NO: 106133 - DNA, 177 bp, Glycine max
  Peptide Sequence Number=SeqID_222911
atgtggcagtatggttatgaggctgttatgaatgtgaagaaaagtcattgcatgcgggagaagtataattattggttaggtgttatacatggcagtatagggaattctgaggatgggattctgaatatgctaaaaccctggtttcaattgcagttgctgagatatgttttggtttaa

SEQ ID NO: 106134 - DNA, 468 bp, Glycine max
  Peptide Sequence Number=SeqID_222912
atggatggcgtgcagatggtaaatatgaatggaacctcccaaccaaattgggttgcaggggtgtggctgcaaaacacatcccctctcttattggagagattcgtcaaaggcatagtgttggcctttctgctctggtggaaaccaaaattggaggaaataaagctgagaagatttcctaaactcatcaaaggatttattagaagccgaagtatttacgactgcacttgtgtcacctcggaggaggctagtaatttgcttaataagagtgtttggcggcaactttgttttgaaagtgtatatccgcaaatccaattgggattatttgctgaaagtccttcagttaatggcaaacctgctggttactacttttgtaagaggggtgtgcgccaaggagatgccctctctcctctactcttttgtctcgtcaaggaagctcttagccaccaatgtcccaaggacatttattag

SEQ ID NO: 106135 - DNA, 1104 bp, Glycine max
  Peptide Sequence Number=SeqID_222913
atgcagcgtgttagattttcatctcagcaggcaccagtacacaagctaggagatcctcaaatgacattatctcctaagtttaggttagctgtgatccaatctgctttggcaaatccatcacctgagttagagctttctctcagagaagaacccttaattcctggtcttcctgatgatgttgctctcaattgtcttctccggcttccggttcagagtcactcatcttgtagagctgtgtgcaagaggtggcatatgctacttggtaacaaagagaggtttttcaccaataggaagcaatttggtttgaaagacccttggctttttgtatttgcttaccataagtgcactgggaagatccagtggcaggtgcttgacctcacacacttttcttggcacactatccctgcgatgccttgcaaggacaagatgcaaaataatagatggactgtgatgaataggatgatcactgctaggtcattttttgctagtggagtgattgatggtatgatttatgtagctgggggaaatagtaccgatctttatgagcttgattctgctgaggtgttggatcctttcaatgggagttggcaccctattgcctacatgggaacgaacatggcatcttatgatgctgcagtgctcaatgggaaacttctggttactgaaggatggttgtggcctttttatgtctcaccaagaggccaggtctatgatcctagaactaataactgggaaaatatggctgttggtctcagagaagggtggaccggttcaagtgtggttgtttacgggcacttatttgttgtttcggagctcgaaagaatgaagctaaaggtttatgaaccggaaaatgattcctgggaagccatagaagggcctcctttgcctgagcaaatatgcaagccttttgctgtgaatgcttgtgattgtcatatttatgttgtgggtcgaaatcttctggttgccgttggccatatcactagactgaacccaaaagaaagctgtaaggaaaaatggaacttcagtgttcgatggcatgtaattgatgcaccagaaagcttgtcagatctgactccttcaagctctcaggtgctgtttgcttag

SEQ ID NO: 106136 - DNA, 474 bp, Glycine max
  Peptide Sequence Number=SeqID_222914
atggagcatgccaatggaggggaagccggggagaacgaaagccaacacggaggagaagaagccagacgagaagaaacaaagggcgcggaggaagaagaagtcagatgggaagcaaatttgaaatggaagattgttgggtgcacggccaacggaggaagaagaaagcgcggaagaagaaaggcttttttaaaatatattatcttctattttttaaatgaagggacccttacagcttctaatgggccatattggttacagcccaatccaaataccttattacccgcattgcaaattattggtgcttttccaaacctctccatgtcatcctcaccaaccgtaaaacacgtgaagcaagaaagaacactatggtggcctagtgggcgatggttgttcatgaaaggaaacgatgatacacaaacactattggaaccgatgttgaagatcaccaacgatgtctttctaaagagtgtatga

SEQ ID NO: 106137 - DNA, 714 bp, Glycine max
  Peptide Sequence Number=SeqID_222915
atgaatacttcttcagctttcgataaagaaaatgctaaggggaaagagaaatgcaattgttgctcttattgtgacagagcatttgacaattatgaaggtcttgaagatcataaaaaaatgcatgaagctgagtttaagcgacttgtcaatcaaagcaatccttttcataattcaatggatatcaccaagcccatttttggttatggaaatgtctcaatgaaaactttgtatggaggtacaacaatcaatccttgtgtaacaaaaggaaattgttatggtgacaataacagaggagaccataattcattgttcatgacttcaagttattcttttacaagaaccaacaatgcatccttggtagcgtcacttccaaataaggagattgatccttgtgtaatgaaaggaaattgttatggtggtaatagccgaggagaccataattcattgttcatgccatcaaattattcttttacaagtagcaacaatgcatccttggtagcgccaattccaactaaggggattccttgtgtaacaaaaggaaattgttatggtggtaatagccaaggagatcgtaattcattgttcatacctccaaattattcttttacaagaaccaacaatgaatccttggtagcaacaattccaactaaagggaccattcctttttctcagtcacacaccaagtgcaagttctggtataagtcatcaatttga

SEQ ID NO: 106138 - DNA, 792 bp, Glycine max
  Peptide Sequence Number=SeqID_222916
atgaaggctgcggccgacaaacaccgccgcgacgtatccttcgaggtgggcgactgggtctacgtccggctccgaccgtaccgtcagacgtcgttagccccaacatactctaagctggccaaacggttttacggccccttccgcattacggcgagaattggtcccgtggcctatcggctcctattgccagcctcttcgcgcatccatcccgccttccacgtgtctcttttgaagccccaccaaggttcctttccggcttcaccagcaacgctaccagagcaatccactgacaacaatccccttattcatcctattgccattctcgattgcaaaatggattcttcatccactccgccggtaaggcgcgtattggtccagtgggacggtttgcccccggaggaggcatcttgggaatcctgggatgagttaagcgttctccacaaccttgcggacaaggtcgttttcgacgaagggggtgttgatagtaacacagcaacagatcaacacttggatacaggcaggcccaagagagagtgtatagaagaacacttatctttcagtattacacccttatctccctccagtagtttaggaccgtatcaactggtccgacctgccttcctcccctccgccatgccggagcaccacacacgtcaggtcaccacggataagctggaagaggcggttaaaaccctctcccaggataactctactctgaacaacaaaattgatactattcacgcgtcccttgccgccaagatcgaagcacttttcgatcgattcgccgcctaa

SEQ ID NO: 106139 - DNA, 279 bp, Glycine max
  Peptide Sequence Number=SeqID_222917
atgtctaatagatatcttgttttgcctcagatacttgtctacatggatatgcttggaagctggaatatcaaagcaaatgatcctggagagaatcttacaatatcaatttctgttcatcatcctgagcatggaaactattttactgccagtctgaaagccaaaaagctgtgctcatccccagagtcagatcatgcagttttcttttggttgatgcctcataaagttgcagtatggatatattggcatactatgataagttttctttggcaagcaatttaa

SEQ ID NO: 106140 - DNA, 195 bp, Glycine max
  Peptide Sequence Number=SeqID_222918
ggacctgtatttgcaataattggtgcttggctcatgtatcaaattcaaaacaagcatgttattgcaagtgatgcttcagagaacctgttccagaaggcagttattatgacagctcttattttcatattaagccactttggtccaattgacgaatggtattccatacattattcagagaacgcagtttactcatga

SEQ ID NO: 106141 - DNA, 1890 bp, Glycine max
  Peptide Sequence Number=SeqID_222919
atggggagaatgcagaagaggtgcagcagttgggtgattggacatgtccaaaatgtagaaacttttgcaactgcagtttttgccgccaaggcatctggtttcaagtcagtgtctgaaatgcttgtttcaaagactgctgaatctaatgatttggaattgaacaaggtgaataaggttttgctttcaaaggaaactactaaggaaaagaagcaaaaatgtgtaaataatttaagttctggtaaggttcctgtgagcacagctgtttcacctatgaagcaaattgcatcagagaaggagcttgtagtagttctctcaggagaaattgggaaggaaaattcttcagatggaaagcttgaccctgtgaccagtcagaagacatcaactaaaaaatctaagaaaacaaagcgtgaagaattaaaggaaatatctaatgagaacaatgttggtagtgctggcaaaaagaagagcctgaaaaggcctaaaatttgcaaagaagttccaagtgaggaagcgaaaggaaaagtaaatgatgacactaaagtttgcaatggagtctctaaaaagaaaaaagtagatagcaaccatgatactgctcatgtatcgatggacagtccagaggctcaggctgcaaatggtcttttattgtttgggaaagttgccaaaggcaaccctttctctgaggtgcaaacacaagtacatagaaatcatggcactgtttttggagatcctgcaaatgattccattggccctgctgtgactttggctccaaaacattatttattcaattctaaacatccagatatgaaacatatgcttggtgataattggaacaacactgtacttgtagatggtaatgctggtgccaagttccaagtaggaatagcaacgttcccaaatgttggcatgaatttagcgatgcaaaaaattgaagaggaaattcctttcccccctggaactgagttaacagaaatattggacattgagctcccacctgaagatattgggaacgcattgcagcttttagagttttgcagagtgtttggaaaggctcttgatctcaagaagggagaagctgatgccattttacgagaattagtacgtaaacaaaatttgcgtcgaggacaaaacaccttagtggttcaatttcaaattagagtgttgaccttgatactaactgattcaggaaatgagtctccatccttgactactagcaatggaaataattcatggttaaaaccactggaggatttaattactaaatctaatcatatactaaaagattttcctttggattggcttcaagaaggcgttagtggatattccaatttggatttatctaaaaagctcacactgttgaattttctttgtgatgaagctttagccactgataaactgaggagttgtattgaagataaaaattcaagacatgtagaagaagtaaaggaagcaaaaaccaggattgctgcagccaaggaaaaggaaaagggtcttaggcagaagttgcagaatgagacggttaaagctgttctgtcaaatgcgactcctcttaaaatggagaagcatgacgctcttcttaaaaagatgaaaagtgaagtggctcaagctcatgctgaggtactcgagttaaagggaacaattccaaaagtgaaacatagttctgatgctatgagaattgagcctgagtttttggacaacaatggtcaggtgttttggaacaaattttctaaaagaaagcaatatgcagatatcaaaattcaggatgaaactgctactgcaccttatgaaaaatggtttgtttatggtcctgaaaagaaggatgaggctgataagtacatttcctcaagggctaaaagacttagtcacaaggttgtttacatgctttcgcagtga

SEQ ID NO: 106142 - DNA, 1419 bp, Glycine max
  Peptide Sequence Number=SeqID_222920
atggtaatgcaagaggaggagttgttggggttgtttgaagttatgcatactcttgtggatgaccctgactgggcccaagcacaccctcaaccatgtactgacactccatggcctggaattgagtgtgaagttagtaatgaaccacaaatttttcatgtcacaaagatccacattggtcctgatatactctccccaccttgcaagtcttctgcttacctatctcagtccttgctcaaactcacttacttgaaaacactttcaattttcaactgttttgtttcttcaccagtcaacctaccctcaactctctttggtcctttctctaccttggaacacctggctttgcagtctaatccaacactctctggagaaatacctccaagtttgggtgctgttgctagtcttagagtcctgagcctgtcccagaacagcttccagggaagcattcctagacagattggtggtttggtttctttggagcaacttgatctgagttataataacttcagtggtcaaatccccaaggaaattggaggtttgaaaagtattgccattttggacctaagttggaatgaaattgaagggaaccttcctagctctcttggacaacatcaacttcttcagaagatggatttgagctcaaacatgcttactggaaaaatacctcctgatttaggaaacctcaagaggttagtcttgcttgatctgagtcataattgtattggtgggcctattcctgaagccctttcaaatttagaacttttagaatattttctcattgatgacaaccccatcaaatcagagataccccacttcatagggaaccttagcaagctcaagtcagtgagcttctcagggtgtggattgattggctccattcccaattctttctcctccttgaagaatctcacagctctctccctagataacaatagcctcagtggatcagttcctccaaagctagctttgctcccaaacttagatcaattgaacatcagccacaacatgctgaatggagttcttcagctccctgatgagttcattggaaaacttggtaaaaggttggatgtaagaggaaatacggaactttgcatcagtaataagccaaagaagaagaatttgtcttcatatttggaaatctcctcttgtgtgaacatgaagccaagaaatggcaaatcttatgctaaaggaccaccagaagatccagcaggaatcaagccatctttgtaccgaagcaacataagtaattcaagttcatcatcatcatggctagatctacaacctttagaaagagagagtggcaggaacgcagcactgtcggtgtctgatataaatgagcatgctgcaaccaccctagttgctgccaacacaaaaaagatgtacacctcagagcttgttttggtagagagaatcttgtaa

SEQ ID NO: 106143 - DNA, 480 bp, Glycine max
  Peptide Sequence Number=SeqID_222921
atgttggataaacaaggagttgtgggactggcgaaacctacagataggccagatcatgatgtcgatgatcccctatttctgatgacgttgaccatcccacaactttttctgaagccgttgcatatgactgagacaagtatgcgagcgggaaatgttgatgttgcacattggcaaatgatcatcattttgcctaaggaaaatgttgtcatctggttttgttcgttgcataatagaccagacaactacctcaaaggaataattaacaggtcagtgttgtttgtcaatacatttgcattagcattagtcaggaacatcaatatcttaattgtacaacaagcatccatatttgtattcaacggtgctttgaaaggacttaacgatactccacaaagtaaatccaaggttgctgctaggtggattgttgttaaatgtaatagacaaaaaggaagcactaagtgcggatattacgtcatgcactag

SEQ ID NO: 106144 - DNA, 1269 bp, Glycine max
  Peptide Sequence Number=SeqID_222922
atggtaatctatggcccaaatcagagacgcaacccagcatcagagaacacgtgtcctccaacctcgcgaaactcaacaaaaacaaaaattacggaaagcaacctctgtcatgccacttcgttgcatgcaaaaacgattatgaagacgccaaaacgccactcgccgccgccaaattcttccctgcgagtggagtctgattccggcgaaatcgtcacgaggttcaagaacggtcgccggagaagaattaaaatcaagcgaatgaaatacacttgccagacgaagatccgcgtcaggaatgacgccggcgccggcggcgtgtctcaacttctggcggtggattctgaaggagagaagagagagattcacgagaacgtggagatatcgctgtcgctggcttcgtcgtcgtcggaagaggaagagcgattgtcgtcgaagcaaaacgacggcgttttgtcgtacgggtcggcatcggtgatagggagcaggaaggagatggaggacgcggtgagtgaggagatagggtttgctgcgaagtgcgacttcttcgcggtgtacgacggccacggcggagctcaggtggcggaggcgtgcagggagaggctgtacaggctggtggcggaggagatggagaggagtgcgagtcacgtggaatgggactggcggggagtgatggaagggtgttttcggaaaatggactgcgaggttgccggcaatgcggctgtcaggacggtgggttccacggctgttgtcgccgtcgtcgcggcggcggaggttgtcgttgctaattgcggtgattgtagggccgtcctgggaagaggaggtgaggccgtggacttgtctagtgatcataagcccgacaggcccgatgagttgatacgaattgaagaggctggtggaagggtcattaactggaatggccagcgcgtgcttggtgttcttgccacttcacgatccataggagatcagtaccttcgaccttatgtaatatcaaaaccagaagtgacagtgaccaagcgaagcagcaaggatgaatttctcatactagcaagtgatggattgtgggatgtgatgtcaagtgaagttgcgtgccaagttgtaaggaaatgcttccacgggcagattaggagagtgtgcgatggagttgggaatcatcaaaaccgtgctaccgaggctgcaggcctcttggcagagatagcattggcaaagggaagtagagataacaccagtgtcattgtagttgagctaagaggatcagtaacaactgattga

SEQ ID NO: 106145 - DNA, 105 bp, Glycine max
  Peptide Sequence Number=SeqID_222923
atggcttacttctcaccttctgttgtattggattactgggaaaagcagtttatcagctttggcaagactacaaggctaagtatggcaccagttaagaggctatga
